United States Patent 10,760,091 (GENES AND USES FOR PLANT ENHANCEMENT) - sequence listing, part 14

SEQ ID NO: 58335 - protein, 456 aa, Pseudomonas aeruginosa PAO1
MNQRPGTALPSSPVSSFQRWRLQIFAITWLAYAAFYFTRKAFSVAKLGIAEDPGFQLDKMAMADLDAIYLAAYAVGQFTWGVLADRFGPRIVVFGGLLISALAALVMGTFATLPIFATCMVVQGLAQSTGWSGLCKNIGSFFATHERGRVLGLWSTCYAFGGLVASPFAGWWAYSVFGTWHAAFYFSAAVVGGVALLFLLLQRNRPEDVGHPPVEPQAASEAVRYAGFRPEGGNGGNGGSLQVLAKVVRNRTVLCLGLAYFLLKPARYAILLWGPVIVYERMPALGKVGAAIVPTAFEVAGLLGPILIGFASDKLFGARRMPACVISLLALTVCLALFVPAMTTGSIPIVVGLLFMMGLTLYGPDSMICGSAAIDFGTSEAAGTASGFVNGCGSVGAILGGLLPGYFDTYTVFIGFTIAALIATAVLLPHWNSRPGGARESLRNIPSLADFRPIRS

SEQ ID NO: 58336 - protein, 353 aa, uncultured bacterium
IGAANNLLAAMLDNHIQQGNALGINPKKITWKRCVDMNDRQLRFVVDGLGGSANGCPREDGFDITVASEIMAVFCLASSMADLKARLSRIIVAYTYDDKPVTAGDLKATGAMAALLRDALKPNLVQTLEGTPAFVHGGPFANIAHGCNSVMATRMAMRMGDYTVTEAGFGADLGAEKFLDIKCRMAGLTPDAVVIVGTVRALKMHGGLDKKQLANEDLAALEKGIPNLLRHVSNIRNVYQLPCVVAINRFPTDTDAEIDFIIRKCRELGVNTVLSTVWAEGGKGGEDLAREVVRLREEEKGNFTFSYELDASIEEKLEAVTKKIYGGAGVMLTPAAKKQAEKLTALGFDKMPV

SEQ ID NO: 58337 - protein, 348 aa, uncultured bacterium
NLLAAMLDNHIQQGNALGIDVKKITWKRCVDMNDRQLRFVVDGLGGKANGTPREDGFDITVASEIMAVFCLASSMKDLKERLGRIIVAYTYDDKPVTAGDLKATGAMAALLRDALKPNLVQTLEGTPAFVHGGPFANIAHGCNSVMATRMAMRMGDYTVTEAGFGADLGAEKFLDIKCRMAGLTPDAVVIVGTVRALKMHGGLDKKQLVNEDLAALEKGIPNLLRHVNNIKNVYQLPCVVAINRFPTDTDAEIDFIIRKCRELGVNTVLSTVWAEGGKGGEDLAREVVRLCEEEKGNFTFSYELDASIEEKLEAVTKKIYGGAGVSLTPNAKKQAERLTELGFDKMPV

SEQ ID NO: 58338 - protein, 353 aa, uncultured bacterium
IGAANNLLAAMLDNHIQQGNALGIDVKKITWKRCVDMNDRQLRFVVDGLGGKANGTPREDGFDITVASEIMAVFCLASSMKDLKERLARIIVAYTYDDKPVTAGDLKATGAMAALLRDALKPNLVQTLEGTPAFVHGGPFANIAHGCNSVMATRMAMRMGDYTVTEAGFGADLGAEKFLDIKCRMAGLTPDAVVIVGTVRALKMHGGLDKKQLVNEDLAALERGIPNLLRHVNNIKNVYQLPCVVAINRFPTDTDAEIDFIIRKCRELGVNTVLSTVWAEGGKGGEDLAREVVRLCEEEKGNFTFSYELDASIEEKLEAVTKKIYGGTGVSLTPNAKKQAERLTELGFDKMPV

SEQ ID NO: 58339 - protein, 193 aa, Brassica napus
MPLNFGNDVDGSSRILLNEPRGSTAQVLLFGGQVISWKNERREELLFMSSKAQYLPPKIIRGGIPVCFPQFGNFGGLERHGFARNRFWALDDDPSPLPAANKQSSVDLILKSTEDDLKIWPHSFELRVRISISLGKLTVIPRVRNIDSKPFSFMFALRNYLHVSDISEVRVEGLETLDYLDNLKGKERFTEQA

SEQ ID NO: 58340 - protein, 353 aa, uncultured bacterium
IGAANNLLAAMLDNHIQQGNALGIDVKKITWKRCVDMNDRQLRFVVDGLGGKANGTPREDGFDITVASEIMAVFCLASSMKDLKERLGRIIVAYTYDDKPVTAGDLKATGAMAALLRDALKPNLVQTLEGTPAFVHGGPFANIAHGCNSVMATRMAMRMGDYTVTEAGFGADLGAEKFLDIKCRMAGLTPDAVVIVGTVRALKMHGGLDKKQLVNEDLAALEKGIPNLLRHVNNIKNVYQLPCVVAINRFPTDTDAEIDFIIRKCRELGVNTVLSTVWAEGGKGGEDLAREVVRLCEEEKGNFTFSYELDASIEEKLEAVTKKIYGGAGVSPTPNAKKQAERLTELGFDKMPV

SEQ ID NO: 58341 - protein, 299 aa, Ustilago maydis 521
MPSQEEYEATLAEELEVLESIYIDELETVSSEHLRIRIEPEEDVLPLLFSIGLEPGQAPTESVEQGSRSPIVLSLDIQCTPEYPDAPPNMSIHVVRDTKGILGPQTDESEESGTESGTVERPSVAELQAELDEVAQDSLGMAMVFTLASHLRESVTTLIQRRVQEIEAAASAKREAEIEAEAEKFRGTAVTPERFAEWRLRFLQEMAEKEKKEEEAKMSKMSAKEREDYKKSKVKPSGKQLFEKGGTFEDDDAAEEGAQEVDWSLYTREQREKERREREEQEELQSRTDGLAFDDAEDE

SEQ ID NO: 58342 - protein, 375 aa, Candida albicans SC5314
MSIDPETRRKLLNLQKTGENKKCFDCSAPNPQWASPKFGIFICLECAGVHRGLGVHISFVRSITMDQFKPEETLRMEIGGNERLKKYFIDNGVDLNLSPKQKYDNYVAEDYKEMLTCEVEGKEFVAKDHSGEKLPDINNTASTTTDPVSRGRPTPVPLTNEQKQKNEAYFADLGAKNDQRPDHLPPSQGGKYGGFGNTPAPSNTTSNNNNNNNSNNNNNNSSLSSFTLDNFQNDPLGTFTKGWGLFSSTVVKSVQEVNNSVIKPSIDQIQSSKITGQAKTAMAQFGQKMQQTGKYGQETFQTFTKDINENGLNKTLDSTFGGIFGHNNNNNGSNQGNQVPNAFGFKKPDNGVKYESLSGGSKKNDDDDDDKWDDF

SEQ ID NO: 58343 - protein, 395 aa, Rickettsiella grylli
MYFTQLDDLGLKNKRVLIREDFNVPLDNGKITSDARIRAALPTIQYALKKGAAVILLSHLDRPPEGNMTPEFSLAPIAVRLGQLLGQPVRFITHWLDGFEITPGEVVLCENVRFQRGEKKNDPILAKKIAQLGDIFVMDAFATAHRVEASTVGAAQFSPQVCAGFLLTSELNALSVGLENPSRPLLAIVGGSKVSTKLTLLSSLLNKVNFLMLGGGIANTFLVAQGYFIGRSLYEPAQVHRAKRLLDLSKTLHVKIILPTDVIVANEISNHAKTAIRKVTHIKNEEMILDIGPESMKQYTDYVNRSASILWNGPLGAFEWTPFQQGTRCVSEAIANSPAFSIAGGGDTLAAIEKYGVAHKLSYISTGGGAFLEFLEGKTLPILTILHKRQKEKQR

SEQ ID NO: 58344 - protein, 573 aa, Coccidioides immitis RS
MPFRSRWSIPIPNTSLPSLIFKSPQHPHSDTRKCYVDTTRPDTHFFTVHGYFLWCKRLAAGLRKSGLKSGDRVLLFSANTFMYPVAFMGIVMAGCVFTGANPTYTPRELAYQLSDSGATYLLCAESALDTGIAAAEQSGLARDRIFVFNDLVYEGTGEGTKGCRYWGELFASTKEGERFSWEELSTPEAADRTLALNYSSGTTGVPKGVQITHKNYVANTLQFTNSTYLDKDHAEKLKRTRWMCFLPMYHAMAQNIFIAAALILGVPVYLMPRFDFIQMLENTQKFRISNLILVPPIAVALAKHPAVKNYDLSSLEQIGCGAAPLGREISEELEGLFPKGKLFVRQGWGMTETTCSILGWDPNQKGTSASVGELNPNCEAKIMAEDGVTELGRNQQGEIWVRGPNIMKGYWNKPEATKETLTEDRWLKTGDIGYVDDAGKFYILDRKKELIKVKGNQVAPAELEAILLDHSAVADAAVIGVTKRTDASHWCKRDNEEYPRAYIILKPGSPTTVETAQNIVDYMKDKVAPVKRITGGIVFVDTIPKNPSGKILRRELRDRARSEIKAGLASSKL

SEQ ID NO: 58345 - protein, 466 aa, Glycine max
EKRKEGKMELFFYAVFGGLGAVVAVTELSKSNKDRINTSSAFNSFKNNYLIVYSLMMAGDWLQGPYVYYLYSTYGYGKGDIGQLFIAGFGSSMLFGTIVGSLADKQGRKRACVTYCITYILSCITKHSPHYKVLMLGRILGGIATSLLFSAFESWLVAEHFKRGFDQQWLSLTFSKAIFLGNGLVAILSGLFGNVLVDTLALGPVAPFDAASCFLAIGMAIILSSWSENFGDPSENKDLLTQFRGAAVAIASDEKIALLGAIQSLFEGSMYTFVFLWTPALSPNDEEIPHGFIFATFMLASMLGSSLASRLMSRSSLRVESYMQIVFAVSSAALMLPILTTFLVVPSGVKGGSISFSGCIQLLGFCAFESCVGIFWPSIMKMRSQYIPEEARSTIMNFFRIPLNIFVCVVLYNVDAFPITVMFGMCSIFLLVACILQRRLMVISDKPKTEDWQMKDRDAESEPLNI

SEQ ID NO: 58346 - protein, 428 aa, Pseudomonas aeruginosa PAO1
MADKKAQLIIEGSAPVELPVLSGTMGPDVVDVRGLTATGHFTFDPGFMSTASCESKITYIDGDKGVLLHRGYPIEQLAEKSDYLETCYLLLNGELPTAAQKEQFVGTIKNHTMVHEQLKTFFNGFRRDAHPMAVMCGVIGALSAFYHDSLDINNPKHREVSAHRLIAKMPTIAAMVYKYSKGEPMMYPRNDLNYAENFLHMMFNTPCETKPISPVLAKAMDRIFILHADHEQNASTSTVRLAGSSGANPFACIASGIAALWGPAHGGANEAVLRMLDEIGDVSNIDKFVEKAKDKNDPFKLMGFGHRVYKNFDPRAKVMKQTCDEVLQELGINDPQLELAMKLEEIARHDPYFVERNLYPNVDFYSGIILKAIGIPTSMFTVIFALARTVGWISHWQEMLSGPYKIGRPRQLYTGHTQRDFTALKDRG

SEQ ID NO: 58347 - protein, 213 aa, Brassica napus
HLYRMDYMNFVQKHIESNADITVSCLPMDESRASDYGLLKIDESGQIVQFSEKPKGDDLKAMQVDTTVLGLPPKEAAELPYIASMGVYVFRKEVLLNLLRSSYPTSNDFGSEIIPLAVKEHNVQAFLFNDYWEDIGTIGSFFDANLALTEQPPKLQFYDPKTPFFTSPRFLPPTKVDKCRILDSIVSHGCFLRECSVQHSIVGIRSRVESGVE

SEQ ID NO: 58348 - protein, 752 aa, Gibberella zeae PH-1
MSTRRRAAAKAPVDPPLDGCAIAVSGKFDDIGHSHASLETLIRRHGGTFTRSVTKATTHVVSTDDDFNSGSNKVTTAQAKGLPIMNPSWLLDTDSAGTKQNPDDYHWSSSKTNSTAKSTANGASKKRSPPTDDDEDSQPRSKRARSTSVAPSSKAKPKATKKGAKAKLDVAAESEEEEEEEEKPKTKAKPKAPVKKGTKGKAAVKAEPEPEPESEPEDVKEEKMVAEGQFIKKKDIAIPLDEHCTLPNYQVWVDPDSGLIYDASLNQTNAGNNNNKFYRIQVLKDPKAATFKTWTRWGRVGEPGQKAILGNGSLDDAVKVFQKKFKDKSGLAWDNRGADPRPGKYAFVERSYNPDSDSESDDEDDKAVKKENGEDEDEAPEPECKLEKPVKELMELIFNQQYFQQAMTSLNYDANKLPLGKLSKATITRGFQQLKNLAALFDNPNLASTEYNMSVAQAIEQLSNTFYSVIPHAFGRNRPPVINTNQMLKKEIELLESLSDMKDAAEIMKVDRKTRDTIHPLDRQFAGLGMEEMTPLEHNSNEFTRLKDYLNESRGATHNMTYDVKDIFRIEREGEFKRFDDSKFSKMSSDRRLLWHGSRATNFGGILSQGLRIAPPEAPSTGYMFGKGIYLADMSSKSAGYCCAYNSGGEALLLLCEAELGDPIQKLTGASYDAGTTAKNQGMHSTWGQGRTGPSSWIDAEVVHENLKGIKMPDPNIKPGNTNVANAGLYYNEYICYDVAQVKLRYLLRVKI

SEQ ID NO: 58349 - protein, 200 aa, Thermoplasma acidophilum DSM 1728
MLKIYVVDNGGQWTHREWRVLRELGVDTKIVPNDIDSSELDGLDGLVLSGGAPNIDEELDKLGSVGKYIDDHNYPILGICVGAQFIALHFGASVVKAKHPEFGKTKVSVMHSENIFGGLPSEITVWENHNDEIINLPDDFTLAASSATCQVQGFYHKTRPIYATQFHPEVEHTQYGRDIFRNFIGICASYREIQKENFQH

SEQ ID NO: 58350 - protein, 367 aa, Thermoplasma acidophilum DSM 1728
MAEWTEVNFGPQHPSMHGVLRLRVKLDGEIVKEVEPIIGYLHRNAEKIGELQFYCDNMIYFDRMDYVAAMNMEVGYLEAAEKLLDIEVPERAQWIRVMMAELNRIASHLVWLGAFGLDLGMLTPFFYCFKEREKILKIFTEVSGSRQQLNYMSIGGVYQDVTDEALDHIKTFIREFPKELNKIESLFVKNDVFISRTKGIGILSKEMAIDYGVTGPMLRASGVEYDVRKAQPYLVYDKVNFDIPVSFKGDNLARFLVRVEEMRQSVKIVEQTIQKLPAGPYFNQKAKKPLMIRLRGQGEVYARTESPKGEFGVYLIGDGSLRPYRVRVRSPTFKNLSVLPALAKDQMIADLISIGGSIDLVFGEVDR

SEQ ID NO: 58351 - protein, 569 aa, Clarkia epilobioides
MASPALISETEAWKDLKAHLEGIKMTHLRELMGDTERCQSMMVEFDNIFLDYSRQQASPDTISKLYKLADAAHLKQKIDRMYNGDHINTTENRSVLHVALRAPRNSSICSDGKNVVPDVWNVLDKIKDFSDRVRNGSWIGATGKELKDVIAVGIGGSFLGPLFVHTALQTDPEASKNARGRELRFLANVDPIDVARNISGLNPETTLVVVVSKTFTTAETMLNARTLREWISSALGPSAVAKHMVAVSTNLPLVEKFGIDPNNAFAFWDWVGGRYSVCSAVGVLPLSLQYGFAVVEKFLQGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEELKKENVSEHLIPHKTFTGNRPSLSILLPTLDAYRIGQLLAIYEHRVAVQGFVWGINSFDQWGVELGKSLATQVRKQLHASRVKGEPVEEGFNFSTKTLLTRYLQATSDVPADPSTLLPNI

SEQ ID NO: 58352 - protein, 569 aa, Clarkia epilobioides
MATPALISETEAWKDLKAHLEGIKRTHLRELMGDTERSQSMMVEFDNIFLDYSRQQASPDTINKLYKLAEAAHLKQKIDRMNNGDHINSTENRSVLHVALRAPRNSVICSDGKNVVPDVWNVLDKIKDFSERVRNGSWVGATGKELKDVIAVGIGGSFLGPLFVHTALQTDPEASKNARGRELRFLANVDPIDAARNISGLNPETTLVVVVSKTFTTAETMLNARTLREWISSALGVSAVAKHMVAVSTNLPLVEKFGIDPNNAFAFWDWVGGRYSVCSAVGVLPLSLQYSFAVVEKFLQGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEQLKKENVSEHLIPHKTFTGNRPSLSILLPTLDAYRIGQLLGIYEHRVAVQGFVWGINSFDQWGVELGKSLATQVRKQLHASRVKGEPVEEGFNFSTKTLLTRYLQATSDVPADPSTLLPNI

SEQ ID NO: 58353 - protein, 336 aa, Legionella pneumophila str. Paris
MSYEELSNTMEQMLHEGKGILAADESNSTIGKRFASINTENTEENRRDYRLLLATTPDLEQYINGVILFEETFTQTDEHGTPIPELFANKGIIPGIKVDKGLVDLANTEHEKVTQGLDGLTERLLHFKKLGAKFAKWRNVYSISEYTPSLTAIKTGAENLGRYAAACQSVGIVPIVEPEVLMDGNHSIEHCAEVCEMVLHELFHTLFIHQVELEHIILKPSMVTCGKEVTPFSDPEEVADYTISVFRNNVPASVPTINFLSGGQTPQQATANLNAINQIGHQPWLLSFSFGRALQEDCLKEWCGNKANITKAQEALIKRARLNSMACLGEYQNDME

SEQ ID NO: 58354 - protein, 476 aa, Clarkia delicata
MATPALISETEAWKDLKAHLEGIKRTHLRELMGDTERSQSMMVEFDNIFLDYSRQQASPDTINKLYKLAEAAHLKQKIDRMNNGDHINSTENRSVLHVALRAPRNSVICSDGKNVVPDVWNVLDKIKDFSERVRNGSWVGATGKELKDVIAVGIGGSFLGPLFVHTALQTDPEASKNARGRELRFLANVDPIDAARNISGLNPETTLVVVVSKTFTTAETMLNARTLREWISSALGVSAVAKHMVAVSTNLPLVEKFGIDPNNAFAFWDWVGGRYSVCSAVGVLPLSLQYSFAVVEKFLQGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEQLKKENVSEHLIPHKLLGIYEHRVAVQG

SEQ ID NO: 58355 - protein, 633 aa, Phalaenopsis hybrid cultivar
MEGCDCIEPQWPADELLVKYQYISDFFIALAYFSIPLELIYFVKKSSFFPYRWVLIQFGAFIVLCGATHLINLWTFTMHSRTLAIVMTVAKVSTAVVSCATALMLVHIIPDLLSVKTRELFLRNKAEELDKEMGLIRTQEETGRHVRMLTHEIRSTLDRHTILRTTLVELGRTLDLAECALWMPSRTGLNLQLSHTLNNQIPVGSVVSINLPVVNQVFNSSRAVRIPHTCQLARFQPHTGRYVPPEVVAVRVPLLHLSNFQINDWPELSAKNFAVMVLMLPSDSARKWHVYELELVEVVADQVAVALSHAAILEESMRARDQLMDQNVALDLARREAEMAIRARNDFLAVMNHEMRTPMHAIIALSSLLLETELTPEQRLMVETILKSSNLLATLINDVLDLSKLEDGSFELEVTVFNLHTVFREVVNLIKPIAAVKKLSLIVSLSPDLPSCAVGDEKRLMQTMLNVVGNAVKFTKEGSISITASIAKPDSLRDPRDPEFYPIPSDGHFYLRVQIKDTGCGISPQELPHLFTKFAHAQNGSDKGYNGSGLGLAICKRFVNLMKGHIWLESEVLGKGCTTIFIVKVGISEDPAHRYQHKLLPPIRAGQSEADAFGSKRTPTDLIPLKNRYQRSL

SEQ ID NO: 58356 - protein, 314 aa, Nicotiana benthamiana
MVAPTRGRGSGGFRGGRGDGGGRGGRGGRGGFGGGRGGGGSAMKRGGGRGGGGRGGGGRGGGRGGRGGGFKGGNKVVVEPHRHGGVFIAKGKEDALCTKNLVPGEAVYNEKRISVQNEDGTKVEYRVWNPFRSKLAAAVLGGVDDIWIKPGAKVLYLGAASGTTVSHVSDLVGPGGVVYAVEFSHRSGRDLVNMAKKRTNVIPIIEDARHPAKYRMLVGMVDVIFSDVAQPDQARILALNASYFLKAGGHFVMSIKANCIDSTVPAEAVFAQEVKKLQAEQFKPMEQVTLEPFERDHACVVGAYRVPKKQKAAA

SEQ ID NO: 58357 - protein, 418 aa, uncultured bacterium 159
MTKHPLLNEVQDGARLKNISEEYGTPLYTYFGEIICNNLDRIDTALRANFDKYQIYFAVKSNNNPNLLAFMHQYLPTLGADCSSPGELVVAERAEIPMKNCVYTGNYESMDDLQSAVNSGCEINLDDETSFIRLKNIGIPEYISFRLNPGVGKGRFAEIVTGGREAKFGIPVEKIAAVYKSALADGVKTFGLQCHSGSAILDQNHFRENTELILKTARHIEDAIDHRLLKISIGSGFGIPYADDEDPLNFNDVFGLVAEIFKEFYGQHQHDWPVLCIEPGRALVGDAAILLAQVTGIKDSYKTFIGLDAGMETLMRPALYGAVHRIYKVGALMEEQNLTVDITGRICENTDRLAIDIPFPDVAEGDLIAIMDTGAYGYAMAHQFNTRPRPAEVLIDKDKPHLIRSRETVEDIFRKCDT

SEQ ID NO: 58358 - protein, 329 aa, Pisum sativum
MTITRFVLNEQSKRPESRGDFTILLSHIVLGCKFVCSAVNKAGLAKLIGLAGETNIQGEEQKKLDVLSNDVFIKALISSGRTCILVSEEDEEATFVEPSLRGKYCVVFDPLDGSSNIDCGVSIGTIFGIYMVKDNHAPTLDDVLQPGKNMLAAGYCMYGSSCTLVLSTGSGVNGFTLDPSLGEFILTHPDIKIPKKGKIYSVNEGNAKNWDGPTTKYVEKCKFPTDGSSPKSLRYIGSMVADVHRTLLYGGIFLYPADKKSPNGKLRVLYEVFPMSFLMEQAGGQSFTGKQRALDLIPTKIHERSPIFLGSYDDVEEIKALYAAEQKNA

SEQ ID NO: 58359 - protein, 464 aa, Oryza sativa (japonica cultivar-group)
MELGVPLPRRPVPGSYGVPFVSAVRDRLDFYYLQGQDKYFESRAERYGSTVVRINVPPGPFMARDPRVVALLDAKSFPVLFDVAKVEKRDVFTGTFMPSTSLTGGYRVCAYLDPSEPNHAKIKQLLLSLLVSRKDAFVPVFRSNFGALLDTVESQLASGGGKSDFTALNDATSFEFIGEAYFGVRPSASSSLGTGGPTKAALWLLWQLAPLTTLGLPMIIEDPLLQTLPLPPFLISSDYKALYAYFAAAASQALDAAEGLGLSREEACHNLLFATILSRVAQAGEKLHERLAAEIRSAVADAGGNVTLAALEKMELTRSVVWEALRLDPPVRFQYGRAKADLEIESHDASFAIKKGEMLFGYQPCATRDPRVFGATAREFVGDRFVGEEGRKLLQYVYWSNGRETENPSVDNKQCPGKNLVVLVGRLLLVELFLRYDTFTAEAGKKVVITGVTKASTSAVNRTA

SEQ ID NO: 58360 - protein, 171 aa, Oryza sativa (japonica cultivar-group)
MGDDGGGDGGASSAGFSYFAVFHNYPLVAALLGFAVAQSIKFFVTRYKENRWDPKQLIGSGGMPSSHSATVTALAVAIGFQDGFGCALFATAAIFASVVMYDASGIRLHAGKQAEVLNQIVCELPSEHPLSETRPLRELLGHTPTQVVAGALLGSMLATAGQMFLVVSGSV

SEQ ID NO: 58361 - protein, 82 aa, Saccharomyces cerevisiae
MVNNSQHPYIKDGWFREINDKSFPGQAFTMTVDSILYEARSEFQDILIFRNKVYGTVLVLDGIVQCTEFDEFAYQEMITHIA

SEQ ID NO: 58362 - protein, 245 aa, Oryza sativa (japonica cultivar-group)
MEDDIDAGIRAASQANAQAKLDEFRKKTSGGKDADEGSDDEDEDDEEDSDDSSDSDIDPELERIIAERERAKSGRKHSRDEEKKTSRHRSSSRGRSKHRRSTKRSDTEDDLEEERSKDKKKKSRRKRHERSDEDSESDSDKKRHRKSRKDRKRRRSHRRSDDTSDEDESGGEDRRRRRHRKRQHHHRKGASDGDSGSGASDSADDRKRSSRRRRHRKSESSGSDGDERHGQGAKRSKEKRGKEEC

SEQ ID NO: 58363 - protein, 1064 aa, Rickettsiella grylli
MKKKPIKFRKILILGSGGLRIGQAGEFDYSGSQAIKALKEEKITSVLINPNIATVQTDPHLANKIYLQPLNLDTVQRIISKEKPDGILLGFGGQTALNLGLDLEEKGLLKKYKVTVLGTSVLSIRRTEDRDLFKAVLEQINIKTPLSFAVRTVSEALQAAEKIGYPIMLRSGFSLGGLGSGKITHREMLEHRAQESLASAPQILIEEYLFGWKEFEYEIVRDQEGNALTICNMENMDPMGIHTGESIVVAPAQTLNNDQHQHLRTMALQVAEHFNIIGECNIQFAINPKNGDYRVIEMNARLSRSSALASKATGYPLAFIATKLALGYRLCEIKNSVTQVTSAFFEPALDYIVVKIPRWDTHKLKAAERTIGTEMKSVGEVMAIGRSFSEALQKAVGMLNKGVTCLMDYPEKIDNPRQEIQCATDRRLFALYQFFKRGGSISQAERLSQINFWFLAQIHQLTELEKKLNVNKLDKNLFRQLKQAGFSDRFIAKAKKKSIKQIRALRLNYGIIPFVKQIDTLAGEFIAHTNYLYLSYHAIEHDISPAKRRPIIVLGSGPYSIGSSVEFDWCAVNTAHTLRRLNETTVIINSNPETVSTDYDESDRLYFEQLTFERVQDILEFESAKGIIVSVGGQIANNLAVPLAKAGYQLLGTDPRFIDQAENREKFSALLTKLNIDQPAWESITNLRKAKIFSAKVGYPVLIRPSYILSGSAMNVVFDPESLEHHLQAAAHVSHDHPVVVSKFVQEAKELEIDGVAKQGEIVIEAISEHIENAGVHSGDATVVLPPQKLYLETIRRTKKIARKIVKALHITGPFNIQFIAKNNAIQVIECNLRASRSFPFVSKVTGHNFIHIATEVMLNKHQPKQYETLELDYVGVKAAQFSYNRLKGSNPVAQVEMASTGEVACIAENLIEAFYKAWLATDQNVTEKKILLSISDNYKLKLLPWIRHLDDHDWLIYSTEGTHRFLSQHGIASYFVNKTSEIKKPNIRDLISQRRIATIINIPSSMTGLQQTDGFLIRRLAIDHHVPLITNAQIALIVLQCLVHLWNKRLPIESWQNLVLKKE

SEQ ID NO: 58364 - protein, 409 aa, Pseudomonas aeruginosa PAO1
MAIEIKAPTFPESVADGTVATWHKKPGEAVKRDELIVDIETDKVVIEVLAEADGVLAEIIKNEGDTVLSNELLGKLNEGGAAAPAAPAAAAPAAAPAAQAAAPAAAGGDDAILSPAARKLAEEAGIDPNSIAGTGKGGRVTKEDVVAAVEAKKNAPAAPAKPAAPAAEAPIFAAGDRVEKRVPMTRLRAKVAERLVEAQSAMAMLTTFNEVNMKPIMDLRSKYKDLFEKKHNGVRLGFMSFFVKAATEALKRFPGVNASIDGNDIVYHGYQDIGVAVSSDRGLVVPVLRNAEFMSLAEIEGGIANFGKKAKEGKLTIEDMTGGTFTISNGGVFGSLLSTPIVNPPQTAILGMHKIQERPMAVNGQVVILPMMYLALSYDHRLIDGKEAVSFLVAIKDLLEDPARLLLDV

SEQ ID NO: 58365 - protein, 478 aa, Pseudomonas aeruginosa PAO1
MSQKFDVVVIGAGPGGYVAAIRAAQLGLKTACIEKYIGKEGKVALGGTCLNVGCIPSKALLDSSYKYHEAKEAFKVHGIEAKGVTIDVPAMVARKANIVKNLTGGIATLFKANGVTSFEGHGKLLANKQVEVTGLDGKTQVLEAENVIIASGSRPVEIPPAPLTDDIIVDSTGALEFQAVPKKLGVIGAGVIGLELGSVWARLGAEVTVLEALDKFLPAADEQIAKEALKVLTKQGLNIRLGARVTASEVKKKQVTVTFTDANGEQKETFDKLIVAVGRRPVTTDLLAADSGVTLDERGFIYVDDHCKTSVPGVFAIGDVVRGAMLAHKASEEGVMVAERIAGHKAQMNYDLIPSVIYTHPEIAWVGKTEQTLKAEGVEVNVGTFPFAASGRAMAANDTTGLVKVIADAKTDRVLGVHVIGPSAAELVQQGAIGMEFGTSAEDLGMMVFSHPTLSEALHEAALAVNGHAIHIANRKKR

SEQ ID NO: 58366 - protein, 156 aa, Capsicum annuum
MSAPKKILLKSSDGETFEVDEAVALESQTIKHMIEDDCANTSIPLPNVTSKILSKVVEYCKKHVDAGAKTEDKASEDDLKSFDSEFVKVDQGTLFDLILAANYLNIKSLLDLTCQTVADMIKGKTPEEIRKTFNIKNDFTPEEEEEVRRENAWAFE

SEQ ID NO: 58367 - protein, 204 aa, Staphylococcus aureus subsp. aureus Mu50
MANPIKIGIGGPVGAGKTQLIEKVVKRLSKEMSIGVITNDIYTKEDEKILVNSGVLPESRIIGVETGGCPHTAIREDASMNFAAIDELLERHDDIELIFIESGGDNLAATFSPELVDFSIYIIDVAQGEKIPRKGGQGMIKSDFFVINKTDLAPYVGASLEQMAEDTKVFRGKRPFTFTNLKTDEGLDEVIDWIERDTLLKGLS

SEQ ID NO: 58368 - protein, 500 aa, Oryza sativa (japonica cultivar-group)
MALPLLRLLLLLVLSSVPLSCQLAHSTAADTQNWGQTSVVHLRNAHTRKLLGLLDDISGRTGSLHALLLEESPKQAPPHHHNRHGGHHRAAHTPAPSPAPSPSPFTAPPKSASPAAITIPISPSTPQPKAESNPAVEDAPAQPRHSWRNYGLVTAGSAVFLVMTIASVIYCRAKKVGTVRPWATGLSGQLQRAFVTGVPSLKRSELEAACEDFSNIIGSTSSCMLYKGTLSSGVEIAVLTSSTESGKEWSKECESQYRKKITNLSKVSHKNFMNLLGYCEEENLFTRAMVFEYAPNGTLFEYLHVREAENLDWMARVRISMGIAYCLEHMHQLNPPVVPRNFNSTTIYLTDDFAAKVSDLDFWNDSKGSFNSATSDETVMVEIDSMVHQYGIILLEILTGRVPYSESDGPLEHWASGYFEGKMTLAELIDPSLGSFPEDAARALCDVARWCIEPEPSKRPLMSQVAGRMKEITSLGPEGATPKVSPLWWAELEIMSGQAT

SEQ ID NO: 58369 - protein, 540 aa, uncultured proteobacterium
MSSIMNIDPELQSLANQIATRRVTECFEGDANRASDFRCTSNGLVLDYSKHHIDAPSRQRLLEIAQQSALAADFEALTRGDAINITEERAALHTLLRGTRKEESPELYAEVHATNSKLAQLVAKIHSGAWSGFGANRFTDVVNIGIGGSDFGPKMVCRALRTETDLMKSHFVANVDPQDLDETLASLDPQSTLFIICSKSFTTEETLTNALRARAWLLAAGAKDTDVNKHMVAVTTNLEGASRFGISPENCFPMWDWVGGRYSLWSAVGLSIALQSGWETFLRLLTGAHEMDIHTLGSHDKNNLPLMMALLEFWNTVYLKTDTHVVLPYAQALEKLPDFLQQLSMESNGKRVDLSGSALTLPSAPVLWGSAGTIGQHSYYQLLHQGNRRFTADIILPLSHKEKDLDAQRKLAANALAQSRALLVGRDKSAAQRLAAERGQPESFAPHYEMPGNHSHSLIYFESLTPEILGALIAAYEHKTFFLSRLLGINAFDQWGVELGKVIGRQILTMLEHGEGLEVIDPATAIVVEAWRAANAKNTS

SEQ ID NO: 58370 - protein, 345 aa, uncultured proteobacterium
MPTPISLTKRRESRSPEVETKWHLLGDIGGTNARFGICDDQKDPYQLIGSYEVAAFPTFSNVLEQLQSDLIKAGLSMADAGESCLAVAGPPDVQPVSFTNSAWRFDRELVMSTLGLQSVSIINDFAAAARALPLLSENHLEKVGGGRAEPGSPCVALGPGTGLGVATLATTHSGEPLVISGEGGHVDFAPVTNVEAAVLDFLRARYGRVSIERLCCGEGINNIYQALADYRNLKIKYSSAAEIGAAALSADDALSKETMAMFFAVLGAAAGNFALTLGAKGGIYIAGGIVPRYLDLLRRSDFRARFLAKGRFADYLSDIPTFVVTHSQLGLLGASASLNDPHIRG

SEQ ID NO: 58371 - protein, 366 aa, Daucus carota
MASVMNLSITHFCSSHLKQKSPNKLVFHGLNSNPNFSKSKPPQNVIPYSSLSISSVQTTKIVMDSSPTPSTFDFKSYMLEKAISVNKALDASVSLQEPVKIHESMRYSLLAGGKRVRPLLSIAACELFGGHEAVAMPSACAVEMIHTMSLMHDDLPFMDNDDLRRGKPTNHKVYGESVAVLAGDAMLALAAFHLVATETRGVSSDQVVRVIVELAKAIGAEGLVAGQIVDVCSEGDPNLGLEDLEFIHRSKTAALLEGSVVMGAILGGANDEEVEKVRKYARCIGLLFQVVDDILDVTKSSKELGKTAGKDLVADKTTYPKLIGIEKSREFSDELKREAIDQLAGFNSDKTAPLIAMANYIANRDN

SEQ ID NO: 58372 - protein, 386 aa, Coprinopsis cinerea okayama7#130
MSGKVYVPIPPRPAGYFQTNPRADLTEDERSMYEEVLAHFTKDSYVLPNEEKGELTEKEKFWLSRECLLRYLRASKWKVATAIQRLESTLKWRREFGIYDLTAEYVEPEAVTGKEIIFGYDVKGRPAFYMIPSRQNTDGVERQNQFAVWMLERGIDCMPPGVETLDLLINFAQRAKHPNFSQARTILSIIQDHYPERLGMALLLNMPFLVTAFLKLIFPFVDPVTREKVKLNPSPIEDGLFEQDMIMSEYWGGSQDFEYVHEKYWPEFVKTSTENAARWTAKWKELGGKIGISEWDYKGGPSSEKEEVDGAVSTSVAVETGEKDEQKPSTEPAQKDSKKDEEQAPPQATPAAGGAVTTAGGGAIAAGAVAGSGGDASAAGGDAGGE

SEQ ID NO: 58373 - protein, 1060 aa, Methanothermobacter thermautotrophicus str. Delta H
MPRDESINKVLIIGSGPIQIGQAAEFDYSGSQACKSLREEGIETVLVNSNPATIQTDMEMADRVYVEPLTPEIVAKIIQKEKPDAVLPTMGGQTGLNVATGLAEMGALEGVRVIGSSIETIRNVEDRDLFDSFMKKLNEPVPAARAVSSVEEALEAVEEIGYPVIVRPAFTLGGTGGGVAHSRDELIEIATRGLEMSFINQVLIDQSVLGWKEFEYEVMRDRNDTCIIVLCNMENIDPMGIHTGESVVVAPAQTLSDEDNQRLRDAAIKIIRALKIEGGCNIQFAVHPETGEYKVIEVNPRVSRSSALASKATGYPIAKIAAKIAVGMTLDEIQNDITKETPASFEPTIDYVVTKIPRWPFDKFKGISREIGVQMKSTGEVMAIGRTLEESLNKAIRSLDIGADGFTETPYTRADLENPTDQRLFQVYTALRDGMSIEEIHGLTQIDPFFLQKISNIAEFESSITRESLEDPRILLKAKRMGFSDSRLASLTGMDESSIRALRLENNIKPVYKMVDTCAAEFEARTPYYYGCYDLEDEVEVSDRRKVLIIGSGPIRIGQGIEFDYCCVHAAMALTEDGYETIMVNNNPETVSTDYDISDKLYFEPLTLEDVLAIIEKEKPEGVVVQFGGQTSINLAVPLAEAGVRILGTPHESIDRVEDRERFTEVLNKLGIPQAPYGIAKSFEDARAVAERIGYPVLVRPSYVLGGRAMEIVYDDVELEEYMREAVRVSPEHPILVDKFLEDAIEVDVDALCDGTDVYIGGIMEHIEEAGVHSGDSACVIPPQSIPEDIIDTIKEYTRKLALELEVVGLINIQYAVKPDSDPSVYILEANPRASRTVPFVSKATGVPLAKMAARLMMGAKLRDLGLTEEKDIEHVAVKESVFPFIKLPGADSVLGPEMKSTGEAMGIDENFGIAYYKSQLSASMDLLNEGKVFISVRDQDKDKIADIVKKADELGFRIMATRGTARAVSDIADIEVVRKVSQGSPNIRDAILDGEVGLIINTPSGKQSADDGYLIRRMAVELGIPYVTTLAGARAALNAIEAVRMGKITVKSLDEYHGM

SEQ ID NO: 58374 - protein, 367 aa, Daucus carota
MAFIQTNTAHENSLLSKNLLFDHLKNTGKTPSSYCTRHHPMKIQGANAVNSTLVQSVNVQELLTNPRVTPGPEFHFEGYMKTSGKKINKALDEAVPVQKPAIIHEAMRYSLLAGGKRVRPVLCIASCELVGGLESWAMPMACALEMIHTMSLIHDDLPCMDNDDLRRGKPTNHKVYGEETAILAGDALLSLAFEHVADATDMVTPGRVVRAIAELGSAVGSQGLVAGQIMDICNQGKDVDLNDLEYIHVHKTSKLLEASVVCGAILGGGNVIEVERLRKYARCIGLLFQVVDDILDVTKSSAELGKTAGKDLVTDKTTYPKLMGLERAKRFATELVAQAEEELSYFGSSARVAPLYHLAKYIAYRQN

SEQ ID NO: 58375 - protein, 1064 aa, Lactococcus lactis subsp. cremoris
MPKRNDIKKIMIIGSGPIIIGQAAEFDYAGTEACLALKEEGYEVVLVNSNPATIMTDREIADTVYIEPITLEFVSKILRKERPDALLPTLGGQTGLNMAMELSKTGILEELNVELLGTKLSAIDQAEDRELFKELCESINEPLCASDIATTVEEAINIADKIGYPIIVGPAFTMGGTGGGICDTEEELREIVANGLKLSPVTQCLIEESIAGYKEIEYEVMRDSADNAIVVCNMENFDPVGVHTGDSIVFAPSQTLSDNEYQMLRDASLNIIRALKIEGGCNVQLALDPNSYEYRVIEVNPRVSRSSALASKATGYPIAKMSAKIAIGMTLDEIINPVTNKTYAMFEPALDYVVAKIARFPFDKFENGDRHLGTQMKATGEVMAIGRNIEESLLKAVRSLEIGVFHNEMTEAIEADDEKLYEKMVKTQDDRLFYVSEAIRRGIPIEEIADLTKIDIFFLDKLLYIVEIENQLKVNIFEPELLKTAKKNGFSDREIAKLWNVTPEEVRRRRQENKIIPVYKMVDTCAAEFESSTPYFYSTYEWENESKRSDKEKIIVLGSGPIRIGQGVEFDYATVHCVKAIQALGKEAIVINSNPETVSTDFSISDKLYFEPLTFEDVMNVIDLEEPLVVIVQFGGQTAINLAEHLSKAGVKILGTQVEDLDRAEDRDLFEKALQDLDIPQPPGATATNEEEAVANANKIGYPVLIRPSFVLGGRAMEIINNEKDLRDYMNRAVKASPEHPVLVDSYLQGQECEVDAICDGKEVLLPGIMEHIERAGVHSGDSMAVYPPQNLSQAIIDTIVDYTKRLAIGLNCIGMMNIQFVIYEEQVYVIEVNPRASRTVPFLSKVTNIPMAQLATQMILGENLKDLGYEAGLAPTPDMVHVKAPVFSFTKLAKVDSLLGPEMKSTGLAMGSDVTLEKALYKSFEAAKLHMADYGSVLFTVADEDKEETLALAKDFAEIGYSLVATAGTAAFLKENGLYVREVEKLAGGEDEEGTLVEDIRQGRVQAVVNTMGNTRASLTTATDGFRIRQEAISRGIPLFTSLDTVAAILKVMQSRSFTTKNI

SEQ ID NO: 58376 - protein, 343 aa, uncultured proteobacterium
MIRVAINGFGRIGRNILRAYYDRPELSQAIDIVAINDLGEPAINAHLLEFDTAHGRFGHEVTSGEDYLAVDGRRIAVLNERSPSALPWAELNIDLVLECTGLFTTRVSAAAHLDAGAQRVLVSAPTKDADATIVYGVNHGTLTNEHRVISNASCTTNCLAPVVQPLHEEIGLVSGLMTTIHAYTNDQNLNDVYHKDLFRARAAGQSMIPTATGAANAIGLVLPELQGRLDGLAVRVPTLNVSLVDLSFTAARETSVEEINSLMSKAATEDAFGILGYNERPLVSVDFNHDSHSANFDANHTRVAGSLVKVLAWYDNEWGFSNRMLDNALELSAIAGLSANKAA

SEQ ID NO: 58377 - protein, 470 aa, Cicer arietinum
LDPIYSGSKGGVIMFSRALRLYKRQGIRVNVLCPEFVETDMGTMIGPKFLSMMGGFVPMEMVVKGAFELITDENKAGDCLWITNRRGLEYWPTPSEEAKYLLRSTRSRRRTEYKAPPIKLPESFEKIVVQTLTHNFRNATSVVRAPLRLPIKPNYVLVKIIYAGVNASDVNFSSGRYFGGNNSDTASRLPFDAGFEAVGVIAAVGDSVTDLKVGMPCAFMTFGGYAEFTMIPSKYALPMPRPEPEGVAMLTSGLTASIALEKAGQMESGKVVLVTAAAGGTGQFAVQLAKLAGNTVVATCGGGAKAKLLKELGVDRVIDYHSEDIKTVLRKEFPKGIDIIYESVGGDMLKLCLDALAVHGRLIVIGMISQYQGENGWTPSKYPGLCEKLLSKSQTVAGFFLVQYSHMYQEHLNKLFDLYSSGKLKVAVDPKRFIGLHSVADAVEYLHSGKSVGKVVVCVDPTFGHQVAKL

SEQ ID NO: 58378 - protein, 509 aa, Carboxydothermus hydrogenoformans Z-2901
MASKVIVLDFGGQYSQLIARRIRELKVYCEMLPYNTPLEKIVQENPGGIVFSGGPSSVYGEGAPTVDPEIYRLNIPILGICYGMQLMAHQLGGIVRPAEGREYGKTPLFILNRDRLFAGLNETEICWMSHGDFVAKAPEGFLVTAKTEYTPIAAMENRERNLYAVQFHPEVVHTPKGKEILKNFLYEICGLTPDWTMESFAQKAIREIKEQVGEEKVVCALSGGVDSSVAAVLVHKAIGDNLTCIFVDHGLLRKGEAEEVVRTFKEQFQMNLVFVDAKEQFLAKLKGVRDPEQKRKIIGHEFIRVFEEEAAKLGDIRFLVQGTLYPDVVESGTATAATIKSHHNVGGLPEDMKFQLIEPLKWLFKDEVRELGLELGLPESIVWRHPFPGPGLAVRVLGEITEEKLAILREADYIFIDELKKSGWYRKTWQAFAVLPNLQSVGVMGDERTYAYTIALRAVTSEDGMTADWVRLPYELLEKISARIVGEVKGVNRVVYDITSKPPATIEWE

SEQ ID NO: 58379 - protein, 1064 aa, Geobacillus stearothermophilus
MPKRRDIETILVIGSGPIVIGQAAEFDYAGTQACLALKEEGYKVILVNSNPATIMTDTEIADKVYMEPLTLDFVARIIRKERPDAILPTLGGQTGLNLAVELAKAGVLEECGVEILGTKLEAIEKAEDREQFRALMNELGEPVPESAIIHSLEEAYAFVEQIGYPVIVRPAFTLGGTGGGICTNEEELVEIVSTGLKLSPVHQCLLERSIAGYNQIEYEVMRDANDNAIVVCNMENIDPVGIHTGDSIVVAPSQTLSDREYQLLRNASLKIIRALGIEGGCNVQLALDPDSFRYYVIEVNPRVSRSSALASKATGYPIAKLAAKIAVGLTLDEMINPVTGKTYACFEPALDYVVTKIPRFPFDKFESANRRLGTQMKATGEVMSIGRTFEESLLKAVRSLEIGVHHLELNEAKTAADDVMEKRIRKAGDERLFYIAEALRRGVTVETLHEWSQIDRFFLHKIQNIIEMETVLKNHPGDLDVLKKAKGLGFSDAAIAALWNKTERDVYALRRQEGIVPVYKMVDTCAAEFTSETPYYYSTYEEENESIVTEKPSVIVLGSGPIRIGQGIEFDYATVHCVLAIKQAGYEAIIINNNPETVSTDFSTSDKLYFEPLTAEDVMHVIDLEQPVGVIVQFGGQTAINLAAELEARGVRLLGTTLEDLDRAEDRDKFEQALSELGIPKPAGKTAVSVEEAVAIAEEIGYPVLVRPSYVLGGRAMEIVYNREELLHYMEHAVRVNPQHPVLVDRYITGKEVEVDAIADGETVVIPGIMEHIERAGVHSGDSIAVYPPQTLSDDVIAKITDYTVKLARGLHIVGLLNIQFVVAGSDVYVLEVNPRSSRTVPFLSKITGVPMANLATKAILGAKLADMGYETGVCPVRPGVYVKVPVFSFAKLRNVDISLGPEMKSTGEVIGKDVTFEKALYKGLVASGIQIQPHGAVLLTVADKDKEEAVELARRFADIGYQLLATNGTAETLKAAGIPVTVVNKIHSASPNILDVIRQGKAQVVINTLTKGKQPESDGFRIRREVENGIPCLTSLDTARAMLQVLESMTFSTTAMTEGLVRS

SEQ ID NO: 58380 - protein, 984 aa, Staphylococcus aureus subsp. aureus Mu50
MQEHLVVTLDGKDYLVEPGTNLLEFIKSQDTFVPSICYNESMGPIQTCDTCTVEIDGKIERSCSTVIDRPMTVNTVNNDVKDAQKEALDRILEKHMLYCTVCDYNNGDCEIHNTMDAWGLQHQTYEYKEKPYEKDYGPFYRYDPNQCILCGRCVEACQDIEVNETIRIDWDREHPRVIWDNDVPINESSCVSCGQCATVCPCNAMMEVNMEGNAGYMTDTEPGSLAAMIDLTKKAEPGYGPLFAISDSEAEMRKERIKKTKTVCTYCGVGCSFEVWTKDREILKVQPSHDSPANKIVTCVKGKFSWGHINSDQRLTKPLVRKNGEFHEVEWDEALNVIADNFTSIKEKYGPDALSFISSSKATNEESYLMQKLARQVIGTNNVDNCSRYCQAPATKGLFRTVGHGGDSGSIEDLEKAAMSVLIGTNTAEAHPVIASRMKRAQKLFGQKIHVFDIRKHEMAERADRFYQPKPGTDLAWLSAVTKYIIDHDLHDKAFIDEWVDDFDEYYKSLETFTMAFAEEATGIPESELIKFAEECAKAESVVICWAMGITQQDIGSDSSTAISNLLLVTGNYRRPGTGAYPLRGHNNVQGCSDMGSMPDKITGYQSIEADDIRAKFEKEYGVKLNPKAGKDNHEMVEGIHDGEVHSLYLYGEDTGIVDSNINFVQAAFEKLDFMVVQDEFLTFTATYADVVLPASPSLEKDGTFTNTERRIQRLYQALEPLGDSKPDWKIFQAIANRLGFDWNYKHPSEIMDEVARLTPLYAGVSYDRLEGFNSLQWPVQPDGTDEPILYLEGFNFDNGKAKLFPLSFDNYFKQDEIYDIHVNNGRLLEHFHEGNMTYQTPMIKYKVPRAFVEISPELAEDRGIHEGAEVKLISETGEAVLQVHVTDRVKGKEIYIPLNNDAMENGDLGAINLLTNSDVDQYTDTPSYKRTSCRLEVITKRGKSPLNPNNFRVNKKRHPQYSVQVQKKWERSDYVFPGNQVDK

SEQ ID NO: 58381 - protein, 514 aa, Arabidopsis thaliana
MVKMGEVWTNTGSALASLVFIYTIFERFFPYRLREHFEPLAQSLIGFIYPYIQITFHEYSGERFKRSDVYDAIQSYLSKDSSSRAKKLTANTIKGNKSIILSMDDHEEITDEFQGVKVWWQSKKHQSESRAISFYPKADESRFYMLKFHRRDREVITKKYLNHVISEGKTIEVKNRERKLYSNNPSQNWSGYKQTKWSHVTFEHPATFDTLAMEYKKKEEIKNDLIKFSNSKDYYKKIGKAWKRGYLLFGPPGTGKSTMIAAMANLLEYDVYDLELTTVKDNTELRRLLIETSGKSIIVIEDIDCSLDLTGQRKQKKDEEEDEDETSPIEKQMKKDQGENKGSKVTLSGLLNFIDGLWSACGGERIIVFTTNFIDKLDPALIRKGRMDKHIEMSYCGFEAFKVLANNYLDAKEEDDNELFDEIKRLLEVEEIKMTPADVGENLLKKSEVETKEICLKRLIEALKEEKEEAKRRIEDEEKKKKEEEEIKRKKREEKKIKKEEKEEKEENETTMKD

SEQ ID NO: 58382 - protein, 257 aa, Brassica napus
  misc_feature (135)..(135): Xaa can be any naturally occurring amino acid
MELSLSTSYPASPAVLRRQASPLLHNQQVLGVSFASVLKPGGVLRFRSRRRPLHRPITCSASPSTAEPSSEVKKKTLVRRNDVRNIAIVAHVDHGKTTLVDSMLRQAKVFRDNQVMQERIMDSNDLERERGITIXLSKNTSITYKNTKVNIIDTPGHSDFGGEVERVLNMVDGVLLVVDSVEGPMPQTRFVLKKALEFGHAVVVVVNKIDRPSARPEFVVNSTFELFIELNATDEQCDFQAIYASGIKGKAGLTPDD

SEQ ID NO: 58383 - protein, 247 aa, Thermoplasma acidophilum DSM 1728
MIEQSLEDALYAIVTQNPMIFLDYDGTLVPIIMNPEESYADAGLLSLISDLKERFDTYIVTGRSPEEISRFLPLDINMICYHGACSKINGQIVYNNGSDRFLGVFDRIYEDTRSWVSDFPGLRIYRKNLAVLYHLGLMGADMKPKLRSRIEEIARIFGVETYYGKMIIELRVPGVNKGSAIRSVRGERPAIIAGDDATDEAAFEANDDALTIKVGEGETHAKFHVADYIEMRKILKFIEMLGVQKKQ

SEQ ID NO: 58384 - protein, 298 aa, Triticum urartu
FSLAPLVPRLSELLGIEVKKAEDVIGPEVEKLVADLANGAVLLLENVRFYKEEEKNDPEFAKKLASLADLFVNDAFGTAHRAHASTEGVTKFLKPSVAGFLLQKELDYLDGAVSNPKRPFAAIVGGSKVSSKIGVIESLLEKCDILLLGGGMIFTFYKAQGLSVGSSLVEEDKLELATSLLAKAKAKGVSLLLPSDVIIADKFAPDANSQTVPASAIPDGWMGLDIGPDSVKTFNDALDTTQTIIWNGPMGVFEFDKFAVGTESIAKKLAELSKKGVTTIIGGGDSVAAVEKVGVADV

SEQ ID NO: 58385 - protein, 658 aa, Streptococcus mutans UA159
MSDLSVNAIRFLGVDAIEKSKSGHPGVVMGAAPMAYSLYTKHLRVNPSQPNWINRDRFVLSAGHGSMLLYALLHLSGFEDISIDEIKNFRQWGSKTPGHPEYGHTVGVDVTTGPLGQGISMAVGLAQAERFLAAKYNREGYPIFDHYTYVIAGDGDFMEGVSGEASSYAAKQNLDKLIVLYDSNDICLDGETNDAFTESVRARYDAYGWHTILVEDGNNIEAIGLAIEEAKAAGKPSLIEIKTVIGYGAPTKGGTNAVHGAPLGAEEAAATRKALNWGYAPFEVPQEVYDDFKENVADRGEAAYDAWSNLVGEYRQAYPKEAREVDAIIDGKDPVEIKEADFPVYENGFSQATRNSSQDAINAAADVLPNFLGGSADLAHSNMTYIKADGLQDADHPLNRNIQFGVREFAMGTVLNGMALHGGLRVYGGTFFVFSDYLKAAVRLSALQGVPVTYVFTHDSIAVGEDGPTHEPIEHLAGLRATPNLVVFRPADARETQAAWHYALTSQNTPTALVLTRQNLDVEAGSSFTSVAKGAYVTYETDSDFNTILLASGSEVNLAVKAAKELEAQGEKVRVVSVPSTELFDEQSAAYKEAILPNSVRRRVAIEMAASQPWYKYVGLDGAVIGIDKFGASAPAAQVIENYGFTVDNVVKVVKELK

SEQ ID NO: 58386 - protein, 298 aa, Triticum turgidum subsp. dicoccoides
FSLAPLVPRLSELLGIAVKKAEDVIGPEVEKLVADLENGAVLLLENVRFYKEEEKNDPEFAKKLASLADLFVNDAFGTAHRAHASTEGVTKFLKPSVAGFLLQKELDYLDGAVSNPKRPFAAIVGGSKVSSKIGVIESLLEKCDILLLGGGMIFTFYKAQGLSVGSSLVEEDKLELATSLLAKAKAKGVSLLLPSDVIIADKFAPDANSQTVPASAIPDGWMGLDIGPDSVKTFNDALDTTQTIIWNGPMGVFEFDKFAVGTESIAKKLAELSKKGVTTIIGGGDSVAAVEKVGVADV

SEQ ID NO: 58387 - protein, 129 aa, Lithospermum erythrorhizon
IRTTGGVKSITNYSPVLKAISSAKNMGFSDVLYLDAVNKKYIEEVSSCNIFVVKGNVISTPATNGTILEGITRKSILEVAQDIGFRVEERLIEVEELEDVEEIFCMPQPSCSPVRSITYKGNKIELVRI

SEQ ID NO: 58388 - protein, 537 aa, Bacillus cereus E33L
MMMNVPLTISSMMERAEKLFSKKEIVSRTHDTVTTLTYKQLGERTRRLSSALKKLGIKEGERIGTLAWNHHRHVEAYFAIPGIASVLHTINIRLSPQHISYIIQHAEDRILLIDEDLVPLIENIQSQLSTVQAYIIMTDKDEIPNTTLEPVYHYEKLLEEGDPNFQFVKDIDENTPAGMCYTSATTGNPKGVVYTHRSTVLHCMALGLADTAALSESDAAMAIVPMFHVNAWGLPFAATWFGSKQVLPGPMFTPKILLEMIQAEKVTLAAGVPTIWLGVLQELENNSYDLSSMTRILCGGAAAPKSVIKAFEQKHNVPFIHAYGMTETSPLVTLARLKSYETELSYEEQLEIRSKQGYLVPGVEMKVVGTNGEVKWDSTEMGELCLRAPWIAESYYNDDRTVEGFRDGWLYTGDVVTVDEEGCVKIVDRTKDVIKSGGEWISSVDLENALMAHDAIFEAAVVAVPHPQWQERPVACVVQKKNSTVTKEEIYEFLKPQFAKWWLPDDIVFMEEIPKTSVGKFLKQALRKELEHLHKEK

SEQ ID NO: 58389 - protein, 369 aa, Candida albicans SC5314
MFAKLRNKVSTPPPPVATTGSPTSSSSEITTTTNEKSSSTASLSTVYIPFSTPSSESHIPSEPELTQEQKDKYLHVLKHFQQSDLKIAISEETHKHKRKTKELTIGEKSWITRECILRYLRATKWHESEAIDRIELTLSWRREFGISEPFDNENKVNGELVSEENETGKEVILGYDNDSRPCLYLKPGRQNTKTSERQVQHLVYMLERVIDYMPAGQDSLALLIDFKAHPVGTQSGKIPPVGIGRQVLHILQTHYPERLGKALLTNIPWLGWTFLKIIHPFIDPLTREKLVFDQPFINYVPKEQLDKDFEGLVNFEYDHKKYWDVMIKISQDKKHQYFERFEKFGGIVGLSEVDLRGNNEELIHPVGTI

SEQ ID NO: 58390 - protein, 308 aa, Zea mays
MAIISDFKDDEAPEQQLAAGHGVEEALVAALERSGGALPFLQAAIDVAHRRSGLFRDPSAVSKVTAMAAAVRAQIEAEERVTREAEAKRKAEEDERKAEAEAQRAAKEAVMATAEEKPESTVEKDSMEVDKKEEANVRQPNAGNGLDLEKYSWTQQLPEVNITIPVPQGTKSRFVVFDLKKNHLKVGLKGQPPIIDGELYKPVKVDDCFWSIEDGRTLSILLTKHDQMEWWKSVIKGDPEVDTQKVEPENSKLSDLDPETRQTVEKMMFDQRQKQMGLPTSDEMQKQEILKKFMSEHPEMDFSRAKLD

SEQ ID NO: 58391 - protein, 394 aa, Streptococcus thermophilus CNRZ1066
MTVMDLTQRFNKNLDKIEVSMIRQFDQSISDVPGIKKLTLGEPDFTTPDHVKEAAKTAIDANQSHYTGMAGLPDLRQAAANFVKEKYNLTYNPDNEILVTIGATEALSASLTAILEPGDTILLPAPAYPGYEPIANLVGAKIVEIDTTANDFVLTPEMLEKAILEQGDKLKAVLLNYPTNPTGVTYSRQQIEDIAEVLKKYDIFVVSDEVYSELTYVDQHVSIAEYLPEQTILINGLSKSHAMTGWRIGFIFAPESLTAQLIKSHQYLVTAAATMAQFAAIEALSAGKDDAQPMKVEYLKRRDYILEKMTELGFKIIKPDGAFYIFAKIPEGYNQDSFKFCQDFAREKAIAIIPGVAFGKYGEGYVRLSYAASMDTIETAMTRLKEFMEEHAEA

SEQ ID NO: 58392 - protein, 262 aa, Glycine max
MKMPPFLHSFPPRSFFFCCFLLLPLLLLLLLLVAPSSSGAPNEKVTVSLYYESLCPYCADFIVNHLVRLFQTGLISIVNLRLVPWGNAWIAPDGTVVCQHGDDECFLNTIEACAITIYPDVVQHFRFVRCLERLTLEGRHNQWVNCFQMTGLGTSPIDCYTNGNGKAIDQKYAKETAQLNPPHRFVPWVVVNNQALQEDYQNFVTYICRAYKGNVIPNACRSLSTKTYDSNEKVNSFQPVCYVDEARNLSFPLVTRLSNKSP

SEQ ID NO: 58393 - protein, 368 aa, Xanthomonas campestris pv. campestris str. ATCC 33913
MKTRAAVAWGPHQPLSIEEVDLQPPRPGEVLVRLVATGICHGDAHALAHAPASSFPAILGQEGSGVVEEVGIGVTSVRVGDHVIPLDMPECGVCKFCRSGRTNLCQAIRSSQERGLMPDGSSRFSLDGRPILHHMGTSTFSEYTVLPEIAVARIHPDAPLDQVCLLGCTVTTGVGAVLNSIHVRPGDCVAVFGLGGIGLSVIQGAVLAQAGRIIVVDIAPGKFALARALGATDCLDPRDYGAPIQQVIVDLTDGGADHSFECIGDVGAMRAALECCHKGWGESVILGVADGAQEISTRPFQLVTGRVWRGSAFGGVKGRSELPGYVERYLRGDLQLAPLITRTLALDDINQALADLRAARGIKSIVLY

SEQ ID NO: 58394 - protein, 1073 aa, Candida albicans SC5314
MLSFLTEVTGAIAQTSARRPIQFMVVPALLASIAYLSIIDDYIPEHIKSSSGSSGISYYHPYTSSHYKSQPDLDKWTAIDKEHINDDIYTQANQISVIPLRFRRFQDVVPNVPNAIHISDNEQILIVPTDQIENSLDQLQEITNNGITWKARNNDKLAKYYDYIRYGLNKVQDAIQHAENFDILLIFVAYLGMWYALIKVFVDMRKIGSKFWLAFSTLTSSTFAFLLALLVSNKFLHTKVSLLSLSEGIPFLVSVIGFKHKVSIATIVANSSTASPEDVPHVVGKAVSSHCLSMLRDHLVVIGGLLSCAIYAHHLTGLRNFCILSSLILSFDLILVYTFFSAILGLKVEINRARRTEDLQNALEEEGISSLVAARVAEQSATIEHPNEHNFFKSNNSSIAYFKVIMSLGFFAFHAFWLGSSWLYSTTDGGESFSRFSFLSNIPTLSQDISQQIPIGKKGTVVTILPTIFFMPSGFMVQLEDFIYLVLSKFSSAIRDSIISKFLVFGFALSIVTNVYFLNAARYQVSATHKLIEKEISRPQDSSVTATTTTTATGTTSSGAATSKAIGNNKGLKSVQEIPDNEDESSDEELEIKAPVKVLPLEECVKVLKEGKVKTLSNDEVSSLVVGGKLPLYALEKQLADNKRAVIVRRKAIAKLANAPVLDTNRLPYAHYDYDRVFGACCENVIGYMPLPVGVAGPLIIDEKPYHIPMATTEGCLVASTMRGCKAINAGGGVETVLTRDGMTRGPCVRFPTLKRAGAAKLWIDSEQGQATIKKAFNSTSRFARLQHIQTALAGTSLFIRFRTTTGDAMGMNMISKGVEYSLKYMVEECGWDDMEIVSVSGNYCTDKKPAAINWIEGRGKSIVAAARIPADVVTKVLKSDVDALVELNISKNLVGSAMAGSVGGFNAHAANLVTAVYLACGQDPAQNVESSNCITLMEKDKETGDLNVSVSMPSIEVGTIGGGTILEPQGAMLDLLGVRGPHPTNPGANAQQLAKIVASAVLAAELSLCSALAAGHLVQSHMQHNRSKAPAAGATTTTTPAITDSKASNGSIASNGKDLKRLEEGSVTCIKS

SEQ ID NO: 58395 - protein, 1058 aa, Streptococcus pyogenes serotype M18
MPKRKDIQKIMVIGSGPIIIGQAAEFDYAGTQACLALKEEGYKVILVNSNPATIMTDKEIADKIYIEPLTLEFVNRIIRKERPDAILPTLGGQTGLNMAMALSKAGILDDLEIELLGTKLSAIDQAEDRDLFKQLMQELDQPIPESTIVKTVDEAVTFARDIGYPVIVRPAFTLGGTGGGICSSEEELCEITENGLKLSPVTQCLIERSIAGFKEIEYEVMRDSADNALVVCNMENFDPVGIHTGDSIVFAPTQTLSDIENQMLRDASLKIIRALKIEGGCNVQLALDPYSFKYYVIEVNPRVSRSSALASKATGYPIAKLAAKIAVGLTLDEMINPITGTTYAMFEPALDYVVAKIPRFPFDKFEHGERQLGTQMKATGEVMAIGRNLEESLLKACRSLEIGVCHNEMTSLSNISDEELVTKVIKAQDDRLFYLSEAIRRGYSIEELESLTKIDLFFLDKLLHIVEIEQELQMHVDHLESLKKAKRYGFSDQKIAEIWQKDESDIRAMRHSHSLCPVYKMVDTCAAEFDAKTPYFYSTYELENESVQSNKESILVLGSGPIRIGQGVEFDYATVHSVKAIQKAGYEAIIMNSNPETVSTDFSVSDKLYFEPLTFEDVMNVIDLEQPKGVIVQFGGQTAINLAQSLSDAGVTILGTQVEDLDRAEDRDLFEKALKELGIPQPQGQTATNEEEALEAAKKIGFPVLVRPSYVLGGRAMEIVENKEDLREYIRTAVKASPEHPILVDSYIFGKECEVDAISDGKSVLIPGIMEHIERAGVHSGDSMAVYPPQQLSKQIQETIAEYTKRLAIGLNCIGMMNVQFVIKNEQVYVIEVNPRASRTVPFLSKVTGIPMAQIATKLILGQTLKDLGYEDGLYPQSQLVHIKAPVFSFTKLAQVDSLLGPEMKSTGEVMGSDTSLEKALYKAFEANNSHLSEFGQIVFTIADDSKAEALSLARRFKAIGYQIMATQGTAAYFAEQGLSACLVGKIGDAANDIPTLVRHGHVQAIVNTVGIKRTADKDGQMIRSSAIEQGVPLFTALDTAKAMLTVLESRCFNIEAI

SEQ ID NO: 58396 - protein, 70 aa, Oryza sativa
VKQTVLANKRWVVPPTGKGSLYIRPLLMGSGAVLGLAPAPEYTFIIFVSPVGNYFKEGLAPINLIVEDKF

SEQ ID NO: 58397 - protein, 1080 aa, Xanthomonas axonopodis pv. citri
MPKRTDLETILIIGAGPIVIGQACEFDYSGAQACKALRDEGYRVVLVNSNPATIMTDPNMADAVYIEPINWQTVEKIIAKEKPDALLPTMGGQTALNCALDLADHGVLEKYNVELIGAKREAIRMAEDRELFRVAMGEIGLDCPTAAVAHTLEEALEIQTRVGYPTIIRPSFTLGGSGGGIAYNREELIEIVGRGLELSPTTEVLVEESVLGWKEFEMEVVRDTADNCIIVCAIENLDPMGVHTGDSITVAPAQTLTDKEYQRLRDASIAVLRKIGVDTGGSNVQFGISPTTGRVVVIEMNPRVSRSSALASKATGFPIAKVAAKLAVGYTLDELKNEITGGLTPASFEPSIDYVVTKIPRFAFEKFPQADARLTTQMKSVGEVMAMGRTFSESLQKALRGLETGKIGLDPTGLDLSSEDDIATLKRELKAPGPERLFYVADAFRAGMTVADVYALSFIDPWFLDQIEEIVSHEQQLADDGMAALDAPRLRMLKRAGFSDARMAQLIGSNEESVRTLRRALKVRPVYKRVDSCAAEFATSTAYLYSTYEDECEALPTDRDKIMILGGGPNRIGQGIEFDYCCVHAALALRDDGFETIMVNCNPETVSTDYDTSDRLYFEPLTLEDVLEIVELEKPKGVIVQYGGQTPLKLARALEANGVPVIGTSPDSIDLAEDRERFQQLVDKLGLKQPPNRIARNAEEALVLAREIGYPLVVRPSYVLGGRAMEIVYGESDLARYVRDAVKVSNDSPVLLDRFLDNAVEVDVDIIADKDGNVLIGGVMEHIEEAGVHSGDSSCSLPPYSLSPQTQAELRRQVVMLAEGLNVVGLMNTQFAVQVNEAGDDIVYLLEVNPRASRTVPFVSKAIGMPLAKIAARCMAGKTLAEQGATKEIVPDYYSVKEAIFPFAKFQGVDPILGPEMRSTGEVMGVGRSFSAAFARAQEAGGIKAPPLGKAFVSVRDPDKQRVLPVAQALVERGFTLVATRGTGAWLQQNGLSCEIVNKVAEGRPHIVDSIKNGEIVYIVNTTEGRAAISDSFSIRREALQHRVTYSTTVAGAKALVQSLEFRGTGPVWSLQELHKELEA

SEQ ID NO: 58398 - protein, 443 aa, Hyphomonas neptunium ATCC 15444
MAINITMPALSPTMEEGTLAKWLVKEGDTVKSGDIIAEIETDKATMEVEAVDEGTVAKIVVAEGSEGVKVNAVIAVLAEDGEDASSVKTPSADAAPKKEEKKEDAPKAGEKKPDEKKPEPKKEEAKPEPAKAAAPAKSDDGARLKASPLAKRIAANKGIDLKALKGSGPHGRIIKRDVESAKPGAQAATAGAAAPASPDGLILPQILDDRVYAPDTYELKPLDGMRKTVARRLTQSFMQVPHFPLNIDITLDNLLTSRASINNAAREGVKVSVNDLLIKAAALALMDEPDCNASFTDKGIAYHKHANVSVAVAVEGGLITPVIFKAETKGLAEISEEMKDLAARARERKLKPQEYMGGTFSISNLGMFGIKSFASIINPPEGMILSVGAGEKRAVVDEKGNVAVRTIMSVTLTCDHRVIGGAEGAKWLTAFKRYVETPEAMLL

SEQ ID NO: 58399 - protein, 1081 aa, Synechocystis sp. PCC 6803
MPRRNDLNKIMILGAGPIVIGQACEFDYSGTQACKALKEEGYEVVLVNSNPASIMTDPELADRTYIEPLIPEIVEKIIEKERPDAVLPTMGGQTALNLAVSLSKSGVLEKYGVELIGAKLPAIEMGEDRELFKEAMARIGVPVCPSGIASSIEEARQVAHEIGSYPLIIRPAFTLAGTGGGIAYNQEEYEEMVQYGLDQSPMSQILVEKSLLGWKEYELEVMRDLADNVVIICSIENFDPMGVHTGDSITVAPAQTLTDKEYQRLRDYSIAIIREIGVETGGSNIQFSVNPANGDVIVIEMNPRVSRSSALASKATGFPIAKFAAKLAVGYTLNEISNDITKKTPASFEPTIDYVVTKIPRFAFEKFPGAEPILNTQMKSVGEAMAIGRTFQESFQKALRSLETGRFGFGCDRHETLPTLSHLRSQLRTPNPERVFSLHHAFNLGMTVEEIHELTAIDPWFLDKLEDLVKTEKYMKQRSLKDLTAADLRYIKQQGFGDRQIAFATKTTEDEVRAYRKSLGITPVYKVVDTCAAEFEAFTPYYYSTYEPEECEVLPSDKPKVMILGGGPNRIGQGIEFDYCCCHAAFSLSDAGYETIMVNSNPETVSTDYDTSDRLYFEPLTKEDVLNIIEAENPVGIIIQFGGQTPLKLAVPLQKYLNSPDCPVQTKIWGTSPDSIDTAEDRERFEKILHELEISQPPNGIARDYEESRVVANRISYPVVVRPSYVLGGRAMEIVYSDEELERYMTYAVQIEPDHPILIDKFLENAIEVDVDSLTDSTGKVVIGSIMEHIEEAGIHSGDSACSIPYTSLSDNVLTTIRQWTEQLARALNVVGLMNIQYAVQGDQVYILEANPRASRTVPYVSKATGRPLAKIASLVMSGKTLEELGVTEEFIPQHVAVKEAVLPFSKFPGADTLLGPEMRSTGEVMGIDSDFGKAFAKAELGAGVILATTGTVFVSMSDRTKEAAVPVVRELIDLGFKVVATSGTQKVLREHGIEGVEVVLKLHEGRPHVIDWIKNGQIQFIINTPSGEESQLDGRTIRRAALDYKLPIITTIAGGKATVAALRSLQDHPLDVKALQDYLG

SEQ ID NO: 58400 - protein, 315 aa, Triticum aestivum
MAFVCAKAVLLAAVMLASAAQLCMGARRRMELYRPDPADMLSYHNGAVLHGDIAVSVLWYGNFKPAQKAVILDFLLSLTAEPQAASPSVAQWWSTIDQQYLSPASAKSNGAGAKTRVLLADQLSDGECSTGKSLTLEQITALAATASPKKGGVAVVFTAQDVAVEGFGMGRCSLHGSDASSGTTHIWVGNPETQCPGACAWPFHQPAYGPQDAPLVAPNGDVGADAMVMNFASMLAGAATNPFGDGYYQGSSDAPLEAATACPGVFGNGAYPGYAGDLKVDQATGASYNCNGAHGRKYLLPALYDPSKSACGTLV

SEQ ID NO: 58401 - protein, 1071 aa, Neisseria gonorrhoeae
  misc_feature (95)..(95): Xaa can be any naturally occurring amino acid
MPKRTDLKSILIIGAGPIVIGQACEFDYSGAQACKALREEGYKVILVNSNPATIMTDPEMADVTYIEPIMWQTVEKIIAKERPDAILPTMGGQTXLNCALDLAGNGVLAKYDVELIGATEDAIDKAEDPGRFKEAMEKIGLSCPKSLFCHTMNEALAAQEQVGFPTLIRPSFTMGGSGGGIAYNKDEFLAICERGFDASPTHELLIEQSVLGWKEYEMEVVRDKADNCIIICSIENFDPMGVHTGDSITVAPAETLTDKEYQIMRNASLAVLREIGVDTGGSNVQFAVNPEKGEMIVIEMNPRVSRSSALASKATGFPIAKVAANWAVGFTLDELRNDITGRRTPASFEPSIDYVVTKMARFAFEKFPAADDRLTTQMKSVGEVMAMGRTIQESFQKALRGLETGLCGFNPARRRQTEIRRELANPGPERMLFVGKAFRAAFTPEEIHEISAIDPWFLAQIEDLMKEEKSVSDGQLQDLDYAALHRLKRKGFSDKRLAQLLNVSEKEVRETRTPVKLDPVYKPVDTSAAEFATETAYLYSTYEEECESRPSDRKKVMILGAGPNPIGQGIEFDYCSVHAALPLRESGFETIMVNCNPETVSTDFDTSDRLYFEPLTLEDVLEIVRTENPWGVIVHYGGQTPLKLANALVENGVNIIGTSADSIDAAEDRERFQKVLNDLGLRQPPNRIAHNEEEALVKAEEIGYPLVVRPSYVLGGPAMQIVHSAEALQKYMREPVQVSEDSPVLLDFFLNNAIEVDVDCVSDGKDVVIGGIMQHVEQAGIHSGDSGCSLPPYSLSEEIQDEIRRQTKAMAYALGLVGLMNVQFAVQDAVVFVLEVNPRATRTVPFVSKATGQRLAKVGARCMAGISLKEQGVEKEVVPDFYAVKEAVFPFIKFPGVDTILNPEMRSTGEVMGVGRSFGEAYYKAQLGAGERLNPTGKIFLSVREEDKERVIKTAKNFQALGYGICPTRGTAQYLTEHGLIVQAINKVPEGRPHIGDALKNGEIALVVNTVSSDPQSVSDSHIIRQSALQQRVPQYTTTAGGEAMSEGAKSRDYLGVYSVQELHGRLKNRN

SEQ ID NO: 58402 - protein, 317 aa, Solibacter usitatus Ellin6076
MKHALIVSLAVSGLMYAQGPGQGKGAPEIVPHRTNPQGAGAPTAGSAGAIKPGIQYRGGPVMNAPAPYLIWYGNWNQSNGSDNPGGQQIVRDAIFGLSASNYYMTNASYSGVSGSLNVAGFLGNGANGSHEINDPYSQGSNLSDSQVASIVSTAIAQGLGGPGGDSNGIYFVLTSSDVNESSGFCTQYCGWHTYGTLGSKSIKYAFVGNANRCLNSCAAQTTGPNGNAGVDGMISVIAHEMEETNTDPELNAWFSAKGAEDADMCAWTFGSSQLRLPGGAYYNMTLAGISMPTRNYLIQRELDVNSKCYVDYVNKKQ

SEQ ID NO: 58403 - protein, 487 aa, Salmonella enterica subsp. enterica serovar Dublin
MKKINHWINGQNVAGDDYFQTTNPATGDVLAEVASGGEAKLNQAVAAAKEAFPKWANLPMKKRARLMRRLGDLIDQNVPEIAAMETADTGLPIHQTKNVLIPRASHKFEFFAEVCQQMNGKTYPVDDKMLNYTLVQPVGVCALVSPWNVPFMTATWKVAPCLALGNTAVLKMSELSPLTADRLGELALEAGIPAGVLNVVQGYGATAGDALVRHHDVRGVSFTGGTATGRNIMKNAGLKKYSMELGGNSPVLIFEDAEIERALEAALFTIFLINGERCTAGLSIFIQQSIYPEFVKRFAERANRLRVGDPTDPNTQVGALISQQHWEKVSGYIRLGIEEGATLLAGGAEKPTDLPAHLKGGNFLRPTVLADVDNRMRVQEEIFGPVACLLPFKDEAEGLRLANDVEYGLASYIWTQDVSKVLRLARAIEAGMVFVNTQNVRDLRQPFGGVKASGTGREGGEYSFEVFAEMKNVCISMGDHPIPKWGV

SEQ ID NO: 58404 - protein, 514 aa, Legionella pneumophila str. Paris
MSHNAPLVLMILDGWGYNENDRYNAIAKANTPQWDEWWQTCPHILLKASGLPVGLPDEQMGNSEVGHMHIGAGRVIQQDFTRINEAINNGKFAKNAVFHEVIDQLKKTEKSLHIMGLLSPGGVHSHEQHLFALLALCNQKKFRSVHLHLFLDGRDTPPQSALDSLKCLNEELAKHPVATINSICGRYYAMDRDKRWERVEPVYNLLTQGKSERQFPDAETAIHFYYKNKISDEFVPPTLIGKEHSIQDGDAVLFFNFRADRARQLTSTFLDPLFKGFERKTLPKLSCFVSMTQYDKNLFTTTAFPPVPLNNTLGEVLSSHGLSQLRIAETEKYAHVTFFFNGGCESVFTNEERIMVPSPQVATYDLQPEMSAHELTKTLIAAINSRDYHVIICNYANADMVGHTGNFEATVQAIECLDQCMQQVWQALKNNGGKLLITADHGNAEEMFSEATNQAHTAHTSEPVPFLYVGGGWHFTHSEGSLIDIAPSLLALLGITPPPEMTGRILLEKNHAHA

SEQ ID NO: 58405 - protein, 139 aa, Nocardia farcinica IFM 10152
MTEQTLVLIKPDGVSRGLVGEVLARIERKGLKIAALELKQVSDELAREHYAEHADKPFFGSLIEFITSGPVVAAVLEGPRAIAAFRQLAGGTDPVEKAAPGSIRGDFGLETQYNLVHGSDSPESAKREIGLWFPEFPVA

SEQ ID NO: 58406 - protein, 351 aa, Ustilago maydis 521
MPVTLINNNKAVKLELPKSQASAEVLFFGATVTSWKVAGGSERLFLSSKAALDGSAAVRGGIPLVFPVFGSPKDHDDVPELITKLNKHGFARDHDWALSTHVASVDQEDKASVTLELRTNDKPDIKAVWPFETVLQYTVTLLPHQLKCELKVNYVDGEGDMPFHALLHNYFLVPDSTKASVQGLNGMFYIDKVLGGEEVQLNTDNFTLDAQPIDRVHVGKHKTIPAGEKPRDVKLVYNASLLQDPLGRMGKGVEVTRSKQLKDTVVWNCADEGNKLIKDLEDGDWKKYVCVEPGSVHGFETLPKGSKWIAEQTLTACDGGSNAFCTVLEPRRCFMVEDVGVTTVPRTDPND

SEQ ID NO: 58407 - protein, 298 aa, Aegilops speltoides subsp. speltoides
FSLAPLVPRLSELLGIEVKKAEDVIGPEVEKLVADLANGAVLLLENVRFYKEEEKNDPEFAKKLASLADLFVNDAFGTAHRAHASTEGVTKFLKPSVAGFLLQKELDYLDGAVSNPKRPFAAIVGGSKVSSKIGVIESLLEKCDILLLGGGMIFTFYKAQGLSVGSSLVEEDKLELATSLLAKAKAKGVSLLLPSDVIIADKFAPDANSQTVAASAIPDGWMGLDIGPDSVKTFNDALDTTQTIIWNGPMGVFEFDKFAVGTESIAKKLAELSKKGVTTIIGGGDSVAAVEKVGVADV

SEQ ID NO: 58408 - protein, 518 aa, Oryza sativa (japonica cultivar-group)
MEEERMEPPPPPPYIHIETNDFLHRRHKRQKEEDIAVCECQYNLLDPDSACGDRCLNVLTSTECTPGYCLCGVYCKNQRFQKSQYAATRLVKTEGRGWGLLADENIMAGQFVMEYCGEVISWKEAKRRSQAYENQGLTDAYIIYLNADESIDATKKGSLARFINHSCQPNCETRKWNVLGEVRVGIFAKQDIPIGTELSYDYNFEWFGGAMVRCLCGAGSCSGFLGAKSRGFQEATYLWEDDDDRFSVENVPLYDSADDEPTSIPKDILIKDEPNTQDGNNNTIQNTGIPIIASSSEFTPMNVEPSIASSNEFTPMNVEPLNVSSNELTPMTIEPLNAIPMGVDFTQNGSIEYGAQCAEDALQNSTRGVANLQNQSAPRDNNHTELVAVKRRPTLRGGKAKRGMRKQLNVVGICDRLASEVAREEILYCEEMKNEAAAEIDSLYDEIRPAIEEHERDSQDSVATSLAEKWIEASCCKYKADFDLYASIIKNLASTPLRSKEDAAPTEQNGLMYLENGP

SEQ ID NO: 58409 - protein, 175 aa, Capsicum annuum
MASKMCEPLVIGRVIGEVVDYFCPSVKMSVIYNSNKHVYNGHELFPSSVTTKPRVEVNGGDLRSFFTLIMIDPDVPGPSDPYLREHLHWIVTDIPGTTDCSLGREVVGYEMPRPNIGIHRFVFLLFQQKKRQTISNAALSRDRFCTRKFSEENELGSPVAAVFFNCQRETATRRR

SEQ ID NO: 58410 - protein, 446 aa, Oryza sativa
MPSEFVAARKKPPPELLFAAGRKKQQPPPPGMAFVPSEFAAAGVGRKRQPAPPVEIRRVWAHNVEEEFRIIRNAIDHFPYVSMDTEFPGVIHRPTKHPALLTAGDRYDLLRRNVDALHLIQVGITLAASPTAAPALAFEINLSDFDQRVHRHAAESVQLLAEHGVDLAAHRRHGVRASALAPLLMSSGLVCSHGAVKWVTFHSAYDFAYLVKLLMGRKLPRSMAEFLNLVRVFFGDEVYDVKHMMRHCGGELYGGLERVAAALQVKRAAGRCHQAASDSLLTWDVFRRMRELYFLKHGVEAYQGVLFGLELDMDMPSNKTPSLPLVVAGKATPTKLLLCMGDEVACVGYGDRRPEWFGAADPSRWRLDLASPQPDQERTTPDGGGPVEVMAARHGRQQGGDNVGDNTAATVTYDHEAGVSATAKAVAACVHQSPGLAWLAVGRWSG

SEQ ID NO: 58411 - protein, 225 aa, Candida albicans SC5314
MHVLFFFFTHTTKHTNAILKSTIIYNSLQGIVIRIVSTGATFMRDSRSRFSFLDILRILGGILFLNAFLSWWFTSTSTWGYRGKWLNTDYLKFRLFNANNPLNLTISELSLYNGTDKHLPIYLAIDGIVFDVSSSPKVYGPGGPYHELTGKDAARVYVTGCFNKKDEYTYDLRGLDETEAENDIQSWQQFFFDHDKYWYVGTVQHEPITGDPPAPCEHMKFPGMH

SEQ ID NO: 58412 - protein, 393 aa, Oryza sativa (japonica cultivar-group)
LSLCQTCVLATLLCSDTCLKLKTIEEKIGRGCRGGRKEGRKKATMVDLVNGVLNWVATPAMVASLLLFYPPYYLFKTVHSFLSYLFPDDLARKVVLITGASSGIGEQLAYNYALNRASLVLVARREWSLRKVADQAFELGAPDVIILPGDVANPEDCKRFVQTAIDHYGRLDHLVCNAGIASVGAFQEIPDVTNYSSQFDVNFWGSVQSTFEALPHLKRSRGRIVVTASATGWNPVPRMTFYNAANAALINFYETLRTELGSQVGITIVTPGWIESEMSKGKFLKDHGEMEVDQEMRDAQIGLFPVEYAKNCAKAMVQAVRQGKRCLTVPPWFSTMYLWRVFAPEVVEFCYRLLYMHRHGGSQADAPSKKMAEAGGKKLLYPTSLRSDDIKDE

SEQ ID NO: 58413 - protein, 237 aa, Triticum aestivum
  misc_feature (101)..(101): Xaa can be any naturally occurring amino acid
  misc_feature (222)..(222): Xaa can be any naturally occurring amino acid
  misc_feature (224)..(224): Xaa can be any naturally occurring amino acid
MEDERSTQSYQGGEAAEQVEVTDRGLLGNLLGKKKAEEDKEKKEEELVTGMEKVSVEEPEVKKEEHVDGEKKETLFSKLHRSSSSSSSSSDEEEEEVIDDXGEVIKRKKKKGLKEKLQEKLPGHKDTEGEHVTGLPAPAAPASVQTHHDTDVVVEKIDGDVKTEATPAVPEEEKKGFLEKIKEKLPGGHKKPEDAAAVPVTHAASAPVTHAAPAPVHAPAPXPXEEVSSPDAKGKEG

SEQ ID NO: 58414 - protein, 170 aa, Zea mays
MKAGRKNLRRACDEGAAVTLAEGESIMQVLTLRGSNVIEVMDGVGVRSLALFPAKFQKSFWIKNGSFVVVDASGRDQALESGSKIACVVSRVLFHEQVRALQKSGNWPAIFNSAPTPNEASEAGAEAQAAQVDEEPDSDEEDDDLPPLEANTNRNRPYELYSDSDSGSDA

SEQ ID NO: 58415 - protein, 550 aa, Cryptococcus neoformans var. neoformans JEC21
MGGGAAVGGGFDALLTQNQDRGFRGLFKNRRALGLACFASLGGVLYGYNQGVFGQVQVMYSFKERYTATLTNTDTKGLLTAILELGAFLGALMAGPLSDKFSRKYSISAWCIVFMMGTAVQTGANYNIACIYAGRWFAGMGVGALSMLVPMFNAELAPPGIRGSLVALQQLAITFGIMISYWIGYGTNYIGGTGAGQSTAAWRVPLGIQLVPAIVLCIGSCFLPFSPRWLMLKGREEECLTNLAKLRNSTEDAPEIQYEFRALQAERLVEREAAKERYGQEDVNFRVTLAEYKRLFTTKPLLHRLMLGAGCQTLQQWTGMNAITYYAPTIFEQIGLSGAGAGGTISLLATGIIGIVKFVFTIPAVLFVDNFGRKPLLAWGEANMAISHAIIAAIVAVYGDKFDTHKSAGNAAVFFIYWISANFACTWGPLAWVVSSEVFPLDMRGKGMSVSSGANWIMNFTVAMITPHMIGSIGYKTYIVFMCFCIVGFFFSIFILPELKGLSLEEIDNVFNDDSGVEDRARRERIAAQIGLDKVADQIQHQEKVDDSEV

SEQ ID NO: 58416 - protein, 439 aa, Emericella nidulans
MSASSTLKKAFPQVDAEGHNLPPSPAPSSPHGSRRYNIATELVYTESNDQYNASSVPIYQSATFKQSSHEGGGEYDYTRSGNPTRTHLERHLAKIMSTQRALVVSSGMAALDVITRLLRPGDEVVTGDDLYGGTNRLLKYLSTNGGIIVHHVDTTNPDKVKEVLTDKTAMVLLETPTNPLIKIVDIPTIAAASHEANPNCLVIVDNTMMSPLLLSPLELGADVVYESGTKYLSGHHDVMAGVIAVNDPALGERLYFPINASGCGLSPFDSWLLMRGVKTLKVRMDQQQANAQRIAEFLESHGFKVRYPGLRSHPQYELHHSMARGAGAVLSFETGDVSVSERIVANASVGYQRYFGCVNTLISLPCRMSHASIDAETRKERAMPEDLIRLCVGIEDVDDLIDDLSERWYKLALSTSLWTALKRTRRSQRSQVMKEYGYG

SEQ ID NO: 58417 - protein, 331 aa, Flaveria bidentis
MSAASAFAMNAPSFVNASSLKKASTSARSGVLSARFTCNSSSSSSSSSATPPSLIRNELVFAAPAPIITPNWTEDGNESYEEAIDALKKTLIEKGELEPVAATRIDQITAQAAAPDTKAPFDPVERIKSGFVKFKTEKFVTNPALYDELAKGQSPKFMVFACSDSRVCPSHVLDFQPGEAFVVRNVANMVPPFDKTKYSGVGAAVEYAVLHLKVQEIFVIGHSRCGGIKGLMTFPDEGPHSTDFIEDWVKVCLPAKSKVVAEHNGTHLDDQCVLCEKEAVNVSLGNLLTYPFVRDGLRNKTLALKGGHYDFVNGTFELWALDFGLSSPTSV

SEQ ID NO: 58418 - protein, 133 aa, Arabidopsis thaliana
  misc_feature (29)..(29): Xaa can be any naturally occurring amino acid
MAPTVMASSATSGAPFQGLKSTAGLPVSXRSNSAGLGSVSNGGRISCMQVWPIEGIKKFETLSYLPPLTVEDLLKQIEYLLRSKWVPCLEFSKVGFVYRENHRSPGYYDGRYWTMWKLPMFGCTDATQVLKEL

SEQ ID NO: 58419 - protein, 527 aa, Zea mays
MATCDLLMLREASPWALAGAVASVSLLWLVAWTLEWAWWTPWRLDRALRAQGLKGTRYRLFTGDLRETARVNREARKKPLPLGCHDITPRVQPMHHSTIKEYGKLSFTWFGPTPRVMIPDPELVKEVLSNKFGHFGKPRSSRIGRLLANGLVNHDGEKWAKHRRILNPAFHHEKIKGMMPVFSTCCIEMITRWDNSMSSEGSSEIDVWPEFQNLTGDVISRTAFGSNYQEGRRIFELQGELAERLIQSVQTIFIPGYWFLPTKNNRRMRAIDVEIRKILREIIGKREKDTKNRETNKDDLLGLLLESNTRQSNGNASLGLTTEDVIEECKLFYFAGMETTSVLLTWTLIVLSMHPEWQERAREEVLSHFGRTTPDYDSLSRLKTITMILHEVLRLYPPATFLTRRTYKEMELGGIKYPAGVDLLLPVIFIHHDPDIWGKDASEFNPERFANGISSATRHQAAFFPFGGGPRICIGQSFALLEAKMTLCTILQRFSFELSPSYTHAPYTVITLHPQHGAQIRLKKLSP

SEQ ID NO: 58420 - protein, 600 aa, Mycoplasma mycoides subsp. mycoides SC
MDKSKIRNFSIIAHIDHGKSTLADRILELTNTVEKREMQDQLLDSMDIERERGITIKLNSVQLKYHSKDNQDYIFNLIDTPGHVDFTYEVSRSLAACEGAILVVDASQGVEAQTLANVYLAIDSNLEIIPVINKIDLPSADVDKVKHEIEEIIGLDCSKSPLISAKTGLNVEDVLQAIVEKIPSPSDAIDNAPLKALIFDSYYDKYLGVVMSIRLKQGMLKVGDKIKLMSTNAEYEVTSLGIKTPKIVKKDFLEAGEVGWVAASIKTIKDVNVGDTITSVLNPADEPLDGYKKLKPMVYCGIYPIDTNKYQDFKEALEKIELSDSSLVYEPETSQALGFGFRCGFLGLLHMEVIQERLEREYNLELIATAPSVVYKVHLTNKQVIELDNPALLPEAQKISKIEEPFVEIKIATPSEYIGDLMNLCQNKLGIYKNMEVIDNNRRILIYQMPLAEIIFDFFNKLKSISKGYASFEYELIGYKESKLVRMDIKLNGEMVDAFSMIVNQKFAYQRGSALTLKLKELIPRQNFEVPVQATIGNKVISRETIKAYRKDVTWKLHAADKSRRKKLLEKQKEGKIKMKEIGTVEVPQEAFVAILKIDD

SEQ ID NO: 58421 - protein, 421 aa, Erwinia carotovora subsp. atroseptica SCRI1043
MKNSELNQRRLAATPRGVGVMCDFYAERAENSTLWDVEGREFIDFAAGIAVLNTGHRHPKIVAAVREQLDRFTHTAYQIVPYGSYVTLAERINALAPIQGAAKTTFFTTGAEAVENAVKIARAYTKRPGVIAFNAAFHGRTLLTMTLTGKVAPYSTGFGPFPGSIFHALYPNEQTGITVEQALESVERLMHTDIAADQVAAIILEPVQGEGGFHVAPPAFISGLRKLCDEHGILLIADEVQTGFARTGKLFAMEYYTEKADLITMAKSLGGGFPISGVVGRAEVMDAPSPGGLGGTYAGNPLSVASALAVLDVIEEEKLCQRAQRLGAALVETLEKVKAQCPALVAIRAQGSMVAAEFNDPNTGKPSAEITRQFQKSALEAGLLLLTCGVHGNVIRFLYPLTVPDEQFSKAMNILTRVLTR

SEQ ID NO: 58422 - protein, 197 aa, Zea mays
MDAFNYRDGELFAEGVALSAIAERFGTPTYVYSRAHIEAQYRSFADALEGTPSLVCYAVKANSNLGVLNVLARLGAGFDIVSRGELERVLAAGGKADKIVFSGVGKSREDMRRALEVGVHCFNVESTDELERLQVVAAEMGVRAPISLRVNPDVDAGTHPYISTGLKENKFGIAIADAEDVYIRAAQLPNLEVLGRE

SEQ ID NO: 58423 - protein, 490 aa, Erwinia carotovora subsp. atroseptica SCRI1043
MQLKQSISLKQQVLFRQHCLIDGEWQDSQSGERLNVTNPATGEVLGTVPLVTVSQTEQAIAAAEQALVEWRKKTGKERAALLQAWARLIMDNQDDLAVLLTAEQGKPLAEARGEIAYATSFIDWFAEEAKRIEGSVLQSPQGQQRLMVIKQPIGVCAAITPWNFPAAMITRKVGPALAAGCTMIVKPAEQTPFTALALAELAQQAGIPRGVLQVIVGDAQSVGKVLCDSPVVRKLSFTGSTEVGRILMAQSAPTVKKLSLELGGNAPFIVFDDADVDQAVKGILASKFRNSGQTCVCANRIYVQNGIYPTLVERLIEEVRKLNVGDGTQPGVTQGPLIDDDAVSKVEQHIADALSHGATLLLGGQRHERGGTFFTPTIVGDVTREMRFAREETFGPVAPLFRFSDEAEVIAMANDTEFGLAAYVYTRDAIRQWTVPEALDYGMVGINTGLISNEVAPFGGVKQSGLGREGSRFGIEDYLEMKYLCVDLSR

SEQ ID NO: 58424 - protein, 287 aa, Nocardia farcinica IFM 10152
MTTPVIAVLGSINMDLVTTTARRPAPGETVLGSGFDTVPGGKGANQAVAARRSGGRVEFLGAVGTDVFAPQLRGALESVGVGTAGLRTVPGPSGVASIVVDESGENSIIVVGGANAAMTALRETDRAMIAAADVLVCQLEIPVPTVAAGLRHARANGTTVLLNPSPAQDLPPQLWADVDVAVVNRGEERQLGAVLDRVPHVVVTLGGAGARYRGPDGAELAVPGVPVEVVDTTGAGDAFTGALAVTWRHGPAAALRWACAAGALATTRLGASASIPERAAIEDLLAR

SEQ ID NO: 58425 - protein, 515 aa, Candida albicans
MTTFWSQTINRQNGGVATATATATATAATTTPTAGGTGAGTTTSTKGMITPTPFNIDINNDLNDFDGKFIETFKPDLELQKKYRSFIQREGALSFPRTEITQSMSKRDICALILNLGYPKKAVEDYPILTLKELAYILLKLMLTDSAQLEPKVEIDENDNKNDGTNNSDIDSNSDMDSQSESGELGDAMDVDDSLPENEDEYDQDMSTTTLKRTINMTPFKYKLPDLISDLSRAKKIMVVTGAGISTSLGIPDFRSFKGLYNQLSKLNLSDPQKVFDLQTFMREGRLFYTIAHLVLPPDGKFSLLHAFLKLLQDKHKLLRNYTQNIDNLEQRAGLKSEKLVQCHGSFAKAKCVSCQGIFAGEKIYNHIRRKQVPRCAICWKNTKQAPIHFGAIKPTITFFGEDLPERFHTLMDKDLQQIDLFLVIGTSLKVEPVASIIERVPYKVPKILINKDPIPNRGFNLQLLGLCDDAVSYLCKCLKWDIPHADFNNNDELKLSKLKNGDWEIVNKSTSTKK

SEQ ID NO: 58426 - protein, 192 aa, Triticum aestivum
  misc_feature (36)..(36): Xaa can be any naturally occurring amino acid
  misc_feature (70)..(70): Xaa can be any naturally occurring amino acid
  misc_feature (148)..(148): Xaa can be any naturally occurring amino acid
RRPTPSVPGSRSNNTLPWSPAVMASSATTGAPFQGXKSTAGLPVGRRSSGSLGSASHGGWIMCMQVWPIXGIKKFETLSYLPPLSTEALLKQVDYLIRSKWVPCLKFNKVAFLFREHNSFPGYYDGRYWTMWKLPMFWCTDTTQVLNXEVEDVKKEYPDSYIRVIRLDNLRQLQCVIFIAFRPSGCEEYDKA

SEQ ID NO: 58427 - protein, 220 aa, Arabidopsis thaliana
MALELWQTLKEAIHAYTGLSPVVFFTALALAFAIYQVISGWFASPFDDVNRHQRARSLAQEEEPPIPQPVQVGEITEEELKQYDGSDPQKPLLMAIKHQIYDVTQSRMFYGPGGPYALFAGKDASRALAKMSFEEKDLTWDISGLGPFELDALQDWEYKFMSKYAKVGTVKVAGSEPETASVSEPTENVEQDAHVTTTPEKTVVDKSDDAPAETVLKKEE

SEQ ID NO: 58428 - protein, 394 aa, Xanthomonas campestris pv. campestris str. ATCC 33913
MDSLLSPVSGYSRRSQDIAPFHVMALLARANALEQAGHDVIHLEIGEPDFTTAAPVVAAGQAALAAGHTRYTAARGLPALREAIAGFYAQRYGCHIDPERVLVTPGGSGALLLASSLLVDPSKHWLLADPGYPCNRHFLRLVEAGAQLVPVGPDSDYQLTPALVDACWTADSVGALVASPANPTGSVLSRAQLAALSQALQARGGHLVVDEIYHGLTYGLDAHSVLEVDDSAFVLNSFSKYFGMTGWRLGWLIAPPSAVPELEKLAQNLYISASSIAQHAALACFTPESIAIFEARRAEFQQRRDYLLPALRALGFDIAVEPQGAFYLYADISAFSKDAQAFCTHFLETEHVAFTPGIDFGFHRANQHVRIAYTQSLPRLEQAVERIARGLRHI

SEQ ID NO: 58429 - protein, 539 aa, marine gamma proteobacterium HTCC2080
MLFDGPELAKTAANHTPLSPVSILKRVERVHPNLPAQVHGSIRRNWGEVAARCKRLASALAKRGVSKGDTVALIAPNIPEALECALAVPMLGAVLNANNMRLDASTLGYILEHGEASVLLVDTEFSAVAAEAVRLSGRELLVIDIEDTEGPGGACIGALTYEALLAEGSEDFAYALPDDEWDALALNYTSGTTGHPKGVVYSHRGAWTNSVNNVVTWEMPHHPTYLWTLPLFHCNGWCFPWTITLLAGTHVFMRGPTAKGIYAAFAEHGVTHLCGAPIIMSMIASAPNDERQPFDQKVRMMTAAAPPPAPVIEAMEQMGIAITHVYGLTEVYGPAVVCAEKPEWAALPLDEQSKLKARQGVAYELEEDVLVLDPETSLPVPLDGETQGEVVFRGNIVMKGYLKRPEETDAAFRDGWFWSGDLAVQHPDGYIEIRDRAKDIIISGGENISSIEVENALHTHPAVDFVAVVAMADEKWGETPCAFVELVEGSTATEQELLDHARALLAGFKRPKKVVFGPLPKTTTGKIRKNELRDRLRNI

SEQ ID NO: 58430 - protein, 391 aa, Alkaliphilus metalliredigenes QYMF
MKHRFLAKRYWNTMTTPMGAVVDLAKQYSDVINLSLGDPDYVTNQEVIQRAFEDAENGHTHYTDSLGDEELRHEIIKYYEEAYEYKVGSKEVMAVVGACHGMYLALEAILDDGDEVIIPAPYFTPYIQQVELVRGKPVILDTYEEDGFQIDINRLKGLINHRTKAIIINTPNNPTGACFSKETLEAVGKVAKEFDLLIIADDIYDAFTFSDPFLPATTMKGMQERTITIGSFSKDYAMTGWRVGYVLAPDFIIQCMRDINEGICFTVPSISQRAAIYALRMRETIQPPMIAEYKKRMYYAYERINAIPNMSVLSPQGSFYLFVNIKKTGLNSVDFCKELLEEAHVLAIPGIAFGGCGEGYIRLACTVGVAALKEAFDRIEKMKVCCAHNLQ

SEQ ID NO: 58431 - protein, 523 aa, Zea mays
  misc_feature (510)..(510): Xaa can be any naturally occurring amino acid
MDDDVVVAAAAAAAAAAASSSPSPPWSLLQGLLALLVAWGAYRAAQTFWLRPRRLGRALRAQGLTGTAYRFPAGDLKENARLNDEARSRPMQPPCSHDVVPRVMPHLFNTVKDHDAELQATSVSTWLGPIPRVVITEAELVRDILSNKFGHFEKFTNKSLGKMIALGVASYDGEKWAKHRRILNPAFHLEKLKRMQPAFLTCCTELIDRWDKEVAGGSDGSFELDVWPEFQSLTGDVISRTAFGSSFMEGRRIFQLQAEQAERVIKAFQYIYIPGFVFFPTPNNRRMKEINREIEGTLRGMIDKRERAIENGEASGDDLLGLLLQSNMESGKGGLRMSTEDVVEECKLFYFAGMETTSVLLTWTLVILGMHPEWQDRAREEVTMILYEVLRLYPPAVTLNRRTFKDMQIGGITYPAGVILELPVIVVHHDPDVWGKDAHEFRPERFAEGISKATKDQQPAFFPFGWGPRICIGQNFALLEAKMALSMILQRFQFRLSPSYTHAPYTVLLXHPQHGAPIIFDRI

SEQ ID NO: 58432 - protein, 180 aa, Arabidopsis thaliana
  misc_feature (77)..(77): Xaa can be any naturally occurring amino acid
  misc_feature (97)..(97): Xaa can be any naturally occurring amino acid
  misc_feature (106)..(106): Xaa can be any naturally occurring amino acid
  misc_feature (114)..(114): Xaa can be any naturally occurring amino acid
  misc_feature (148)..(148): Xaa can be any naturally occurring amino acid
  misc_feature (154)..(154): Xaa can be any naturally occurring amino acid
SHQRIQCNQRQIEQADVVDEADIQLEFCQGGYEQVCATSNMGAGTEEGDDRKDRVNRGSEFRKQWLARNQRLLDLLXHKRSTVLGCQEVGVGAEELXSVYHHQVSXSGHVNHQXPESSGCGDGLSASIHPGPEIVVTCRQQLPNGKGXRVDKLXHVRTQTPTLLEGKQDVQQEVQTEITH

SEQ ID NO: 58433 - protein, 250 aa, Brassica napus
  misc_feature (243)..(243): Xaa can be any naturally occurring amino acid
MAMASLYRRSLPSPPAIDFSSSEGKKIFNEALQKGTMEGFFRLISYFQTQSEPAYCGLASLSVVLNALSIDPGRKWKGPWRWFDESMLDCCEPLEVVKEKGISFGKVVCLAHCSGAKVEAFRTNQTTIDDFRKFVMKCSTSENCHMISTYHRGVFKQTGSGHFSPIGGYNAERDMALILDVARFKYPPHWVPLKLLWEAMDSIDDSTGKRRGFMLISRPHREPGWLYTLSCKDESWISIAKYXKEDVPRL

SEQ ID NO: 58434 - protein, 218 aa, Glycine max
MDSDSWISTRLSSSSRRHHYRSDLYAEESEGNDDFRAEFLCPFCAEDYDVVSLCCHIDDHHPIQAKNGVCPICGKKVGVDLVGHFTTQHGNFLRISFLQRKRRVRKGGSASTISILRKELQEGALQSLLGGSSYLASSNSEPDPLLSSFMFNPVVADESVSATPPSTEDALVKESSKDDFLKRKPQQLQLSEEDQVEKARRFEFVQGLLMSTILDDKL

SEQ ID NO: 58435 - protein, 479 aa, Oryza sativa
  misc_feature (202)..(202): Xaa can be any naturally occurring amino acid
MELGVPLPRRPVPGSYGVPFVSAVRDRLDFYYLQGQDKYFESRAERYGSTVVRINVPPGPFMARDPRVVALLDAKSFPVLFDVAKVEKRDVFTGTFMPSTSLTGGYRVCAYLDPSEPNHAKIKQLLLSLLVSRKDAFVPVFRSNFGALLDTVQSQLASGGGKSDFTALNDATSFEFIGKAYFGVRPSASSSLGTGGLDQGRXLWLLWQLAPLTTLGLPMIIEDPLLHTLPLPPFLISSDYKALYAYFAAAASQALDAAEGLGLSREEACHNLLFATVFNSYGGFKLLLPQILSRVAQAGEKLHERLAAEIRSAVADAGGNVTLAALEKMELTRSVVWEALRLDPPVRFQYGRAKADLEIESHDASFAIKKGEMLFGYQPCATRDPRVFGATAREFVGDRFVGEEGRKLLQYVYWSNGRETENPSVDNKQCPGKNLVVLVGRLLLVELFLRYDTFTAEAGKKVVITGVTKASTSAVNRTA

SEQ ID NO: 58436 - protein, 406 aa, Oryza sativa (japonica cultivar-group)
MLRLSCCRPTAGGGLAGAMLHLLPLLRARAATHLPTSSLDLSRRRRLLLSTAARSAAATPFSVEEYLVDTCGLTGAQALKASKKLSHLRSPAKPDAVLAVLSGVGLSRADLAAVVASDPQLLCARADNIARRIASLRDRVGLSDPQIGSFLLAGGAKGIHACDVASRLEFWIPFLGSFETLLRILKGNNVLVLSDLEKVIKPNIALLQECGLTVCDIAKMARFAPRMFTSNPKQVEGFVRRADELGVPRTSGQFKYMVGIFANISEGSATARMEYLSRSLGCSMDKLRSAVQKLPQILGLSETNLGSKIEFLVGKVRLEPEYLLKTPKLFTYSLEKRLVARHYIVQVLAAKGLKGLKKDVPFCSYVQLGESCFVKNFIDQHENVVPGLSDAYAALRAGKVPPEVQH

SEQ ID NO: 58437 - protein, 117 aa, Zea mays
MASFAVATAPSLAAPAAKRRPAAGVTYVEGMNAYSGLKGLNKVTMLGVRKTADYSFAKVVASLSPAGRKRRGGAFGAQMNAAAEIFRIAATMSGLVLVGVAVGFVLLRVEAAVEEAE

SEQ ID NO: 58438 - protein, 151 aa, Glycine max
  misc_feature (37)..(37): Xaa can be any naturally occurring amino acid
SCFPFTPLVGFILFVVWTIIFFFVCFFLHYLLQPIIXEHASLDNLVLTDADGQGVLYMNREQLEELRVKPLSASSASKRTLVPALNMRLWYAPHLELPTGVVLKGATLVAIRPSELSPNTAKKEASDLSSVSTAFEEPYRTTAEMPTLDNL

SEQ ID NO: 58439 - protein, 437 aa, Cryptococcus neoformans var. neoformans JEC21
MSRLAPRLATAACAVRQPAATRAIAAAFAAPLTKQIRGYRSQPMRDVMTGEIIQLPDIDPSTVKVDLTTHAKSRLPNSKLVFGHTFTDHMLTIPWSSRSGWGTPHIKPYGPLELDPSSTVFHYAFTLFEGMKAYRQEDGTIRLFRPDMNMARMNRSAARIALPHFDSKALIELIKKLVILDSEWIPKEKGYSLYIRPTLIGTQNALGVGPSSDALLFVICSPVGPYYASGFKPVQLLATTKFVRAAPGGTGGYKLGANYAPGVVPQAEAAKEGYSQNLWLLGPEHALTEVGTMNLFVALKKADGSVELVTPPLDDVVLPGVTRDSALQLAREHASGKTPIPGLPEKLVVSERKLVMADLVEAEKNGTLVEVFGTGTAAIVSAVDKIGYEGRDIIIPTGPEGLGNIAKGILDRITAIQTGEIEHPWSVIANDVSSSNF

SEQ ID NO: 58440 - protein, 495 aa, Arabidopsis thaliana
MILITLCLTTLLALLLKSILKRTATKNFNLPPSPWRLPVIGNLHQLSLHTHRSLRSLSLRYGPLMLLHFGRTPVLIVSSADVAHDVMKTHDLVCANRPKTKVVDKILSGGRDVAFAPYGEYWRQMKSICIQNLLNNKMVRSYEKIREEEIKRMIEKLEKASCSSSPSPVNLSQILMTLTNDIICRVALGRKYSGKKDGIDVENIVRTFAALLGEFPVGEYIPSLSWIDRIRGLDHKMEVVDKRFDEFLERVVKEHEEADKETRSDLVDKLLTIQSDKTGQFELEKSALKLIIWDMFLAGTATTLSFLEWAMTELMRNPKVMKKLQEEIRSSSPQDLFVTEKEAEKMNYLQAVIKEALRLRPPAPLLVPRVLSEDVKLKGYNIPAGTQVIVNAWAIQRDTTTWGTDAEEFKPERHLDTNLDFQGQDFKFIPFGSGKRICPGIGFTSALIGVTLANIVKRFNWRMDVEPQRVQHDLTEATGLVVFRKFPLIAIPSSA

SEQ ID NO: 58441 - protein, 298 aa, Secale cereale
FSLAPLVPRLSELLGIEVKKAEDVIGPEVEKLVADLANGAVLLLENVRFYKEEEKNDPEFAKKLASLADLFVNDAFGTAHRAHASTEGVTKFLKPSVAGFLLQKELDYLDGAVSNPKRPFAAIVGGSKVSSKIGVIESLLEKCDILLLGGGMIFTFYKAQGLSVGSSLVEEDKLELATSLLAKAKAKGVSLLLPSDVVIADKFAPDANSQTVAASAIPDGWMGLDIGPDSVKTFNDALDTTQTIIWNGPMGVFEFDKFAVGTEAIAKKLAELSKNGVTTIIGGGDSVAAVEKVGVADV

SEQ ID NO: 58442 - protein, 1551 aa, Venturia inaequalis
MAYAGTKGDGIIRTASGHETYAPDGLGTPQREYEEEIAPSEDPSRATSERYAPITGHLYRRNSSDTEKGSDEDFTMATRSKSFTENMDTDDKDKLNRILTSLSQHQTRSSTLRRNDTISGLKEDDPVFDPSHKDFDLYKYLRLFMRDLQADGRETKKAGIVFRNLSVSGSGAALQLQSTVSDFVLAPFRLRELFSSSKSHKQIIDKFDGVLKSGELLIVLGRPGSGCSTFLKTLCGELTGLTVDKGSVIHYNGIPQKKMIKEFKGEVVYNQEVDKHFPHLTVGQTLEFAAAVRTPSNRLHGESRTEFSSQVAKVVMAVFGLSHTYNTKVGNDFVRGVSGGERKRVSIAEMAVAGAPLAAWDNSTRGLDSATALKFVEATRISADLTGSSHAIAIYQASQAIYDRFDKAVVLYSGRQIYFGPASKAKQFFEEQGWYCPKRQTTGDFLTSITNPSERRPREGMEKQVPRTPEDFEKYWRNSEMYQSLQKEIEDHETEFPIGGETLGKLQQQKRNAQASHTRPKSPYMISVPMQIKLCTKRAYQRIWNDMSSTLTMFISQIIMSLIIGSVFYGTPNATAGFFSKGAVLFFAVLLNALVAMTEINSLYDQRPIVEKHNSYAFYHPATEAIAGIVSDIPVKFLLAVGFNVIFYFLAGLRREPSQFFLYFLVSYVIMFVMAAVFRTMAAVTKTISQAMSLAGVLVLALVIYTGFVIPVSYMKPWFGWIHYINPIYYAFEILIANEFHGRDFTCSAIIPAYTPLQGDSWICSIVGAVPGRRTVSGDDFIMQMYQYSYSHVWRNFGILLGFLCGFMCIYFVGVEVNSSTSSAAEFLIFRRGYVPAYMQDDPKHAGNDEEKMADGTTDAKEDGGDVSAIPPQKDIFTWRDIVYDIQIKGEDRRLLDHVTGWVRPGTLTALMGVSGAGKTTLLDVLAQRTTMGVITGDMLVNGKPLDASFQRKTGYVQQQDLHLETATVRESLRFSAELRQPKTVTLQEKFDYVEDVIKMLNMEDFAEAIVGSPGEGLNVEQRKLLTIGVELAAKPKLLLFLDEPTSGLDSQSAWAICAFLRKLADAGQAVLCTIHQPSAILFQEFDRLLFLAKGGKTVYFGPVGKNSETLIDYYESNGARKCGEEENPAEYMLEIVNKGSSGQGQDWHEVWKGSKEREAVNEELKQIHKEKEGEAIAGANEEGAQDEFAMPFTAQVKAVTVRVFQQYWRMPSYVFAKWALGIASGLFIGFSFFQANTTQQGVQNVLFSAFMIATIFSSLVQQIMPLFVNQRSLYEVRERPSKAYSWKAFMIANIVVEIPYNIFLGVPVFACYLYAIAGIISSVRQVLILLLMIQFFVYAGTFAAMCIAALPDAETAAAVVTLLFATSLTFNGVMQSPQALPGFWIFMYRISPFTYWISSLVSTMLHGRRIECSSSETSRFSPPAGQTCQQYLADYLQTAPGTLQNPNDTTNCRYCSLSTADQLLAGSNVKYDTRWRDFGIVWSYVIFNIFVAVLTYYLFRVKKWNKGTGKSDGAKKAGFLGKILKKGANKGNDAKTEKGEQQANQHQRAI

SEQ ID NO: 58443 - protein, 298 aa, Hordeum vulgare subsp. vulgare
FSLAPLVPRLSELLGIEVKKADDVIGPEVEKLVADLANGAVLLLENVRFYKEEEKNDPEFAKKLASLADLFVNDAFGTAHRAHASTEGVTKFLKPSVAGFLLQKELDYLDGAVSNPKRPFAAIVGGSKVSSKIGVIESLLEKCDILLLGGGMIFTFYKAQGLSVGSSLVEEDKLELATSLLAKAKAKGVSLLLPSDVVIADKFAPDANSQTVAASAIPDGWMGLDIGPDSVKTFNDALDTTQTIIWNGPMGVFEFDKFAVGTEAVAKKLAELSKKGVTTIIGGGDSVAAVEKVGVADV

SEQ ID NO: 58444 - protein, 316 aa, Arabidopsis thaliana
MISDSIPKELILEIMLRLPAKSIARFHCVSKQWASMLSRPYFTELFLTSSSTQPRLLFAIKRNGLWCFFSLPKHQSPYDNSSSSLVVAADFHMKFLPNKIQMYSSSENRKLSCCYASGLIYYDDVTDDAMKLRVWILVDVEEQEWLKYAYSLRDDKFFTHDVFVVRVTATEMNTIQRVEIQGFGECQHEYDYYRSRVVYVFADHVEDLDVNDPKLLESKSEEEEEEEEEEEEEEEEEEEEEEEEEEEEESKEREKEKKIETVIGDIFLPKNKNGSEKKMLKKRKITATATTNHHTCFSRRKNVKNLHRCNRLIKLS

SEQ ID NO: 58445 - protein, 1489 aa, Venturia inaequalis
  misc_feature (846)..(846): Xaa can be any naturally occurring amino acid
MGPDGPAPAHARGIEKESLQNPHSHDGTIADLTDEKESQSSHEGHERTWGAIQSPTSVNVSSAEAQFAELSKELSRNSHKDRLSRQQSHQSRRTISKNVDQEKTIGLSDSASSDSSEPFDLEAILRGNKREDEAAGIKTKKIGVVWEGLSVSGIGGVKNYVKTFPWAFVSFLNVYETAKGILGVGKKGKEFQILRDFGGVVKPGEMVLVLGRPGSGCTTFLKVIANQRFGYTKIDGEVMYGAFGSEEFSKRFRGEAVYNDEDDLHHPTLTVGQTLDFALETKVPGKRPAGLSRPDFKNKVIDLLLNMFNIAHTRNTIVGNPFISGISGGERKRVSIAEMMVTGATVCSWDNSTRGLDAATAVDWSRSIRVLTNIYKLTTFVSLYRASENIYEQFDKVMVIDEGRQVFFGPANEARGYFESLGFLEKPRQTTPDYLTGCTDPFEREYKDGRSSDNAPNSPDTLAEAFKNSKYHAQMKETMDTYKEQIGKEKEVYDDFQLAFKESKRHTSGRNVYTIPFYLQVWALMKRQFLLKWQDKFSLSVSWITSIVIAIVVGTVWLDIPTSSAGAFTRGGVLFIALLFNAFQAFSELASTMMGRPIVNKHRAYAFHRPSALWIAQIMVDMVFSSAQIMVFSIMVYFMCHLVRDAGAFFTFYLMIVSGYLAMTLFFRTVGCLCPDFDVAIRLAACIITLFVITSGYIIQWQSQQLWLRWIFYINSLGLGFAALMMNEFKRIDLTCEGTSLVPPGPGYTDLNHQVCTLAGSVPGQARVSGSAYIGSAFSYDPSDLWGYWGITIGLIIGFLLANAFLGEFVKWGAGGRTVTFFAKENKETKKLNEELTRRKDSRQKXETQGSSELNITSKAVLTWEDLCYDVPVPSGQLRLLNNIYGYVKPGELTALMGASGAGKTTLLDVLASRKNIGVITGDVLVDGIAPGIAFQRGTSYAEQLDVHEPAQTVREALRFSADLRQPYETSQEEKYAYVEEVISLLEMESIADAIIGEPENGLAVEQRKRVTIGVELAAKPELLLFLDEPSSGLDSQSAFNIIRFLRKLSAAGQAILCTIHQPNSALFENFDRLLLLQRGGQCVYFGDIGKDASVLREYFAKSGAHCPPKANPAEWMLDAVGAGMAARIGDKDWGEIWKDSDEFAQAKAEIVRLKAERTKAIGDLAPVEQKEYATPMWHQIKLVCKRQSLSFWRTPNYGFTRFFNHVAIALITGLAYLTLDDSKTSLQYRVFIIFQVTVLPALILAQVEPKYAIARMISYRESAAKAYKTFPFALSMVIAEMPYSVLCAVGFFLPIYYIPGLNSASSRAGYQFLIVLITELFSVTLGQMIAACTPSPFISALVNPFIIITFALFCGVTVPKPQIPGFWRAWLYELDPFTRLIGGMIVTELQDLPVQCTPQELNAFTAPAGQSCGEYMSAFFQTGGAGYLVNNATSNCEYCAYTSGQQFFQPLGYEFAHRWRDLGIFAAYIGSNLIILFLAARFLNFNKR

SEQ ID NO: 58446 - protein, 298 aa, Zea mays
FSLAPLVPRLSEFLGIQVIKADDVVGPEVEKLVSALPNGNVVLLENVRFYKEEEKNDPEFAKKLASLADLYVNDAFGTAHRAHASTEGVTKFLKPSVAGFLLQKELDYLVGAVSNPKRPFAAIIGGSKVSSKIGVIESLLEKCDILLLGGGMIFTFYKAQGHSIGSSLVEDDKLELATSLLRKAKEKGVSLMLPFDLVVADKFAPDASSQVVPASAIPDAWMGLDIGPDSISAFSSALETTQTVIWNGPIGVFEFDKFAVGTKAIAKKLAELSGKGVTTIVGGGDSIAAVEKVGVADS

SEQ ID NO: 58447 - protein, 468 aa, Arabidopsis thaliana
MLSFCYSSLKGCFSVTISLVLNISFNISLSLCVGSANRTFMVSVSLPKELILEILKRLPAKSVKRFHCVSKQWASMLSCPHFRELFLTRSSSAQPRLLFAIEKHNQWSLFSLPQRLTPYEKSSSSSVVVTPEFHMKFPPDGMLIYPRHDRRFSFGYASGLMYFYGMWINEHDYDGVPVICNPLTGRYASLPFLERYRKAFSFFGFDPIEKQYKVLFMAYPSGPDHHTVLTFGTGEMSWRKIECSVKHDIVSDGICINGVMYYLGDTSEFMTAFVVVCFDVRSETFSFIYPGSYCEVINYKGKLGLVFCDDYTDDAIELRLWVLEDKEKIEWSKYAYKLKDEKFSAHYVSIVGVSAAGEIVLSMADFTSKQPFYVFYYNPERNTLQCTEIQGFEEHHGTFDRRSRVRVFVDDCSSFYRFADHVEYLNVDEPKLLKSKIYDGPNAKIEWEEEEEEDEDEDQEKEEEDQWS

SEQ ID NO: 58448 - protein, 532 aa, Arabidopsis thaliana
MYNKLQNLRHETRSVEEYAEEFYLLLTFNDINDSQTQLVSRLIGELRSQLQNSLSQFDPTTVSEAHRRAASFEKQMRSASWNFTNTRPRSLEQQTPPTNIASREGDEQIKIVTRNTNDEQGLRRSARTENGTIKKFTRSFTYKHLTPYEKSSSSSLVETAEFHMKFPPDGMQIYPRNDRRFSCGYASGMMYFYGMRIKEDDYDGVPVLCNPITGHYATLPAIARFRQAFSFFGYDPIDKQFKVLFMIMAYPCSPDHHKVLKLGSGEMSWRRLKRTLRHEIMSEGICINGVVYYLGDTSEVLTSFVVVCFDVRYETFSFLYPGSYCELINYKGKLGLVFYDDYDGDTIKLRLWVLEDEEKNEWSKYAYVLWDDIFLAHYVSVVGVTATGEIVLSMADYTSKQPFYIFYYNPEMNTLQCVEIRGFGEYHEASGNRSRVCVFVDNVFEKDCSRFYALADHVEDINVIDSKLLKSKIYEDTYPNLEDYEQSDHDETSDDEESLRSYNYSYKPYMYAGEEERRKRSRRTRRSTIRRR

SEQ ID NO: 58449 - protein, 221 aa, Psychrobacter arcticus 273-4
MTVNSTAPSQDQIPASSSGHNLHGRPERIATVERITAETQVTCTVNLDGTGQGTVDTGVPFLDHMIDQIKRHGLFDLDIKCTGDTFIDDHHSVEDTGITLGQAFNKALGDKKGIRRYGHFYAPLDESLTRAVVDLSGRPGLHMEIPFTRSHVGTFDVDLFSEFFYGFVNHSWMTVHLDNLKGKNSHHQIESTFKAFARALRMACEYDERALNTLPSTKEAF

SEQ ID NO: 58450 - protein, 388 aa, marine gamma proteobacterium HTCC2080
MSDIYPIAVPKWGIEMVEGTITTWNKSQGDAVAKGDEVFEMESDKIVNVWEAPVDGVLRRVLAEPGDAHPVGALLGVIAPAAVSDGDIDTFIAGYAGDDAKEAPAQATAEPAKPVAQTSDAYTRSSPSVRKLADELNVDLSTVTGTGRRGRITDNDVRDAAGGNDEAVGVQVIPLSPTRKTIARRLTEAKQTIPHFYLSADYALDGLMAHRQTLNGSGDTKVSVNDLLVWCVGQALMREPRVNVNLVGDDIHQFEAANIAVAIATDDGLYPATIPGVEAKSPAEVAQATGALAEKARSNSLTKEDISGGSFTVSNLGMYGISEFTAIINPPMGAILALGKAEPKVVVKDGEQSIATVLTATLSCDHRVIDGAVGAQFMAALRDVIDGL

SEQ ID NO: 58451 - protein, 333 aa, marine gamma proteobacterium HTCC2080
MSQKTMRDAINEALHQAMEQDESVFVIGEDVAGCQGSAGEVGAVGGVFGVTTGIYKRWPDRCIDTPISESAIVGAAAGAALVGMRPVAEIMFADFIGVCMDQIVNQMAKFRYMFGGKSRCPAVIRFSAGGGFSAAGQHSQAMYQIMTSFPGIKVVVPSNAYDAKGLLLSAIADDDPVLFFEPKVLYQEACDVPDEMYTIPFGEAAFVREGDDVTVVAFGQMVPRAAAAIDELAAEGISCDLIDPRTTSPLDENAILESVEATGRLVVVDEAPPRCGLTADIAGLAADRAFSSLKGPIKQVCAPHSPTPFSPELEAAYLPDTNKIKAAIKATMA

SEQ ID NO: 58452 - protein, 230 aa, Psychrobacter arcticus 273-4
MDKQLLIFDFDGTLIDSVPDLADAVNAMLTTLGKAPYPIDTIRNWVGNGSRMLVERALVGKIEVSEGELAKETIDHAEQVFFDAYSKMGGSKTVAYPNVDSGLKKLKAAGFKLALVTNKPIRFVPKILQFFGWHDIFSEVLGGDSLPTKKPDPAPLLHVCEVLNINPAQAVMIGDSINDILAGQNANMDTLGLSYGYNYGQDIRQLNPTEAFDDFSALVDYLLKAYPANN

SEQ ID NO: 58453 - protein, 326 aa, marine gamma proteobacterium HTCC2080
MSIPTEALSDAYRLMKTIREFEERVNAEIMNGQIPGFTHLYTGQEANAVGVCAHLDTDDTIISTHRGHGHCIAKGADVSGMMKELFGSSEGLCKGKGGSMHVADIDKGILGANGIVAGGPPISVGSALAAKIRKNGKVAVSFSGDGSVNQGTCFEAMNMAVVLKVPAVFVIENNYYSEHTNISYAVGCDDLKARTEAFGFPVFVADGADFFAVHEAAGKAIAHARAGNGPAGVFAEQGRYHGHFVGDPQHYRGEGELDDLRENRCCLKNFRARMLESGEVSEDVLDGIDAEVMALIEQATIDAKAAARPTPDQVTEDVYINYGAGA

SEQ ID NO: 58454 - protein, 440 aa, Gibberella zeae PH-1
MDVNSKIVVIGAGLFGLTTAKQLMLEGHQDITVIDRHMPPVPDGSSSDISRIIRFDYGDSDYCSLAYEAYQKWSQDAKYKGIFYPSEYIIAGSRSTTEKSWTDKTIAQLKKRQLPYTTLPDAATTKKQFPILTGDLAQPNFEGYLNKSGGWADANKAIKQLRDECLELGISFISGRAGTVVGFDSDAHGVIKAVRIVGGTPIAGDHFILAAGAWSSGLVPTYNSTLSTAQALGFLRLTDAEMIKYKDLPIYVNYSTGWFNFPPHEDTKMLKFAVHGWGYTRAPSTGDNNAVASNISVPPPVSRERKNFVPADAEQRLRAGLREILPELADRELERAALCWYTDTPTGDFIMDYHPDYKNLFVGGGGSGHAFKFLPVLGKYMAAAIKKTLPSDLANKWRFHTEFQHREDTFLGDGSRGGPARRELNAVEKAKLDGEERAKL

SEQ ID NO: 58455 - protein, 379 aa, Streptococcus agalactiae NEM316
MNNTEFYDRLGVSKDASQDEIKKAYRRMSKKYHPDINKETGAEEKYKEVQEAYETLSDTQKRAAYDQYGAAGANGGFGGFDGGGFGGFDGGGFGGFEDIFSSFFGGGGMRNPNAPRQGDDLQYRVNLSFEEAIFGAEKEVSYNRESSCHTCSGSGAKPGTSPVTCQKCHGSGVINVDTQTPLGTMRRQVTCDVCQGSGQEIKEKCPTCHGTGHEKKTHKVSVKIPAGVETGQQIRLTGQGEAGFNGGPYGDLFVIINVLPSQQFERNGSTIYYTLKISFVQAALGDTIDIPTVHGAVEMSIPAGTQTGKTFRLRGKGAPKLRGGGQGDQHVTVNIVTPTKLNDAQKEALHAFAEASGDKMVHPKKKGFFDKVKDALDVD

SEQ ID NO: 58456 - protein, 334 aa, Arabidopsis thaliana
  misc_feature (148)..(148): Xaa can be any naturally occurring amino acid
MENHTTMKVSSLNCIDLANDDLNHSVVSLKQACLDCGFFYVINHGISEEFMDDVFEQSKKLFALPLEEKMKVLRNEKHRGYTPVLDELLDPKNQINGDHKEGYYIGIEVPKDDPHWDKPFYGPNPWPDADVLPGWRETMEKYHQEALXSHLWRVSMAIARLLALALDLDVGYFDRTEMLGKPIATMRLLRYQGISDPSKGIYACGAHSDFGMMTLLATDGVMGLQICKDKNAMPQKWEYVPPIKGAFIVNLGDMLERWSNGFFKSTLHRVLGNGQERYSIPFFVEPNHDCLVECLPTCKSESELPKYPPIKCSTYLTQRYEETHANLSIYHQQT

SEQ ID NO: 58457 - protein, 592 aa, Xylella fastidiosa 9a5c
MSFSKHFGKLMLATCLSLSAAPVFSYSISHGKVIDDKGNQIQLKGGSWFGFETTNHVVHGLWTRNWKEFITQIQSMGLNAVRLPFCPASLNSNTSPSSIDYNRNPDLQGLSSLQIMDKVVKELSDRGIYVLMDHHTPDCAAISELWYTDSYSEKQWIDDLRFVAHRYANVPGVIGLDVKNEPHGRATWGTGDPKTDWNTAVEHAAAAILEAAPKWLIGVEGIGENPSCSSTIGHFWGENLEPMDCTPLKVPADHLLLIPHVYGPDVYVQPYFNSPDFPNNMAAIWDKHFGHFAKAGYAMAIGEFGGKYGEGDPRDVAWQNALVDYLISIGVTDTFYWSINANSSDTGGLFRDDWNHVREDKLTLLKKLWNGKDGSGGGGGSGGGSGSGGGSGSGGGSGSGGGSGSGGGSGSGGGSGSGGGSGSGGGSGSGGGGGSGGGSGSGGGSGSGGGSGSGGGSGSGGGSGSGGGGGSGGGGSGGGGGSGGGSGSGGGSGSGGGSGTGGGGSDPTKSKISVNTIVDSDWHTGYCERIQVTNISNSPTTWTVTISIRGNIQTLWSARWSVKGNALTASGMDWNKTLDPKGTTEFGFCSNY

SEQ ID NO: 58458 - protein, 454 aa, Rhodococcus sp. RHA1
MDVTELRARARRHLGPHFTRKDTWESDFPVFVRGEGSYLIDTEGDRFLDGLAGLFCVNIGHGRDDIAKAASEQIGTLAYASNWGSAHIPAIEASALIADLAPGDLGTTFFVNSGSEAVETAVKFARQYHRSQGNPQRTKIISREMAYHGTTLGALSVTQLPKIKDPFGPLLPGVRSVPNTLGYLGDCGPANELDCIAAIEAVIEEEGADTIAAVFAEPVQNGRGALVPPDGYWSALRALCDKHGILLVSDEVICSFGRLGHWFGHGLTGVVPDMITFAKGSTSGYAPLGGLIVREQLVRELYDSPKGGVFTHGATWGGHPVSTAVAVANITAMRDENVLGNVTARGPKLKSALDSLMSAHRCVKDVRGTGFFYAIELMADSDSGREFTEQESLTVLRKVLPEAFARTKVILRGDDRGATMLMISPPLVADDEVLSELLHGIDSMLTDIEKAIQP

SEQ ID NO: 58459 - protein, 259 aa, uncultured marine bacterium
QPNAMGGREVEGMANLLAAHRNLASADDRQEVADYWGVDKISDKPGLTATEMFKALESGEMKAVWIVCTNPLVSLPDARQAERALKNAKFVVVQDISSKSDTADYADLVLPAAGWTEKEGTMTNSDRRISYLPQINEAPGEAIPDTDIPLKFAKAMGWEGFDYDSTEAVFNEHRELTRGTNIDITGLSYDYLKTKGTAQWPFVEGATEGTKRLFEDKVCWTPNQRAQIHTSLAANQSEKLPLDHPPGMSSGRIRDQWHT

SEQ ID NO: 58460 - protein, 979 aa, Bacillus cereus E33L
MNNNMVHITIDGKKYTAEPSSTILGVINENGIEHPQICYVPEVDPIQTCDTCIVEVDGKLMRSCSTVVTEGMNIERNSTRAKEAQTEAMDRLLENHLLYCTVCDNNNGNCKLHNTAELMEIEHQKYPYEPKVDVSEVDMTHPFYRYDPNQCIACGQCVEVCQNLQVNETLSIDWEAERPRVIWDEGVNINDSSCVSCGQCVTICPCNALMEKTMLGEAGFMTGLKPDILEPMVDLIKEVEPGYSGIFAVSEVEAAMRDTRTKKTKTVCTFCGVGCSFEVWTKGRKILKVQPSSDAPVNAISTCVKGKFGWDFVNSKERITKPLIRKNGTFVESTWEEALNVVANKLGSIKEEYGKDAIGFISSSKITNEDNYVIQKLARQVFETNNIDNCSRYCQSPATDGLFRTIGMGGDAGTIKDIAQSGLVIIVGCNPTEGHPVLATRIKRAHKLHGQKLIVADLRKTEMAERSDVFISPKQGTDQVWLMAVTKYMIDQGWHNQRFIDENVNFFEDFKESLAEYTLEYAEEVTGISQETLIQMAEMIRDADGTCILWGMGVTQNTGGSDTSAAISNLLLATGNYRRPGAGAYPLRGHNNVQGACDMGTLPGWLPGYQHVTNDMERAKFEMAYGVKINSEPGLNNIEMLHAIDKGKMKAMYLVGEDMALVDSNANHVHEVLSSLDFFVVQDVFLSKTAQYADVVLPAAPSLEKEGTFTNTERRVQRLYQVLPTLGDAKPDWWIVQEVANKLGANWSYSHPSEIFAEMASLSPLFSQANYEVLEGWNSFHWGSFDGTNTPLLFQDGFNFPDKKARFAIADWVRPAEFPAEFDLHINNGRMLEHFHEGNMTNKSTGIQTKVPGVFVEISPALAKERGVKTGSLVRLVSPFGALKLRALVTDRVKANELYLPMNSTDNETAINFLTGPAVDTRTNTPAYKQTKVRMEVLEVDGENPMPKANPRNKKRHPQSGIEVHRKWARPGYVHLTDK

SEQ ID NO: 58461 - protein, 259 aa, uncultured marine bacterium
QPNAMGGREVGGLANQLAIHRGFDPDSIKLISEFWQTDNLATRPGLKAIELFEAVERGDIQVIWIMATNPVVSMPDNVFIQRALQKCPLVIVSDVTHDSDITQYADLLLPAAGWGEKQGMVTNSERMLTRQRKFLPSKGEAKPDWQIIAEVGKKLCQRLDKPNAFEFKSESSVFREYAAMTGLNKDTPLLLDLSKYAEISDEEYESWNPVQWGSSRPFADGKFSTENRKARFVVTTAPLIKGESRLWLNTGRQRDQWHT

SEQ ID NO: 58462 - protein, 117 aa, Alkaliphilus metalliredigenes QYMF
MDIIKGIDAAQLKKDIIDFNTGDTIKVHVRIKEGTRERIQVFEGIVIKRQGGGIAETFTVRRISYGVGVERTFPVHSPKIEKIEIVKHGKVRRARIFYLRDRIGKAAFKIKERKNFK

SEQ ID NO: 58463 - protein, 334 aa, Xylella fastidiosa 9a5c
MSIEQLAETAQAMVASGKGIIAIDESAGTIAKRFSSVGIENIEENRRAYRELLLTTPKLSDYISGAILFDETIRQSTKAGVPFPKYMADHGIIPGIKVDKGAYPLAGCPGELVTEGLDGLRARLEEYYKLGARFAKWRAVINIGDDIPSGMCIDANVHALARYAALCQEQGLVPMVEPEVIMDGNHDISAAYEVTEATLRSLFNALYEQNVVLEGTILKASMVIPGTDCEEQASIDEVAESTVMCLKSTVPAILPGIVFLSGGQTDAQSTAHLNAMNQLDPLPWPLSFSYGRAMQQAALKLWSQDMKGNFAKAQQVVYERAKENGLAALGKWKG

SEQ ID NO: 58464 - protein, 259 aa, uncultured marine bacterium
QPNAMGGREVGGLANQLAIHRGFDPDSIKLISEFWQTDNLATRPGLKAIELFEAVERGDIEVIWIMATNPVVSMPDNVFIQRALQKCPLVIVSDVTHDSDITQYADLLLPAAGWGEKQGMVTNSERMLTRQRKFLPSKGEARPDWQIIAEVGKKLCERLDKPNAFEFKSESSVFREYAAMTGLNKDTPLLLDLSKYAQISDEEYESRNPVQRGSSRPFADPKISTQNRKARVVVTTAPLIKGERRLWLNTGRQRDQWHT

SEQ ID NO: 58465 - protein, 513 aa, Vibrio sp. Ex25
MDFNLALKLYTAEQVKNGETLAAQMAGVSMYSLMQRAGMAVYERFLHLYPKSKNILVICGKGNNGGDGYVFASLAKQAQLNVQVFQLGDVTALKGDALRAYQDWQSIDGVNNDWDEWNTALLEADVIIDAMLGTGLSGEVRSEYRRYIEQINQIHTPVIAVDIPSGLCANTGAILGDAIHAEHTVTFIGVKQGLCTGQARDRVGELHFCGLGVNVEFASIEVESALGIDHQVVSRLMPKPNPTAHKGDNGKLLCVGGNQGMSGAIRLCSSAAVRSGAGLTAAITHPSSLVPLQIGCPEVMSQSITADLLRDTENDLTKRIRWAEVLVFGPGFGDDEWAYQAYQYLAQEQKPKVVDADGLNILAMLSQRCDGTLVCDNQRVITPHPGEAARLLNVTTQQIENDRYSAARQLQERYGGVVVLKGAGTLIYDGTRMYVCLAGNAGMATGGMGDVLSGVIGALLAKGLPISVAARLGVVLHSHAADINVSQHGQVGLLASDVIGTLRTAITQQIDRT

SEQ ID NO: 58466 - protein, 268 aa, uncultured marine bacterium
QPNAMGGREVGGLANQLAAHMDFATPNAIELVQRFWQAPNMDRKMVSRPIDMFQAVEQGKIKVLWIMSTNPMVSLPDTEQVRRALEKCELVIVSDCKQSTDTTAYADVLLPALPWSEKDGTVTNSERRISRQRGLLPARGEAKADWWAICQVAGAMGYQSAFSYRSVHDIFREHAALSGFENHGKRDFDISLFSNISEQAYQDLLPIQWPVTKESPNGTARMFTDGRFFTADRKANFIPIDVKEPQVAPDEDWPFVLNTGRVRDQWHT

SEQ ID NO: 58467 - protein, 268 aa, uncultured marine bacterium
QPNAMGGREVGGLANMLAAHMDIENPQHRQWVQEFWDSPTICTEPGLKAIDLFDSMDQGKAKAAWIMATNPLVSMPNRGKITPALENCDCAWCSDCVELNDTLALADVKLPATAWSEKEGTETNSERSISRQRAFKAAPGEAKNDWQIICDVAQKMGYSKGFDSQTPHQIFVEHARLSGVNNFGDRNSHILTLAGLSLQEYQRLKPVQWPVNKRYPDGCKRLFTYGRFFTPSGKALFIPLHPELPEQQTCRDYPLILNSGRIRDQWHT

SEQ ID NO: 58468 - protein, 641 aa, Bacteroides fragilis NCTC 9343
MNYGFVKVAAAVPRVKVADCKFNSERLEGLITIAEGKGVQILTFPEMCITGYTCGDLFAQQLLLEQAEMALIQILNSTRQLDIISILGMPVVVNSTVINAAVVIQKGKILGVVPKTYLPNYKEFYEQRWFTSALQVSENSVRLCGQIVPMGNNLLFETAETTFGIEICEDLWATVPPSSSLALQGAEIIFNLSADDEGIGKHNYLCSLISQQSARCISGYVFSSSGFGESTTDVVFAGNGLIYENGYLLARSERFCMEEQLIINEIDVECIRAERRVNTTFAANKANCPGKEAVRISTEFVNSKDLNLTRTFNPHPFVPQGNELNSRCEEIFSIQIAGLAQRLLHTGAKTAVIGISGGLDSTLALLVCVKTFDKLGLSRKDILGITMPGFGTTDRTYHNAIDLMNSLGVSIREISIREACIQHFKDIGHDLNIHDVTYENSQARERTQILMDIANQTWGMVIGTGDLSELALGWATYNGDHMSMYGVNAGIPKTLVKHLVQWVAENGMDETSKATLLDIVDTPISPELIPADENGEIKQKTEDLVGPYELHDFFLYYFLRFGFRPSKIYFLAQTAFSGVYDDETIKKWLQTFFRRFFNQQFKRSCLPDGPKVGSISISPRGDWRMPSDASSAAWLKEIAEL

SEQ ID NO: 58469 - protein, 304 aa, Dracunculus vulgaris
MGGHDSGRSDISFGGRFASSAFAACFAELCTIPLDTAKVRLQLQKKSVAGDGVSLPKYRGMLGTVATIAREEGLSALWKGIVPGLHRQCLFGGLRIGLYEPVKSLYVGEGFVGDVPLSKKILAGLTTGALAITVADPTDLVKVRLQAEGKLPPGIPRRYSGALNAYSTIVKQEGLGALWTGLGPNIARNAIINAAELASYDQVKQTILKIPGFSDNIFTHILAGLGAGFVAVCIGSPVDVVKSRMMGDSTYKSTLDCFIKTFKNDGPLAFYKGFIPNFGRLGSWNVIMFLTLEQVKKVFIKEAP

SEQ ID NO: 58470 - protein, 275 aa, Oceanospirillum sp. MED92
MTDRYAVFGNPIKHSKSPQIHAAFAESTAQDLTYEAICVAENEFAENVERFLSDNGRGLNITIPFKQEAWELAEVLSPRAKLAGAVNTLYRDDQERICGDNTDGIGMVRDIVRNNGGEIAGKRVLILGAGGAVRGVLQPVLEQKPARLVIANRTASKAEELATLAADLGEVTGTGYDTLEGQCFDLIINGTAASLQGEVPPLPEGILAKGGWCYDMMYSAEPTAFCLWAQDNCAEKAIDGLGMLVEQAAQSFLIWRGVEPDSQAVIKQIREALTA

SEQ ID NO: 58471 - protein, 555 aa, Zea mays
MGSVDAAIAVPVPAAEEKAVEEKAMVFRSKLPDIEIDSSMALHTYCFGKMGEVAERACLIDGLTGASYTYAEVESLSRRAASGLRAMGVGKGDVVMSLLRNCPEFAFTFLGAARLGAATTTANPFYTPHEVHRQAEAAGARLIVTEACAVEKVREFAAERGIPVVTVDGRFDGCVEFAELIAAEELEADADIHPDDVVALPYSSGTTGLPKGVMLTHRSLITSVAQQVDGENPNLYFRKDDVVLCLLPLFHIYSLNSVLLAGLRAGSTIVIMRKFDLGALVDLVRRYVITIAPFVPPIVVEIAKSPRVTAGDLASIRMVMSGAAPMGKELQDAFMAKIPNAVLGQGYGMTEAGPVLAMCLAFAKEPYPVKSGSCGTVVRNAELKIVDPDTGAALGRNQPGEICIRGEQIMKGYLNDPESTKNTIDQDGWLHTGDIGYVDDDDEIFIVDRLKEIIKYKGFQVPPAELEALLITHPEIKDAAVVSMNDDLAGEIPVAFIVRTEGSQVTEDEIKQFVAKEVVFYKKIHKVFFTESIPKNPSGKILRKDLRARLAAGVH

SEQ ID NO: 58472 - protein, 338 aa, Dracunculus vulgaris
MSSRLAGTALCRQLSHVPVPHLPVLRPTAGCSAATAQRAGLWPPSWFSPPRRASTLSDPAQDGGKKKAGTAGKVPPGEGGGGGEQKAVVSYWGVPPSRVSKEDGSEWRWTCFRPWDTYQADLSIDLQKHHAPTTILDKLALCTVKALRWPTDIFFQRRYACRAMMLETVAAVPGMVGGVVLHLKSLRRFEHSGGWIRALLEEAENERMHLMTFMEVAQPRWYERALVLAVQGVFFNAYFLGYLLSPKFAHRVVGYLEEEAIHSYTEFLKDIESGVIQDSPAPAIALDYWRLPQGSTLRDVVTVVRADEAHHRDVNHFASDVHYQGLELKTTPAPLGYH

SEQ ID NO: 58473 - protein, 616 aa, Nocardia farcinica IFM 10152
MPASFADTTFTDPSRIRNFCIIAHIDHGKSTLADRMLQLTGVVEERAMRAQYLDRMDIERERGITIKAQNVRLPWRVDDTDYVMHLIDTPGHVDFTYEVSRALEACEGAILLVDAAQGIEAQTLANLYLALDKDLTIIPVLNKIDLPAADPDRYAAELAHIVGCEPSDVLRVSGKTGVGVPELLDEVIRQVPPPVGDADAPARAMIFDSVYDTYRGVVTYVRVVDGKLTPREKIKMMSTGATHELLEIGIVSPEPKPTDGLGVGEVGYLITGVKDVRQSKVGDTVTAARNGAAEPLTGYREPRPMVYSGLYPVDGSDYPDLRDALEKLQLNDAALSYTPETSVALGFGFRCGFLGLLHMEITRERLQREFDLDLISTAPNVVYRVEMEDGTEHVVTNPSYWPEGKVRKVFEPVVKCTIISPSEFIGSIMELCQSRRGELGGMDYLSETRVELRYTLPMAEIIFDFFDSLKSRTRGYASLDYEESGEQESQLVKVDILLQGEAVDAFSAIVHKDAAQAYGHKMTTKLRELIPRQQFEVPIQAAIGSKIIARENIRAIRKDVLAKCYGGDISRKRKLLEKQKEGKKRMKTIGRVDVPQEAFVAALSSDAQADKPKDKK

SEQ ID NO: 58474 - protein, 419 aa, Streptococcus pyogenes MGAS10394
MKDVIYDVEEVPKAGMLVGLSFQHLFAMFGATVLVPILVGIDPSVALLSSGLGTLAHLSVTKFKIPAYMGSSFAYIAAMQLLMRTNGIGAVAQGAMTGGLVYLIVALIVKAIGNDWIDNILPPIVVGPTVMVIGLSLASTAVNDVMLKNGNYNLTYLVIGLVTLLSVIFFNIYGKGIVAIVPLLLGLLVGYVVALLVGVLTGQEIVDFTNVAQAKWFSIPSVEIPFLTYGVKFYPSAILTMAPIAFVTMTEHFGHIMVLNSLTKRDYFKDPGLEKTLTGDGFAQIIAGFLGAPPVTSYGENIGVMALNKIFSVYVIAGAAVIAALLSFIGKVSALIQSIPTPVIGGISVALFGVIASSGLKILIESKVDMDNKKNLLIASVILVSGIGGLMLQVNGLQISGVAFSTLLGIILYQVLPEK

SEQ ID NO: 58475 - protein, 401 aa, Burkholderia vietnamiensis G4
MKAVVFHGIGDIRIDTVPDPQLAQPTDAVVRLTASAICGTDLHMVRGTLGGMKPGTILGHEGVGIVEAVGRDVRNLKRGDRVLIPSTIACGSCAYCRAGYTAQCDVANPGGPRAGTAFFGGPADTGAFDGLQAEYARTPLANASLIRLPDSIDDDRAILMSDIFPTGYFGAQLAEIKPGDTVAVFGAGPVGQFAIASAKLMGAGRVFAIDRIASRLDMACAQGAETIDFAEEDPVDAVLRLTGGIGVDRAIDAVGVDAMRATHGPAAADADAARAFDTEVDAVAPRRKPDGRNWVPGDGPSQVLQWAVRAVAKAGTVSVIGVYPAQARVFPIGEAMNRNLTIKMGNCNHRTITPHLIELVRSGAFDPAAVLTCREPLTNAIDAYRAFDVREPGWMKVKLTP

SEQ ID NO: 58476 - protein, 188 aa, Hevea brasiliensis
EQCGRQAGGKLCPNNLCCSQYGWCGSSDDYCSPSKNCQSNCKGGGGGGGGGGSASNVRATYHLYNPQQHGWDLNAVSAYCSTWDANKPYSWRSKYGWTAFCGPVGPHGQASCGKCLRVTNTRTGAKTTVRIVDQCSNGGLDLDVNVFRKLDTDGKGYEQGHLTVNYEFVNCGDSFNPLFSIMDHQYIN

SEQ ID NO: 58477 - protein, 342 aa, marine gamma proteobacterium HTCC2080
MMAGLILHQKLDDNTPRTPMTVSDLPTIDLQASDEVVKQALETAFTTIGFALISGHGIAEGQIFEMRQLLKTYFNRPLREKLQESITPENYRGYIPLGFFSANSDNTLADHYEGYKLHYEVAEKDPIRARCDLYGPNRWPHEPPHFKATILSYWHACDRVSHRLLRLLAQIMGVDQHSFLSLFESPLTNMTLLHYPSMPAKPTEEAGYGIHPHKDTDALTLLFPDPVGGLWLRPREQDHWLEVAAESDTLIVNIGDLLELWSGGYFVSTPHKVVNKSGQERYSFPFFTVPRHDVTVAPLVTPQPGFDRTPVPVGPVSREVWRTNWPDSQPSNQNFDLGTLTD

SEQ ID NO: 58478 - protein, 395 aa, Legionella pneumophila str. Paris
MVFGFLNLSFWGYVLATFILTQITIASVTIYLHRNQTHRALTLHPVVSHFFRFWLWLTTGMVTADWVAIHRKHHATTDVEGDPHSPVVEGIRKVFWQGAELYREARKDRDMVAKYSHGTPTDWIERNVYSRHSSKGILLMLLLDLFFFGIPGMTVWAIQMMWIPLFAAGVINGIGHYWGYRNFECPDAATNIIPWGFWIGGEELHNNHHTFASSAKFSVKWWEFDIGWMYIRILSLFGLAKVKKLPPKLAMDEGKFHVDLDTVRAVISNRFQVMSYYYKNVIRPILKHEKNTSIETKEDKKLFQRAGRLLRREDKLLSTKAKTRLQKLLDAREQLRVVYSYKQSLQNVWLKTATTQKELVEALQQWCRQAEESGLDVLKQFAQQLKGYVPVYTRE

SEQ ID NO: 58479 - protein, 1073 aa, Streptococcus pyogenes MGAS10394
MLTLPLLVVFLVSLIMPKRKDIQKIMVIGSGPIIIGQAAEFDYAGTQACLALKEEGYKVILVNSNPATIMTDKEIADKVYIEPLTLEFVNRIIRKERPDAILPTLGGQTGLNMAMALSKAGILDDLEIELLGTKLSAIDQAEDRDLFKQLMQELDQPIPESTIVKTVDEAVTFARDIGYPVIVRPAFTLGGTGGGICSSEEELCEITENGLKLSPVTQCLIERSIAGFKEIEYEVMRDSADNALVVCNMENFDPVGIHTGDSIVFAPTQTLSDIENQMLRDASLKIIRALKIEGGCNVQLALDPYSFKYYVIEVNPRVSRSSALASKATGYPIAKLAAKIAVGLTLDEMINPITGTTYAMFEPALDYVVAKIPRFPFDKFEHGERQLGTQMKATGEVMAIGRNLEESLLKACRSLEIGVCHNEMTSLSNISDEELVTKVIKAQDDRLFYLSEAIRRGYSIEELESLTKIDLFFLDKLLHIVEIEQELQMHVDHLESLKKAKRYGFSDQKIAEIWQKDESDIRAMRHSHSLYPVYKMVDTCAAEFDAKTPYFYSTYELENESVQSNKESILVLGSGPIRIGQGVEFDYATVHSVKAIQKAGYEAIIMNSNPETVSTDFSVSDKLYFEPLTFEDVMNVIDLEQPKGVIVQFGGQTAINLAQSLSDAGVTILGTQVEDLDRAEDRDLFEKALKELGIPQPQGQTATNEEEALEAAKKIGFPVLVRPSYVLGGRAMEIVENKEDLREYIRTAVKASPEHPILVDSYIFGKECEVDAISDGKSVLIPGIMEHIERAGVHSGDSMAVYPPQQLSKQIQETIAEYTKRLAIGLNCIGMMNVQFVIKNEQVYVIEVNPRASRTVPFLSKVTGIPMAQIATKLILGQTLKDLGYEDGLYPQSQLVHIKAPVFSFTKLAQVDSLLGPEMKSTGEVMGSDTSLEKALYKAFEANNSHLSEFGQIVFTIADDSKAEALSLARRFKAIGYQIMATQGTAAYFAEQGLSACLVGKIGDAANDIPTLVRHGHVQAIVNTVGIKRTADKDGQMIRSSAIEQGVPLFTALDTAKAMLTVLESRCFNIEAI

SEQ ID NO: 58480 - protein, 271 aa, uncultured marine bacterium
QPNAMGGREVGVSQYSSKRTLSLGDPQSYRIVSEFWQTDNLATYAGLKAIDLFDAMNEGKIKAVWIMATNPVVSLPDSEKIKTALEKCPFVVVSDCIADTETTRLADVVLPAQGWSEKSGTVTNSERRISRQRRVLPSPGEAKPDWWILKEVAQKMGFKDQFDYRHEGQIFKEYCEMTALGNETGKARDLCLIGLTKLDEQGYGELTPQQWPVMEYQPEIIEQRMFTNGEFFTESGKAQFIAVEHDKPIADTSVEFPLIMNTGRIRDQWHT

SEQ ID NO: 58481 - protein, 450 aa, Streptococcus mutans
MTKQYDYIVIGGGSGGIASANRAAMHGAKVILFEGKQVGGTCVNVGCVPKKVMWYGAQVAETINNYAADYGFDVTTQTFHFDALKQNRQAYIDRIQDSYERGFDSNGVERVYSYATFVDAHTVEVAGEHYTAPHILIATGGHALLPDIPGSEYGITSDGFFELDAIPKRTAVVGAGYIAVEISGVLHALGGETHLFVRRDRPLRKFDKEIVGTLVDEMKKDGPHLHTFSVPKEVIKNTDNSLTLILENGEEYTVDTLIWAIGRAANTKGFNLEVTGVTLDSRGFIATDAFENTNVEGLYALGDVNGKLELTPVAVKAGRQLSERLFNHKPQAKMDYKDVATVIFSHPVIGSIGLSEEVALDQYGEENVTVYRSTFTSMYTAVTSHRQACKMKLVTVGEDEKIVGLHGIGYGVDEMIQGFAVAIKMGATKADFDNTVAIHPTGSEEFVTMR

SEQ ID NO: 58482 - protein, 434 aa, Pseudomonas aeruginosa UCBPP-PA14
MNPRLAACQALAAVLAGRASLSGALPPQLDKVAPRDRGLTQELAFGAARWQPRLQALAARLLQKPFKAADTDIHALLLIGLYQLLYTRIPPHAAIGETVGCADKLKKGWAKGVLNAVLRRAQREGETLLAEVDRDPSARLGHPRWLLKALKQAWPEQLDTLCAANNAHPPMTLRVNRRHGERDAYLAELAEAGIEARACDYSRDGIQLAAPRDVRELPGFAEGRVSVQDEATQLAAELLESAPGQRVLDACCAPGGKTCHLLETQPGLAEVVAVDLEESRLVRVRENLQRLGLQASLVAADARATGEWWDGKPFQRILLDAPCSATGVIRRHPDIKLARKPEDIAALAHLQGELLDALWPTLEVGGVLLYATCSVMPAENSDSIAAFLARTPGARELDLPGPWGMKQPHGRQLLPQVEGHDGFYYAKLIKISAR

SEQ ID NO: 58483 - protein, 268 aa, uncultured marine bacterium
QPNAMGGREVGGLANMLAAHMDIENPEHRQWVQEFWNSPTICTQPGLKAIDLFDSMEQGKVKAVWIMATNPLVSMPNRGKIFRALENCDFVVVSDCVEQNDTLALADVKLPATAWSEKEGTVTNSERRISRQRAFKAAPGGAKNDWQIICDVAQKMGYSEGFDFQTPHQIFVEHARLSGVNNFGDRDFDISALADLSLKDYQQLKPVQWPVNQRYPDGCKRLFTDGRFFTPSGKARFIPLHPELPQQQTCRDYPLILNSGRIRDQWHT

SEQ ID NO: 58484 - protein, 133 aa, Sulfolobus solfataricus P2
MVFVNPLANALTSIYNNEMRRNKQAIIMPASKLVINVLRVMQKEGYVGEFEYIDDGRWGKITVQLLGRVNKCGPITPRYPLSYRQMIALPDYVRRYLPSKEIGIIIVSTSKGVMSHKEAARLRIGGVALGYVY

SEQ ID NO: 58485 - protein, 565 aa, Psychrobacter arcticus 273-4
MQKIFRVMIIIAMLITAYLLILAWRDDYADAPAVDTVPETATSVGADIPSTSGAAGDIPVQTLPVDNGTVDNSAVTATPATDAGLITVTTDRYDIKINPEGGDIVYAALKQYDATLDSDKPFVLLENNSNRVYVAQSGLIGQNGIDTAEGRAKYSHTANNYVMEKGQQTLSVPLTYKKDGVTITKTFSFTHDKYPIDISYKIQNASTAAWQGQMFAQLKRDDSKDPGMSDKGALSMATYLGGAWGTPDDPYNKLKFGNFNDGELTTTSDKGWVGIVQHYFVSAWTPENFTGKFFSRETGDDYFIGFNSQPVNVAPDKQVTLNATLYAGPKVQSELKDVAAGLNQTVDYGLLWPISKILFALLDGIHKIIGNWGWSIILLTILVKFALMWFSNKSYYSMAKMRAIAPRLAALKEEHGDDRMKMSQEMMAMYKEEKVNPMAGCLPILMQMPIFLALYWVLVESIELRHAPWVLWIQDLSAMDPWFILPLLMGVSMFVQQQLNPQPADPMQAKVMKFLPIIFTAFMLFFPAGLVLYWTVNNLFSMTHQYIVNKKVEEEQKLRTVKVLD

SEQ ID NO: 58486 - protein, 259 aa, uncultured marine bacterium
QPNAMGGREVGGLANQLAIHRGFDPDSIRLISEFWQTDNLATRPGLKAIELLEAVERGDIEVIWIMATNPVVSMPDNVFIQRALQKCPLVIVSDVTHDSDITQYADLLLPAAGWGEKQGMVTNSERMLTRQRKFLTSKGEAKPDWKIIAEVGKKLCERLDKPNAFDFKSESSVFREYAAMTGLNKDTPFLLDLSKYAEISDEEYEPWNPVQWGSSRPFAAGKFSTENRKARFVGTTAPLIKGESRLWLNTGRQRDQWHT

SEQ ID NO: 58487 - protein, 105 aa, Candida albicans SC5314
MSGTGRGKGGKGLGKGGAKRHRKILRDNIQGITKPAIRRLARRGGVKRISALIYEEVRVVLKQFLENVIRDAVTYTEHAKRKTVTSLDVVYALKRQGRTLYGFGG

SEQ ID NO: 58488 - protein, 636 aa, Zea mays
PLTTAILVHRRPRGPRSRPPSLLAPLSSLLQSLRSLSDPRPRHPLPWIAALGSLRAAIKGFSYQQRTPSTDGLRSAPSPPTNNGRHQRTRISAPPSSPRHQWKGARSTSAAAAAPGHRSTSVIRSLFSRPLAAAGGASSGSGVAALPDLRRCKSFSCGRGGDALTAAGKPQRRSCDVRGRSTLWALFHQDDRQPVRDGTAFGAFPASSSAAAAALAAKVLSPPQPPPLPPPVCVPEFFNSEEIAVAEDSGEIVPVMEPVSVVGTSGEMETEVSAERDVRAMKDHIDLEASQSQQPRKLPSKDLKEIVGSFWLATSTFSKKWQKWRGKQKLKAGGKENRGSDPPLPRGVQGRRVRRRRPRVLGAMAGPARPRQLDDGSNAPVTYVLKGSQAEQMLCPQWQPQTMENTPVTTNSTLEKQIQEDFCQRAMSQDGTQQPFSSDWRLSNCTATSIDPALPKPAAGGFEQESPAMGSSEFYHFHHAEDLFDHRFSTNSLVEDFSASLDAAFHGPAKKPPRWRKAWSLWGLIHHPFNSCHFLLLFFLLLIVKDQTMDNDDAQIGVAKTQGKYWGIFICWLLGNGCLFGFNGMLTIEDYYVYLFPKYHPTRIITLTYQPFVLATTAIFTYHEAKVNADRSFSKP

SEQ ID NO: 58489 - protein, 311 aa, Oryza sativa (indica cultivar-group)
MGGDLYALDFDGVLCDSCGESSLSAVKAAKVRWPWVFEQVDAAMEEWIVEQMYTLRPVVETGYENLLLVRLLVEIRIPSARRSSLYQMFMPRLFCKVADGLSIQEILENWLKLKPTIMSEWNEDRDSLVDLFGSIRDDWIENDLSGWIGANRFYPGTADALKFSSSEVYIVTTKQGRFAEALLKELAGIEFPSERIYGLGTGLSKGKSSPATAANATASRPDTSDEGCELGGGGAVAGASSVDEEVRPLGFTSFVEDRLATLKNVIKEPALDQWNLYLVNWGYNTPKEREDAEGISRIQVIDLPGFSQKLK

SEQ ID NO: 58490 - protein, 141 aa, Bacillus cereus E33L
METILHNDPLMAAVISWFLAQLTKVVFKLVKTGEFDFAKFFASGGMPSSHASTVTALATGVGVVEGVESTLFAIAAIFAIIVMYDASGVRLAVSKQAKILNEFFHGRQTEYKKLNELVGHTPYEVVVGALLGIIVGVGYCL

SEQ ID NO: 58491 - protein, 513 aa, Arabidopsis thaliana
MTHNISVKQNNIQMDSIWILSLLFFIIFLLLAAFKRKNHGKHRRIPSPPGFPIIGNLHQLGELQHQSLWKLSKKYGPVMLLKLGKVPTLILSSSETAKQALRDYDLHCCSRPSLAGGRELSYNNLDMSSSPYNEYWKELRKLCSQELFSANKIQSIQPIKDEEVKKVIDSIAESSSLKNPVNLSKTFLALTTSVVCKAAFGVSFEGSVLNSDRFNKLVRDTFEMLGSFSASDFIPYVGWIIDKFNGLQGWRKKSFRDLDAFYEQIFDLHKEEKEVGSEDLVDVLLRLEKEEIVVGNGKLTRNHIKAILMNILLGGIDTSAITMTWAMAELAKNPRVMKKVQAEIRNQIKNKERISFDDTDKLEYLKMVIKETWRLHPPTPLLLPRDVITEFEINGYTIPAKTRLHVNVWAIGRDPDTWKDPEMFLPERFNDSNIDAKGQNFELLSFGSGRRICPGLYMGTTMVEFGLANMLYHFDWKLPEGMVVEDIDMEEAPGLTVSKKSELVLVPVKYLDH

SEQ ID NO: 58492 - protein, 259 aa, uncultured marine bacterium
QPNAMGGREVGGLANQAAIHRGFDPDSIKLISEFWQTDNLATRPGLKAIELFEAVERGDIQVIWIMATNPVVSMPDNVFIQRALQKCPLVIVSDVTHDSDITQYADLLLPAAGWGEKQGMVTHSERMLTRQRKFLPSKGEAKPDWQIIAEVGKKLCERLDKPNAFEFKSESSVFREYAAMTGLNKDTPLLLDLSKYAEISDEEYESWNPVQWGSSRPFADGKFSTENRKARVVGTTAPLIKGESSLWLNTGRQGDQWHT

SEQ ID NO: 58493 - protein, 136 aa, Candida albicans SC5314
MARTKQTARKSTGGKAPRKQLASKAARKSAPSTGGVKKPHRYKPGTVALREIRRFQKSTELLIRKLPFQRLVREIAQDFKTDLRFQSSAIGALQEAVEAYLVGLFEDTNLCAIHAKRVTIQKKDMQLARRLRGERS

SEQ ID NO: 58494 - protein, 327 aa, Haloferax volcanii
MSSQNLTIVQAVRDGLYTEMNLDDEVLVMGEDVGKNGGVFRATEGLWDEFGDDRVIDTPLAESGIVGTAIGMAAMGLKPVPEIQFSGFMYPGFDQIVSHMGRFRNRTRGRYTLPMVLRAPYGGGIRAPESHSESKEMFYAHEAGLKVVIPSTPYDTKGLLISAIRDPDPVIFMEPKLIYRAFRGEVPEDDYTVPIGEAAVRREGTDVSVFTFGAMTRPTLEAVENLEEEGIDAEVVDIRTISPLDRETIVESFKKTGRAVVVHEAPKNGGLGAEITATVQEEALLYQEAPVKRVAGYDVPYPLYALEDYYLPSVARVEEGIREAVNF

SEQ ID NO: 58495 - protein, 250 aa, Philodendron bipinnatifidum
MGGHDSGRSDISFGGRFASSAFAACFAELCTIPLDTAKVRLQLQKKSVAGDGVSLPKYRGMLGTVATIAREEGLSALWKGIVPGLHRQCLFGGLRIGLYEPVKSFYVGEGFVGDVPLSKKILAGLTAGALAITVANPTDLVKVRLQAEGKLSPGIPRRYSGALNAYSTIVKQEGLGALWTGLGPNIARNAIINAAELASYDQVKQTILKIPGFSDNIFTHILAGLGAGFVAVCIGSPVDVVNRNSIVSPK

SEQ ID NO: 58496 - protein, 345 aa, Philodendron bipinnatifidum
MMSSRLTGTTVRQLGHALSATGLVVRTTAEPASALRGGGAAAPTPSHAHVWMLRFPPARGASTLSAPMTVDGQEEAAATKQTDAAKVAAAEQKAVVSYWDVAPSRVTNEGGSEWRWACFRPWEAYEADLSIDLKKHHAPTTFLDKMAFRTVRALRWPTDIFFQRRYACRAMMLETVAAVPGMVGGMLLHLKSLRRFEHSGGWIKALLEEAENERMHLMTFMEVSQPRWYERALVLAVQGVFFNAYFLGYLLSPKFAHRVVGYLEEEAIHSYTEFLKDIDRGAIKNVPAPAIALDYWRLPQGSTLRDVVMVIRADEAHHRDVNHFASDIHYQGHELKAAPAPLGYH

SEQ ID NO: 58497 - protein, 303 aa, Streptococcus agalactiae NEM316
MSNIVIIGSISMDLVMETNRIAKEGETVFGQRFSMVPGGKGANQAVAIGRLSQDRDNITILGAIGEDSFGPILLDNLNKNHVTTDFVGTIPSSSGVAQITLYNNDNRIIYCPGANGKVDTKKWSQEWSIIKEADLVVLQNEIPHQANMKIANFCKEHSIKLLYNPAPSRKTDIEMLDKVDYFTPNEHECQELFPNQKLEDILATYPEKLIVTLGTKGAIYSDGKESHLIPALETKAVDTTGAGDTFNGAFGYAISKKFKIANALRFATLAAHLSVQKFGAQGGMPTIKEMEDNQHYEKDWHIK

SEQ ID NO: 58498 - protein, 455 aa, Aspergillus nidulans FGSC A4
MHPSALLGLLSFAAAALAVPAGQAPHTARSISNLKSHIKNVVILVMENRSFDNILGGQTTPGLENPLQSGPFCNPFNLTDPSEGEACTAPKSFDSVINDPDHAIYGNNIQFYGEFVPDNAAIASGELKATNKGFAHEQMRLYEDVANKTDLVTEVMHYYTEEQVPVLTALVKNYLTFNHWHSDIPGNTNPNRAALVSGSSHGHGLNDDGFTNHELPNRSIFQQLTETGHSWLNYVDPDGGTGPDAGFYDWTYATGNDDKIVPLAQFYTDAAAGNLTEFTYINPSCCGVGTTSMHPSGLISDGETFIKSVYDALRAGPQWNNTLFVLTFDESGGFHDHVPAPLAPRPDDLTFTLETPNGENYTFPFDRLGGRIPTLLISPWVAKGAVEQKGTNHKNDVVSYSATSILRTLGYLWDFEPFNPRVEHAASFEHLITARARDDTIEVLPEPEAFKRRGW

SEQ ID NO: 58499 - protein, 536 aa, Fagus sylvatica
MDSTNVLLASSSASLQIGGGEIRKNPTLVCAPIMAESVDKMVINMDKAKQGGADLVEIRLDSLKSFNPNGDLKTLIKECPLPTLFTYRPKWEGGQYDGDEKKRLDALRLAMEFGADYIDVELQVAQEFNESIYGKKPEMFKVIVSSHNYQNTPSVEDLGNLVARIQATGADIVKFATTALEITDVARIFQIIVHSQVSSVPIIAIVMGERGFISRILCPKFGGFLSFGTIESGIVSAPGQPIMKDLLHLYNFRQIGPDTKVFGIIGKPVGHSKSPILYNEAFKSVGFNGVYVLSWWMTCKISPDLLILRFAGFSITIPHKEAALKCCDEVDPVAKSIGAVNCIVRRSTDGKIFGYNTDYVGAISAIEDGLRGSKNISYAADSPLAGKLFVVIGAGGAGKALAYGAKEKGARVVIANRTYERAKEIADTVGGQALSLADLENFHPEDGMILANTTSIGMQPKVDETPIPKHALRSYSVVFDAVYTPKITRLLRESEESGAIIVTGVEMFIGQAFEQFERFTGLPAPKELFKKIMAKY

SEQ ID NO: 58500 - protein, 838 aa, Hordeum vulgare subsp. spontaneum
MMRRMVMKVALEDRSQQRKALKAVSTLHGIDAIAADLRCGTITVVGVVDPVDVVAKLRRLFANAQIVSVGPAKEEKKDGDKKDGADKKKPVPVPPVYYPFPYYPPPRPRYEFTVGFLNSITDNFSEARIIVRGRHGIVYKGVLDNGQYIAVKKLHLMPGLDDEEFKNEFNNLMRVRHQNIIPLVGYCHHTKQVLVEHNGKHVSARVEERYLCSEYLEGGSLDKHLSNEPCALAWYTCYKIIKGICDGLLCLHKGFQEPIWHLELKPTKILLDKDMMPKIGGFGFSRLFDSIETSSTSEVRGTSVYMPPEYISKRLITSRFNVFSLGVIILQIMAGKESYTKCVDIPPEEFTERVYGFWVNRMPGTVSKHTSNEVKTCIEIALKCVESNRVNRPTINEIIQRMDKIDIVECSSLGDLYKTREFAFEFLEHITNVFSEKNIIGRGACGVIYKGVLDNGEEIAVKKLHQTLSIDDGLFKKEVNNVMRAEHKNIVRLVGYCHHISPIIVEHEGKHVSASVIERVICFEYMQRGSLDDQLSAESCKLDWDRCYKIIKGICEGLHYLHNAVPPIYHGDLKPGNILLDKDMVAKIGDFGLSRVFDTTQTYMTTSGVIKGTPGYMSPEYINEHKISLKSDVFALGVIIIKMMTGKEDYSNYAHTPREEFIEHVCKKWQVRLHATMRSHVFEEVRTCIGIALKCVEDDRTQRPTMAQILNELSNIGIVKRSPVDRVQETMSTQVSEEVRTCIEIVLKCVEDDRTQRPTIAQIVNELSKIGIAKGSSISQISQATSSSPEQTTQGGGHQVNKLTATPLEEKSRSCPGQACKELKLKRKVKLKLKRNVK

SEQ ID NO: 58501 - protein, 744 aa, Shewanella sp. MR-7
MLNTLRDITQAVASAHSLETALEVLVSSTKAAMETQCCSVYILDQQELVLSATDGLEKSAVGRVRMPLTQGLVGLAAEREEAVNLADARLHPRFKLFPEVAEEEYRAFLAVPIIYQKAVVGVIVVQQASARQFSEGEEAFLMTLAAQLAMAIRGLKQKAQVSSLHQQILFQGTSASSGIAIAHALVLGGEISLEQPDVRCEDIALESSRLVAAMGRCKEAIGALSQRFDREQDEEVASIFNALQLLLDDASLGGEYAREVQQGWEAESAVSRVSLRYIQQFLAMEDPYLKERASDIRDLGQKVLRQLIEPERLELEPDKPVILVTREADATLLAEFPRQKLAGIVTELGGVNSHAAILARALGVPAITGVEQLLSADIDQKLLVVNASRGQLMVSPSPAIVSEYRSLISAQKALQRQYAQELALPSVMLDGARIRLYLNAGLLSGVASEIAEGADGIGLYRTEIPFMLQQRFPSESEQVKVYQQVLSAASGRPVVMRTLDVGGDKPLPYFPIKEDNPFLGWRGIRLSLDHPELFLVQLRAMLQAGGEGKQLSILLPMVSNLDEIDQSLAYLEQAYVELKNDVNSQIEMPRIGIMLEVPALLYQLDEVAKRVDFVSVGSNDLTQYLLAVDRNNPRVSSLFDSYHPGILRALHQARLDCDYHQLDISICGELAGEPMGAILLVAMGYQHLSMNQGSLARINYLLRRVSRADLTQLLAQALSLSNGFQVRELVKEYLTQQGLATILN

SEQ ID NO: 58502 - protein, 95 aa, Glycine max
  misc_feature (36)..(36): Xaa can be any naturally occurring amino acid
  misc_feature (51)..(51): Xaa can be any naturally occurring amino acid
  misc_feature (72)..(72): Xaa can be any naturally occurring amino acid
GGKGLKKEKAKQHHKVLRNNIQEITKPTIQHLTHKXNIKHISNLIYKKTHXILKIFLKNIIHNTITYTKHTXRKTVTTINIIYTLKKQEITLYEF

SEQ ID NO: 58503 - protein, 175 aa, Oryza sativa
  misc_feature (41)..(41): Xaa can be any naturally occurring amino acid
  misc_feature (81)..(81): Xaa can be any naturally occurring amino acid
MAPSVMASSATTVAPFQGLKSTAGMPVARRSGNSSFGNVSXGGRIRCMQVWPIEGIKKFETLSYLPPLTVEDLLKQIEYLXLRSKWVPCLEFSKVGFVYRENHKSPGYYDGRYWTMWKLPMFGCTDATQVVKELEEAKKAYPDAFVRIIGFDNVRQVQLISFIAYNPGCEESGGN

SEQ ID NO: 58504 - protein, 452 aa, Legionella pneumophila str. Paris
MKTKHFDLIVLGGGSGGIASAVRAAQYGAKVAVIEQNHLGGTCVNLGCVPKKIMYNASSIAETLHKSPDYGFFLENNAKLDWKRLVNKRNAYIERLRENYAKRFSQHKITLIQGKGIFHDQSSITIDHTIYQAEHIIIATGGEPALPAINGIKHAIDSDGFFSLTKLPAKVAVIGSGYIGVELAGILNSLGSETHLLMRGTRPLSRFDHMIGDTLMEIMQKQGICIHQNHKAQAIHLHSDGRKSILCQSGSIIENIDVIISAVGRKPRTGNLNLDKINVNMDDKGLILVDAFQNTSVKGIYAIGDVTNTPALTPVAIAAGRRLADRIFGNQPDACLNYDNICSVVFSHPPSGSVGLTEHEAIEKYGKSKIKIYQTRFIPMYDALSVDKTPTAMKLVTLGKKEKIIGLHVVGYSADEMLQGFGVAIKMGACKKDFDNTIAIHPTSAEEFVTMV

SEQ ID NO: 58505 - protein, 426 aa, Oryza sativa
  misc_feature (354)..(354): Xaa can be any naturally occurring amino acid
  misc_feature (364)..(364): Xaa can be any naturally occurring amino acid
MQVELADRAAARPSETGEAPPSSPAAAAAASAAAEDAPLLPGGGGGVRRRVVVSERFRQRSGSFRREVRRAAEETYLLTRLTLILLRYLGIGYRWIRQFLALCCYTFLLMPGFIQVVYYYFFSSQVCRSVVYGEQPRNRLDLYIPTDRTGLKPVVAFVTGGAWIIGYKGWGALLGRRLAERGILVACIDYRNFPQGTIGDMVEDASQGIAFVCNNIASYGGDPERICTRGQSAGAHIAACTLLHQAIKESGEGDASTWSIAQLKAYFGISGGYNLLNLVDHFHKRGLYRSIFLSIMEGEESLQKFSPLVMVKDPAARSAVSLLPRIFLFHGTSDYSIPSAESEAFFDALQQNGXAKADLFLYDXKTHTDLFLQDPLRGGRDKLLEEIVTVIHNDNPDTSAQHLAVPVARRLVPEFMLMLAGRVSPF

SEQ ID NO: 58506 - protein, 462 aa, Bacteroides fragilis YCH46
MNQTVTENHRLRDTIIIGAGLTGLTTAYCLTRKGCDIEVIEQSPCVGGQIRTYHENGFTFESGPNTGVISHPEVAELLAELSPTCRLETASEASRQRLIWKGDRFHSLPSGLFSAITTPLFSTKDKFNILGEPFRAKGNNPDETIGELVQRRLGISYLHYAVDPFISGVYAGDPMRLVTRHALPKLYQLEQTYGSFILGGIAKSFSHRSERDRLATRKVFSTYGGLSNLTKALEQAIGIKRFSLGATSTSLMPCEQGWVVSFTDSCGIVNRIHCRKVITTAPAFALPSLLPFVPDKQMNRISNLTYAPVMQVSVGLRNTYGKEFHAFGGLVPSCEQKPVLGILFPSACFDNRSPEGGALYSYFLGGTRHPELLEKSDDEIIRLITTGLNEMLDYPAGIVPDLIRIFRHKKAIPQYESSSTDRFAAINELQKQYPGLVVAGNLKGGIGMADRIKQAVEIARER

SEQ ID NO: 58507 - protein, 467 aa, Deinococcus radiodurans R1
MTNNFDYDVLVIGAGPGGYHAAIRASQLGLKTACVERGAVGGVCLNIGCIPTKALLHAAETMQASKHAAEFGLTFSGQALDIARLNGWKDSIVKKLTGGVSGLFKANKVTLLTGQASFVDDHTVQVGDKTYTAANIIIATGSDPAKLPGLEVDQQQIVDSTGALVMPDPVPARMLCVGGGVIGFEFAQVYNNLGSQVKIIEFLPSVIPGADADAVKEFSKIMSRQGIEIVTQMKANRAEKKSDGVHVELENVKTGEKTTEVFDRVLVAVGRRPRTDGLNPEQAGVTVTERGFIPADKQQRTNVPHIFSIGDVAGNPMLAHKAMKEGLVAAEVIAGKPAEQDAVAIPGVVYTNPELAWVGLTEAEAQEKGYEVKTGVFPMSASGRAMTLQATEGFVKMVVEKDTDLLLGVHIVAPHASDMLAEAGLALEMAATATDISLTIHAHPTLGESILEAAEASHKQAIHIVNR

SEQ ID NO: 58508 - protein, 253 aa, Geobacillus stearothermophilus
MRKPIIAGNWKMHKTLAEAVQFVEDVKGHVPPADEVISVVCAPFLFLDRLVQAADGTDLKIGAQTMHFADQGAYTGEVSPVMLKDLGVTYVILGHSERRQMFAETDETVNKKVLAAFTRGLIPIICCGESLEEREAGQTNAVVASQVEKALAGLTPEQVKQAVIAYEPIWAIGTGKSSTPEDANSVCGHIRSVVSRLFGPEAAEAIRIQYGGSVKPDNIRDFLAQQQIDGPLVGGASLEPASFLQLVEAGRHE

SEQ ID NO: 58509 - protein, 249 aa, Pyrobaculum aerophilum str. IM2
MNVADLLASSRHCVVFTGAGISAESGVPTFRGPGGLWERYKPEELATPEAFARDPALVWRWYKWRQEVIYNARPSPGHYAIAELEAMGVVRGVITQNVDGLHQRAGSRLVVELHGSIWRARCVKCGSVYILDKPVEEVPPLCRKCGGLLRPDVVWFGEPLPQEAWRAAVELASVSDVLLVVGTSGVVYPAAYIPRIAKEAGARVVEINVEPSAITPIADVFIQGRAGEVLPRLVEEVKRRLRTRQALTP

SEQ ID NO: 58510 - protein, 253 aa, Coptis japonica
MGRKFFVGGNWKCNGTSEEVKKIVTLLNEAEVPSEDVVEVVVSPPYVFLPFVKNLLRADFHVAAQNCWVKKGGAFTGEVSAEMLVNLGIPWVILGHSERRALLNESNEFVGDKTAYALSQGLKVIACVGETLEQREAGSTISVVAAQTKAIAEKVSDWTNIVVAYEPVWAIGTGKVASPAQAQEVHFELRKWIKENVGADVAGSVRIIYGGSVNGANSKELAGQPDIDGFLVGGASLKPEFVDIIKSATVKSS

SEQ ID NO: 58511 - protein, 397 aa, Solanum lycopersicum
MSSSLHSPLYSSLSSSSALQDRKLRNAVNFAKPNLIFKPRRSFPLIRASAGFSSSLDTGLSTELDAVANHSEIVPDTVIFDDFEKFPPTAGTASSSLLLGICGLPDTKFKSAVDRALSDSECYGLESSDLQMSCFFNKALAHVGGDLAKLVPGRVSTEVDARLAYDTHGIVRKVHDLLKAYTEIEVPPERLLFKIPATWQGIEASRVLEAEGIQTHLTFVYSFCQAAAAAQAGASVIQIFVGRLRDWSRNHTGDSEVESALRRGEDPGLALVTKTYNYIHKYGHKTKLMAAAVRNKPDVFNLLGGGYIITPLKVLQSLKESVTLLDEKYSFTRRLSPQSAAAFNFTQDELQKWDQYSFSSAMGPASVELLTIGLDGYINQAKRVEELFGKIWPPPNV

SEQ ID NO: 58512 - protein, 572 aa, Nocardia farcinica IFM 10152
MTSSTDAGPTVQSKPTRARTGKPVRRKSEGQWALGYREPLNPNEQNKKDDNPLNVRARIENIYAVNGFDSIDKSDLRGRFRWWGLYTQREQGYDGTFTGDENIDLLEAKYFMMRVRCDGGALNVAQLRTLGGISTEFARDTADLSDRENLQYHWIEIENVPEIWRRLEEVGLQTTEACGDCPRVVLGSPLAGESLDEVIDPTPAIQEIVRRYIGDKRYSNLPRKFKTAISGQQDVVHEINDVAFVGVVHPEHGPGLDLWVGGGLSTNPMLAQRVGAWVPLDEVPDVWEAVVALYRDYGYRRLRTKARLKFLIKDWGVEKFREVLEEKYLKRKLIDGPAPEKPVRPIDHVGVQRLRNGLNAVGFSPIAGRVSGTVLTQVADAVERIGSDRIRFTPYQKLIVLDVADDKVEQLIAELEPLGLQARPSAWRRNLLACSGIEFCKLSFVETRKRSQVLAPELEQRLADINAELDVPITVNINGCPNSCGRSQIADIGFKGQLVDDGNGNQVEGFQVHLGGSLGLDSGFGRKLRQHKVTSAELGDYIERVVRNFVKNRDGGERFAQWAVRADEADLR

SEQ ID NO: 58513 - protein, 342 aa, Burkholderia vietnamiensis G4
MKCTLKPVGEQTIVITGATSGIGLVTARKAARRGAKLVLFARNGDALNTLCDEIRQHGGLAVPVAGDVANLEDLQRAAAQAVDTYGGFDTWINNAGVSIFGTAAAVPLEDQRRLFDTNYWGVVHGSLVASDHFRRKGDFHGGAIINLGSEASDAPLPLQSAYVASKHAVKGFTDSLRLELESDRLPVSVTLIKPAAMDTMFVMHAKNYMNVEAKLPPPIYDPELVADAILFAAAHPRRTLFVGGAAKLASAGAYHAPRLFDRLAATLFSRGQRTVRAARPRDDNALYESRHALHEREGMEGPVLRGCAYNAVVQRPKVAGAVALGAAALMVVALARARRTTA

SEQ ID NO: 58514 - protein, 300 aa, Burkholderia vietnamiensis G4
MRLAPCSRPTIKEAYMTQAHTPPPQNQTQQPGSERDMQPKPRDEAADYVGSGKLAGKVALVTGGDSGIGRAVAIGFAKEGADVAIVYLNESDDAAHTKRLIEQAGRRCEAIACDIGDRQQARDAVARTVERLGRLDVLVNNAGEQHPQPGIEDVTEEQLERTFRTNVYGMIFCTQAALQHMKGGGRIVNTASVTAYHGSPKLPDYSATKGAIVAFTRSLSIELAERDIRVNAVAPGPIWTPLIPSTFSAEQVSKFGSNVPLKRPGQPDELIDCYVLLASEGASYMTGQTLHPNGGSIVGG

SEQ ID NO: 58515 - protein, 336 aa, Sulfolobus solfataricus P2
MTFRVAVIPGDGIGPELYEGSKRIIAKLIEKYNLDIDLIEVEAGDVALNKYGEALPRHTLDVIEKADMILKGPVGETAMDVVVKLRQMYDMYANIRPAKSLPNVQSKYPNVDLVIVRENTEDLYKGFEFVTSTGVTIAIKVTTEFASKRIVNVALNYALMRRRKVTCVHKANVMRVTDGLFASVCREILKGKVNFEEMYVDAAAANLVRDPTRFDVIVTSNVYGDILSDEASQIAGSLGLAPSANIGDRKSMFEPVHGAAFDIAGKGIANPTAFLLSVSMMLSRMYELSKENKYILASKSLENAIIETYKSGNKLTEDVGGSAKLKDMVDEIYKYM

SEQ ID NO: 58516 - protein, 390 aa, Burkholderia thailandensis E264
MSRRSKVEMRIASLVAQRAACGFSMARTTKSAQPGARAGDRAPIVPISSFHVWKSLKPRGLPTAILVHAPTPPSATSFERRRYSVSRNAIQWSGVFPAVSTQFKPDFSLDVDATHRVVKNLVNDGVSGLVVCGTVGENTSLSTAEKLAVIEAARDAAGGKVPVIAGIAEFTTEFARNTVREAQRVGVDGVMVMPALVYSAKPHETAAHFRAVASGTDLPVMVYNNPPIYKNDVTPDVLIALQDCENIVCFKDSSGDTRRFIDLRNAVGDRFVLFAGLDDVVVESIAVGAQGWVSGMSNAFPKEGETLFRLAKQKRFDEALALYRWFMPLLHLDARPDLVQCIKLCEELVGRGSALTRPPRLALQGDALAQVKAIVAKALETRPTLPDVGL

SEQ ID NO: 58517 - protein, 153 aa, Oryza sativa (japonica cultivar-group)
MASKSLLLLSVVVASLLLVAQEVAAARELTEANEAKGKNMEPEVVHVPQDEKIAYHGDGYGHGGGYGGGYGSGYGGGNGGGYGGGYGGYGGGYGGGYGGGGGGGGYGGYGGYGGGGYEGYGRGYGGGGGGGGYGGGGYPGGGYYGGGGGGGWH

SEQ ID NO: 58518 - protein, 339 aa, Synechococcus sp. WH 8102
MTMVRSSRIPALSALTRCLQEEASAIAAAAERLSSDQVEAALLLLERCADRKAKLVITGVGKSGIVARKIAATFSSIGLMALFLNPLDALHGDLGVVAPEDVCLLLSNSGETEELLEVLPHLKRRGTGRIAIVGRADSSLARGSDVVLEAGVDREVCPLNLAPTASTAVAMAIGDALAAVWMERRGISPADFALNHPAGSLGKQLTLTAADLMVPVSKLHPLHPHTPLPEVIGGLTRDGIGSGWVEHPEQPGSLVGLLTDGDLRRALQDHSADSWSSLTAADLMTRDPITVNGDVLVVKALEQMEHNRRKPISVLPVVGEQKRLLGLLRLHDLVQAGLA

SEQ ID NO: 58519 - protein, 360 aa, Gibberella zeae PH-1
MSKTLKIAVIAGDGIGKEVMPYGVRCLQAASKKYNLSLEFTEFDFASCDYYEKHGKMMPDDWKDTLTAFDAIYFGAVGMPDQVPDNVSLWGSLLKFRREFDQYINLRPCRLMPGIPCPLAGRKPGEIDFWIVRENTEGEYSSVGGIMFEGTERETVIQDTVMTRVGVDRVLRYAFDLAQSRPRKKLTSATKSNGIGITMPWWDKRVVEMSKNYSDVAVEKYHIDILTAHFVQRPQIFDVVVGSNLFGDILSDLGPACTGTIGIAPSANINPTASFPSLFEPVHGSAPDIYGKGIANPVGMIWAGQMMLSHFGYTDAADGMMAAIENVLARSDPAVMTADVGGKGTTQSLGEAIEKEILSS

SEQ ID NO: 58520 - protein, 670 aa, Candidatus Kuenenia stuttgartiensis
MCGIAGLIDLSGKAIDPEILKSMSDVIRHRGPDDEGYVLIDQATSRFQTYAGHDSPSDIQEFNPNFKSSTTAFAGNLGLSHRRFSIIDLTAAGHQPFYDNDRSCCVVFNGEIYNYIELRAELESRGHIFRSHSDTEVLLEAYKAWDVECFTRFNGFWALALYDFRKKRLILSRDRLGKRPLYWVRNDSRIYFASEIKSLLKVPENARNKKVNQEAIWYWCSSGLRDLNLSTCFEGIFSLPSASWVIVDENFPNKLKTFWKVPEKRMSENDIGISEAATLVRETLMEAVRIRLRADVPIALELSGGLDSSAILALTAQIHPERITTYTVRFHDPRTNEEPFARSVAKHYNVDYRVIDPPSQTFWQHILAFTYLQEEPYHSPNLQTSQDIWSHMRGEGIKVTLTGAAGDEMFAGYSRYYAKAQRENLQTGHYLQFIENALLWSERRYNFKTMALSLIRSPIRYLFNNLMPQASRVRQRNRNYLRNISISQRQCNTETLTETLYSDITNALIPYWLRSGDKTLMGMPFEGRCPFLDYRVVEIATQLPITYLIRHGWHKWILRKALEDYLPSDVLWRKQKMGFPFPYQTFYENSRKIIDLILSHADNPFIELSNKEKFQKDWRAISFILWYEMFFNENLTLFKKIESMINQSCTTTDSKYTPEFLSSCEVTSIT

SEQ ID NO: 58521 - protein, 555 aa, Yarrowia lipolytica CLIB122
MAQSFTTFKQASDLPAWQKLQTLYDSKGKSLPVKQLFKEDPERFNKLSHTFTNFDDSKILFDFSKNIVDDEILAQLVELAKEANVYGLRDELFEGDKINFTENRAVFHPALRNRANVAMDVDDKNVAPEVDDVLAHMKEFSEQVRSGEWKGYTGKEITDIVNIGIGGSDLGPVMVSEALKPYAKKGLRAHFVSNIDGTSIAEEVIKQLNPETTLFLIASKTFTTAETITNATSAKTWFLETAKDTKHVAKHFVALSTNKEKVVEFGIDEANMFPFASWVGGRYSVWSSIGLSVAIYVGFDHFNDFLKGAEAVDKHFKEAPPEKNIPLLGGLLSVWYNNFFNAQTHLIAPFDQYLHRFPAYLQQLSMESNGKGVTRSNEYVKYSTGPVLFGEPATNAQHSFFQLVHQGTKLIPADFILAAQSHNPIDHNLHQRMLASNFFAQSEALMVGKTQEQVEAEGTPADLVPHKIFLGNRPTTSILTQLITPATLGALIAYYEWVTFTEGAVWNINSFDQWGVELGKALAKKIQPELENKSEIDAHDGSTNGLINQYKAWAA

SEQ ID NO: 58522 - protein, 287 aa, Aspergillus nidulans FGSC A4 [sequence omitted]

SEQ ID NO: 58523 - protein, 492 aa, Coccidioides immitis RS
MAGYTNAVTKERVNWAQVKECATYVSCMVAGASPAYNVEEMTYALKTADAKFLMTSPGSIEVAAAAAQKVGIPRKHIFLLEGEVQGYITFKQLQDIGRSYGENGQAPPFQLPVGRTNKELCGFLNFSSGTTGLPKAVMLSHHNVIAQCMQLKAITPPVGRKTVMGALPLFHITGLVKFMNCPMFFNDELIMLPQFNMELMLQTIVEYQISELVLVPPLVIRLVNDPIASKYDLSCVKRISCGAAPLSEQITQLLQQKFPQSGFKQGYGMTESCSCITSHSPKYYDYKYANTVGDIVPSTTVKIIDDNGKELGYNQPGEIIAKGPQIAMGYLGNPTATAEAFDTDGFLHTGDIGYMTEEGLIRIVDRIKEMIKVKGIAVAPAELEDLLLGHPDVADCAVLGVKDDYASEKPKAYVVLRDGLSVSEEMGKKLMKYVSERKVRFKWVEEIEFTDAVPKSPSGKILRRVLREKERSGKDRGFTVKRDGWDGQRAKL

SEQ ID NO: 58524 - protein, 376 aa, Coccidioides immitis RS
MNIRPEESPIEETVHAIPPQKDVFTWRNVVYDISIKGEPRRLLDNVSGWVRPGTLTALMGVSGAGKTTLLDALAQRTTMGVITGDMLVNGKSLDMSFQRKTGYVQQQDLHLETTTVREALRFSAMLRQPKSVSKTEKYAYVEDVIDMLNMRDFSEAVVGNPGEGLNVEQRKLLTIGVELAAKPALLLFLDEPTSGLDSQSSWSIITFLRKLADNGQAVLSTIHQPSAILFQQFDRLLFLAKGGKTVYFGDIGENSRTLLDYFERNGAEPCGSNDNPAEYMLDVVGAGPSGKSEQDWPTIWNESEEARRVQEEIDRINAEKEKDESLQEPTETPREFAMPFTSQVYYVTIRVFQQYWRTPTYIWGKLLLGIMAAVFM

SEQ ID NO: 58525 - protein, 384 aa, Nocardia farcinica IFM 10152
MARDYYGLLGVARNATDQEIKRAYRKLARELHPDVNPDEAAQARFKEVSTAYEVLSDPEKRRIVDMGGDPLESGGGAGGFSGAGFGGLGDVFEAFFGGMSGAGGGQRKPRGRVQPGADSLLRTRLSLAECAVGVTKHLTVDTAVLCDACHGSGTHGNSKPVRCETCGGAGEVQSVQRSFLGQVLTSRPCPTCRGAGETIPDPCHKCGGDGRVRARREIAAPIPAGVANGMRVRLAAQGEVGPGGGPPGDLYVEIVEQPHDVFVRDGDDLHCTIRVPMVDAALGTTVVIDTILDGPTELTIPPGTQPGEVSVLRGHGMPKLRSGVRGDLLAHLDIVIPTKLDGKQTELLRKYKALRDRDRAEVMSAQSEHNSGLFARLRASFSGR

SEQ ID NO: 58526 - protein, 571 aa, Aspergillus nidulans FGSC A4
MCGIFACHHHPDVQAFKPTALRMAKAVRHRGPDWSGSFIADKTILCHERLCIVGVDSGAQPLVNDDESLALAVNGEIYNHRIVRKTLDVEYNYKTHSDCEVIIPLYMKYGLDAPKHLDGMFAWVLYDKKEDRVIAARDPIGICSFYIGWSSQTPGAVYFASELKSLHPVCDKVEAFPPGHVFDSKSGEFSRYFQPSWWDPTNVPSTPVDYKAIRESLTRSVRKRLMAEVPYGVLLSGGLDSSLVASIAQRETLRMQKASSGVKSEANGELVGIDDENELSTVNSFQQLQSFSIGLPGAPDTEAAMEVAKFLGTKHHALTFTIEDGLNALSDVIYHLETYDVTTIRASTPMYLLSRKIKGLGVKMVLSGEGSDEIFGGYLYFHAAPNKEEFHKETVRRVKNLHLADCLRANKSTSAWGLEARVPFLDKAFIETSMSVDPQEKMITKDRIEKYILRKAFDTSDEPDVEPYLPDKILWRQKEQFSDGVGYSWIDGLKDHAELHVTDEMMKNPKPEWGDDIPTTKEAYWYRMMFDEHFPSYCASTVERWVPTWSKQSDPSGRAIATHNAKYDDAE

SEQ ID NO: 58527 - protein, 231 aa, Shewanella sp. MR-7
MNMSQKMAAEFLGTLWLVLGGCGSAVLAAAFPEVGIGLLGVALAFGLTVLTMAFAIGHISGCHLNPAVSFGLWAGGRFPASELLPYIIAQVAGGIVGAGVLYAIASGQEGFSLAAGFASNGFGEHSPGGYSMMSVLICEIVMTLFFLLVILGATDERAPKGFAPIAIGLCLTLIHLISIPVSNTSVNPARSTGPALFVGDWAVSQLWIFWVAPILGAILAGVIYRYFNAAK

SEQ ID NO: 58528 - protein, 137 aa, Parvularcula bermudensis HTCC2503
MTATAIDETDRFSPRFDDRGLIPAIAVEATTGQVLMLAYMTAEAIERTLTTGEVHYWSRSRGELWHKGATSGHTQKLVEMRVDCDQDTVLVRVEQSGPACHTGRPDCFYRKVEGPPTAPSLSFDANAPSPCRQTDRS

SEQ ID NO: 58529 - protein, 355 aa, Brassica napus
  misc_feature (143)..(143): Xaa can be any naturally occurring amino acid
  misc_feature (250)..(250): Xaa can be any naturally occurring amino acid
MGKLLCDSTATLQSPSPTVQWREPPTASAPLDDVDLVDQSTAAAAVEAAEKTMSAAAATTAWDEVYGLEEQQRRHLQRLHAMGVLWKHPGKGQSSSPPVVFRLSHGGEVSSDGNCLFTASQKAMGACGIDARDLRRRTVRRFXGFGSAGEVEKEAIAEAIRHMYSPDLKSGWGIHIVQEEKLLAKKDERESLDSAIEELMQIGMQRETAAESIYRERCLPVNDGPSWAKYMSISGSSEDEHDIITLQYTXDGLLSVDENRQGHAAAFGDDIAIECLATEFKREIYVVQAHGADGMVEEENCVFFLPHKPRSEVIESPLFLFMKGTGWCGGGADHYEPLIANASPMISHEKVALVL

SEQ ID NO: 58530 - protein, 296 aa, Rhodococcus sp. RHA1
MNNSAVGTARVKRGMAEMLKGGVIMDVVTPDQAKIAEDAGAVAVMALERVPADIRAQGGVSRMSDPDMIDGIISAVSIPVMAKARIGHFVEAQILQSLGVDYVDESEVLTPADYANHIDKWQFTVPFVCGATNLGEALRRITEGAAMIRSKGEAGTGDVSNATTHMRTIGGEIRRLTSLSEDELYVAAKELQAPYDLVVEVAKAGKLPVTMFTAGGIATPADAAMMMQLGAEGVFVGSGIFKSGNPAERAAAIVKATTFFDDPDVLAKVSRGLGEAMVGINVDDIPVPHRLAERGW

SEQ ID NO: 58531 - protein, 340 aa, Burkholderia thailandensis E264
MTAVDHPAPPPPSGPVRYGKDFALVLLRDMLRVRRLEETCAQLYGAGKIRGFLHLYIGEEAAGIGALHALEPDDNVVATYREHAHALVRGMDMGVLMAEMFGKREGCARGRGGSMHLFDRQTRLFGGNAIVGGGLPLAAGLALAEKMQAGKRVTACFFGDGAVAEGVFHESMNLAALWRLPVLFCCENNLYAMGTALERSESQTDLCAKAASYGMRVSSADGMDVVAVHDAAKDAVEYVRGGAGPMFVELRTYRFRAHSMYDAELYRQKAEVDEWKARGPIHTFTARLKAEGKLTEDEFAALDADANAEVARAVAFAEAGEWERVEDLAKDVYTAAGGPS

SEQ ID NO: 58532 - protein, 558 aa, Rhodococcus sp. RHA1
MNTGISDVDHTYDWVAEPVGARIDVRPTRSCRARVPAAPSGGNVDSTVPGHTDSSGLGKGLKRRHMNLIALGGVIGAGLFVGSGVVIGGAGPGAIISFLIAGIITLLIMRMLAEMAVARPVVGSFYVYARQALGRRAGFATGWMYWYFFVIVVAVEAIAGGRILQLWLPMIPLWLLSLGLMLLLTATNMVSARSYGEFEYWFSSIKVVAIVLFLGMGALWITGLWPDSTPGLGNLVNHGGFTPLGWGAVLAAVVPCVAFYTGAEIVTIAAAESEEPKRAVAHAMRSIVVRIVTFYVGSILVVVTIQPWNTESVGVSPYAAVLEVLGIPGVATIMNFIVLTAVLSCLNSALYTTSRMLFALTRNGDAPKFFTTLSRNGVPRRAILLGTTVGYVSVACTYVWGDVVFGFLVNSYGAVALFVYLLIAISQVVLRRRLEREDPAALQLRMWLFPWLSYATIALMATVILAMAFLPTTRSQFLMSGLTLIVILISYEVRKLLGKGGRDDESLSGAPPIGSADESVAEAEKRIESVETLGGSDIELLAAAQQEPHTHRHQRRQS

SEQ ID NO: 58533 - protein, 494 aa, Mycobacterium bovis AF2122/97
MLEACQAIGVTAALGEPGEHSLPASTPITGDVLFSIAPTTPEQADHAIAAAAATFTAWRSTPAPVRGALVARLGELLTAHQQDLATLVTVEVGKITAEARGEVQEMIDVCQFSVGLSRQLYGRTIASERAGHRLLETWHPLGVVGVITAFNFPVAVWAWNTAVALVCGDTVVWKPSELTPLTALACQALLSRAAADVGAPAAVGGLLLGGAERGAQLVDDPRVALLSATGSVRMGQQVGPRVARRFGRVLLELGGNNAAIVAPSADLELAVRCIVFAAAGTAGQRCTSLRRLIVHRSVADDVVARVVGAYRQLAIGDPSAPDTLVGPLIHEAAYRDMVAALERARTDGGEVIGGDRREVGSPGAYYVAPAVVRMPSQTAIVATETFAPILYVLTYDDLDEAIALNNAVPQGLSSSIFTTDLREAEHFLDQSDCGIANVNIGTSGAEIGGAFGGEKQTGGGRESGSDAWKAYMRRATNTVNYSSELPLAQGVKFG

SEQ ID NO: 58534 - protein, 490 aa, Rhodococcus sp. RHA1
MTSTPPPVQSQDSGLGKGLKKRHMNLIALGGVIGAGLFVGSGVVIESAGPAAIVSFLIAGIITLLIMRMLAEMAVARPVVGSFYVYAREALGNRAGFSVGWMYWYFFVIVVAVEAIAGGRILQLYLPSAPLWILSLGLLVILTCTNLVSARSFGEFEYWFSSIKVIAIVLFLGLGALWITGLWPDATPGVANLVSHGGFAPLGWGAVLAAVVPCVAFFTGAEIVTIAAAESAEPKKAVARAMRSIVVRIITFYVGSIFVVVAVVPWSTEAVGVSPYAAALSALHIPGVATIMNVVILTAVLSCLNSALYTSSRMLFALTRNGDAPHMFTRLSGGGVPRRAILAGTVIGYASVIAAFVSPDLVFSFLVNSYGAVALFVYLMIAISQVALRKKLEARDPEALSLKMWLFPWLSYATIVLMGAVIAAMAVLPTTRSQFWLSVVTLAFILIGYEFRRRSRTSAERLDTVTPPAASPGDGSDAEQLVGVVTREQP

SEQ ID NO: 58535 - protein, 221 aa, Triticum aestivum
  misc_feature (218)..(218): Xaa can be any naturally occurring amino acid
MEAKSSSIKKETEAMEEAERVVKKQNVTMAMEVFDCPVCSTPLRPPVFQCALGHFVCSPCRDKLPDSKCQACSGVVLKSSCYGIERIVESILVPCPYAEHGCTDMITYYLKGEHKQACPHEPCYCPEPGCGFAGTTAALLDHFTSQHKWPTTVFKYYVPFDLIAKPGMHVLRAQDGNLFLLNVSSPESVLHGISLVRIQPKVSELSRFGCSVGFSCWXGHY

SEQ ID NO: 58536 - protein, 527 aa, Triticum aestivum
  misc_feature (148)..(148): Xaa can be any naturally occurring amino acid
  misc_feature (215)..(215): Xaa can be any naturally occurring amino acid
  misc_feature (329)..(329): Xaa can be any naturally occurring amino acid
MAMAMRRAAALGARHILAASASASSRVASRRHMGSVDAGAAMDKIRAAGLLRTRGLIGGQWVDAYDGKTTEVQNPATGEVLANVACMGNRETADAITSANTTFYTWSKLTASERSKALRKWHDLLMSHKEELALLMTLEQGKPMKEAXGEVNYGASFIEFFAEEAKRVYGDIIPPTLADRRLLVLKQPIGVVGAITPWNFPLAMITRKVGPALGXGCTVVVKPSEFTPLTALAAADLALQAGIPAGALNVVMGNAPEIGDELMQSMQVRKITFTGSTAVGKKLMAGSANTVKKVSLELGGNAPCIVFDDADIDVAVKGSLAAKFRNSGXQTCVCANRILVQEGIYEKFASAFVKAVQSLQVGNGLEESTSQGPLINEAAVQKVEKFVGDATSKGANIMLGGKRHSLGMSFYEPTVVGNVSNDMLLFSEEVFGPVAPLIPFKTEEEAIHLANDTNAGLAAYMFTKNIARSWRVSEALEYGLVGVNEGLISTEVAPFGGVKQSGLGREGSKYGMDDYLEIKYVCMGNLG

SEQ ID NO: 58537 - protein, 315 aa, Oryza sativa (japonica cultivar-group)
MEALPQIRQTLSEIDRRIPDALRVAMGLRLRPTAGAALEEVTRIAASCLPRPCPEGGDDPMECDEAAPARALRMEAASCFLPDHDEDTHFVRPEAGVVALADGVGGYRAPGVDAAAFARALMYNAFEMVVATTPGGAGGICPYALLGWAYEQAVSARTQGASTAVILSLAGATLKYAYIGDSAFAVFRDGKLFFRSEAQVHSFNYPFQLSVKNGNSVTSAARGGVEVKEGDVVVAGTDGLFDNVTSEELQRIVAMGRALGLSPKQTADVVAGFAYEASTTMGRDTPFSLESRKKQGTIFRRGKRDDITVVVAYIV

SEQ ID NO: 58538 - protein, 1107 aa, Erythrobacter sp. NAP1
MPKRTDISSILVIGAGPIIIGQACEFDYSGTQAIKALKEEGYRVVLVNSNPATIMTDPEFADATYVEPITPEIVAKIIAKEKPDALLPTMGGQTALNCALKLDEMGVLAEHGVEMIGAKADAIDKAENRQRFREAMDKIGLESARSGVANTVDEARDVLERTGLPAIIRPSFTLGGTGGGIAYNKEEFDRIVREGLDASPTTEVLIEESLLGWKEYEMEVVRDRADNAIIICSIENVDPMGVHTGDSITVAPALTLTDKEYQIMRTASIEVLREIGVETGGSNVQFAVNPADGRLIVIEMNPRVSRSSALASKATGFPIARVAAKLAVGYTLDEITNEITGATPASFEPTIDYVVTKIPRFAFEKFKGAEPLLATAMKSVGEVMAIGRNFQESVQKALRGLETGLDGFNRVPELEGVARDVITAAISRRTPDRLLKVAQAMREGLSVEDINNVTGYDLWFLRQIEGIVLAEREVQADGLPRDAASLRRLKAMGFSDKRLATLAVRSVGVAGGLGETQAKRSGLLHDALQAMAGATSEDEVRKLRHKLGVTPVFKRIDSCAAEFEAITPYMYSTYEAPSFGEAEDEAMPSDRRKIVILGGGPNRIGQGIEFDYCCVHACFALAEQGFETIMVNCNPETVSTDYDTSDRLYFEPLTAEDVLEILRVEQEAGELVGVIVQFGGQTPLKLAQALEDAGVPILGTSPDAIDHAEDRERFAKLVNKLKLKQPDNGIAYTRDEAAAVAARIGYPVLLRPSFVLGGRAMEIVDSEAQLDDYINTAVTVSGESPVLVDQYLRDAIECDVDALCDGKEVRIAGVMQHIEEAGVHSGDSACTLPPYSLSADIIEEMERQAEALARALGVRGLMNVQFAVKDGEVYLIEVNPRASRTVPFVAKAIGQPVAKIAARVMAGEMLAEFEPFKRDLDYMAIKEAVFPFSRFPGADPVLSPEMKSTGEVMGIDNNFEAAFFKSQIGAGMVPPSEGTVFVSVKNSDKSAIVPAVKQLIEHGFHIIATSGTQKYLSEQGLAVEPVNKVAEGQPHIVDKIIDGEVALIFNTTEGWQSLLDSKSIRATALEKKVPYYTTAAASKAAAAAIAAIKPSQLEVRSLQDYYS

SEQ ID NO: 58539 - protein, 695 aa, Aspergillus nidulans FGSC A4
MAQFTVRRGAEAQQNDKDICSSAFKACSKLTKPAQLHGAEELSAEKVQSPETEAYTEADSADESQYYFDSAEFKNIPDLVRTVVGFEDDPSLPVLTFRSILLSAISCTLGSIVSQLTYFRTTTAPFPVFFVIQASDPLDRFLARILPAYKVPLGRVSFSLNPGPWSPKEHAIVGIAANAGSRGQWANYAYQTRAHLYSGLHSPQWAYPVRATLIDDPEFIFPLSLQQVTLYRSMDTRNRTGKKRALDQMKVFWILLLATFVWQFLPEYLFPFVASLAPLCWIASRNHMVNFIGAGRGGMGLLNITLNWSNIASVVITYLYSVQAIICLAFVLTCWILIPIADSGKLWGSPAYDIMSNGVFQKNGSAYPFNDLSKLVRSLTIEAEDNREWAALTLVPIVMLFGIVVSKKIYMPIWTYFVALGFGAAAMLPMSFVYAMPGFSIKVGYLNELIYGYMIEAKGSSRHPLGQLAYRIISGNVWYDARTVLEDQKIGHYLHLPPRQVVGIQIIANMLALPVNYGVTRWVLATKFEYVSGQKTDPLVQWTGHEFQSYNTAGIQYALVGPKKLFASDFFRPILWGFLAGAVAPILMWLLHRRFPRARFDLWNTTIFFASAAVFYGNLSTGPFTTFLVGTFTNFYLFRYRRVFWNKWAYISGAATDTGFNANLLFIFIFLGSTGTKMVHWWGNNADSVERCFAL

SEQ ID NO: 58540 - protein, 176 aa, Yarrowia lipolytica CLIB122
MTLFIVGGPCGTGKSTVAEALAKHLQCPFVEGDELHPKANVDKMARGEPLNDDDRWGWLQDIAKHGEAEIKDKHNKNAVITCSILKKKYRDLVRETLDKDIRMVVVFLYGSEEEITKRVTGRKGHFMKSGMVRSQFEAMEVPKEDELKDQNGQCFPVYTDNLDPDQVEQKVLSDVE

SEQ ID NO: 58541 - protein, 486 aa, Triticum aestivum
  misc_feature (224)..(224): Xaa can be any naturally occurring amino acid
YIHSRLVPVRNSRDIVDPRVRNAMVGLPGVDGLSTEQRKRLTIAVELVANPSIIFMDEPTSGLDARAAAIVMRAVRNTVNTGRTVVCTIHQPSIDIFESFDELLLMKRGGQVIYAGELGRHSYKLVEYFEAIPGVEKITEGYNPATWMLEVSSPLAEARLNVNFAEIYANSELYRKNQQLIKELSVPPPGYEDLSFPTKYSQNFYNQCVANFWKQYKSYWKNPXPHNAMRFLMTLIYGLVFGTVFWQKGTKIDSPQDLSNLLGATYAAVFFLGSANCITVQPVVSIERTVFYREKAAGMYSPLSYALAQTCVEMIYNVVQGIQYTVTIYAMIGYEWKVAKFFYFLFFIISCFNYFTLFGMMLVALTSSSMLANIPIAFILPLWNLFAGFLVARPLIHYDFERPPGQWANPVSWTIYGVIGSQFGDNTTPLSVVAGGSPTVVKQFLEDSLGIKHDFLGYVVLAHFAYVIGFFLVFGYSIKVLNFQKR

SEQ ID NO: 58542 - protein, 308 aa, Zea mays
MAFASRIGNALRRTLAPTCSPLLQPVRCMSSSKLFVGGLSFATDETTLKDAFSEFGNVLEARIIIDRESGRSRGFGFITFTSTEEASAAMTSMDGKELQGRNIRVNHANERAGGIRGGGGFGAGGGYGGGGGYPTGGYGGGGYSSGGGGGYSSGGGGGYSSGGYAANGYGVGSGSGYGGTYSNASGGGYSGSDGYGNGAASGGYANNLSSGYNSNGRYNTIGSSDGNTGGYNSSPNPYGVGNYNTGGSSSSGGTLGEFGGGGFGGNNFAGNVTGGFSGGGASYGANKPQYNGDDDLLGEGFFDKEVAE

SEQ ID NO: 58543 - protein, 328 aa, Aspergillus nidulans FGSC A4
MDRSLDEIIAERPQRQNRGQNRGPRNQGRRSNGVKKPYRDERVDLDLDWVHDKYEDDRDTRPSRGGRRPRVDRYSPSPDRSASAGTRLRIENLHYDITETDLEELFSRIGPISNVSLVYDRAGRSEGVAYVTYSRYNDAKTAIAEFDGANAKGQPIRISITSSGPRRDRNPFDTAEKPRGSLFDRVERPRDARSLSPESRSESAEGAGRRRRRRGGGGGNYRRSDVSKPAPDHIDRYIPGQQAPARRAGGGRRQGGDGRRGNPRPKKTQEELDQEMEDYWGSNAAAETAEQAAAPEQTAAEPAPAASAVAAPAAAAAPAADDDIDMIE

SEQ ID NO: 58544 - protein, 430 aa, Shewanella sp. MR-7
MTRSEALFEQAKKTIPGGVNSPVRAFNGVGGSPLFIEKADGAYIYDADGKAYIDYVGSWGPMILGHNHPKIREAVLAAVHNGLSFGAPTELEVQMAEKVIAMVPSIEQVRMVSSGTEATMSAIRLARGFTNRDKILKFEGCYHGHADCLLVKAGSGALTLGQPSSPGIPEDFAKHTLTAVYNDLDSVRTLFEQYPTEIACIIIEPVAGNMNCIPPIPGFLKGLRTMCDEFGALLIIDEVMTGFRVSRSGAQGHYGVTPDLTTLGKVIGGGMPVGAFGGRKEVMQFIAPTGPVYQAGTLSGNPIAMSAGLAQMEALCEEGLYEALSAKTKRIAEGFKAAADKHGIPMAINYVGGMFGFFFTEQEQITRFDQVTKCNIEHFRTFYHGMLDEGVYLAPSAYEAGFLSMAHGEEELRLTLEAADRVLARMKAAM

SEQ ID NO: 58545 - protein, 417 aa, Arabidopsis thaliana
MGFSTGKRKSRDEEEDRVSFFASEFPMDDLNDDVLERVLSWLPTSCFFRMSSVCKRWKSSQTSKSFKLACSQIPTRDPWFFMIDNDSNSSSFVFDSTENSWKNLNRRDFLHHHRQDFIPVASSGGLLCYRCSISGDFLLRNPLTGSSRDIPSQDNNNNKPLQAVAMTTTTVTPSSYTLVTISGEIPNLSFKIYESNADSWSKDQELESVKNNDSSLHDDYDTDSGTVYFLSKQGNVVVASNNLQRSPSKQYSSVITVTDEAEIVYFLSSYGTIVACDLTKRCFTELPKLLLPFLEYSIDLVECEGTMYVILLSEFFESASLRIWRLDNNREWVQVGMLPPALSHELYGKKGDINCVGGAGNKILVCFNASPPEVYCRYFVYDLVAEEWNELPKCFKDGEAVDFVSALSFQPRIEATV

SEQ ID NO: 58546 - protein, 524 aa, Coccidioides immitis RS
MADAFKARTLKRKNVKGLALNAAASKLGSKPSDGDAQIPGAIGNTDSNRTDTLEIGLEFQLDLRSEDLMVLKELGAGNGGTVSKVMHASTKVIMARKIIRVDAKEKVRKQILRELQVGRHCDSPYIVTFYGAFTNEARDIVLCMEYMDGGSLDRISKDFGPVRVDVLGKIAESIFAGLVYLYEAHRIMHRDIKPSNVLVNSRGHIKLCDFGVATETVNSVADTFVGTSTYMAPERIQGEAYSVRSDVWSAGLTIMELAVGRFPFDSSDTAAGDRASAGPMGILDLLQQIVHEPAPKLPKSDAFPAILDEFVAKCLLKKPGERPTPRELFDHDAFIQAAKRTPVNLREWAISMMDRHNRKSYLAPPAPRAINRDGSRDSISESRSQQQPDPHSHPTPTSGEIPLNYSHEPYIQRDEQTPRASNPSPTLGLEHLNINNHSQPQVNGQAGWPRRSPYTPGHHSNTNSPQAFTSPRAAPSPRHPSPRNPPQSAGLPLRTGPPSNGQMPPPPPASSGLGSWSRSQGNRA

SEQ ID NO: 58547 - protein, 603 aa, Xylella fastidiosa 9a5c
MTVIEIKVPDIGDYSKVPVIEVLVTVGDHVVKNQGILTLESDKATLEVPSMNNGVVKELKVNVGDLLSQGDVILLLETEDTTAPPSPSNTATSDTTSPPPPSPQPAASKPTAPDQQHADITCRMVVLGAGPGGYTAAFRAADLGLDTVLVERYPNLGGVCLNVGCIPSKALLHAAAVIDEAAHASTFGIDFGKPKITLDTLREYKQNVVNKLTAGLAGMAKQRKVRTVTGIAHFVSPNTLDITTADGSTQRLHFQQCIIATGSHPVKLPNFPWDDPRIMDSTDALELAEVPKKLLVVGGGIIGLEMATVYNALGSHVTIVEFMDQIIPGTDKDLVKPLADRMKKQGIEIHLNTKASHVKADKKGITVSFEAPTQGTQPALKTSTYDRVLVAVGRTPTGNNIGAEKAGVNVTERGFIPVDRQMRSNVPHIFAIGDIVGNPMLAHKATHEGKLAAEVAAAETESGKHREWVARVIPSVAYTNPEIAWIGMTETEAKAKSLNIGVAKFPWAASGRAIGIGRTEGFTKLIFDEDTHRIIGGAIVGVHAGDLLAEIGLAIEMGAEAEDISHTIHAHPTLSESIAMSAEVYDGTITDLYLPKKPATSAK

SEQ ID NO: 58548 - protein, 861 aa, Nicotiana attenuata
MFPIKNIVDGLIGHNDSKKVKGIVVMMKKNALDFTDIAGAVVDGVLEFVGQKVSLQLISSAHGDPANDLQGKHSNPAYLENWLTTITPLTAGESAYGVTFDWDEEFGLPGAFIIKNLHFTEFFLKSVTLEDVPNHGTVHFVCNSWVYPANKYKSDRIFFANKTYLPSETPAPLLKYRENELLTLRGDGTGKLEAWDRVYDYALYNDLGDPDQGAQHVRPILGGSSDYPYPRRGRTGRAPTRTDPESESRIPLLLSLDIYVPRDERFGHLKLSDFLTYALKSMVQFILPELHALFDSTPNEFDSFEDVLRLYEGGIKLPQGPLFKALISSIPLEMVKELLRTDGEGIMKFPTPLVIKEDKTAWRTDEEFGREMLAGVNPVIIRNLQEFPPKSKLDPQVYGNQDSTITIQHIEDRLDGLTIDEAIKSNRLFILNHHDTIMPYLRRINTTTTKTYASRTLLFLQDNGCLKPLAIELSLPHPDGDQFGAISKVYTPTDEGVEGSIWELAKAYVAVNDSGVHQLISHWLNTHAVIEPFVIATNRQLSVLHPIHKLLHPHFRDTMNINAMARQILINAGGVLESTVFPSKYAMEMSAVVYKNWIFPDQALPTDLVKRGMAVEDSSSPHGIRLLIQDYPYAVDGLEIWSAIKSWVTEYCSFYYKSDDSILKDNELQAWWKELREEGHGDLKDEPWWPKMENCQELIDSCTIIIWTASALHAAVNFGQYPYAGYLPNRPTVSRRFMPEPGTSEYELLKTNPDKAFLRTITAQLQTLLGVSLIEILSRHTSDEIYLGQRDSPKWTYDEEPLAAFDRFGNKLSDIENRIIEMNGDQIWRNRSGPVKAPYTLLFPTSEGGLTGKGVPNSVSI

SEQ ID NO: 58549 - protein, 861 aa, Nicotiana attenuata
MFPIKNIVDGLIGHNDSKKVKGIVVMMKKNALDFTDIAGSVVDGVLEFVGQKVSLQLISSAHGDPANDLQGKHSNLAYLENWLTTITPLTAGESAYGVTFDWDEEFGLPGAFIIKNLHFTEFFLKSVTLEDVPNHGTVHFVCNSWVYPANKYKSDRIFFANKTYLPSETPAPLLKYRENELLTLRGDGTGKLEAWDRVYDYALYNDLGDPDQGAQHVRPILGGSSDYPYPRRGRTGRAPTRTDPESESRIPLLLSLDIYVPRDERFGHLKLSDFLTYALKSMVQFILPELHALFDSTPNEFDSFEDVLRLYEGGIKLPQGPLFKALISSIPLEMVKELLRTDGEGIMKFPTPLVIKEDKTAWRTDEEFGREMLAGVNPVIIRNLQEFPPKSKLDPQVYGNQDSTITIQHIEDRLDGLTIDEAIKSNRLFILNHHDTIMPYLRRINTTTTKTYASRTLLFLQDNGCLKPLAIELSLPHPDGDQFGAISKVYTPTDEGVEGSIWELAKAYVAVNDSGVHQLISHWLNTHAVIEPFVIATNRQLSVLHPIHKLLHPHFRDTMNINAMARQILINAGGVLESTVFPSKYAMEMSAVVYKNWIFPDQALPTDLVKRGMAVEDSSSPHGIRLLIQDYPYAVDGLEIWSAIKSWVTEYCSFYYKSDDSILKDNELQAWWKELREEGHGDLKDEPWWPKMENCQELIDSCTIIIWTASALHAAVNFGQYPYAGYLPNRPTVSRRFMPEPGTSEYELLKTNPDKAFLRTITAQLQTLLGVSLIEILSRHTSDEIYLGQRDSPKWTYDEEPLAAFDRFGNKLSDIENRIIEMNGDQIWRNRSGPVKAPYTLLFPTSEGGLTGKGVPNSVSI

SEQ ID NO: 58550 - protein, 429 aa, Erythrobacter sp. NAP1
MTAIIDIHGREILDSRGNPTVEVDVLLDDGSFGRAAVPSGASTGAHEAVELRDGDKDRYKGKGVLKAVEAVNTEIRDLLIGAFDAEDQRDIDLSLIALDGTANKGRLGANAILGTSLAVSKAAANARGLPLYSYLGGVAAHVLPVPMMNIINGGEHADNPIDIQEFMVMPVGAESIAEAVRWGSEVFHTLKKGLSDKGLATSVGDEGGFAPDLASTRAALDFIMASIEQAGFKPGEDIVLALDCAATEFFRDGKYEISGEGLSLDGQGMADYLAKLCDDYPIRSIEDGMSEDDFEGWAAVTKAIGDRVQLVGDDLFVTNPERLSDGIAKGLANSLLVKVNQIGTLTETLAAVDMATRARYTSVMSHRSGETEDATIADLAVATNCGQIKTGSLARSDRLAKYNQLIRIEEELGDSAEYAGRGCFGSLSA

SEQ ID NO: 58551 - protein, 580 aa, Zea mays
DSARRGVFGLYHMPDFVCLHLLSISREKITTAIFNSSGSWLVFGCAKLGQLLVWEWRSESYILKQQGHYFDVNCIAYSPDSQILATGADDNKVKVWTVSSGFCFITFSEHTNAVTAVHFMANNHSLLSASLDGTIRAWDLFRYRNFRTFTTPSPRQFVSLTADQSGEVICAGTLDSFEIFVWSMKTGRLLDVLSGHEGPVHGLMFSPINAILASSSWDKTVRLWDVFESKGAVETFQHSHDVLTLAYRPDGRQIACSTLDGLIHFWDPSDGLLMYTIEGRRDIAGGRLMTDRRSAANTSIGKYFTTLCYSADGSSILAGGNTKYICMYDVGEQVLLRRFQITRNLSLDGVLDFLNSKKMTDGGALDLIDDEDSDVEEGIDRHTRGNLGLGLPGSMANRGRPMARTKCVKFAPTGRSFAAATTDGVLLYSVDESFIFDPTDLDIDVTPEKVEEALAENQQQRALILSLRLNEDLLIKKCIFAVDPADVRAICSAIPYKYLQRLIDTFASLLESCPHLEFILLWSQELCKVHGHYIQQNSRTLLPSLKSLQKSITRLHQDLADTCSSNEYLLKYLCTAGTKN

SEQ ID NO: 58552 - protein, 527 aa, Glycine max
MAKEREKKLYVALLGNYAAELKLLLTTLLLLCAVATLLQFLPSRFTISASDLRVCISRVTQTTQTIPNSTNATSPPVTATASASASASPLVASLSSTTSPSPPPPSPPPPSPPSSEQILPDGTIKRVFNPYGSAAYNFVTMGAYRGGLDTFAIIGIASKPLHVYAKPTYECAWFSLAGDKKKLSTTVGYKILPDWGYGRVYTVVIVNCTFPIPVNADNSGGKLVLFASTSGGGDASFNTTDRIEALTEQPRTLDTTLFSSKPKYDYLYCGSSLYGNLNPQRVREWIAYHVKFFGPRSHFVIHDAGGVHPQVLEVLKPWMDLGYVTLHDIRDQERFDGYYHNQFMVVNDCLHRYKFMAKWMFFFDVDEYIYVPPKSTIKSVLDSLSEYSQFTIEQMPMSSKLCLTSDYGKTYRKWGFEKLVYKDSKKGIRRDRKYAVQPRSLYATGVHMSQNLAGKTTHKTEGKIMYYHYHGTIAEKRESCKMLINSTEITYDKTPYVLDTTMRDIAGVIKKFELKMIGDRLQHKTRQ

SEQ ID NO: 58553 - protein, 221 aa, Yarrowia lipolytica CLIB122
MDQALDEIIAQPSRRDDRPPRPERSRRSDRGDRRGRDYDDRRSARGRGDRERGRFVDKRYRDALPNTVLLIRNLHYELTENDLYDLFNKVGRVDDVEIHYDRSGRSLGDANVVFSRPEDAQDAIDKFDGKRAAGLKIEVKIDHRRDPALDLSERFGPRDRSLSPGRDRPYGGYREDRPPRRGRGGRGGRGRREGGSSTGRIPKEKKTVEELDAELDSYMQD

SEQ ID NO: 58554 - protein, 160 aa, Oryza sativa
  misc_feature (106)..(106): Xaa can be any naturally occurring amino acid
  misc_feature (144)..(144): Xaa can be any naturally occurring amino acid
FFLDEPVNDLPTGVLYNSLGSVIHMLIGSRYAVQRSGNVLMSFNNKEASSAIPLFSPVIGPMAQSFGPIFSQLASYPTIRFGAEAAIKQLENLNPPVGKQLLPLLXQLPPLYMDLIKGREDFIPKPEKTRRLIKTYYGISRNLXKVKDDQIDETSTLAQV

SEQ ID NO: 58555 - protein, 136 aa, Zea mays
  misc_feature (88)..(88): Xaa can be any naturally occurring amino acid
MARTKQTARKSTGGKAPRKQLATKAARKSAPTTGGVKKPHRYRPGTVALREIRKYQKSTELLIRKLPFQRLVREIAQDFKTDLRFQSXAVLALQEAAEAYLVGLFEDTNLCAIHAKRVTIMPKDIQLARRIRGERA

SEQ ID NO: 58556 - protein, 352 aa, Allium cepa
MPIESVIIAPPAPRVETLSKSNLHSIPLEYIRPEHERACLGDALEQLHNSNSGPQIPIIDLDSRDCIEKVTKAAKEWGVMHIVNHGISSELMEKVRAAGMAFFNLPLEAKEEYANDQSKGKIQGYGSKLANNASGQLEWEDYFFHLIFPDDKVDLSVWPKQPSDYIEIMQEFGSQLRILASKMLSILSLGLQLPTKDRLEQELKGPEDLLLQLKINYYPKCPQPHLALGVEAHTDVSALSFILHNNVPGLQVFYEGEWVTAKLVPDSLIVHVGDSLEILSNGIYKSVLHRGLVNKEKVRISWAVFCEPPKDAVVLKPLDEVVTDDAPARYTPRTFAQHLERKLFKKKGWRFG

SEQ ID NO: 58557 - protein, 357 aa, Pyrobaculum aerophilum str. IM2
MAECGIILAGGFATRLRPLSYTKPKPLFPILGRPVIDWVIEKVSEVAEPVISARYLSYIIRNHVNAKWGGRVRVVEEDRPLGDGGAVVNVIKSLGLRGPVIVANGDVFTDISIREMWDFHKKMGGAVTIALIEVPPEEIGRFGIAVLEGERVKRFVEKPKEPVGSNLANAGIYIFEPEAIAQFPDINSGELKIAKHIIPKLMQKFDIYGYVHRGLWFDIGTHGDYLKANFAALERCNCHREVPGVKIIPPVYIGEGAVVGPGSVLGPYVVIGNGSRLGPNVRIRESVLMDGVVAEAGAYVAKSIIGEGVVLGKWTRVIEAVVADGVYIRDEVLVGRGASIGPNREVEQDVKEGEILP

SEQ ID NO: 58558 - protein, 186 aa, Zea mays
MPSHSGDDNVLQVLIKNFDVLALPLVALVYPLYASVKAIETKSLAEDEQWLTYWVLYAIISLFELIFSKLLEWFPIWPFLKLVGICWLVLPQFNGAEHVYRHFIRPFYMNPQRASTNIWYVPQKKFNFFPKRDDDDILTAAEKYMEKHGTDAFERMIVRKDSYERGRRGGGGGSNNYMIFDDDYRY

SEQ ID NO: 58559 - protein, 332 aa, Dechloromonas aromatica RCB
MNPSPKPHRFSPERALELGRQTLSIEAAAVEALQGRINGDFAKAVELILNSHGRLIVSGMGKSGHIARKIAATMASTGTPAYFVHPAEASHGDLGMITRDDVLLALSNSGESGELLSILPALKRQGAKIISMTGVPTSTLAREADIHLDAGVEQEACPHNLAPTASTTAALALGDALAVALLDARGFGPEDFARSHPGGSLGRRLLTHVRDVMRADDKVPAVTPATPITDAIIAMSRGGLGLVAITDPANIVLGIFTDGDLRRAFEKRIDLQQGDIASVMHAAPRTIGPDRLAVEAVEMMERLRINALLVVDAENHLIGALNMHDLFTAKVI

SEQ ID NO: 58560 - protein, 1073 aa, Aspergillus nidulans FGSC A4
MDELFDVFEDKPQAAQLSEPRRPKKEKSKKRQINGDVKENGENAKPKENIAPDVAEQENKEEKSSGSDNNNQPETKRLRLEEEPEPVVADLFETAQEREIAGSAGLQAEKEAGPVVLSHQVRHQVAIPPKYPYVPISQHKPPENPARVWPFTLDPFQQVAVSSIQRGESVLVSAHTSAGKTVVAEYAIAQSLKNNQRVIYTSPIKALSNQKYREFAAEFGDVGLMTGDVTINPTATCLVMTTEILRSMLYRGSEIMREVAWVVFDEIHYMRDATRGVVWEETIILLPDKVRYVFLSATIPNAMQFAEWITKMHNQPCHVVYTDFRPTPLQHYFFPAGSEGMHLIVDEKGVFREENFQKAMSSIADKKGDDPADALAKRKGKGKDKKLNKGGTQEKDDIYKIVKMIMLKSLNPVIVFSFSKRECEFYALKMKSLAFNDDSEKEMVSKVFNSAIEMLSEEDRNLPQIQNILPLLRRGIGVHHSGLLPILKETIEILFQEGLIKVLFATETFSIGLNMPAKTVVFTSVRKFDGFSQRWVTPSEFVQMSGRAGRRGLDDRGIVIMMIGEEMDPAVAKEIVRGEQDRLNSAFHLGYNMILNLMRVEGISPEFMLERCFYQFQNTAGLAGLEKELAELEEKRANMTISDEGTIREYYDIRTQIDQFNDDVRAVISHPEYSVPFLTPGRLLHIKYKDFDFGWGVVVNIKKRKPQKNSEELTGHASYIVDVLLRVADGSSSGTKTFEDLPQGVRPPKEGEKSQMEVVPLLLNCIQAISHVRMIVPKDLQSKDSRTDMGKKVEQIKKRFPDGIAVLDPIEDMGIKDDEFKKTLRKIEVLESRLVTNPLHNSPRLEELYEQYAEKLDLGNKIKATKKKISEGMAIQQLDELKCRKRVLRRFGFINEAEVVQLKARVACEISTGDELMLSELLFNGFFNKLTPEQAAAVLSVFVFEEKTKETPPLSKEELAKPLKEIQAQARIIAKVAQESKLAVSEEDYVQSFHWELMEVIYEWANGKSFADICGMTDVYEGSLIRVFRRLEECLRQMAQAAKVMGSEELESKFETALTKVRRDIVAAQSLYL

SEQ ID NO: 58561 - protein, 199 aa, Streptococcus pyogenes MGAS10394
MAEEQVLNTHNASILLSAANKSHYPQDDLPEIALAGRSNVGKSSFINTILGRKNLARTSSKPGKTQLLNFFNIDNKLRFVDVPGYGYAKVSKSERAKWGKMIEEYLTSRDNLRAVVSLVDLRHAPSKEDIQMYDFLKYYDIPVIVVATKADKIPRGKWNKHESVVKKALNFDKSDTFIVFSSVERIGIDDSWDAILEQV

SEQ ID NO: 58562 - protein, 130 aa, Glycine max
TRAAQYFNIKLWRVPVNKNFQADVKAIRRHINKNTILIVGSAPGFPHGVIDPIEELGHLASSFGICFHVDLCLGGFVLPFARELGYHIPPFDFSVKGVSSISVDVHKYGLAPKGTSVVLYRNHEIRKARQ

SEQ ID NO: 58563 - protein, 220 aa, Xylella fastidiosa 9a5c
MHSLEHLLQNNRNWCERINQEDPEFFARLSKQQSPEYLWIGCSDSRVPANQIIDMAPGEVFVHRNVANVVVHTDLNCLSVIQFAIDVLKVKHILVVGHYGCGGVLASLTRARLGLVDNWIRHVTDVAEKHNSYLETIVALPDQHARLCELNVLEQVLNVCRTSIVRDAWSRTQPLTVHGWVYSLSNGLVHDLGIDVDRFEMLPSCYADALARIQADQVVH

SEQ ID NO: 58564 - protein, 227 aa, Streptococcus pyogenes MGAS10394
MKALKKIAGVTAAQYVTDGMTIGLGTGSTAYYFVEEIGRRVKQEGLQVVGVTTSSVTSKQAEGLGIPLKSIDDIDSIDLTVDGADEVDKDFNGIKGGGAALLMEKIVATPTKEYIWVVDASKMVEHLGAFKLPVEVVQYGADRLFRVFEKAGYKPSFRMKGDSRLVTDMQNYIIDLDLGCIKDPVAFGHLLDGTVGVVEHGLFNGMVDKVIVASKDGVTVLEAPKAG

SEQ ID NO: 58565 - protein, 74 aa, Triticum aestivum
MHPKARIHADPAAPEPDRIDGLPDSLVLLILNKLEDVHSLGRCAAVCRRFSDLVPLVHDVYVKIDRVVAWTQPT

SEQ ID NO: 58566 - protein, 175 aa, Triticum aestivum
  misc_feature (42)..(42): Xaa can be any naturally occurring amino acid
MPPPLMAWSATSFGPFQGLKSTAGLPSSRRSNGVGLGSVSNXGRIRCMQVWPIEGIKKFETLSYLPPLSTEALLKQVDYLIRSKWVPCLEFSKVGFIFREHNASPGYYDGRYWTMWKLPMFGSTDATQVINEVEEVKKEYPDAYVRIIGFDNMRQVQCVSFIAFKPPPPEDSGKA

SEQ ID NO: 58567 - protein, 246 aa, Staphylococcus aureus subsp. aureus NCTC 8325
MFNLKHDLETLKHIIDSSNRITFFTGAGVSVASGVPDFRSMGGLFDEISKDGLSPEYLLSRDYLEDDPEGFINFCHKRLLFVDTMPNIVHDWIAKLERNQQSLGVITQNIDGLHSDAGSQHVDELHGTLNRFYCNVCHKSYTKSDVIDRTLKHCDNCGGAIRPDIVLYGEMLDQPTIIRALNKIEHADTLVVLGSSLVVQPAAGLISHFKGDNLIIINKDRTPYDSDATLVIHDDMVSVVKSLMTE

SEQ ID NO: 58568 - protein, 229 aa, Oryza sativa
  misc_feature (36)..(36): Xaa can be any naturally occurring amino acid
  misc_feature (57)..(57): Xaa can be any naturally occurring amino acid
LVDPRAAVNSAECSKLKTKAKDDKKKKKKDNNTVVXVNKEQKKCPFSVKIDEIPPEXSDNTAGCVAIRKAFALGNGKAKKKELSPQDAALLIQLNYRAHLAHRSQVLRCLRDLAVAKAKLKEIRSLFYNISYRHRMAHDHEERQRFTENIIVLLLTVDALEGPDYMVRTAKKSMLDELEGMLEIVDPQPPGKQRSLTRRKFDLPEGGPITDEKMAGVNNAVKVIPKGKK

SEQ ID NO: 58569 - protein, 408 aa, Campylobacter lari RM2100
MQISTKLKPYYENISFEREDGVMIVNLGPQHPSAHGNLRLILELDGEEITKAAPCIGYMHRGMEKMAENMIYQEFIPTTDRMDYIAASANNYAYVAAVEKLCGLEIPRRASVIRMILLELNRIASHLLWLATHALDIGAMTVFLYCFREREYVLDLIEKYCGARLTHSSMRIGGVMLDLPDGFLDELLAFCKKFPNDIKDYEALLDDNRIWRARTENVGVVSKEQALSWGCSGVMLRGSGIAYDIRKEEPYLLYDEVDFGVPVAKMGDSYARYKVYMQEFRESLKILTQCAKLYQDTPPEILCNHPEYVSASKEQIMTQNYSLMQHFVLVTQGLKPPKGEVYVPTESPKGELGFFIHSDGSGRPYRLRARTPSFFHCAFLEEMLVGSYLADAVAILGSINIVLGEIDR

SEQ ID NO: 58570 - protein, 112 aa, Zea mays
  misc_feature (68)..(68): Xaa can be any naturally occurring amino acid
GGKGDAGKTPVFTQELKSTTVLGANIFRGGLVRKIHPALGFPDGLGHLLAKRPVLRERGGKDPKPLFXEARKRFVKWATRSGIKIGKALNVKNCPGFLEEPGPPLLFFFFLI

SEQ ID NO: 58571 - protein, 210 aa, Campylobacter lari RM2100
MKKGYFKVDFERKNPQSAYEKFIQIIKRSLNTELFVGLYVVLREMLKKNNSATIKYPMEKVSLDNRYRAVHRLMRFIESENECCIGCGLCEKICISNCIRMETSLGEDGRKKVENYSINLGRCIYCGFCADVCPELAIVHGKEYENAAEQRSYFGQKQDFLTPIDELKNQVIFEGSGSLRKDADDLVKKTPNYYEIDLQRQQDTPKEENV

SEQ ID NO: 58572 - protein, 909 aa, Oryza sativa
  misc_feature (534)..(534): Xaa can be any naturally occurring amino acid
MSQALNDGSNLDLPVFQDDLLRGRQRVFSEFLSKDEYQDAVRRMLRMDARRLIINIDDLRSYNREFATGLLNEPNEFLPAFDAALHVSVELAHNAIKDDIKNKQYYIGLRGSFGDHHVNPRTLRSIHLGKMMSLEGIVTRCSLVRPKILKSVHYCENTAKFHQREYRDATMYGTLPPSSTVYPTEDESGNRLTTEYGHSQFRDHQMISIQEMPERAPPGQLPRSIDVVMDDDMVDRCKPGDRIQLVGMYRSLGNRVGQSSSSTFRTLMIGNNINLLSSKAGGGIAQAHITDTDIRNINKIAKRKNVFNLLSQSLAPSIYGHEYIKKAVLLLLGGEEKNLPNGTHIRGDINILMVGDPSTAKSQMLRFVLNTAPLAIATTGRGSSGVGLTAAVTTDKETGERRLEAGAMVLADRGVICIDEFDKMSDVDRVAIYEVMEQQTVTIAKAGIHTSLNARCSVVAAANPIYGQYDVHKDPHKNIALPDSLLSRFDLLFVVTDDVDEQHDRMISEHVLRMHRYLQPGLEEGTPAVDNLTXALDVGAPEGTDADGAAMLGDTSPFEKYNPLLHSGVTGSGRGNDKKEVLSIAFIKKYVQYAKSRIHPVLTKGAAEWIVNVYSNLRNDELSGNQKRTSPLTARTLETLIRLATAHAKSRLSSKVEERDAEAAEEILRFALFKEVLGGRRAANKRRRTGNSPMSDDEDQDDDDDDDSGDEAARTDPNAAYRGGSRGRGGRSRGGGRRGGDRYGEDAHSSDDDDDDAGAFVSSQRSARSNGSYATRAAAAGRAKPKPAMVGPGGMDEEMLDEEDMDALEAMRSLDVEVVIPSQAPPPSAPRAVSAQRIEAFKESLSDLLFASDGRLAETDAIPLDDLLPVMNEGRRTEDLFDSNEARQVLEQMHRENSIMFSEDMVFKL

SEQ ID NO: 58573 - protein, 473 aa, Glycine max
MQPPRRKNNNLPNSETSTTMKGKRNSSISISIVVVVFSIFLFGVFMYNEDVKSMAEFTFLRPKAQEIQEETVSNNNSRTQPERKPVEDSEESQEPIDLKAVVAEERIVEEYEERNEEVVLPPEECDLFTGEWVFDNLTHPLYKEDQCEFLTSQVTCMRSGRSDSLYQNWRWQPRDCSLPKFKPRLLLEKLRGRRLMFVGDSLNRNQWESMICLVQSVVPQGKKSLSKNGSLSIFTIEDYNATVEFYWAPFLVESNSDDPKMHSILNRIIMPESIEKHAVNWKNVDYLIFNTYIWWMNTDTMKVLRGSFDEGSTEYDEVPRPIAYGRVLNTWSKWVEDNINPNRTKVFFSSMSPLHIKSEAWNNPDGIKCAKETIPILNMSTTLQVGTDRRLFVVANNVTQSMKVVPVNFLNITTLSEFRKDAHTSVYTIRQGKMLTPEQQADPATYADCIHWCLPGLPDTWNEFLYTRIISQS

SEQ ID NO: 58574 - protein, 104 aa, Zea mays
  misc_feature (35)..(35): Xaa can be any naturally occurring amino acid
MSMRGKGGKGLGMGGAKRHRKVLRDNIQGITKPAXIRRLARRGGVKRISGLIYEETRGVLKIFLENVIRDAVTYTEHARRKTVTVMDVVYALKRQGRTLYGFGG

SEQ ID NO: 58575 - protein, 612 aa, Streptomyces avermitilis
MTEDLSPAERYGSSSARCRAGHRARPLPRDVRLRPRPLPDRGLSGTRGGQGGAGGRATGSGKTIVGEFAVHLALQQGKKCFYTTPIKALSNQKYADLARRYGADKVGLLTGDNSVNSDAPVVVMTTEVLRNMLYAGSQTLLGLGYVVMDEVHYLSDRFRGAVWEEVIIHLPESVTLVSLSATVSNAEEFGDWLDTVRGDTQVIVSEHRPVPLFQHVLAGRRMYDLFEEGEGHKKAVNPTSRGWPAWRPAAVVPGPQTRPRHARPTASVTRAAVAGVDAGPARGDRAAGRRRAAARHHVHLQPRRLRGRRPAVPVRGPQAERRGRARQGARLVEERTASIPTEDLHVLGYYEWLEGLERGIAAHHAGMLPTFKEVVEELFVRGLVKAVFATETLALGINMPARSVVLEKLVKWNGEQHADITPGEYTQLTGRAGRRGIGCRGPRGRVVAARFSPEHLAGLAGTRTYLRSSFKPSYNMAVNLVDQFGRHLTRAARDVLRAVPGDKSVVGISRQVQRNEEGLEGYKESMTCHLGDFEEYAAPRTQGPRDRAGQAGRGAAAGQAAVALEKLKPGDVIHVPTASTPDWRSCSTRACPRAAPTAIVASSSTTRRGRWC

SEQ ID NO: 58576 - protein, 482 aa, Shewanella sp. MR-7
MLLKDPSLLRQQCYINGQWCDAQSKETVAIANPATGAVIASVPVMGQAETQAAIAAAEAALPAWRALTAKERGAKLRRWFELLNENSDDLALMMTTEQGKPLAEAKGEVTYAASFIEWFAEEAKRVYGDTIPGHQGDKRIMVIKQPVGVTAAITPWNFPAAMITRKAAPALAAGCTMVVKPAPQTPFTALALAVLAERAGIPAGVFSVITGDAIGIGNEMCSNPVVRKLSFTGSTQVGIKLMEQCAPTLKKLSLELGGNAPFIVFDDANIDAAVEGAMIAKYRNAGQTCVCANRIYVQAGVYDEFARKLSIAVGKLKVGEGITEGVTTGPLINRAAVEKVQSHLEDALSKGATVVAGGKPHSLGGNFFEPTVLTHVDSSMRVAREETFGPLAPLFKFTDVDDVIKQANYTEFGLAAYFYGRDISLVWKVAEALEYGMVGINTGLISTEVAPFGGMKSSGLGREGSKFGIEEYLEIKYICMSV

SEQ ID NO: 58577 - protein, 315 aa, Arabidopsis thaliana
MPTLYKKNIMPSSDSTMMKKGTKRKIEIKKRETKEQRAVTCSKRRQTVFSKAADLCLISGANIAVFVTSPSDSSDVVYSFSGYSSAYEIADCYLNRKPPPKIVNPAGSKLGFWWEDPDLYHSCDDLSELSIIEDRLQRMKKHVMACLEKEEKSQLVSSFDQNPNSTCSLDVEDCDGSSYSQIASTFTPNSVNEYCSDQTFSSFHGDQNPNLSSPSFDQDCYSSLYQICGESSSQVASFDQNPSSEIQGFETEEEINQINLLLQETQTEANVNLDDEICFWNDLSNDDVFGLNSYFGLDNTNAMINFGDSDFRRHV

SEQ ID NO: 58578 - protein, 136 aa, Escherichia coli
SGMHCHMSLSKNGVNLFAGDKYAGLSEQALYYIGGVIKHAKAINALANPTTNSYKRLVPGYEAPVMLAYSARNRSASIRIPVVSSPKARRIEVRFPDPAANPYLCFAALLMAGLDGIKNKIHPGEAMDKNLYDLPP

SEQ ID NO: 58579 - protein, 360 aa, Pseudomonas fluorescens PfO-1
MSKQILILPGDGIGPEIMAEAVKVLELANEKYSLGFELSHDVIGGAAIDKHGVPLADETLDRARAADAVLLGAVGGPKWDTIERDIRPERGLLKIRAQLGLFGNLRPAILYPQLADASSLKPEIAAGLDILIVRELTGGIYFGAPRGTRTLENGERQSYDTLPYSESEIRRIARVGFDMARVRGKKLCSVDKANVLASSQLWREVVEQVAKDYPDVELSHMYVDNAAMQLVRAPKQFDVIVTDNMFGDILSDEASMLTGSIGMLPSASLDANNKGMYEPCHGSAPDIAGKGIANPLATILSVSMMLRYSFNLHEAADAIEKAVSVVLDQGLRTGDIFSTGCTKVGTQEMGDAVVAALRNL

SEQ ID NO: 58580 - protein, 195 aa, Triticum aestivum
MCKKREGGSSYQAIYLHSTAMAPTVMASSVTSVVPFQGLKSTAGLPVSRRSNGASLGSVSNGGRIRCMQVWPVEGVKKFETLSYLPPLSREALLKQVDYLIRSKWVPCLEFSKVGFIFREHNASPGYYDGRYWTMWKLPMFGCTDATQVINEVEEVNKEYPDAYVRIIGFDNMRQVQCVNFIAFKPPGCEESGKA

SEQ ID NO: 58581 - protein, 77 aa, Arabidopsis halleri subsp. halleri
MSTESYDDAIKRLGELLSKKSDLGNVAAAKIKKLTDELEELDSNKLDAVERIKSGFIYFKTNNYEKNPTLHNALAKS

SEQ ID NO: 58582 - protein, 559 aa, Schizosaccharomyces pombe
LTMCGILAVHHVAEDIEAFKPKALHLSKQLRHRGPDWSGKAIRNQTILCHERLAIVGVESGAQPLVSDDGKLVLTVNGEIYNHLKLRENLKGNYKFKTYSDCEVILYLYREHGPACANMLDGMFSWVLYDQDKDKVVAARDPIGITTLYQGFSSDSPDTAYFASELKALHPVCDKIIAFPPGHYYDSETKQTVRYFKPSWWDENKIPSNPVDYKLLRETLEASVRKRLMAEVPYGVLLSGGLDSSLIASIAARETEKLANSTSQSEEARTITAWPKLHSFAIGLPGSPDLLAARKVADFLHTFHHEHTFTIDEVLMLFVTLFTILRHMMLPLSVQVPPCIYYLVKSRLKVLKWFCLVRDLTKSLVDTYISVMPPLVRPSIPSVCVVLRTCTYPNACVLTSQLWLGVLRLVFLSWIRTFWKLLLTLILRRKCILTVVKKNIFFAKALDTTHDSSLQPYLPQDILWRQKEQFSDGVGYSWIDALKDTAELCISDDEFALPRREWGDDIPTTKEAFWYRKLFDEIFPRQCADTVMRWVPKAEWGCPEDPSGRYQAGHVAALK

SEQ ID NO: 58583 - protein, 162 aa, Parvularcula bermudensis HTCC2503
MSRVAQALKGATLSDFTSAFWLGMKYFFRPKATVNYPFERGPSSPRFRGEHALRRYPNGEERCIACKLCEAVCPAQAITIEAEERADGSRRTTRYDIDMVKCIYCGLCQESCPVDAIVEGPTLQIATETREELLYDKDRLLANGDRWERLIAKNIELDAPYR

SEQ ID NO: 58584 - protein, 202 aa, Synechococcus sp. WH 8102
MARQGDIHRVTGETDVKVRLDLDGSGQCQASTGVPFLDHMLHQISSHGLIDLEINAVGDTHIDDHHTNEDVGIAVGQALAQALGDRRGIHRFGHFAAPLDEALVQVALDCSGRPHLSYSLSIPSQKIGSYDTELVKEFFVAVVNNSGLTLHIRQLDGVNSHHIVEACFKAFSRALRMATEIDPRRAGAIPSSKGVLEQAGAN

SEQ ID NO: 58585 - protein, 120 aa, Rhodospirillum rubrum ATCC 11170
MAYDDSNIFARILRGEIPCDKVFEDDHVLAFRDINPQAPVHVLVIPKGPYRSWTEFSATASDGEIAALVRAVGTVAADLGVVEQGYRVLSNIGADGGQEVPHLHLHLFGGRRLGRMIAAD

SEQ ID NO: 58586 - protein, 396 aa, Synechococcus sp. WH 8102
MNQASSLPNQAAVVIVGGGMAGLSCAASLARRGIRDVVLLEAKTLAHAKASSFGETRMFREMYSDPVLCRLAQEANRLWREEETHAGEQLRETHGLLFYGESWDEETIEGSIPGARQVMDDQGIPYEALDADAIRARFPLKPKPEFTGLFEPTAGAVRSDKVIAHWTRTARQAGQQLIEHCPVAGIDADGTGVTLDNGHHIRAGQVVVTSGIWTQLLLAPLGLAPKLEVWPMLWAHYTVDPALADRYPQWFCFQRERGDDGGLYYAFPVLSHTPDGLPRIKAGIDWAPKELRVAEPNAMATEPPERLVELLDSFLFNEVAGVQERVETVMSPYSMASDVNFVLDRLSPTLSLFAGGSGQAFKFAPLIGDSLARLACGEQPAVDLNCWSHQRDAVRA

SEQ ID NO: 58587 - protein, 232 aa, Brassica napus
MSSSPEKKKKKLAEELPSTQQTNPTPSLPDELLTSCIARLSRLYYPTVSLVSKSFRSLLSSPELYKARSLVSRTETCLYLCLESSSDSCWFTLCRKPDKTVTKDDVSKNKKNNDDVSKKKSTSYVLCKLPALHSPPAVFSGLVSVGSDIYNIRSSSNVSVLDCRFHTWRKAPSLPVELMALSACAVDEKIYVAGIHGESLKNASKVLNARTQTWDHVVSIPCSLKRRGALNM

SEQ ID NO: 58588 - protein, 199 aa, Rhodospirillum rubrum ATCC 11170
MRQATVTRATKETEITVWLDLDGTGQYEVSTGIGFLDHMLEQVSRHSLMDLRVHAKGDTHIDFHHTTEDTGLAIGQAVTQALGDRKGIQRYGSALIPMDEALTQVAVDLSNRPYLIWKVDFSRDKLGDMDTELFKEWFQAFSQTAGVTLHVANHYGENNHHIVESCYKALARALRQAWEIDPRKADAVPSTKGVLGGTL

SEQ ID NO: 58589 - protein, 416 aa, Oryza sativa (japonica cultivar-group)
MVAEAEVMHQPVPVLEVPYHRCVAKGVEEVAAAAAVAPPPVVEVEVAVQVPHMVYYGVYCLSVYYTRLFSVRGCKRLTQFGLESAAGAPSISVDALQFVPSIRSGSFADIGPRRYMEDEHIRIDDLSAHLGSLLVCPLPSAFYGVFDGHGGLDAAAYMKRHAMRFLFEDSEFPQASQVDETYVQSVENSVRRAFLQADLALADDLDISRSSGTTALTALVFGRQLLVANAGDCRAVLCRRGVAMEMSRDHRANYAEECERVAASGGYIEDGYLNGVLSVTRALGDWDMKMPDGSISPLIAEPEFRQTMLTEDDEFLIMGCDGIWDVMTSQHAVSIVRRGLRQHDDPERCARELVMEAKRLETADNLTVIVVCFVSELGSPRQEQVGGQAGVARPRSCKSLSAEALCNLRSWLETDR

SEQ ID NO: 58590 - protein, 336 aa, Citrus clementina x Citrus reticulata
MASVIILLLGMLIATLDTTSAQIGVCYGMLGDNLPSKPDVIALYNQNNIRRMRLYDPNKEALEALRGSNIEVMMGVSNDFDLLRRIASKQAEANTWVQDNVQNFVNNVKFKYIAVGNEAKPGDDFAQYLVPAMRNIQNAINGANLGSQIKVSTAIAGALDTKSSPPSAGSFNQDYRPILDPLITFLNENNSPLLVNLYPYFAIVGDRQISLDYALFRSQQPVVSDPPLSYQNLFDAQLDATYAALEKPVGGSLDIVVSESGWPSAGDGALTSVDNARTYNNNLIQHVKQGSPKKPSRPIETYIFAMFDEDKKGDEIERHWGLFSPDRQTKYQVNFN

SEQ ID NO: 58591 - protein, 339 aa, Aspergillus nidulans FGSC A4
MAKTLAFVAHEAGSTFTANSILYSVTWKLRSLLYLLRVAEMSRGTSNLKYLSNALATPEQLTSSSSAIDGVPTDLETSVRFAGTQLTQAAGVLLRLSQDIIAQAIVTFTRFWLGPEGGSLRIYSAKDVSAAALYLTAKLSFQPTSPRSVLTVYAFLLAKEASPLWFVNPKGSPNEPIPTRYHLTEGGYQSQRQILLRIESVILRTLGFNTHVALPHTITLTYLQTLGVSSTEVARRAFEHLNSSLLSPQLLFVTHQPNALAVASIYLAARERGVKLVDGEWWEVFDVDREDLGFLVVGMQSMEGFARAEMERWKGRTVPLDVEEVEAEIERRQMLESGE

SEQ ID NO: 58592 - protein, 693 aa, Streptomyces avermitilis MA-4680
MKMSTHTHDSFEWTDLDRRAVDTARLLAADAVQKVGNGHPGTAMSLAPAAYTIFQKVMRHDPADPEWTGRDRFVLSPGHTSLTLYTQLFLAGYELELDDLKAFRTHGSKTPGHPEYGHTAGVETTTGPLGQGAANAVGMAMAARYERGLFDPHAPEGESPFDHTIWAIVSDGDLEEGISAEASSLAGHQKLGNLVFLYDDNHISIEGDTATAFSEDVPKRYEAYGWHVQRIEPSADGDIDVHALHAALKAAQAETERPSFIAMRTIIAWPAPNAQNTEASHGSALGAEEIAATKRVLGSDPEQTFEVADEVLAHARRALDRGAEEHAAWDKRIAEWRTAQPERAKLFDRIVAGQLPEGWEQSLPVFEAGTSVATRAASGKVLQALGAVIPELWGGSADLAGSNNTTIDKTSSFLPKGNPLPEADPYGRTVHFGIREHSMAAEMNGIALHGNTRIYGGTFLVFSDYMRNAVRLSALMQLPVTYVWTHDSIGLGEDGPTHQPVEHLASLRAIPGLNIVRPADANETAIAWREILERHATHPAPHGLALTRQGVPTYEANEDAAKGGYVLQEASTGTPDVVLIATGSEVQLAVAARERLEAEGVGTRVVSMPSVEWFEEQSPEYRASVLPPSVKARVAVEAGIGLTWHRYVGDAGRIVSLEHFGASADAETLFAEFGFTAENVAAAARESITAARG

SEQ ID NO: 58593 - protein, 323 aa, Brassica napus
  misc_feature (307)..(307): Xaa can be any naturally occurring amino acid
VARADRLVSNGGWDSWGNDDSYRSRTDMRRNQSENDFRGLGGGGGGAPVKSKSSEDIYTRSQLEASAAGKESFFARRMAENESKPEGLPPSQGGKYVGFGSGSGSVPRSNQQDDVYSVVSQGFGRLSMVAASAASVVQTGTKEFTSKVKEGGYDHKVSETVNVVASKTTEIGQRTWAFMKGVMAIASQKVGEYTKEGKTTSWNQRNESESNGYYQNFGNGNKAANPSVEGRGSQSSSSGYYNNSHKSNSWDDWGENESKKKEAVASKGSSASNDDDGWTGWDDPKDDVYYQSAGDKKSAGHNGKSNXRLDWWRLSVKVISECL

SEQ ID NO: 58594 - protein, 483 aa, Marinobacter sp. ELB17
MIESPLLQNITGYAGGQWQQAAADTFDVDNPATGAVIAKVPFVTEQQVQDAIAAAKKAEKLTTPYPLETRRKWLEDIRDALTANRAEMGRILCLEHGKPLNEAQGEVDYAAGFFDYCAKNIEVLSPRNLDERPKGCSWTVHFRPVGVVGLITPWNFPIGMIAKKLSAALAAGCPSVIKPASATPLTMVALFTLMDKYVDLPAGMVNLVMGKASMIGKALSESPDVPMLSFTGSTEVGRQLIIDSADSVKKLALELGGNAPFIVFDDADLDAAVDNLMANKFRGSGQTCVCANRIFAHEKIVESFSQKLAERVRKMTVGDGINGDVDLGPLINRDGYNKVKRHLENALEQGATLVAGKKPSELNDDDLFFPPTVITGVTPQMCCSREETFGPLVPIASFSDENEVIAAGNDTEFGLASYVFTADVKRAQRVAAGLRFGHVGWNTGTGPTPEAPFGGMKMSGTGREGGEEGLFEFTEAQTVPRGF

SEQ ID NO: 58595 - protein, 381 aa, Coccidioides immitis RS
MAEATLHNAPIVLDNGSGTIRAGFAGEDLPKCYFPSFVGRPKHPRVLAGALEGDVFIGQRAQELRGLLKIRYPLEHGIVTDWDDMEKIWQWVYEGELKTLSEEHPVLLTEPPLNPRANRDTAAQILFEQFNIPALYTSIQAVLSLYASGRTTGIVLDSGDGVSHAVPVYEGFAMPSSIRRIDVAGRDVTEHLQLLLRKSGYVFHTSAEKEVVRMIKEKTSYVALDPKKEEKEWSTGVGKQDTKIQEYVLPDGHKLKVGVERFRAPEILFDPEIIGLEYPGVHQIVVDAINRTDMDLRKSLFANIVLSGGSTLCKGFGDRLLHEVQRLAVKDMRIKIFAPPERKYSTWIGGSILAGLSTFRKMWVSIDDWHENPDIIHQKFT

SEQ ID NO: 58596 - protein, 126 aa, Enterococcus faecalis V583
MKTIKTKQAPQAIGPYSQAKIVNGLLITSGQIPLDPETGKVVGTTIKEQTNQVLKNIQGILTEAGSDFAHVVKTTCYLQNMADFTAFNEVYAEYFSAEYPARTTIEISKLPMDVLVEIEIIAEVVA

SEQ ID NO: 58597 - protein, 141 aa, Escherichia coli
GDNGSGMHCHMSLSKNGVNLFAGDKYAGLSEQALYYIGGVIKHAKAINALANPTTNSYKRLVPGYEAPVMLAYSARNRSASIRIPVVSSPKARRIEVRFPDPAANPYLCFAALLMAGLDGIKNKIHPGEAMDKNLYDLPPE

SEQ ID NO: 58598 - protein, 382 aa, Vitis vinifera
MSIVCVEGNPPSMFNPPTDDHKNQEPLVFDASVLRHQSNIPKQFIWPDAEKPGDKATELSVPLIDLGGFLSGDPAAAMEATRLVREACQKHGFFLVVNHGVDDKLIYKAHQYMDSFFGLPLAKKQRAQRKLGEHCGYASSFIGRFSSKLPWKETLSFSYSAEKKSSNAVQEYFLNKMGEDFSEFGQVYQDYCEAMSTLSLVIMELLGMSLGIGGAHFREFFEENDSIMRLNYYPPCLKPDLTLGTGPHCDPTSLTILHQDQVGGLQVFVDDKWWSISPNFDAFVVNIGDTFMALSNGRYKSCLHRAVVNSQTPRKSLAFFLCPEKDKVVRPPTELVDTNSPRIYPDFTWSNLLEFTQKHYRADMKTLEVFSSWLQQKTAEAG

SEQ ID NO: 58599 - protein, 135 aa, Escherichia coli
GSGMHCHMSLSKNGVNLFAGDKYAGLSEQALYYIGGVIKHAKAINALANPTTNSYKRLVPGYEAPVMLAYSARNRSASIRIPVVSSPKARRIEVRFPDPAANPYLCFAALLMAGLDGIKNKIHPGEAMDKNLYDL

SEQ ID NO: 58600 - protein, 509 aa, Agrobacterium tumefaciens str. C58
MDAMTKLDVKQEAAALLDKMGVARDLYTGGDMASFSPVTGEQIASLRTVSVEGVAAVVDKADAAFRTWRNVPAPRRGELIRLLGEELRAFKTDLGRLVSLEAGKIPSEGLGEVQEMIDICDFAVGLSRQLYGLTIATERPGHRMMETWHPLGVVGVISAFNFPVAVWSWNAALALVCGNSVVWKPSEKTPLTALAVQGIFERAAARFGDAPEGLSQLLIGDRAVGEAMVDYPKVPLVSATGSTRMGRDVGPRLAKRFARAILELGGNNAGIVCPSADLDMALRAIAFGAMGTAGQRCTTLRRLFVHDSVYEELVPRLKKAYASVSVGNPLESSALVGPLVDKAAFDGMQKAIEAAKAAGGVVHGGDRVDTGAADAYYVKPALVEMPKQVGPVLEETFAPILYVMKYSDLDQAIDAHNAVAAGLSSSIFTRDIQESERFLSSEGSDCGIANVNIGTSGAEIGGAFGGEKETGGGRESGSDSWKAYMRRATNTINYSKALPLAQGVSFDIE

SEQ ID NO: 58601 - protein, 140 aa, Escherichia coli
GDNGSGMHCHMSLSKNGVNLFAGDKYAGLSEQALYYIGGVIKHAKAINALANPTTNSYKRLVPGYEAPVMLAYSARNRSASIRIPVVSSPKARRIEVRFPDPAANPYLCFAALLMAGLDGIKNKIHPGEAMDKNLYDLPP

SEQ ID NO: 58602 - protein, 717 aa, Arabidopsis thaliana
MAPNLHIKKAFMAMRAMGIEDAQVKPVLKNLLALYDKNWELIAEDNYRVLADAIFDSHEDQAIQESEEKKADEVKEDEGCAAEVDRGKKKLHESIEDDEDVMAESDRPLKRLRRRGEGGSALASPSLGSPTLEGPSINDEENAPILLPYHPVPIENDHDAGELILTKVEPITNMPLSSIPDSVDRGDSSMLEIDKSNGHVEEKAGETVSTADGTTNDISPTTVARFSDHKLAATIEEPPALELASSASGEVKINLSFAPATGGSNPHLPSMEELRRAMEEKCLRSYKILDPNFSVLGFMNDICSCYLDLATNGRDSANQLPKNLPFVTTNIDALKKSAARMAYTSQASNDVVEICSNEHMRDAENGAVGDSMALVVVPECQLSADEWRLISSVGDISLGKETVEIPWVNEVNDKVPPVFHYIAQSLVYQDAAVKFSLGNIRDDQCCSSCCGDCLAPSMACRCATAFNGFAYTVDGLLQEDFLEQCISEARDPRKQMLLYCKECPLEKAKKEVILEPCKGHLKRKAIKECWSKCGCMKNCGNRVVQQGIHNKLQVFFTPNGRGWGLRTLEKLPKGAFVCELAGEILTIPELFQRISDRPTSPVILDAYWGSEDISGDDKALSLEGTHYGNISRFINHRCLDANLIEIPVHAETTDSHYYHLAFFTTREIDAMEELTWDYGVPFNQDVFPTSPFHCQCGSDFCRVRKQISKGKNVKKRA

SEQ ID NO: 58603 - protein, 113 aa, Escherichia coli
SLSKNGVNLFAGDKYAGLSEQALYYIGGVIKHAKAINALANPTTNSYKRLVPGYEAPVMLAYSARNRSASIRIPVVSSPKARRIEVRFPDPAANPYLCFAALLMAGLDGIKNK

SEQ ID NO: 58604 - protein, 498 aa, Shewanella sp. MR-7
MSTPKKRSDWESLAASLAINGKAYINGEYRDAAAGSTFDCVSPIDGRVLAKVASCDLMDANIAVANAREVFESGVWSKTAPVKRKQVMIRFAELLEENANELALLETLDMGKPIRFSKAVDITGAARAIRWSGEAVDKLYDELAPTAHNEIGMITREPVGVVAAIVPWNFPLLMACWKLGPALATGNSVILKPSEKSPLTAIRIAELAVQAGIPKGVLNVLPGYGHTVGKALALHMDVDSLVFTGSTKIAKQLMIYAGESNMKRVWLEAGGKSPNIVFNDAPDLKAAAVAAAEAIAFNQGEVCTAGSRLLVESGVKDQLIALIAEELTSWQPGHPLDPTTVSGAVVDKQQLDTILSYIKAGQDEGASLVHGGQQVLAETGGVYVQPTIFSQVHNKMKIASEEIFGPVLSVIEFNGMEEAIAIANDTIYGLAAGVWTADISKAHKTAKALRSGMVWINHYDGGDMTAPFGGYKQSGNGRDKSMHSFDKYTEIKATWIAL

SEQ ID NO: 58605 - protein, 341 aa, Streptococcus pyogenes MGAS10394
MMTIAIDWDNLGFEYHKLPFRYISYYKNGQWDKGQLTEDATLHISESAPALHYGQQAFEGLKAYRTKDGSIQLFRPDRNAARLQATADRLLMPQVSTEQFIDAAKQVVKANEDFVPPYGTGATLYLRPLLIGVGDIIGIKPAEEYIFTIFAMPVGNYFKGGLAPTNFIVSEAFDRAAPYGTGAAKVGGNYAGSLLPGKAAKSAGFSDVIYLDPATHTKIEEVGAANFFGITANNEFVTPLSPSILPSITKYSLLQLAEERLGMTVIEGDVPINELDKFVEAGACGTAAVISPIGGIQYKDNLHVFYSETEVGPVTRRLYDELVGIQFGDIEAPEGWIVKVD

SEQ ID NO: 58606 - protein, 507 aa, Zea mays
  misc_feature (285)..(285): Xaa can be any naturally occurring amino acid
MMASQAMVPLRQLFVDGEWRPPAQGRRLPVVNPTTEAHIGEIPAGTAEDVDAAVAAARAALKRNRGRDWARAPGAVRAKYLRAIAAKVIERKQELAKLEALDCGKPYDEAAWDMDDVAGCFEYFADQAEALDKRQNSPVSLPMETFKCHLRREPIGVVGLITPWNYPLLMATWKVAPALAAGCAAVLKPSELASVTCLELADICKEVGLPPGVLNIVTGLGPDAGAPLSAHPDVDKVAFTGSFETGKKIMAAAAPMVKPVTLELGGKSPIVVFDDVDIDKAVEWXTLFGCFWTNGQICSATSRLLVHTKIAKEFNEKMVAWAKNIKVSDPLEEGCRLGPVVSEGQYEKIKKFILNAKSEGATILTGGVRPAHLEKGFFIEPTIITDITTSMEIWREEVFGPVLCVKEFSTEDEAIELANDTQYGLAGAVISGDRERCQRLSEEIDAGIIWVNCSQPCFCQAPWGGNKRSGFGRELGEGGIDNYLSVKQVTEYISDEPWGWYRSPSKL

SEQ ID NO: 58607 - protein, 147 aa, Escherichia coli
KPMFGDNGSGMHCHMSLSKNGVNLFAGDKYAGLSEQALYYIGGVIKHAKAINALANPTTNSYKRLVPGYEAPVMLAYSARNRSASIRIPVVSSPKARRIEVRFPDPAANPYLCFAALLMAGLDGIKNKIHPGEAMDKNLYDLPPEEA

SEQ ID NO: 58608 - protein, 413 aa, Schizosaccharomyces pombe
HTSEREELFIKKLEQCNIIFDFNDPSSDLASKEIKREALLQMIDYVSENRGISSASLFPYVVNTFSLNVFRPISPALNDYSSDMFALDDEPFLEPAWPHLEEVYLLFIKFLESPDFRASKAKSLVDRRFFNRLLALFDTEDPRERELLKTTLHRIYGKFLNLRSYIRKSMNNVFLQFIYEREKFHGIAELLEILGSIINGFAVPLKEEHKIFLSKVLIPLHQTKSVFLYHPQLTYCIVQFIDKDPSLTKAVLTGILKYWPRINSFKELLFLNEIEDIFEVLEPSEFVNIMSPLFQQLARSISSMHFQVAERALCLWSNEYFTSLVSQNVVTLLPIIYPSLYKTANEHWNSTIQAIACNVLQIFVDMDADFFNGLVEDYKQAIIKQEEVMIIRKQQWCQIEALAAENKPTDYLR

SEQ ID NO: 58609 - protein, 487 aa, Synechococcus sp. WH 8102
MASAPLRLSPAPIKFGTDGWRGVLGVDITVERLLPVAAAAAQELAHRAPDGLNSRTVIIGFDRRFLAPELAEAIANAVRGCELEPLLTETPVPTPACSWAVVERKALGALVITASHNPPEWLGLKIKGPFGGSVEGDFTAAVERRLAAGGITPPIAATTSRFDGRGEHLEGLRRKLDLTALVTGLKAMNLKVFVDPMHGSAAGCVSDLLGPEASELVDEIRSTRDPLFGGNPPEPLAPYLSDLITAVQHSTAAGTPAVGLVFDGDGDRIAAVDENGRFCSTQLLMPLLIDHLARARQLPGTVVKTVSGSDLMRLVAEAQGREVLELAVGFKYIASEMLAGEVLIGGEESGGVGFGMHLPERDALFAAMLVLEALVEGGQPLGSRLDALQQRHGGASHYDRLDLRLQDMEARRRLETLLASSTPQQVAGDAVVEVNTTDGIKLRMGASHWLMLRFSGTEPLLRLYCEAPDRDRVDAVLAWAKRYAEAA

SEQ ID NO: 58610 - protein, 549 aa, Streptomyces avermitilis MA-4680
MSDSPRLTRRPEWTELEDHRAGPLLHPALRELFAADPERAERYVVRAGDLRLDYSKHLITDETLALLQELATATDVFGLRDAMFRGEKINVTENRAVLHTALRAPRDAVIEVDGENVVPAVHAVLDRMADFADRVRSGEWTGHTGSRIRTVVNIGIGGSDLGPAMAYEALRAFTDRSLTVRFVSNVDGADLHEAVRDLDPAETLFVIASKTFTTIETITNATSARSWLLAGLDGDEKAVAKHFVALSTNAGKVSDFGIDTANMFEFWDWVGGRYSFDSAIGLSLMIAIGPERFRELLDGFRIVDEHFRTAPAEANAPLLLGLLGVWYGSFFGAQSHAVLPYSHYLSKFTAYLQQLDMESNGKSVDRDGHPVEWQTGPVVWGTPGTNGQHAYYQLLHQGTKVIPADLIGFINPVDGLSDELAAQHDLLMANLFAQGQALAFGKTGDEVRAEGVPEEQVPHRTFRGNHPTTTILAAELTPSVLGQLIALYEHKVFVQGAIWNIDSFDQWGVELGKVLAKRVEPALTEGADVPGLDPSTAALVAAYRTHRKK

SEQ ID NO: 58611 - protein, 375 aa, Nicotiana tabacum
MEVISTNTNGSTIFKNGAIPMNGHQNGTSEHLNGYQNGTSKHQNGHQNGTFEHRNGHQNGTSEQQNGTISHDNGNELLGSSDSIKPGWFSEFSALWPGEAFSLKVEKLLFQGKSDYQDVMLFESATYGKVLTLDGAIQHTENGGFPYTEMIVHLPLGSIPNPKKVLIIGGGIGFTLFEMLRYPSIEKIDIVEIDDVVVDVSRKFFPYLAANFNDPRVTLVLGDGAAFVKAAQAGYYDAIIVDSSDPIGPAKDLFERPFFEAVAKALRPGGVVCTQAESIWLHMHIIKQIIANCRQVFKGSVNYAWTTVPTYPTGVIGYMLCSTEGPEVDFKNPVNPIDKETTQVKSKLGPLKFYNSDIHKAAFILPSFARSMIES

SEQ ID NO: 58612 - protein, 137 aa, Desulfotalea psychrophila LSv54
MEKTFAIIKPDAFAAGNAGKILARIYQEGFTVIGLKKLCMSQREAEGFYAVHNKKPFFAELTKFMSSGPCIVMVLEAEGCIGKWRDLMGATNPADAKPGSLRREFGTIVGENATHGSDAPETAAVELEYFFSGLELL

SEQ ID NO: 58613 - protein, 342 aa, Pyrobaculum aerophilum str. IM2
MRIFKTPGPIKYINCLLTAAMYFPGLEGVVVKETKICHIDLENSKIYYRGYDLEELAQYSTFEEVAYLLWFGKLPAGAELERFKAELMMYRKPPEHVDEAVKIAPKNAEPIDVLRTAVSAMALGEDLSDRSPEAELVRGLKITAAMPYIVASFDRLRRGSQPLHPGEAKSHAEYFLWALRGERPGEREVRALDVMLIIYAEHSMNNSAFTAVTVASTLSDMYAAITAAIASLKGPLHGGANVDAAKMLEEIGDAKRVESWVDQQLSRGRRIPGFGHRLYKKGPDPRLRVLRKLARDLASEKGDFKWVELAERLEEYVTAHLSQKGIYPNTDLYAAVIFKYLG

SEQ ID NO: 58614 - protein, 304 aa, Aspergillus nidulans FGSC A4
MAATNGASNDFTVKAGLAQMLKGGVIMDVVNAEQARIAEEAGAAAVMALERVPADIRAQGGVARMSDPSMIKEIMEAVTIPVMAKARIGHFVECQILEAIGVDYIDESEVLTPADNLYHVTKHNFKAPFVCGCRNLGEALRRISEGAAMIRTKGEAGTGDVVEAVKHMRTVNAEIARARAILQSSPDPEPELRAYARELEAPYELLREAAEKGRLPVVNFAAGGVATPADAALMMQLGCDGVFVGSGIFKSGDAKKRAKAIVQAVTHYKDPKVLAEVSQGLGEAMVGINVSHMKDEDKLAKRGW

SEQ ID NO: 58615 - protein, 291 aa, Streptomyces avermitilis MA-4680
MTQDSYLVGLIGSGIGPSLSPALHEREAGRQGLRYHYRLIDIDRLGVGPEAVGGLVRAARDLGFDGLNITHPCKQLVISHLDTLAPQAEALGAVNTVVFEDGRAVGHNTDVTGFAASFARGLPDARLERVVQLGAGGAGAAVAHALLTLGAGHVTVVDALPERAAALAVALNRHFGDGRAAAASPDTLPKLLTDADGIVHATPTGMAAHPGIPLPAELLHPGLWVAEVVYRPLETELLRTARALGCATLDGGGMAVFQAVDAFRLFTGREPDSMRMLADIAELAGTAAVRH

SEQ ID NO: 58616 - protein, 400 aa, Campylobacter lari RM2100
MFEEIHFNTIERLPNYVFAEVNAIKMAARRAGEDIIDFSMGNPDGKTPQHIIDKLCESANKDKTSGYSASSGIYKLRLAICSWYKRKYDVDLDPESEVVATMGSKEGFVNLARAVINPGDVAIVPTPAYPIHTQAFIIAGGNVATMNFDFNENYELNENTFFENLQKTLHESIPRPKYVVVNFPHNPTTVTVEKSFYERLVAMAKKERFYIISDIAYADLTFGSYKTPSIFEVEGAKDVAVETYTLSKSYNMAGWRVGFVVGNKRLIAALKKIKSWFDYGMYTPIQVAATVALDGDQTCVEEIKATYAKRLEVLLESFYQAGWELKKPNASMFVWAKLPQSKAHLGSMEFSKQLLQKANVAVSPGVGFGEAGNEYVRIALIENENRIRQAARNIKKYLRE

SEQ ID NO: 58617 - protein, 501 aa, Kluyveromyces lactis NRRL Y-1140
MNFKLNWVTLFCTALWLHFATANKGTITEKQNQICSGMYSKEDWSGRVDPYISFDLKKLNKEGISVVIFDFQDYIHIGAKTKAGVVKYICDEEAIKENLCQEKNKNQFIISPEAYDPDSDTEKSLSADIHTFYVGNTGLVKDKYAIKKTGYYCVGTYAKDTGISYKAEVNFRNSFGNLAASEINKLPLYGLLAIFYVVAMALYLFAFWKHKHELLPLQKYLLAAFVFLTIDTIFIWGYYDLKNTKGSTAGTTVYMVIVSILNSAKITMSLFLLLVICKGYGVVYPKLNKTTMRRVQFFSVLTFAISVAALIQNYMTPSDSTSMVPLFFFIPLGICFMIFYFLILQSLDQTVKYLKQQKQIVKLGMYKKLIIIFYVALFVIFGGIILSSFVLIGMSSIEMVEQHWRTRFFFVDFWPSLVYYAVFVALSFTWRPTSTSYMLAVSQQLPTDPENVADFDLDDLQSLEQEWNQEYEQPAGSEPNEADLNFSDDENDKKKPVQPSA

SEQ ID NO: 58618 - protein, 109 aa, Escherichia coli
NGVNLFAGDKYAGLSEQALYYIGGVIKHAKAINALANPTTNSYKRLVPGYEAPVMLAYSARNRSASIRIPVVSSPKARRIEVRFPDPAANPYLCFAALLMAGLDGIKNK

SEQ ID NO: 58619 - protein, 232 aa, Aspergillus nidulans FGSC A4
MTYPLTKKIINNVNESQQEKQVTTVSPLDPGESDVGKLELPENFGEVVKGIYRCAFPQPWNLPALKTLGLRTIITLVDEPYTQSHEKFLEETGITHHRIPFIANKDPAIKTPERVVNTILRLMLNKSNHPILIHCNKGKHRTGCVTACFRKLQGWDRQDIMNEYIRYSRPKQRLLDEVFIDEFDPSALSHLAQASGAMSWELSGTYASITQEDKNSPENLIQPPRNGIRVAS

SEQ ID NO: 58620 - protein, 224 aa, Brassica napus
VRREQVDLVVSLIEKRRRAIRNKTAPSFSYLDTLFDLKVEGRETAPSNEEIVTLCSEFLNGGTDTTGTAIEWGIAQLIANPEIQSRLYDEIRSTAGDRSIEEGDVDKMVFLQAFVKELLRKHPPTYFSLTHAVMETTSLGGYDVPAGVNVEVYIPGISEDPRIWSNPKQFDPDRFISGKEDADITGISGVKMIPFGVGRRICPGLGMATVHVHLMLARMVQEFE

SEQ ID NO: 58621 - protein, 300 aa, Acidobacteria bacterium Ellin345
MKLRGCGTALVTPFKQDGSVDFAAQRALVEWQIESGIDFLVPCGTTGETPTLSHDEWLKVIAQTVEVNHGRVPIVAGATSNNTAEAVEKAKEVAAIKGVDAILTASPYYNKPTQEGQYLHFKAIAEAVDKPLVLYNVPGRTAANIETATLLRLAKIPNIIAVKEASGSLPQIMDVCAQKPEDFTVLSGDDALTLPILAVGGVGLVSVASNQIPKELSEMVRAALNNDWATARKLHNHFLALMNANFLESNPGPVKAVLAMMGRIEENYRLPMVPMRPENRAKLEKIAAEAGVLKNATVAQ

SEQ ID NO: 58622 - protein, 332 aa, Triticum aestivum
  misc_feature (75)..(75): Xaa can be any naturally occurring amino acid
  misc_feature (77)..(77): Xaa can be any naturally occurring amino acid
  misc_feature (79)..(79): Xaa can be any naturally occurring amino acid
  misc_feature (314)..(314): Xaa can be any naturally occurring amino acid
MAASTASRLSPPCLHAAPHHPLRRSRFSPLRAAKLEAVLSIGTHVIPHPRKVETGGEDAFFVGGDGGGVFAIADXVXGXIILLSTDRWAEKNVNPALFSRELMANSSTFIKDEEVSQDPQILLMKAHAATSSIGSATVIVAMLEKTGTLKIASVGDCGLKVIRKGQVMFSTCPQEHYFDCPYQLSSEAIGQTSQDALVCTVNLMEGDMIVSGSDGFFDNIFDQEILGVINESLGTDEAAKALAELARKHSVDVTFDSPYSMEARSRGFDVPWWKKLLGAKLVGGKMDDITVIVAQVKTVVIPDDEGSGVELEKXWGGEQLAAAGVASTEQNE

SEQ ID NO: 58623 - protein, 365 aa, Zea mays
MGAASPAMWAGLVLVVLLAASGPASAGLPRFAEAPEYRNGDGCPAPVTGAGVCDPGLVHIAMTLDAHYLRGSMAAIYSLLKHASCPESIFFHFLAAEGGGAPAVAELRAAVAASFPSLRFEIYPFRADAVAGLISASVRAALEAPLNYARNHLADLLPRCVPRAIYLDSDVLAVDDVRRLWETRLPAAAVVAAPEYCHANFSRYFTEAFWDDPVLGARVFAGRRRAPCYFNTGVMVIDLRRWRVGNYRQRIERWMEMQKEKRIYELGSLPPFLLVFAGEIEAVDHRWNQHGLGGDNVFGSCRPLHNGPVSLMHWSGKGKPWDRLDAGKPCPLDHTWKSYDLYIGENDSSPASGPSRSALSSLVAW

SEQ ID NO: 58624 - protein, 360 aa, Debaryomyces hansenii CBS767
MNNEQPPPQQAHTRQISFNVSDHYQILEVVGEGAYGIVCSAIHKPTNQKVAIKKIEPFERSMLCLRTLRELKLLKHFNHENIISILAIQRPINFNLFNEIYLIQELMETDLHRVIKTQKLSDDHIQYFIYQTLRALKTMHLANVLHRDLKPSNLLLNSNCDLKICDFGLARSIASSEDNFGFMTEYVATRWYRAPEIMLTFQEYTTAIDVWSVGCILAEMLVGRPLFPGRDYHNQLWLIIEVLGTPNMEDYYNIKLKRAREYIRSLPFVKKVPFANLFNSEAINPLAIDLLENLLVFNPAKRITVDNALNHPYLNIYHDPNDEPISEKIPEDFFDFDKRKDELSIEDLKKLLYDEIMKPL

SEQ ID NO: 58625 - protein, 283 aa, Rhodospirillum rubrum ATCC 11170
MITGKARVAGVIGWPVGHSRSPRLHGFWLARHGIDGAYVPLAVAPEALERALAALPALGLAGVNVTVPHKEHALARMDALTERARRIGAVNTIVCQSDGRLLGDNTDGFGFLENLRQRRPDWRAGHGPAVVLGAGGAARAVCASLLEAGCPALTLVNRDQGRARALAEALAAWSPVPITLATWDEAPRTLGGAALLVNTTSLGMVGQPPLDLDLRGLAPSALVTDIVYAPLETPLLARARALGLATVDGLGMLLHQGRPGFEAWFGVAPEVDDALRAAVLGKP

SEQ ID NO: 58626 - protein, 581 aa, Candidatus Kuenenia stuttgartiensis
MTDSAIVEKLKTRFGGSEITEQKTSDEFPTIWVSKDKLIDVISFLKTEVSKPYRMLYDLTAIDERTRAKRVEMPKGDFTVVYHLLSFERNDDIRIKVPLKGEYPSLPTITKVWSNADWYEREVYDMFGIKFDGHPHLKRILMPLTWEGHPLRKEHPARATEMGPFQLPKEKEERENQALHFNPEEWGMKRESEDSDFMFLNIGPQHPGTHGVLRLVLQLDGEEILNVVPDIGFHHRGAEKMGERQSWHTYIPYTDRIDYLAGVMNNLAYLLAVEKLAGIKVPERAQVIRIMLCELFRLSSHLVWYGTFAQDIGQLSPVFYMFSDREKVFEIIEAICGDRMHPNWFRIGGVTDDLPNGWDRLVKNFINYFPKRLKEYDTMVMQNRIFKGRTIGIGIYNTEEAIEWGVTGPGLRATGFEWDFRKKRPYSGYDQFEFDIPTAQNGDCYDRAIVRIEEMRQSIRIIEQCVKNMPSGPYKSDHPLATPPRKEKTMHDIETLITHFLGVTWGPVIPAGEAFFGIEATKGNNGYYLISDGNTSSYRTRVRTPSFPHMQMVPFISRSYTVPDLLSILGSIDFVLADIDR

SEQ ID NO: 58627 - protein, 447 aa, Zea mays
  misc_feature (186)..(186): Xaa can be any naturally occurring amino acid
  misc_feature (390)..(390): Xaa can be any naturally occurring amino acid
  misc_feature (415)..(415): Xaa can be any naturally occurring amino acid
  misc_feature (436)..(436): Xaa can be any naturally occurring amino acid
MNLAALPSTAVPPHAHGLMPLNLPSAASSSLRRSLFASLRKKISPMASAPASASAALSTAAPADNGAAKPAEQRPVQVAKRLEKFKTTIFTQMSMLAVKHGAINLGQGFPNFDGPDFVKEAAIEAIKAGKNQYARGYGVPELNSAVAERFLKDSGLQIDPDKEVTVTSGCTEAIAATILGLINPGXDEVILFAPFYGSYEATLSMAGANVKAITLRPPDFAVPLEELKAAVSKNTRAIMINTPHNPTGKMFTREELEFIADLCKENDVLLFADEVYDQLAFEADHISMASIPGMYERTVTMNSLGKTFSLTGWKIGWAIAPPHLTWGVRQAHSFLTFATSTPMQSAAAAALRAPDSYFEELKRDYGVKKALLVDGLKAAGFIVYPSSGTXFVMVDHTPFGFDNDIEFCETWIREXVGVVAIPPSVFYLNPEDGKNXLVRFTFCKDDG

SEQ ID NO: 58628 - protein, 384 aa, Streptomyces avermitilis MA-4680
MSDPVPASGTVHWIGAGLSTGSGLAAVCVAADRVRLWHRTEERAAQALDHLGLAGRAEPRAYTLPALAAELAPGDVVVSMLPAPEHAPLLALCVQGRAHFACSSYVSDAVLDQVPAAAAAGVVVLTEAGLDPGIDHLFAHSLIARAQEAIGSETAAEVSLTSYCGGVPAVPNDFKYRFSWAPAGVLNALRSPARYLDHGAETTTDRPWEATRPHVVDGETFEVYPNRDSVPFIGQYGLPAAWKPQTFVRGTLRLDGWLRAWGAVFEELKAGDDERIAALAAELATTYPTTEEDRDRVVLAVSLEVRSGTGATWSGRYLLDLEGTPEESAMARCVSRTLGLGVRHVLDGDLPAGLNRAAETAQRSEEWLGELRREGIDFALRTDG

SEQ ID NO: 58629 - protein, 497 aa, Emericella nidulans
MSDLFTTIETPVIKYEQPLGLFINNEFVKGVEGKTFQVINPSNEKVITSVHEATEKDVDVAVAAARAAFEGPWRQVTPSERGILINKLADLMERDIDTLAAIESLDNGKAFTMAKVDLANSIGCLRYYAGWADKIHGQTIDTNPETLTYTRHEPVGVCGQIIPWNFPLLMWSWKIGPAVAAGNTVVLKTAEQTPLSALYAAKLIKEAGFPAGVINVISGFGRTAGAAISSHMDIDKVAFTGSTLVGRTILQAAAKSNLKKVTLELGGKSPNIVFDDADIDNAISWVNFGIFFNHGQCCCAGSRILVQEGIYDKFVARFKERAQKNKVGNPFEQDTFQGPQVSQLQFDRIMEYINHGKKAGATVATGGDRHGNEGYFIQPTVFTDVTSDMKIAQEEIFGPVVTIQKFKDEAEAIKIGNSTDYGLAAAVHTKNVNTAIRVSNALKAGTVWINNYNMISYQAPFGGFKQSGLGRELGSYALENYTQIKTVHYRLGDALFA

SEQ ID NO: 58630 - protein, 356 aa, Campylobacter lari RM2100
MPADLNDYFNKKNNQNNNKQNLNFKAPEFNFKGFGKFSPLIYSAIAIILVFALFKPFAIVNSGEMGIKSTTGKYSPTPLEPGLHFFMPILQKITIVDTRVRQINYASIEGVNENLQIGSGVVNKNSISVLDSRGLPVSIDVTVQYRLNPLQVPQTIATWGLNWENKIIDPVVRDVVRNVVGQYTAEELPTNRNTIAVQIDQGIRKTIESQPNEPAELQAVQLREIILPIKVKEQIERVQIAKQEAERTKYEVERANQEALKKAALAEGEANATIISAKGRASAVKIEADAQAYSNREIAKSLNNPLLDLKQIETQKQFNEALKVNKDAKIFLTPGGAVPNIWVDSKDSKRTSSVAN

SEQ ID NO: 58631 - protein, 497 aa, Emericella nidulans
MSDLFTTIETPVIKYEQPLGLFINNEFVKGVEGKTFQVINPSNEKVITSVHEATEKDVDVAVAAARAAFEGPWRQVTPSERGILINKLADLMERDIDTLAAIESLDNGKAFTMAKVDLANSIGCLRYYAGWADKIHGQTIDTNPETLTYTRHEPVGVCGQIIPWNFPLLMWSWKIGPAVAAGNTVVLKTAEQTPLSALYAAKLIKEAGFPAGVINVISGFGRTAGAAISSHMDIDKVAFTGSTLVGRTILQAAAKSNLKKVTLELGGKSPNIVFDDADIDNAISWANFGIFFNHGQCCCAGSRILVQEGIYDKFVARFKERAQKNKVGNPFEQDTFQSPQVSQLQFDRIMEYINHGKKAGATVATGGDRHGNEGYFIQPTVFTDVTSDMKIAQEEIFGPVVTIQKFKDEAEAIKIGNSTDYGLAAAVHTKNVNTAIRVSNALKAGTVWINNYNMISYQAPFGGFKQSGLGRELGSYALENYTQIKTVHYRLGDALFA

SEQ ID NO: 58632 - protein, 225 aa, Arabidopsis thaliana
VSRNFLAKNPDFVFSRRELGKMSCTHDHNCEDHECSSDWSLYKHIDLSKVSALNESVSGSAKSVFKAWEQRLHSSGEHLESNEGDPELLVFVPFTSDVKIKSISIVGGPEGTSPSKLRVFINREGIDFSDAESMQAVQEWELAENLQGVLEYQTRYSKFQSVGNITLHFPESFGGDTTQIRYIGFKGEATQLKRDVVATIVYEIRPNPSDHKTKAETGGGFSQVE

SEQ ID NO: 58633 - protein, 215 aa, Medicago truncatula
MGFIPFPTNLTFPSLDCNQSLKAFSSIASSLTSESDSTSNLTQTLLTTNPQKSKEYLTSSFGGSTPFLSLHGSIVNPWAILGGEVISNCMNNSGKRNGVDHRDNHLGVSTTMKMKKMKGRKKVREPRFCFKTLSTDVDVLDDGYKWRKYGQKVVKNTQHPRSYYRCTQENCRVKKRVERLAEDPRMVITTYEGRHVHSPSNDLEDSQTQSDNFLW

SEQ ID NO: 58634 - protein, 230 aa, Cyperus longus
ISVLCDAEVGLIISSSKGKLYEFATENSMDKILDRYERYSYAEKVLVSTEQDPQANWCHEYRKLKAKVEAIQKCQRHLMGEDLDSLNVKDLQQLEVQLEVSSKHIRSRKSQLVIDSISDLQRKERLLQEENKMLQKELADKQKVLTQQGHWEQHQHQQHQHQHQQQHQMQPQIQPHQQHQSNSSSPGFLLGDTLPLNISAYQGTTRGEVVAAQAQAPAGLPPWMLSPLNH

SEQ ID NO: 58635 - protein, 188 aa, Triticum aestivum
  misc_feature (151)..(151): Xaa can be any naturally occurring amino acid
MTSVWKTKVLPGLNKIFDKDGKKAAAAEFLKSFNKEEIDKEIEDKKTELEPKVVETIEASPPEIKGLMKDKKTSKIKKNSVAVTKFLDDLAKIDFPGAKLVSDAVAKSGAPPPLSPAIVFILDKVAPFVPAPKEEPKAEPEDAAPAEETTXREVAVEEKKEDPPALRRTGRSGRSNVMPSGHQPTLSP

SEQ ID NO: 58636 - protein, 171 aa, Candidatus Kuenenia stuttgartiensis
MLSNLKTIWLAFLHMFRKRVTYQYPEEKAPLPARWRGRIILSRDPDGGERCVGCYLCAAVCPVDCISLQATEDEYGRRYPEFFRINFSRCIFCGFCEDACPTYAIQLVPDFEMCEYNRQNLVYEKEDLLISGEGKYHGYNYYKVAGVSIKGKDKGESESESPPIDVKGLLP

SEQ ID NO: 58637 - protein, 145 aa, Medicago truncatula
MGDRQVADNQHTVDQQLPSSPPLPPPSKDDMISCVMALEAALLPCLPARELQAIDRSPHPSHQIDVDRHARDFMEAAKKLQLYFISLQREDKPTKAEMLRKEITLMEDELNEKNELIKKQEHLIQEWKKELSDQLEKHNIELNRV

SEQ ID NO: 58638 - protein, 369 aa, Streptomyces avermitilis MA-4680
MTQLHLWLRHESRTTERRTPVVPSDARRLVESGVRLTVEDSPQRIFPTEAYEAVGCEIAEAGSWVSAPPDAVIVGLKELPDEPAELVHRHVFFGHAYKRQPGAEALLRRFAAGGGALFDLEYLVDDDGRRLAAFGYWAGYLGAALAVLHHRGGLGTPLRPTSKEELEAELRSSEGELTALVIGALGRSGRGARVALGEAGVEPTCWDLAETRDLDRPVLLEHELLVNTVLTTRPIPPFLTDKDLDEPGRRLRTLADVTVDVGSPLNVLPVYDTTTDWAHPVRRLREAPPLDLIAIDNLPSLLPREASTDFSAALLPSLLDFGTAESRGRSGGPGVRSGGPWGRCLDRFHEACRELGIELGTDDTEVRDV

SEQ ID NO: 58639 - protein, 390 aa, Schizosaccharomyces pombe
KNQTHIFREMSDDSHLETKVVTDGTTGEKKTISYEPCRVLGSGSFGVVIQAKLVGTPGFIAVKRVLQDKRYKNRELQIMRAISHPNIIKLIAFFHTHNPSKDETHLCLLLEYMPETVFDDMRWYTRRRKSIPNLSIKLYAFQLFRALAYLHSTGVCHRDIKPQNLLVDYKTGILKLCDFGSAKVLVPSEPNVSYICSRYYRAPELVFGATHYTTKIDVWSAACVIAELFIGPPLFPGDSSVEQLVEIIRVLGTPPYHEISAMNPTYVNHSLPNVRPHTLESVMPHNCTKSAMDLLHKMLTYVPSKRISAIEVLTHPFFDELRDPNCMYHCSRDEGTIERHLPPLFNFNLAELSIRPNLNKAILPPHVYESLDVDINNFEPIVVKQADADS

SEQ ID NO: 58640 - protein, 167 aa, Zea mays
SESPAVIIPHMGLENITVNEILRAKGEAEAGAVYWCSTAHLVHEAVQHMAAHNVGALVVLKSGDMNQLAGIVTERDFARKILLPGRPSQQTRVEDIMTEEDKVITVSGRTNILRAMEVMTDKRIRHVPVFDDKVVGMISIGDVVRTIVDQQHQEVKQLKKYIRGDYY

SEQ ID NO: 58641 - protein, 381 aa, Streptomyces avermitilis MA-4680
MNTHADVVVIGGGVMGTSIAYHLARAGVRDVVLVERDELASGSTSRAAGGVRAQFSDELNIRLGARSLEAFGRFGEEPGQDIGLHRVGYLFLLSTPEEVAAFETGVRLQNSLGVPSRMLEPAEARRLSPLITTDGLLAAAFSPDDGHCTPESVVHGYAAAARRHGAKVLRHCEVTGIETRGDDITAVLTRRGRIGTGTVICAAGAWSKAVGAMVGVDLPVRPLRRQIAVTEPVTGLPPGLPMTIDFTSSLYFHTEGPGLLVGMSDPDETTGFSTETHDRWIPRLCEAMERRAPPLLDLRRTGGWAGLYEITPDHNALIGEAGSCSRFLYATGFSGHGFLQGPAVGEVIRDLYLDRVPFVDISPLSVERFAADAPRPEVNRV

SEQ ID NO: 58642 - protein, 278 aa, Synechococcus elongatus PCC 7942
MSSAAQNAIALLIEMAESGEIDPWDVQVVDVFDRFLEQLQQRPSLTPLTDFSRSRYEADLSESGEAFLYASILILLKADALARLEFPPAEVLEEFVESLDDLAAMPQLPAKLEQQLRRRAVALPPQQRRVTLSDLIEQLEQVAQSLADPPARSRRRQPKPAPRRQAIQAIAHLAHQENLAETAAALGDFLQRQWSALQPENDWLNFEDLVQLWSQTQAGDHHLDGDRVGVFWALLFLAAQSIVELQQESLYSPLWIRCLTPFGNPIAVPFEPTASASV

SEQ ID NO: 58643 - protein, 349 aa, Methanothermobacter thermautotrophicus
METTEVIEGKNITVERTGEENRKLIFQDCLCAVCGLCGEICPVSAIEVNPTGAMVRTEQDESKILIDENKCVLCGMCSSICPFQALDLQIDGTSIKELAEYPKILKSAEIDDETCIQCKACETACPQDAITITRELPERKDLITGEIEIDKDTCIYCGMCEEMCPVDAIEIEHQIPSSSSPTVATDINVDEDKCVHCGICKRICPVDAIMQVCRICPYGEYEIKVPEVTGTSYIDPELCVNCGWCQEICPVDAATVTKPFEGELIIDQDTCQACETCVMACPCNVLSFPKPEKSGEKPTKLYKDERFCIYCGACERSCPVNAIEVKRSRINTTPIKSKAWKNAFESLLK

SEQ ID NO: 58644 - protein, 305 aa, Pseudomonas fluorescens PfO-1
MSANVVVIGSLNMDLVTRAPRLPRGGETLIGHSFATVSGGKGANQAVAAARLGAQVSMVGCVGNDEYGVQLHDALLAEQIDCQAVSVVEDSSGVALIVVDDNSQNAIVIVAGANGSMTPAVIDRFDAVLQAADVIICQLEIPDATVGHALKRGHELGKMVILNPAPASRPLPVDWFAAIDYLIPNESEAAALCGLPVDSLETAEKAAAHLISLGAGKVIITLGAQGSLFANGTGYQYFPAPKVKAVDTTAAGDTFVGGFAAALAAGKTEDEAIRFGQVAAALSVTRAGAQPSIPTTSDVQAFKPA

SEQ ID NO: 58645 - protein, 281 aa, Euglena gracilis
MKGDFGKGKGKGDGKGKGKGKGKGKGKGKGKGKGGKGSAVVVEPHKVHAGIFVSRGKSEDSLATLNLVPGVSVYGEKRVQTETTDANGAPEKKEYRVWNPYRSKLAAAVVGGIDNCKVAPGAKVLYLGAASGTTVSHVSDIVGPTGIVYAVEFSHRSGRDLVEMSKRRPNIVPIVADARNPKAYRMLVGMVDCIFMDVAQPDQARILAINAKQFLKADGWFMISIKAPCIDSTIEPAVVFAAEVEKMKAEQLRPKEQITLEPFERDHAVVVGVYRPTKAKK

SEQ ID NO: 58646 - protein, 317 aa, Haemophilus somnus 129PT
MTTQLDALRNMTVVVADTGDIDAIKKYQPQDATTNPSLILSASSLPQYAPLIDEAIAYAKAKSADKTQQLIDAEDKLAVNIGLEILKIVPGRISTEVDARLSYDTQATVEKARKLIALYNEAGISNDRILIKIASTWQGIRAAEILEKEGINCNLTLLFSEAQARACAEAGVYLISPFVGRILDWYKANSDKKEYAPAEDPGVISVTKIYNYYKQYGYNTVVMGASFRNVGEITELAGCDRLTIAPALLKELQENSTALVRKLEFKGEVQAKPQPLTESQFYWQHNSDPMAVEKLADGIRKFAIDQEKLEKMLLEKF

SEQ ID NO: 58647 - protein, 366 aa, Triticum aestivum
MARRHHLLLLLPLLALAFSFVAAAPEGQGDAAAFIDGASHRYLRDQQGDQATSMSLDEVSAAVSVLLGFAPPAMLPAPSSAKLNELLLPKPFDRPRAVFLMQIDGSHDSVDSFVSDAGSIYKTKIDVAKNAATGLTDRDELIVIRSDESSGSDVLDNELTNLATWLEGSYQKADSKLIIPLKSGNSLTLLLNKEVDVEFASSLISLLKTIKRGIQVHEDFSGGIVSPAELLVCHFTGIKALEDEYGSAEIVKQGVEVVQTALTKAFDQLQGAYNGKIVGLVISTKEASTSLASIIDAPSSLHISRRLAEASKTNATASIAAIYLVRLSLAWITGIIFLVSTLIGICLLMNMPLTRDTLLYSNVKMD

SEQ ID NO: 58648 - protein, 412 aa, Rhodococcus erythropolis
MANAKRHHVIVGGSAAGVSAALSMRRAGFEGQITLVEADTAVPYQRPPLSKSFEDLDSPKVIVPEVTYDDHDVQLLSGERVASLDEDRRRVVLESGTDLQADSVLVATGVLPRRLGVPGDDLNNVLTLRDINDARALASRLDAGPLVVVGGGFIGLEVAAAARLRGQHVTVIEALRVPLTGALGDEVGSLVTNMHLARGVHVVTERTVVELRGDGDVESVILNDGSQLNAATVVVGCGVSPNDELARRAGVFTDNGIVIDEYGQTSRGWIWAAGDVATFESPFTDRRQRIEHWNVAQGQGAVVGANMAGTATAYRDVPYFWSDQYDSHLQMYGRAVASDRLTIRPSSEHEGFLALWIRDDVLVAAASIGESKQLRLAKNLIEHHVPVRETELANPHQSLRELVKQHKPQAFR

SEQ ID NO: 58649 - protein, 212 aa, Medicago truncatula
MAKKRKSVESRLDEVDRTMYSTFCTTANSLSHLYTHAMNQQKLSFQAGERHALEKMYQWILRQQQEGMRVTTIDIVSHLQNELEYGAEESPVSPRQSIQQNSQTAIQTNFAASIPSNAFGSTVAGQGIRTGQTDQVKNSVFSNALSSPIRRSLQPYHLAQGSNPSSNVMSSGNGTRNNEMVYPSGQNRDTNSSNSSDCMDMHADSPGHDFPY

SEQ ID NO: 58650 - protein, 384 aa, Haemophilus somnus 129PT
MTDLDLAGKRVFIRADLNVPVKEGKVTSDARIKATIPTLKLALEKGAKVMVTSHLGRPTEGEFKPEDSLQPVVDYLKGAGFNVRLAQDYLNGVEVNEGEIVVLENVRVNKGEKKNDPELSKKYAALCDVFIMDAFGTAHRAQASTYGVAEFAPVACAGPLLAAELEALGKALKEPQRPMLAIVGGSKVSTKLTVLDSLSKIADQLIVGGGIANTFIAAEGHNVGKSLYEADLIPEAQRLSKVTNIPVPVDVRVGTEFSETALSTEKSVADVSGEESIFDIGDKSAEQLADIIRNAKTILWNGPVGVFEFPNFRKGTEIVSNAIAEATANGAFSIAGGGDTLAAIDLFGIKDKISYISTGGGAFLEFVEGKVLPAVEILEKRANG

SEQ ID NO: 58651 - protein, 399 aa, Oryza sativa (japonica cultivar-group)
MATITAASPRPSAAPAAMEETSKAMPTSEWPAASGGNASPPARSRPSLLVIFSACLVLLGAGGPLLLRVYFVHGGTRLWLSATLQISGWPLLLPPLCVSLYRGRRHGIGNLLLPRRLVGAAAVLGGLYAVSCFVYALGSQALPLSTSSLLLATQLAFTAVFAFLFVGLRFTPFSANAVVLLTIGPAVLGVGPSSGKPAGESSRAYWTGFCEAIGAAALAGLVIPLVEVATARYGRRTGPAARVPPPYATVMQMQAVMGAAGTAVCVLGMAIKGDFQAVAREAAAFGLGAANYYLVLAWDAVSWQLLNLGIMGLITCASSLLAGIMIAVLLPLSQVLAVIFLHEKFDGTKGIALVLSLWGFASYLYGEKAQKKKEAQKMREREQEVALAQKTADVESAAP

SEQ ID NO: 58652 - protein, 196 aa, Arabidopsis thaliana
MSASRFIKCVTVGDGAVGKTCILISYTSNTFPTDYVPTVFDNFSANVVVDGNTVNLGLWDTAGQEDYNRLRPLSYRGADVFILAFSLISKASYEHVAKKWIPELRHYAPGVPIILVGTKLDLRDDKQFFIDHPGAVPITTNQGEELKKLIGSPIYIECSSKTQQNVKAVFDAAIKVVLQPPKQKKKKKNKNRCVFL

SEQ ID NO: 58653 - protein, 172 aa, Glycine max
  misc_feature (63)..(63): Xaa can be any naturally occurring amino acid
MAMRGGRKNLKRATEEKHITLQDGQGIMQVVSLRGANIIEVMDASGNKLLALFPAKIQKSMWXIKRGSFVVVDESGKEKALESGSKVACLVSQVLFSKQVRELEKSPEWPESFKSAMVDDSIESTTSQQEHELEGSDDDGLPPLEANTNRIRPAELQADDEDSESSSDTDDD

SEQ ID NO: 58654 - protein, 671 aa, Candidatus Kuenenia stuttgartiensis
MNNMNPKTGTLEQQGINTVRILAADAVQKANSGHPGTPMGLASVGHVLWAQIMNYNPQNPAWANRDRFILSCGHACMLQYSFLYLTGYPITLDDIKKFRQLHSKTAGHPEYGLLPGIEVTTGPLGQGFANGVGFAIAQRYMAARYNKPGFDIFNYKVYAICSDGDIMEGISSEAASIAGHLQLGNMIYLYDDNHITIEGNTDLAFDEDVAKRFEAYGWHVQELPDGNDLGALSTAIKNAQKETDRPSLIKVRTHIGYGSPNKQDTAAAHGSALGEAEVKLVKENFGFDPDKHFVVPDDVLNYYREAGKKGIDKEKNWNDLYKRYKEKYIELSNEYELLSSGKLPEGWEERVPVFKTEEEMATRKASGKVLNAIADYLPNLIGGSADLAPSTDTNLEKYKSFLATNYDGRNFHFGIREHAMGAILNGLVLSKYLIPYGATFLVFSDYMRPPIRLAAIMKIRPIYVFTHDSIALGEDGTTHQPVEQLIGLRSVPNLTVIRPADANETVQAWRIAIEHSGGPVALILTRQKIPVIDQEKYTKAIELEKGAYILSESKTQPDIILIGTGSEVQLLLAAQQRLKEENIAARVVSMPSWELFEKQDKTYKEKIFPASLRKRLAVEAGSPLGWLKYVTDQGDIIGIDRFGESAPGEEVMKEYGFTVENVVKRAKALIE

SEQ ID NO: 58655 - protein, 390 aa, Sulfolobus shibatae
LDTLEALSQPERVIQVKIQIRGSDGKLKTFMGWRSQHNSALGPYKGGVRYSPNVTQDEVIALSMIMTWKNSLLLLPYGGGKGGIRVDPKKLTLKELEDLSRKYVQLIHNYLGSDVDIPAPDINTNPQTMAWFLDEYIKITGEVDFAVFTGKPSELGGIGVRLYSTGLGVATIAREAANKFIGGIEGSRVIIQGFGNVGSFTAKFLNEMGAKIIGVSDIGGGVISDDGIDVNKALEVVQSTGSVVNYPEGKKVTNEELLTSDCDILIPAAVENVINKFNAPKVKAKLIVEGANGPLAADADEIIKQRGIVVIPDILANAGGVVGSYVEWANNKSGGIISDEEAKKLIIDRMTNAFNALYEFHKRKFADQDLRTVAMALRVDRVVGMKARAI

SEQ ID NO: 58656 - protein, 452 aa, Streptomyces avermitilis MA-4680
MTIDLAALPHDFLWGTATAAYQIEGAVAEDGRSPSIWDTFSHTPGKIDNNDHGDVACDHYHRWREDIGLMKQLGTNAYRLSVAWPRVIPGGDGPVNAKGLAFYDELVDGLLEAGITPSVTLYHWDLPQVLQDRGGWPERATAEHFAAYAAVVAERLGDRVTHWATLNEPLCSAWIGHLEGKMAPGLTDLTAAIRASYHLLLGHGLAAQAIRAAAPAAEVGIVNNLSTIHAASDRPEDVAAARRMDGHVNRWWLDPVHGRGFPADMREVYGVELPEQPGDLATIAAPLDWLGLNYYFPATVADDPTGPAPRVRSVRRLGVPRTGMDWEIDATGIETLLLRLTHEYGPRKLYVTENGSAFPDVVRPDGTVDDPERQDYLVRHLAACASAARKGAPLAGYFAWSLLDNFEWAYGYDKRFGLVHVDYRTQVRTIKGTGHRYADIVRTHRGRARRAA

SEQ ID NO: 58657 - protein, 378 aa, Nostoc sp. PCC 7120
MMVCEYKPGLEGIPAAQSSISYVDGQKGILEYRGIRIEDLAQQSTFLETAYLLIWGELPTKEELQVFEEEVRLHRRIKYRIRDMMKCFPESGHPMDALQASAAALGLFYSRRDLHNRCYIRDAVVRLIATIPTMVAAFQLMRKGNDPVKPRDDLDYSANFLYMLNEKEPDALAAKIFDICLILHVEHTMNASTFSARVTASTLTDPYAVVASAVGTLGGPLHGGANEEVIQMLEEIGSVENVRSYVEERLQRKDKLMGFGHRVYKVKDPRATILQGLAEQLFAKFGADKYYDIAQEMERVVEEKLGHKGIYPNVDFYSGLVYRKMGIPTDLFTPIFAIARVAGWLAHWKEQLEENRIFRPTQVYNGKHSVTYTPIDQR

SEQ ID NO: 58658 - protein, 261 aa, Bacillus megaterium
MYTDLKDKVVVVTGGSKGLGRAMAVRFGQEQSKVVVNYRSNEEEALEVKKEIEEAGGQAIIVRGDVTKEEDVVNLVETAVKEFGSLDVMINNAGVENPVPSHELSLENWNQVIDTNLTGAFLGSREAIKYFVENDIKGNVINMSSVHEMIPWPLFVHYAASKGGMKLMTETLALEYAPKGIRVNNIGPGAIDTPINAEKFADPEQRADVESMIPMGYIGKPEEIASVAAFLASSQASYVTGITLFADGGMTKYPSFQAGRG

SEQ ID NO: 58659 - protein, 792 aa, Pseudomonas fluorescens PfO-1
MKFSEQWLRGWVSPQVDRDALVARLSMAGLEVDSVTPAAGVFSGVVVGEVLSTEQHPDADKLRVCQVSNGAETFQVVCGAPNVRPGLKIPFAMIGAELPGDFKIKKAKLRGVESNGMLCSQAELQIGEGNDGLMELPADASVGEDFRVYLDLEDASIEVDLTPNRGDCLSLAGLAREVGALYDAPVTRPVVMAVPAAHDEVRSVEVLAPAACPRYLGRVIRNVDLSRPTPLWMVERLRRAEVRSIDAAVDITNYVMLELGQPLHAFDLAEINGGIRVRMAEEGEKLVLLDGQEVSLRSDTLVVADHTRALAIAGVMGGEHSGVSATTRDVFLESAFFDQIAVAGKARSYGLHTDASHRYERGVDWQLAREAMERATGLLLEITGGEAGPIIETVSEQHLPSIAPITLRAQRITQMLGMEMDSAEVERLLNALGLKVSADGAGQWRVEVPSHRFDISLEVDLIEELARLYGYNRLPVRYPQARLAPQAKAEARSDLPELRRLLVARGYQEAITYSFIDPKQFELFNPGVEPLLLANPISNDMAAMRSSLWPGLVKALQHNLNRQQDRVRLFESGLRFVGQLEGLKQEPMIAGVVCGSRLPEGWAQGRDTVDFFDVKADVEAVLGFAGALDQFTFAPGKHPALHPGQTARIEREGREVGFIGAIHPELSKSLGLDRPVFVFELVLAEVALGKMPKFHELSRFPEVRRDLALIAHKDVAASAVLDVIRENAGEWLTDLRLFDVYQGKGIDTDRKSLAVGLTWQHPSRTLNDDEVNSTTQNILTSLEQRLNATLRK

SEQ ID NO: 58660 - protein, 226 aa, Dechloromonas aromatica RCB
MHFESVTFDLDGTLLDTIADLAEACRLMLDEIGAPPRTPAEVHSFVGKGMAVLVERCLTHEHPPSAEQLHFAIESFKRHYAVVNGKYTQIYPGVIEGLQAWKASGLKMGVVTNKPGMFTEALLDRMGMTDYFDVIVSGDTTPNKKPHPEPILHACRLFNVRPDRNLHIGDSENDIHAARAAGSPTFCVPYGYNEGKPVDSADCDALVSDLLAGYQQALIFKDLIHK

SEQ ID NO: 58661 - protein, 175 aa, Triticum aestivum
MAPTVMASSATSVAPFQGLNSTVGLPVSRRSNGASLGSVSNGGRIRCMQVWPIEGIKKFETLSYLPRLITEALLKQVDYLIRSKWVPCLEFSKVGFIFREHNTSPGYYDGRYWTMWKLPMFGCTDATQVINEVEEVKKEYPDAYVRIIGFDNMRQVQCVSFIAFKPPGCEESDKA

SEQ ID NO: 58662 - protein, 570 aa, Shigella flexneri 2a str. 301
MSEKHPGPLVVEGKLTDAERMKLESNYLRGTIAEDLNDGLTGGFKGDNFLLIRFHGMYQQDDRDIRAERAEQKLEPRHAMLLRCRLPGGVITTKQWQAIDKFAGENTIYGSIRLTNRQTFQFHGILKKNVKPVHQMLHSVGLDALATANDMNRNVLCTSNPYESQLHAEAYEWAKKISEHLLPRTRAYAEIWLDQEKVATTDEEPILGQTYLPRKFKTTVVIPPQNDIDLHANDMNFVAIAENGKLVGFNLLVGGGLSIEHGNKKTYARTASEFGYLPLEHTLAVAEAVVTTQRDWGNRTDRKNAKTKYTLERVGVETFKAEVERRAGIKFEPIRPYEFTGRGDRIGWVKGIDDNWHLTLFIENGRILDYPGRPLKTGLLEIAKIHKGDFRITANQNLIIAGVPESEKAKIEKIAKESGLMNAVTPQRENSMACVSFPTCPLAMAEAERFLPSFIDNIDNLMVKHGVSDEHIVMRVTGCPNGCGRAMLAEVGLVGKAPGRYNLHLGGNRIGTRIPRMYKENITEPEILASLDELIGRWAKEREAGEGFGDFTVRAGIIRPVLDPARDLWD

SEQ ID NO: 58663 - protein, 294 aa, Oryza sativa (japonica cultivar-group)
MTSGRAATSMLRYNATPKASPPMSPLRPPPTPRTPLGGAATTPDQLPPPSPHTPRPAITLTAPPSKKKRRGGAAARSLRAIRAVRALFRSLPILAPACRFHGAIRAPGGASRAHDGHVSGASRTTGTLFGYRKARVTLAVQETPGSVPILLLELAMQTGRFMQEMGAEHLRVALECEKKPPGAGAGIGRTRLLDEPLWTAYVNGRKIGYAMRREPTEGDLTVMQLLRTVSVGAGVLPTDVMGGDAGAEVQDAGDLAYMRARFDRVVGSRDSESFYMLNPDGNNGPELSIFFIRI

SEQ ID NO: 58664 - protein, 128 aa, Brassica napus
MSTFSSISSFRTSKLFSHKEDEQKMYADSGLMLRYMQTCSPDIHQFEDLFKSYKLSDDEMRNAFAGPSNIPEYDTGEEGDLFKAPDSILEESILTVDPLSAALTMISCGEDSSQGLCDLPDLDLGLQS

SEQ ID NO: 58665 - protein, 444 aa, Acidobacteria bacterium Ellin345
MTDTRSARVVVIGGGFGGLETVSHLKHQPVQILLLDRKNHHTFQPLLYQVATAGLSPAEIAAPLRSIVSKQKNTEVLLAEVTGFDLARKIVHTVDAEIEYDYLVVAAGARHSYFAHDEWEPLAPGLKTVEDALEIRRRVLLAFEEAERQAALHGHHQDITFAIVGGGPTGVELAGTISEVARTSLPRDFRNIDPTHTRVILIEAGPRVLAAFPEDLSASAEQQLHKLGVEVRTSTMVTQILPHEIHMGDVVLPTSVTLWAAGVFASPLGRALSEQVDRAGRVPVQPDLTLPNHPEVFVIGDLATIKNPDGKPVPGVAPAAMQMGRFVAKTISDDLAHRPRTNFVYNDKGNLATIGRNAAVAQFPGFKLTGYFAWLSWLFIHILFLIGFRNRLLVMIEWAWSYLTYKRSARLITDEVGRLREQRSSPDSHNAETPPVEVIERRSA

SEQ ID NO: 58666 - protein, 454 aa, Zea mays
MAPPEPEMFDVVIFGASGFTGKYVIREALKFLNASSSASPLRSLAVAGRSRDRIAAALRWAAAPAPPPEDVPILVADTSDPASLAALASHARVVLSCAGPFRLHGHAVAAACAAVGADCLDISGEPEFMERVESELHEPAARSGSLIISACGFDSVPAELGFMFHSRQWEPPSAPATVEAYVSLQSTKRIVGNIGTYESAVLGVANAGQLQALRRSRPRRPRPNIPGPPPPKGSLIEGHNPLGMWAMKLPSADTVVVKRTLSTLTEHPEGLPGAEETPEYADHRKKFWSSVKPAHFGVKIASRSLLILVRFIFTGIFIGLLANFSFGRSLLLKYPEFFSAGLFSRAGPTEEEVKSASFKMWFVGHGYSNVDSSLELGRSKPDKEVITKVSGPEVGYVTTPIVLVQCALVLLSQRANLPKGGVYTPGTVFGPTDLQQRLQDNGLSFEVNTTRAMH

SEQ ID NO: 58667 - protein, 590 aa, Desulfovibrio vulgaris subsp. vulgaris str. Hildenborough
MARGILYGIAVSSGISIGKAFFMDRSRQSAAHDIIQPGAAESEVARLDEAAAQVASDLDRARAQVPADLRDHAAIIDSHRMICRDPKLMGDAARRIREQNISAPWALEQAVDAIAQAFRAIDDPYIRERVQDVRAVAERILSRLAGNARELKSTGERMVLLAHDLTPADTIELQVSRIMSFATAEGGKTSHTGILARSLQIPAVVGVSGLEEATADGDLVIIDALRGRILIDPDEHELAEYTELKYQFESYQRSIRRQSTLPAETLDGYRIEVQSNIELLEEVPQVLDSGADGVGLYRTEYAFLARRQPPSEQDLCDEYSQVAALMSPRQVVFRTLDVGADKMLREQVRMEEPNPALGLRAIRFCLRHQDVFRTQLRAILRASVHGNVALLFPMISGIQELRQARHILQEVRQELDAEGIPHAPDMPVGIMVELPSAVLIADALAHEVDFFSIGTNDLIQYSLGIDRGNRHVSYLYQPLHPAIVRSIKLVVDSAHRAGISVSVCGEVASDPFCLPILMGMQIDSISIAPQAVPGIKHIIRKTNMEECKTLTRDVLNATTVSTINRMVKETIYNRFPEELTFFSSMLDTDD

SEQ ID NO: 58668 - protein, 464 aa, Vibrio parahaemolyticus RIMD 2210633
MLKFLEQVRKPTLDLPVEVRRKMWFKPFIQSYLVVFIGYLTMYLIRKNFNVAQNDMISTYGLSMTDLGLIGLGFSITYGIGKTVVSYYADGKNTKQFLPFMLILSGLAMLGFSFSMGGGSASLFLMVAFYALSGFFQSTGGPSSYSTITKWTPRNKRGSYLGLWNMSHNVGGAGAAGVALFGANYLFDGHVIGMFVFPSIIAIIVGFIGMRFGSDSPEAYGLGKVEELFDEAVSEEDTAAEENQMTKKEIFVEYVLKNKVIWLLCFANIFLYIVRIGIDQWSTVYAYQELGLSKETAISGFTLFEVGALVGTLMWGYLSDLANGRRALVACVSLGLIIVSLEFYQHATNEFMYLSSLFVLGFLVFGPQLLIGVAAVGFVPKKAISVADGVKGTFAYLIGDSFAKLGLGMIADGTPIFGLTGWKGTFAALDTSAMICIVLLAFVAIAEEKKIRHAKKLQLAQNQA

SEQ ID NO: 58669 - protein, 305 aa, Arabidopsis thaliana
  misc_feature (108)..(108): Xaa can be any naturally occurring amino acid
  misc_feature (134)..(134): Xaa can be any naturally occurring amino acid
MSHFGRSGPPDISDTYSLLVLNITFRTTADDLYPLFAKYGKVVDVFIPRDRRTGDSRGFAFVRYKYKDEAHKAVERLDGRVVDGREITVQFAKYGPNAEKISKGRVVXEPPPKSRRSRSRSPRRSRSPRRSRSXPPRRRSPRRSRSPRRRSRDDYREKDYRKQSRSRSYDRRERHEEKDRDHRRRTRSRSASPDEKRRVRGRYDNESRSHSRSLSASPARRSPRSSSPQKTSPAREVSPDKRSNERSPSPRRSLSPRSPALQKASPSKEMSPERRSNERSPSPGSPAPLRKVDAASRSQSPYAAE

SEQ ID NO: 58670 - protein, 115 aa, Desulfovibrio vulgaris subsp. vulgaris str. Hildenborough
MDIMKKIELEHLRMDLPKFRSGDTVKVHLRIVEGEKERIQMFQGNVIRIHRGTTGGTFTVRKVSDGVGVERVFPLHSPFIDRVELITEGRVRRSRLYYLRDLRGKAARIKPKNRF

SEQ ID NO: 58671 - protein, 100 aa, Arabidopsis thaliana
  misc_feature (60)..(60): Xaa can be any naturally occurring amino acid
HELSLSLSLSLSLSLSLSLSLSLSLSLSHSSMLSNATMEAYPAQATMVATYNGLKPYADXQDTRRANNDNTKITRPGGRDNRMHMKPTIAKKKPATYNDQ

SEQ ID NO: 58672 - protein, 457 aa, Escherichia coli O157:H7 EDL933
MESKNKLKRGLSTRHIRFMALGSAIGTGLFYGSADAIKMAGPSVLLAYIIGGIAAYIIMRALGEMSVHNPAASSFSRYAQENLGPLAGYITGWTYCFEILIVAIADVTAFGIYMGVWFPTVPHWIWVLSVVLIICAVNLMSVKVFGELEFWFSFFKVATIIIMIVAGFGIIIWGIGNGGQPTGIHNLWSNGGFFSNGWLGMVMSLQMVMFAYGGIEIIGITAGEAKDPEKSIPRAINSVPMRILVFYVGTLFVIMSIYPWNQVGTAGSPFVLTFQHMGITFAASILNFVVLTASLSAINSDVFGVGRMLHGMAEQGSAPKIFSKTSRRGIPWVTVLVMTTALLFAVYLNYIMPENVFLVIASLATFATVWVWIMILLSQIAFRRRLPPEEVKALKFKVPGGVATTIGGLIFLLFIIGLIGYHPDTRISLYVGFAWIVVLLIGWMFKRRHDRQLAENQ

SEQ ID NO: 58673 - protein, 317 aa, Haemophilus somnus 129PT
MSKTLTVLGSINADHVISVPHFAKPGETLSGKQYHIAYGGKGANQAVAAARLADFSQGATVNFVGCIGSDDIGQAMKKAFAQDGINVATITEIPNEMTGIAMIQVADSGENSIVISAGANAYLTPEIVDKFATEIERADYLLMQLETPLNAILEAAKLAKKHGATVVLNPAPASQLPDELLSLLDMITPNETETEILTGVKVTDEQSAAKAASVLHQKGVATVLITLGSKGVYVSRKSSTQELGQNKVIAGFRVNAVDTTAAGDTFNGAFLTALLENKSLDEAIRFAHAAAAISVTRQGAQPSIPTRRETLDFLAQH

SEQ ID NO: 58674 - protein, 64 aa, Glycine max
MSSFLLTSLTSLTTLRGSMSSLTSLAPLEAVLFDVDGTLCDSDPLHYYVALKLLQELGFNGGAP

SEQ ID NO: 58675 - protein, 563 aa, Aspergillus oryzae
MPFKSRWQVHVPDAHLATVLFTSPTHPLSKTHRCFSEAARPDTHYFTTHDFRLWSKRFAAGLRKAGLQSGDRVLLFSGNDLFFPVVFMGIIMAGGIFSGANPTYVARELAYQLQDSGATYLICAEGSLDTGIEAAQVAGLSRGRVFVFNNAIFDGRGEGKMGCRYWGELVASAEEGSQFEWDDLSTPEKANRTLALNYSSGTTGRPKGVEISHKNYCANMLQANQSFYLNPDWKARNARARFLCFLPMYHAMAQNIFIANALKREVPVYIMPKFDFIKMLEYTEKFRITDLILVPPVVVALAKHPAVRSGKYDLSSVEGIGSGAAPLGREVCDEVEALWEPGRVNVKQGWGMTETTCAILGWDPTETSHTASVGELNPNCEAKIMADDGVTELGRNQRGELWVRGPNIMKGYWRNPQATKETKTEDGWLKTGDIAYVDDQGKFYVVDRKKELIKVKGNQVAPAELEALLLEHPAVADVAVIGVSVNDDERPRAYVVLKPGQSASAQDLIAFMDGKVSAIKRITGGVVFVDTIPKNPSGKILRKVLRDRAKEEVASNPSIAAKL

SEQ ID NO: 58676 - protein, 381 aa, Oryza sativa (japonica cultivar-group)
MAGQIPQPIRCKAAVCRAAGEPLAVEEIVVDPPKAHEVRIKIVCTSLCHSDVTFWRMQDFPGVFPRIFGHEAFGVVESVGEHVEGFAAGDPVVPTFLGQCTECVDCASERSNVCSTYRFAVRPGMPRDGTARFRDRHGAPIHHFLGVSSFSEYTVVDANQVVRVDPAVPPATASLLSCGATTGVGAAWKLAKVEPGSSVAIFGLGAVGLAVAEGARICGASTIIGVDLNPEKHELGKKFGVTHFINPQELGDKPVSQAIIEMTDGGADYCFECIGLASVMSDAFRSSREGWGKTIILGVEMHGAPLSIPSLEILNGKCVMGSLFGGVKPKQDIPILADKYLNKELELDKFITHEVPLKDINTAFDLLLQGKSLRCTIWMDK

SEQ ID NO: 58677 - protein, 229 aa, Cryptococcus neoformans var. neoformans JEC21
MPPHFARTWTCEELLRGHATKKYALIIVNQPIRKDLLQRAWQAVDIRLCADGGANRLFDVDHESQYLPDLIKGDLDSLRPDVQAHYASLKVPIKKDEDEYSTDLMKCIQEVPEDYALVLLGGLSGRVDQTVHTMSMLHKMDREIYVLDKESMAWVLRPGQHEIHIDHSTMGQTCGILPVGIDSAHVRTKGLKWDVGNLSTSNHLLPEEPVVWIETSRPILWTVEIRQIE

SEQ ID NO: 58678 - protein, 379 aa, Oryza sativa (japonica cultivar-group)
MEDQSLKPIRCKAAVCRAASEPLIVEEIVVDPPKAYEIRIKIICTSLCHTDVTLWHKVDPAFPRILGHEAYGVVESVGENVEGLAAGDTVVPTFMGQCDSCASCAAEWTNQCTAVPFTMGPGMRRDGTTRFWDGEGKPLSDTVAVTSFSQYTVVDVNQVVKVDPAVPPKIACLLGCCGGTGVGAAWRLAKVQPGSSVVVFGLGSVGLAVVQGAKMCGATKIIGVDLNPNKEEVGKEFGVTDFVNPSQLGDKSVSEVINAMTDGGADYSFECIGISSVMTEAVRSTKSGRGKTIILGVEKDSQPLCLPSFEFLFGKCVMGSLFGGAKPKTDIPILAEKCMNKELELEKLVTHEVGLTEINTAFDLLLQGKSLRCIIWMDK

SEQ ID NO: 58679 - protein, 394 aa, Rhizobium etli
MTKTWRPATQLVHGGTWRSEYGETSEAIYLTQGFVYDTSEPAEARFKGETDGFIYARYGSPTNDMFEKRMCALEGAEDARATASGMAAVAAAVLCQVKAGDHIVAARALFGSCRWVVETLAPKYGVECTLVDGRDLANWEKAIRPNTKVFFLESPTNPTLEVVDISGVAKLANQVGAKLIVDNVFATPLFQKPLELGAHIVVYSATKHIDGQGACLGGVVLADKAWIDENLHDYFRHTGPAMSPFNAWTLLKGIETLPLRVRQQTENAAKIADFLAEQGKVAKVIYPGRKDHPQAEIIAKQMTGGSTLVCFELKGGKEAAFALQNALEIIKISNNLGDTKSLITHPATTTHKNLTEEARAELGISPGTVRLSAGIEDTDDLIEDFARGLTKVSA

SEQ ID NO: 58680 - protein, 371 aa, Arabidopsis thaliana
  misc_feature (357)..(357): Xaa can be any naturally occurring amino acid
MADGEDIQPLVCDNGTGMVKAGFAGDDAPRAVFPSIVGRPRHTGVMVGMGQKDAYVGDEAQSKRGILTLKYPIEHGIVNNWDDMEKIWHHTFYNELRVAPEEHPILLTEAPLNPKANREKMTQIMFETFNAPAMYVAIQAVLSLYASGRTTGIVLDSGDGVSHTVPIYEGYALPHAILRLDLAGRDLTDALMKILTERGYSFTTTAEREIVRDIKEKLCYIALDYEQELETAKTSSSVEKNYELPDGQVITIGSERFRCPEVLYQPSMIGMENAGIHETTYNSIMKCDVDIRKDLYGNIVLSGGTTMFPGIADRMSKEITALAPSSMKIKVVAPPERKYSVWIGGSILASLSTFQQXYDESGPSIVHRKCF

SEQ ID NO: 58681 - protein, 446 aa, Vibrio parahaemolyticus RIMD 2210633
MFGFLRSPKFTQPSLSNEQIDQRYRHWRLHIMLGMYIGYAGFYFTRKTFNYAAPAMITDLGLDKGDLGLIGTLFYITYGCSKFISGTISDRSNPRYFMGLGLIATGLVNIAFGFSSSLAAFITLWILNAWFQGWGWPSCSKLLTTWYSRSERGFLWAIWNTAHNVGGALIPILVGYLTLHYSWREGFILPGIIGVLLGLFVCWRLRDKPTTMGLPSVGQWRNDALELAQENYGRGLTYREILKSYVFNNKYIWLLAFSYVLVYIVRTAINDWGNLYLTEQHHYSLINANAALSMFEIGGFVGSLVAGWGSDKLFGGNRGPMNLLFAIGIFLSVSALWLMPLTNFAFQAAGLFSIGFFVFGPQMLIGMAAAECSHKDSAGAATGFVGLFAYMGAALSGYPLALILEEYHWTGFFITISVCAAVIGLLLLPFLQAQPSRKPLEPKPRL

SEQ ID NO: 58682 - protein, 420 aa, Vibrio parahaemolyticus RIMD 2210633
MPKLNQDNPVQSSALSDIETSSKIQSALEPKFHKPEKRLCLSPGLSDKHLARRWQVLEQVTNKDHLLDPFTQSHCDAYSNNIEHFIGTVNVPVGIAGPLRVNGLYANDDFLVPLATTEAALVASYNRGANLITAAGGASALLLSEGVSRTPVFAFNNLANAGQFVSWVVTQFEVFRQIAESTTSHGKLKDINVNIEGNHVYLVFEYVTGDASGQNMVTIATNEVFHHILATSPIKPTQAFLDGNLSGDKKPNAHTLRSVRGKKVSAEVTIPAELVEKYLHTTPESMVQFGKMTTVGGLLSGTIGVNAHYANALAALYIACGQDAACVAESAIGITRMDVDTQGNLYACVTLPNIMVGTVGGGTGLPTQKACLDILGLHGNGKAKALAEVAAALCLAGELSIVGAFCADHFSRAHHKLARK

SEQ ID NO: 58683 - protein, 334 aa, Acidobacteria bacterium Ellin345
MAIKVGINGFGRIGRNVYRAALNDSNIEIVAVNDLTDPKTLAHLLKYDSILGNLHHNISATADAITVDSKSVKVFAEKDPAALDWSALGVQVVVESTGRFTKAADAKKHLKGSVKKVIISAPATDEDITIVLGVNQDKYDASKHHILSNASCTTNCLAPVVKVLHETFGIVSGLMTTIHSYTNDQVILDFPHKDLRRARAAAINMIPTSTGAAKALRLVIPEMAGKLDGFAIRVPTPNVSVVDLTFTAEKPITKDAINEAVKKAAEGELKGILGYETAPLVSSDFKGNSLSSIFDAELTKVLGNTAKVISWYDNEWGYSCRVRDLITFLGNKGL

SEQ ID NO: 58684 - protein, 403 aa, Acidobacteria bacterium Ellin345
MSKLSIKDLQLSNKRVFMRVDFNVPLDENGRVTDDTRIRETLPTIEYALRHGAKLILCSHLGRPKGKPNPKMSLKPVAERLRVMLDHAISPGQNVGFSPDCIGMQAQEMAKQLEKGQALLLENVRFHAEEEKNDPAFAKELASLCELYVNDAFGSAHRAHASTEGITHYVEKSAAGLLMQKELDYLGKATSNPAKPFVAILGGAKVSDKIGVIQNLMAKVDAIIIGGGMAYTFLKAQGQEIGKSLFEADKLDLAKQILADAHKRGLKFLLPVDHVTADKFDMHATPHQIGEGQSIPAEQMALDIGPKTVALFSEEIAKARTIVWNGPMGVFEFDNFAKGTRAIAKAVAGNSGATSIVGGGDSVAAVHDAGVADKITHISTGGGASLEFLEGKKLPGVEALTNK

SEQ ID NO: 58685 - protein, 431 aa, Shewanella oneidensis
MAKIINVIGREIMDSRGNPTVEAEVHLEGGFIGMAAAPSGASTGSREALELRDGDKSRYLGKGVLTAVANVNGPIRTALIGKDATAQAELDQIMIDLDGTENKDKLGANAILAVSLAAAKAAAAFKGMPLYAHIAELNGTPGQYAMPVPMMNILNGGEHADNNVDIQEFMVQPVGAKNFREALRMGAEIFHTLKKVLHGKGLSTSVGDEGGFAPNLSSNADALAVIKEAVELAGYKLGTDVTLALDCAASEFYKDGKYDLAGEGKVFDSNGFSDFLKSLTEQYPIVSIEDGLDESDWDGWAYQTQIMGDKIQLVGDDLFVTNTKILTRGIENGIANSILIKFNQIGSLTETLAAIRMAKAAGYTAVISHRSGETEDATIADLAVGTAAGQIKTGSLCRSDRVAKYNQLLRIEEQLGEKAPYRGLKEIKGQA

SEQ ID NO: 58686 - protein, 327 aa, Mycobacterium avium 104
MTSPPLDPDAAARIASFGETAPMRQRGLPAVRAGLESAPRPATMPEMASVTEALVPSAAGGIPVRIYRPTTDSGVAVLVYLHGGGLVMGSNRSFEPLARELASASAATVVAVDYRLAPESPPPAQFDDAYAATEWVSRKAGELGVDADRLAVIGDSAGGSLAAAVALAARDRRGPPICAQVLLYPGLDRDMSVASIAAMPDAPLLIRDDIDYMHALVDGDAGPPTDPYLVPAYAADLSGLPPAIVVTAGCDPIRDWGERYADRLRDAGVQTTVTRYPGMYHGFLMRSDATARGRLAIAEIGGLLRAKFTHPLRFDVPITGRHSTPTR

SEQ ID NO: 58687 - protein, 148 aa, Vigna unguiculata
MADPLTDDQISEFKEAFSLFDKDGDGCITTKELGTVMRSLGQNPTEAELQDMINEVDADGNGTIDFPEFLNLMARKMKDTDSEEELKEAFRVFDKDQNGFISAAKLRHVMTNLGEKLTDEEVDEMIREADVDGDGQINYEEFVKVMMA

SEQ ID NO: 58688 - protein, 512 aa, Flavobacteria bacterium BBFL7
MKILSAQQLAEADQSTIDKNQITSNDLMEHIAKLIFDRIHQRLQGSPVPIKIFCGIGKNGGDGLALSRHMIQHGYHVTTYVTNYSKKRAPEFLFHYDKIKEVTKDWPILLSSEKDFPELHPQDIIIDAIFGTGINRPIDGWMAQLVHYLNKTPAFKLAIDMPSGLYANNSQDIDSPIIQAQHTFSFETPKLSFFLPETGHYAGTFEVVPIGLDPEYMMKAEPLAQIISSDAAKSMYKPRKKFSHKGDFGHVLTMAGSKGKIGAAVLATGAAVNMGAGKVTAYIPEHANSILQSSIPEVMTISSKSKDYITDFDHDLKDITLCVGPGLSTGDDVKHAFAKALSQQTQPVIIDADGLNILSDNSDYWKLIPKNSILTPHDGELEKLIGQWNDDYDRLEKAKKLSIDKDVILVLKGAHTIIISGKNLYINDTGNPGMATAGSGDVLSGMIAGLLAQHYDALTAAVFGVFIHGRAGDIASQTYAHEGLKASIISNFVGAAILDLFRPEPQQQPQQQ

SEQ ID NO: 58689 - protein, 156 aa, Oryza sativa (japonica cultivar-group)
MANAGLKPVAGLLLVLNFCMYVIVAAVGGWAINHAIHTGYFIGSGMALPANFSPIYFPMGNAATGFFVIFAVIAGVVGAAAALAGFHHVRAWSHESLPAAASSGFIAWTLTLLAMGLAVKEIDLHGRNARLKTMESFTIILSATQLFYLLAIHGGR

SEQ ID NO: 58690 - protein, 368 aa, Malus x domestica
MGKGGQSCNGVVRDAKPVEQENMAAWLVDVNTIKILPFKLPAIGPNDVRIRIKAVGICGSDIHYLKTMKCGDFQVKDPMVIGHECAGIVDKVGSEVKHLVPGDRVAVEPGISCARCQQCKGGRYNLCPDMKFFATPPVHGSLANQIVHPADLCFKLPENVSLEEGAMCEPLSVGVHACRRANVDPETTVLIIGAGPIGLVSVLAARAFGAPRIVIVDMDDKRLAMAKSLGADEAVKVSTKMEDLDDEVAEIKEAMISEVDVTFDCVGFNKTVSTGLNATRPGGKVCLVGMGHGVMTVPLTPAAAREVDVVGVFRYQKTWPLCLEFLRSGKIDVKPLITHRFGFTEKEVEEAFATSARGGNAIKVMFKL

SEQ ID NO: 58691 - protein, 419 aa, Schizosaccharomyces pombe
LMGFGAGLAILRRGLISGASLVKRRMLVSVEIPSKEKSYNAFLHWMSTVPKRYSNQLAVESNRQLKMPQNAREKPDKQVANRFFSLVPGPGKHYIKYKKCWIQVERERSNRLQDLTTGTPWETITLTTLSRDRGIFSELLLEAQKFMQSAQKNKTTIYTAWATEWKPFGHPRSKRMLSSVVLESNVKKMITDDVHDFLRNSQWYDTRGIPYRRGYLLYGPPGSGKTSFLYALAGELDYDICVLNLAEKGLTDDRLNHLLSNVPPKAVVLLEDVDSAFQGRERSGEVGFHANVTFSGLLNALDGVTSSDERIIFMTTNHPEKLDPALVRPGRVDVKAYLGNATPEQVREMFTRFYGHSPEMADDLSDIVCPKNTSMASLQGLLVMNKSSPADAVDMAKELPDNPPSTPFSFNVHRKSLSV

SEQ ID NO: 58692 - protein, 542 aa, Debaryomyces hansenii CBS767
MSVKSIKDDDGHIPIPREIYNWKIVLVAITAASAAIIIGYDTGFIGGTVELESFQKEFGMDKMSSDERSLVSANVVSIFHAGAFWGALLMYPIGELFGRKVGLIVSGFILTLGCAIAMISNNERGLGAVYAGRVLSGFGIGGCSGLAPIYISEISPASIRGKLVGCFELSWQVGGIVGYWINFGVQENQPISTKQWLIPFAIQLVPAGMFWILTFVIPESPRFLVSKGKIEKARKNLAFLRDLPEEHEYSLHEMDLFIADSEKKSKIGTGFFAPIKEVFTSKKLLYRLLLSTSLFPMQNGTGINAITYYSPTVFKSLGMDGSSAGLLSTGIFGIIKGVSALFWMFFIVDNLGRRFALIVMSVPLSLCMWYIGAYVYVADPASRLASGNTEMDAGGKTAQGLLYIWSVAYAMSWNGTPWIINSEIFSQEVRTFTSAINASSNWFWSFIMSRFTGKAFEATSYGLYFLFASCMVLFPCVVYMLYPETKEVPLEAIDYLFEVPAWRARDYAMSKFEIEYEGQYTADPSSSEQSFHEAHFPDKGNS

SEQ ID NO: 58693 - protein, 250 aa, Acidobacteria bacterium Ellin345
MSRKKIIAGNWKMHNTPQQSLAFVKAFLPLVADHTRDEIVLCPPYLSLATVVEATKGSNVMVGAQNMHWEVKGAFTGECSPEMLVESGVTHVIIGHSERRQYFNETDDTVNRKLEVALEHGLTPIVCVGEVLEEREAGLTEDVLRRQCSRAFRGISGKKAAKLVMAYEPVWAIGTGKTATPEIAEDAHLVIRGEAAKAFGDDFAHALRIQYGGSVKADNARTLMSQPDIDGALVGGASLDAAGFAKIVKY

SEQ ID NO: 58694 - protein, 144 aa, Synechococcus sp. WH 5701
MSTPVLSVTPTTPLQEAVKLMSDHHISGLPVLDEQGALIAELSEQDLMVRESGFDAGPYVMLLDAVIYLRNPLDWDKQVHQVLGNTVGDVMSRHPHSCSAEVTLAAAAKLLHDRSTQRLFVREGETVVGVLTRGDVVRALAAEG

SEQ ID NO: 58695 - protein, 197 aa, Oryza sativa
IIRNDELIVANAGDSRCVLSRKGRAYDLSKDHKPDLDAEKERILNAGGFIVAGRVNGSLNLARAIGDMELKQNEFLPAERQIVTAEPELNTVKLSEDDEFIVLACDGIWDCMSSQEVVDFVHKEMNTEDSLSAVCEKLLDHCLAPVSGGDGCDNMTVIIVKFKKPSKSAATSSTNQSVSSEEMRPNELDDGPSDPNK

SEQ ID NO: 58696 - protein, 284 aa, Rhodospirillum rubrum ATCC 11170
MSDDVLQPPQDQDSQPGHELEMTPQPDCQPRHPGSDRLAGKVALISGGDSGIGRAVALAFAREGAKIALLYLDEHDDARETERLVMAEGRECLVMPGDVGDEAICIDAVAQVIGNFGALDILVNNAAEQHEVEDLSDLTAGQLEKTFRTNVFGYIYLAKAALPHLPKGGSIINTTSITAYQGHRTLIDYSATKGAIVALTRSLSQSLLDRGIRVNAVAPGPIWTPLIPASFSPDHVASHGASVPMGRAGQPNEVAPAYVFLASDDASYISGQVIHPNGGAIIGS

SEQ ID NO: 58697 - protein, 641 aa, Streptomyces avermitilis MA-4680
MTKRDRTPKTYTRLTHPLVRDSRDEPLRRATWEEALDRAARGLDAARGAFGMFSCARATNEMNYVAQKFARVVMGTNNVDSCNRTCHAPSVAGLSAAFGSGGGTSSYEETEHTDLIVMWGSNARFAHPIFFQHVLKGIRNGARMYAVDPRRTSTAEWAESWLGLNVGTDIPMAHAIGREIIHAGLANETFVERATSGFEEYRALVEPWTLSLAEKVTGVPARAIRELAHAYARAERAQLCWTLGITEHHNGTDNVRALINLSLLTGHVGRYGSGLQPLRGQNNVQGGGDMGAIPNRLPGFQDILDPDARLKFESAWDTVIQPHYGLNLTEMFEAMEEGTLRAVYCIGENPAQSEADSERAVRRMRALDFLVVQDIFLTRTAELADVVLPATAGWAETDGTTTNSERRVQRVRRAVTPPGEAREDIDILCALAARLGHDWKYADAEAVWNELRSVSPDHYGMTYERLAEHQGIQWPCPAPDRLEPPYLHGRLWSSDPAGRGRLAPFGIVQHDPPVDLTDEEYPIRLTTGRRLDSYNTGVQSGGFASPLRRGEFVELCPEDAERYGVVVGEQVQVASRRGAVVAPVWIDPALRPGLAFMTMHFPDEVDTNRLTIEANCPIAGTAEFKASAIRIEKLPVTAVRS

SEQ ID NO: 58698 - protein, 394 aa, Xanthomonas axonopodis pv. citri str. 306
MDSLLQYAGGYSRRSQDIAPFHVMSLLARANALEQAGHDVIHLEIGEPDFTTAAPIVAAGQAALAAGHTRYTAARGLPALREAIAGFYAQRYACNLDPERILVTPGGSGALLLASSLLVDPGRHWLLADPGYPCNRHFLRLVEGAAQLVPVGPDSDYQLTPALVESAWNADSVGALVASPANPTGSVLSRTQLAALSQALHARGGHLVVDEIYHGLTYGLDAHSVLEVDDGAFVLNSFSKYFGMTGWRLGWLIAPPDAVPELEKLAQNLYISASTIAQHAALACFTPESIALFEARRAEFQQRRDYLLPALRALGFEIAVEPQGAFYLYADISGFSDDAQAFCAHFLETEHVAFTPGIDFGHYRANQHVRIAYTQSLPRLQQAVERIARGLKRL

SEQ ID NO: 58699 - protein, 529 aa, Oryza sativa (japonica cultivar-group)
MGSADLVLKAACEGCGSPSDLYGTSCKHTTLCSSCGKSMALSGARCLVCSAPITNLIREYNVRANATTDKSFSIGRFVTGLPPFSKKKSAENKWSLHKEGLQGRQIPENMREKYNRKPWILEDETGQYQYQGQMEGSQSSTATYYLLMMHGKEFHAYPAGSWYNFSKIAQYKQLTLEEAEEKMNKRKTSATGYERWMMKAATNGPAAFGSDVKKLEPTNGTEKENARPKKGKNNEEGNNSDKGEEDEEEEAARKNRLALNKKSMDDDEEGGKDLDFDLDDEIEKGDDWEHEETFTDDDEAVDIDPEERADLAPEIPAPPEIKQDDEENEEEGGLSKSGKELKKLLGKAAGLNESDADEDDEDDDQEDESSPVLAPKQKDQPKDEPVDNSPAKPTPSGHARGTPPASKSKQKRKSGGGDDSKASGGAASKKAKDTKPSVAKDETPSSSKPASKATAASKTSANVSPVTEDEIRTVLLAVAPVTTQDLVSRFKSRLRGPEDKNAFAEILKKISKIQKTNGHNYVVLRDDKK

SEQ ID NO: 58700 - protein, 474 aa, Ehrlichia ruminantium str. Welgevonden
MIKKYRKKCMQNYDIVVIGGGPGGYKCAIRSAQLGLKVACVDKNEILGGTCLRVGCIPSKALLHFSHEYYHIKNHLDEVGITCNSLSFNLDKIMSFKNKNITELSNGINYLFASNKIDRLCGVGKIRSINSNNFDITVTGNNGEEKITAKYVVIATGSEVASFPGIEIDEKNVVSSTAALSFKEVPKKLVVVGAGAIGLEMSSVWSRFGSEVTVVEFFDKIAPSMDIDISKALLASLKKQGINFKLSTKVTSIDKSSDNLTIHLESVKDGKSEIIEAEKVLISIGRMPYTDGLIDQNCIECDSRGFIKVNNKYETNIPGIFAIGDVIGGAMLAHKAEEEGIAVAELIAGNIPHVDYDIIPSVIYTHPAVASIGKTEESLKNINYAYNVGKSNFSANSRSKITNNGEGFVKVLTSKENNAILGVHIIGAYADTIINEAAIAMAYRASSEDVFRISHSHPDVNEAFKDACEAAYLK

SEQ ID NO: 58701 - protein, 454 aa, Zea mays
LGTSRPAGIHSHTTPPELRTTSFASRRDDWARPPPPPPPELGRFPGEADIVVAVAGGEVVWPDGGPAAAPASICSLEMADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYSFTTSAEREIVRDIKEKLAYIALDYEQELETAQNSSSVEKSYELPDGQVITIGAERFRCPEVLFQPSMIGMEAAGIHETTSNSIMKCDVDIRKDLYGNIVLSGGSTMFPGIADRMSKEITSLAPSSMKIKVVAPPERKYSVWIGGSILASLSTFQQMWISKEEYDESGPAIVHRKCF

SEQ ID NO: 58702 - protein, 289 aa, Zea mays
MFRLARGTARKLILALLTCLSSALLYRQIQPLPPKIPGTPGGPPVTATRTRLSDGRYLAYLETGVPREKAKHRLVFVHGFDSCRHDALPISTELAQELGVYMLSFDRPGYAESDPHPARTEESIALDIAELADNLQLGRKFYLAGFSMGGEIMWSCLKYIPHRLSGVAILGPVGNYWWPGLPSNVSRDAWYQQLPRDQWAVWVAHHLPWLTYWWNTQKLFPASSVIAYNPALLSQEDEMLMAKFGYRAYMPQIRQQGEHECLHRDMMVGFGKWSWSPLQLENPFADADA

SEQ ID NO: 58703 - protein, 884 aa, Cryptococcus neoformans var. neoformans JEC21
MKSNFVFQNLCGTVYRQGNVVFTPDGNSVLSPVGNRVSVFDLVNNKSRTLPFENRKNIASIALSPDGNVLISIDEDGRALFVHFRKGTVLHHISFKRKVHHVSFSPDGKYIAITHGHMVQIWNTPSHLVREFAPFTLHREYTGHHDEVVSVCWSKSSRYFITTSRDMTARLYTINPLEGFQPKQFGGHRDVVLGAFFSQDEKTIYTVSRDGAVFVWKAKKGVSEADSDVEMDILDAPTTSTSAANLALEHAVAYTRWGVHARHFFNQPGTKVICATFHPKTSLLIVGFSSGVFGLWEMPEFTPVHTLSISNEKISSVAVSASGEWLAFGAAKLGQLLVWEWQSESYVLKQQGHYYDMNTLAFSPDGQNIATGGEDGKVKLWNASSGFCFVTFPEHTAAISTVEFAKQGQVLFTASLDGTVRAYDLIRYRNFRTFTSPTPVQFSALAVDPSGDVVCAGSQDSFEIYMWSVQTGKLLDILTGHTAPISGLAFSPTGNQLASSSWDRSIRLWSVFGRSRATEPIELSGEATALAFRPDGNEICASTLNGELIFIDVEEGQIKSVIEGRRDISGGRKVDDRLTAANNAASKYFNSVIYTADGACVLAGGSSKYVVLYDRTEGVMVKKFQISENLSLDGTQEMLDSRKMTEAGTIDSFDRQGEEEDLEDRLDSTLPGASKGDLSKRRYRREARTNCVRFSATGRSWAAASTEGLLIYSLDESTTFDPFDLSLDLTPESVMQTVVSGDHLIALIMALRLSEKPLIQRVYESIPPSSIRLIARQLPRVYITQFMKFISDHIENTPHVEFDLVWTAAMLTSHGKFLKERKGEMASTLRGLVRGLMGLEMSVAKISDENTFSLNYILSQAGKDDQIEFEEGEGDAFILDVDGA

SEQ ID NO: 58704 - protein, 326 aa, Haemophilus somnus 129PT
MNPMNINAIQSLIKTDMDKVNATILAQLNSDVALINQLGYYIVQSGGKRIRPMIALLAARALNYQGDEPITCAAFVEFIHTATLLHDDVVDESDMRRGNPTANAEFGNAASVLVGDFIYTRAFQLMTKLNSLRILQIMSDATNIIAEGEVQQLMNVNDPETSEDNYMKVIYSKTARLFEVATQCAAITAQSNAEQEIALQHYGRYLGTAFQLVDDVLDYSANAATLGKNIGDDLAEGKPTLPLLHAMRNGTPQQSALIREAIEQGGKRDFLDDVLAIMTEQKSLDYAMSKAKEEAQKAVDSISCLPENQYKQALISLAYLSVERHY

SEQ ID NO: 58705 - protein, 338 aa, Pseudomonas fluorescens PfO-1
MNIKKTLAASLLALSIGNAFAAESTGVEHNTQAFLDALAAGGGKPLEQLSPKDARAVLTGAQASVKVDLSGVEVSDKAIKVDGQTINLKVVRPAKVKGELPVFMFFHGGGWVLGDFPTHQRLIRDLVVGSGAVAVYVDYTPSPEAQYPTAINQAYAATKWVAEHGKDIGVDGKRLAVAGNSVGGNMAAVVALMAKEQKTPALRFQLLMWPVTNAGFDNGSYQQFAEGHFLTKGMMQWFWDNYTTNPAERAQIHASPLNASAEQLKGLPAALVQTAEFDVLRDEGEGYARHLDAAGVPVTSVRYNGMIHDFGLLNPLNGIPEVKAAVRQAAAELKTHLN

SEQ ID NO: 58706 - protein, 220 aa, Pseudomonas fluorescens PfO-1
MHIQKLVLAMAIGAVLSASTVLIPDNLSGVSSVQAKEGGSGGGGSGGGGGGGGNGGGGGGNGGGGSGGGGGGNGGGGSGGGGGGNGGGGSGGNGGGHGGSGSGGNSGSGGGGNSGHSGSDHGSGHSGNTASSGRSGTHSEPGDDHGVHRAGEVGDDHGVHRAGEIGDDHGVHRAGEVGDDHGVHRAGEIGDDHGLHAAGQPGDDRGVHVGGEPGDDKRAN

SEQ ID NO: 58707 - protein, 275 aa, Bacillus cereus ATCC 14579
MELWFTEKQTKHFGITARINRTLHTEQTEFQKLDMVETEEFGNMLILDGMVMTTEKDEFVYHEMVAHVPLFTHPNPENVLIVGGGDGGVIREVLKHPSVKKATLVEIDGKVIEYSKQYLPSIAGALDNERVEVKVGDGFLHIAESENEYDVIMVDSTEPVGPAVNLFTKGFYAGISKALKEDGIFVAQTDNPWFTPELITTVFKDVKEIFPITRLYTANIPTYPSGLWTFTIGSKKHDPLEVIEERFHEIETKYYTKELHNAAFALPKFVGDLIK

SEQ ID NO: 58708 - protein, 130 aa, Trichodesmium erythraeum IMS101
MITRKIIKTDKAPEPVGPYNQAIAATGQMLFISGQIAIDTKTNQIVYREDVSKQTEQVMANLEAILTEANTNWSNVVKTTVYLKNMDDFATVNNVYAKYFDPENAPARACVEVARLPKDVLVEIDCIAVI

SEQ ID NO: 58709 - protein, 243 aa, Triticum aestivum
  misc_feature (236)..(236): Xaa can be any naturally occurring amino acid
YFVDMPKEMQARGINEKRLQLLFEVSGVFRPRVLTALVGSSGAGKTTLMDVLAGRKTSGCIEGDIKISGHPKEQQTFARIAGYVEQNDIHSPQVTVEESLWFSSALRLPTDISRETKKAFVEEVTSLVELDELRHALVGKPGSSGLSTEQRKRLTIAVELVANPSIIFMDEPTSGLDARAAAIVMRTVRNAVDTGRTVVCTIHQPSIDIFESFDELLLLKRGGRVIYGGSLGVNSXDMIHYFQ

SEQ ID NO: 58710 - protein, 524 aa, Oryza sativa
IIIFQTMVKAYIAIFSIAVLLLIHFLFRRRGRSNGMPLPPSPPAIPFFGHLHLIDKPFHAALSRLAERHGPVFSLRLGSRNAVVVSSPECARECFTDNDVCFANRPRFPSQMLATFNGTSLGSANYGPHWRNLRRIATVHLLSSHRVSGMSGIISGQARHMVRRMYRAATASAAGVARVQLKRRLFELSLSVLMEAIAQTKTTRPEADDADTDMSVEAQEFKNVLDELNPLLGAANLWDYLPALRVFDVLGVKRKIATLANRRDAFVRRLIDAERQRMDNNDVDGGDDGEKKSMISVLLTLQKTQPEVYTDTLIMTLCAPLFGAGTETTSTTIEWAMSLLLNHPEILKKAQAEIDMSVGNSRLISVVDVHRLGYLQCIINETLRMYPAAPLLLPHESSADCKVGGYHIPSGAMLLVNVAAIQRDPVIWKEPSEFKPERFENGRFEGLFMIPFGMGRRRCPGEMLALQTIGLVLGTMIQCFDWGRVDDAMVDMTQSNGLTSLKVIPLEAMCKPREAMCDVLRKFM

SEQ ID NO: 58711 - protein, 348 aa, uncultured bacterium
NNLLAAIIDNHIQQGNELGIDTRQIIWKRAVDMNDRALRNIVVGLGAKADGVPREDHFVITVASEIMAILCLADDMDDLKKRLSRIIVAYTRDGEPVTAGQLNAVGAMAALLKDAIKPNLVQTLEHNPVIIHGGPFANIAHGCNSVRATKTALGLSDITVTEAGFGADLGAEKFLDIKCRMAGLKPDAVVLVATIRALKYNGGVDKKNLGEENLDALKKGIANLEKHIENIQKYGVPVVVTLNSFLTDTEAETEFVRQFCEERDCRFALSEVWAKGGEGGEALAKEVINTLENKPSNFAPIYSDDLGLKEKITTVAKEIYGADGVQFSGPAARQLAKIEEMGFGKLPV

SEQ ID NO: 58712 - protein, 353 aa, uncultured bacterium
IGAANNLLAAMLDNHIQQGNALGIDAKKITWKRCVDMNDRQLRFVVDGLGGRANGCPREDGFDITVASEIMAVFCLASSMKDLKERLGRIIVAYTYDDKPVTAGDLKATGAMAALLRDALKPNLVQTLEGTPAFVHGGPFANIAHGCNSVMATRMAMRMGDYTVTEAGFGADLGAEKFLDIKCRMAGLTPDAVVVVGTVRALKMHGGMDKKQLANEDLAALEKGIPNLLRHVNNIKNVYQLPCVVAINRFPTDTDAEIDFIIRKCRELGVNTVLSTVWAEGGKGGEDLAREVVRLCEEEQGNFTFSYELDASIEEKLEAVTKKIYGGAGVLLTPAAKKQAERLTELGFDRMPV

SEQ ID NO: 58713 - protein, 198 aa, Escherichia coli O157:H7 EDL933
MNMSASALVCLAPGSEETEAVTTIDLLIRGGIKVTTASVASDGNLAITCSRGVKLLADAPLVEVADGEYDVIVLPGGIKGAECFRDSTLLVETVKQFHRSGRIVAAICAAPATVLVPHDIFPIGNMTGFPTLKDKIPAEQWQDKRVVWDARVKLLTSQGPGTAIDFGLKIIDLLVGREKAHEVASQLVMAAGIYNYYE

SEQ ID NO: 58714 - protein, 207 aa, Zea mays
MENHGNKRVWDQSSDSNTQRVDSPESKIRRVDSSDSGINSSESQLESVLDSSEVQLQDDIFNMLDDTDNVPERDSVQGLDSVIKSFEDEINAPGSDSGSGDPAQEPDSGELQSNLGYLLEASDDELGLPPTVGDGEEMGRAAPEMAELARFVGFEDDIPSYDAFGFGSGFTAENDGGAGGFVTVDGLFDYSDPSADVLWRSESLQAM

SEQ ID NO: 58715 - protein, 609 aa, Oryza sativa (japonica cultivar-group)
MASHALRLHPLLFSAAAARPAPLAARPGGGARRVHRRHSLAVVRCSSSAAQALKIKSIPTKPVEGQKTGTSGLRKKVKVFQQENYLANWIQALFNSLPPEDYVGGTLVLGGDGRYFNKDAAQIITKIAAGNGVGKILVGRNGLLSTPAVSAVIRKRQANGGFIMSASHNPGGPDNDWGIKFNYSSGQPAPETITDQIYGNTLSISEIKTADIPDVDLSSLGVVSYGDFTVEVIDPVLDYLELMENVFDFQLIKGLLSRPDFRFVFDAMHAVTGAYADPIFVEKLGADPDYILNGVPLEDFGNGHPDPNLTYAKELVFTMFGSGAPDFGAASDGDGDRNMILGRRFFVTPSDSVAIIAANAQAAIPYFQSGPKGLARSMPTSGALDRVADKLNVPFFEVPTGWKFFGNLMDAGKLSICGEESFGTGSDHIREKDGIWAVLAWLSILAHRNKDKKAGERLVSVEDVAREHWATYGRNFFSRYDYEECESESANKMMEHLRDVIAKSKPGEKYGNYTLQFADDFSYTDPVDGSTVSKQGLRFVFTDGSRIIFRLSGTGSAGATIRIYIEQFESDASKHDLDAQIALKPLIDLALSVSKLKDFTGRDKPTVIT

SEQ ID NO: 58716 - protein, 353 aa, uncultured bacterium
IGAANNLLAAMLDNHIQQGNALGIDVKKITWKRCVDMNDRQLRFVVDGLGGKANGTPREDGFDITVASEIMAVFCLASSMKDLKERLGRIIVAYTYDDKPVTAGDLKATGAMAALLRDALKPNLVQTLEGTPAFVHGGPFANIAHGCNSVMATRMAMRMGDYTVTEAGFGADLGAEKFLDIKCRMAGLTPDAVVIVGTVRALKMHGGLDKKQLVNEDLAALEKGIPNLLRHVNNIKNVYQLPCVVAINRFPTDTDAEIDFIIRKCRELGVNTVLSTVWAEGGKGGEDLAREVVRLCEEEKGNFTFSYELDASIEEKLDAVTKKIYGGAGVSLTPNAKKQAERLTELGFDKMPV

SEQ ID NO: 58717 - protein, 352 aa, uncultured bacterium
ITSANNLMCAMLDNHLLQGNTLRIDPNRIVAKRCLDMNDRALRNIVVGMGKRLDGVVREDHFCITVATEVMAILCLAENLEDLKARLSRIIVAYNYDNEPVTAGDLKCVGAMTVLLKDAIRPNLIQSLEGNPVFVHGGPFANIAHGCNSVRATKVALKAADYVVTEAGFGADLGAEKFLDIKCRMAGLKPDAVVLVATARALKYNGGVPKDELSNENVEALKKGIVNLGKHIENLQKYNVPVVVTINKFVSDTEAEVEAIREFVQDKGCRFAVSDVWGQGGQGGLDLAKEVFEAVEEGSPEFRFLYDDELSLTEKIEKVATEIYGADGVDYTTEAMNAIKRAESLGFGKMPV

SEQ ID NO: 58718 - protein, 116 aa, Zea mays
  misc_feature (40)..(40): Xaa can be any naturally occurring amino acid
  misc_feature (43)..(43): Xaa can be any naturally occurring amino acid
  misc_feature (65)..(65): Xaa can be any naturally occurring amino acid
MADACLIEGNALLPPEVNWLLYLRNLPFNISGEEMYDIFXSTXSSRQIRLDNVIDTRVTAYFFYXDIYDSKNAVYHLSCFNLGNRYLIVLYYQPAKMYNKSDLNKKEDEITRLHEK

SEQ ID NO: 58719 - protein, 352 aa, uncultured bacterium
ITSANNLCAAMLDNSIKQDNELNIDPEKVVWKRCVDINDRVLRNIIVGRGRDVDGVEREDHFAITVASEIMAILCLANDYADLKDRLGKIIVAYTYDGKPITAKDIKAVGSMAALLKDAMKPNLIQTLEHTPALVHGGPFANIAHGCNSVRATKTALKMADYVITEAGFGADLGAEKFLDIKCRKAGLKPDAVVLVATVRALKYNGGVPREDLQTEDLDALSKGIVNLEKHIENIQQYDVPVVVTLNQFGTDTDAEIEFVKNFCEEHDCDFAPAKVFKEGGEGGIELAEKIIETIDTKPSNYHPLYTDDMSIKEKIETVATKIYGADGVTYSDEAEEALKKIEELGYSDYPV

SEQ ID NO: 58720 - protein, 286 aa, Alkalilimnicola ehrlichei MLHE-1
MRRDDNWFTEVLEEEGMAFSLRVREKLHEERTAFQHIEVYETEAWGRLLVIDGCVMLTSRDNFVYHEMMSHPALFTHPDPRRVAIIGGGDCGMLREVLKHPGIESVVQVDIDAGVTRAAERYFPELTEANDDPRATLLFDDGVAWIQDQPAGSLDVVIVDSTDPVGVAEGLFGPGFLGQVYRVLGDQGLMVQQSESPILHRDTILERLHGHMRGSGFAPVVTLPYPVVSYPSGWWSATLASKGPHPAAFRESDARAKAFATLYYNADIHRAALAAPEFCKGLLTDQ

SEQ ID NO: 58721 - protein, 1467 aa, Aspergillus oryzae
MALAMDGGTSSGTQTYANSERSDLEQKDKLAENRAEIDEQLTNLARKLTTKSEQLHHRSPFEAPEGGCLDPNSPNFRARDWAKAFYNARYNADENCPPRVAGVAFKDLNVSGYGSPVDYQMSVGNALLKLPTQIYQFLGGKKRKINILQGLDGLVLPGEQLCVLGPPGSGCSTFLKTIAGETHGFQVDPAAYINYHGITPKQMSTDFRGEAIYTAEVDAHYPQLSVGDTLYFASLARAPRHLPGGISSQEYATHLRDVIMAMFGISHTINTRVGNDFVRGVSGGERKRVTIAEAALSYAPLQCWDNSTRGLDSANAVEFCRTLRTQSDVFGMTSCVAIYQAPQAAYNLFDKVIVLYEGHQIYFGTAHDAKSYFERLGFLCPESQTTADFLTSMSSPTERIVRPGFESLAPRTPEEFAKLWKESPERQSLLRQIDQYATEHPFDGADLDRFSQSRKTEKSKNQRQKSPYTLSYWGQIRLCMWRELQRLKNDPSVTIVMLINNFFEALIISSIFYNLSGNTSSFFSRGAILFMMVLLNAFSSMLEILSLYAKRTIVEKHNRYALYHPSAEAISSMIMDMPYKIVNSILMNITLYFMANLRREPGPFFFNYLISFMMVMSMSMFFRLFASLTKTIQQALAPSSIILMALVLYTGFAIPVSYMRGWASWIRHLNPVAYGFEAIMVNEFHGRTFPCASFVPSGVGYENISKDERVCSVVGSVPGSDLVDGTTFVKSTYGYENSHRWRNFGIILALTIFLALCQIIATELVASERSKGEVLVFRRGSSQKARAKQHQHDEERTQAPVIQNEKHSEGPDSTLGVEKQTSIFHWENVCYDVKIKSETRRILDHVDGWIKPGTLTALMGSSGAGKTTLLDVLANRTTVGVVGGDMLVDGRPRDSSFQRKTGYVQQQDLHLHTSTVREALEFSALLRQPPQYTREEKLDYVEKVLDLLNMRDYADAIVGIPGEGLNVEQRKRLTIGVELAARPKLLLFLDEPTSGLDSQTSWSICNLMETLTKNGQAILCTIHQPSAMLFQRFDRLLLLAKGGKTVYFGDIGRESRILMDYFTRNGGPALPPGSNPAEHMLEVIGAAPGAKSEIDWPAVWRNSPEYQNVRHELSNLRALANQPSPVSDTNDKSSYAEFAAPFATQFVQVGLRVFQQYWRTPAYIYSKVLLTIGCSLFIGFSFFKADNTAQGLQNQMFGVFVFLFVVIQLIIQIIPSFVTQRTLYEARERQSKTYSWQAFVVTNILVELAWNSIMAIFCFLVWFYPVGLFHNAEYTDTLHYRSTLTFLFIWVTFLFASSLAHMLIAGIESEEIASSLSNILAIMMYAFCGILAGPDALPGFWIFMYRVNPFTYLVSGLLSTSLGEAPMHCAEKEFLSFSTPANLTCGEYMQDYISTNGGYLLNSGAQGGEDCHFCATGNTTQFLQHVNIDFSTRWRDFGLMWVYVVFNIFAAISLYWLCRLPKGKKNK

SEQ ID NO: 58722 - protein, 426 aa, Candidatus Desulfococcus oleovorans Hxd3
MTQVARAKQGVVTEQMAAVAKSEGLSPEAVRDGVAAGRIVIPGNVNRRFAPVGIGSGLRTKVNANIGTSPEHHDVAEEERKLQTAVAAGAHSVMDLSTGGDLFAVRKMVLEKSPVMVGAVPIYEVAARLSAESRAFYEMTPDMLFDAIERQCAEGLDYITVHCGVTRQAAALAGADRRVTGIVSRGGSLLAAWMHDHRKENPLYEEFDRLLGIAAAYDVTLSLGDGLRPGAVADASDGAQLQELVVLGDLARRARDADVQVMIEGPGHVPIDQIGANVQMQKALCGGAPFYVLGPLTTDCAPGYDHITGAIGGAVAAAAGADFLCYVTPSEHLCLPDIDDVRVGVIAARIAAHSGDIAKKVPGALDRDMQMSACRKALDWRGMYQAAIDPCLPRQRREASHPEEESVCTMCGELCAVKTHNRMTNP

SEQ ID NO: 58723 - protein, 748 aa, Cryptococcus neoformans var. neoformans JEC21
MTLDILQPKPTPDASVQSFLNRHKQLLELERKAEEEQTRLLNSKCSPSLLEQRGLALNGLGVSGISIGLGGKSLIELHRPLAYHTSPALPPHTFRPGDPVRIEAHVATTSGKSKGKKRESEDEGAVEGVVYRVGPEKVVVAVNESKEIDLPERLRLLKLANSVTFDRMEKTLAHLERLVLPSGGTPSPPSFNMPLVQALLGKQLPTWKETIPPQNNIEPLGQLSSDEDMKWFGQHLNDSQKESIKFCLKANEVACIHGPPGTGKTHTLVELIFQLLSRPAAPNTTLPPRILITTPSNLALDNLLIRLHILAQQPPYSSLLPRNSFLRMGHPTRVHRDLVKETLDWKAANGDQGELLKDVGKEMQGHLDALGKKRGEKGAVKGKERGKKWGEVRELRKEYRQREGKVVKTVVNGAQIVLATCHSAGSRQLNNMIFDVCIIDEATQAVEAVCWVPILKSKKLILAGDPQQLPPTIMSKENAPPLKDLQEAIDQIKLGDSPSLKSPRTLETTLFERLEKLYGPGIKRVLQVQYRMNEHIAVFPSETLYESALISDASVAKRTLLELPSVKDKTSEDVKDDLEPTVVFFDTADCEFYERTEGDGEATKSSIGEGSKSNENEAEIVARWARKLISLGIPPIEIGIVTPYQAQVTLISSLLHEEYPEMTIGSVDGLQGQEREAIILSLVRSNPSGEVGFLGEYRRLNVAMTRAKRQLCVVGDSKTVSKGTKYLKKWMDWLEAEADVRWAGEETV

SEQ ID NO: 58724 - protein, 1097 aa, Aspergillus oryzae
MPLLEAPRNGGAVNNGVLSGVSHSQSFGIDTESHLDDPNRRQQIVVVGLGMVAISFLEKLVKQDSERRKYDIVVIGEEPHVAYNRVGLSSFFEHRNIEDLYLNPKEWYGSFKDRSFDYHLNTRVTDIFPDRKTVKTSTGDIIAYDLLVLATGSDAVLPTHTPGYDANGVFVYRTISDLERLIEFASNHKGETATTVGGGLLGLEAAKAMTDLEDFGKVKLIDRNKWVLARQLDGDAGTLVTRKIRELGLDVMHQKRVAKIKTDDNNNVTGIVFEDGEEIDCCCVCFAIGVRPRDELGTTAGIQCASRGGFVINESLQTSIPEIYAIGECASWENQTFGIIAPGIEMADVLAFNLTNPDKEPRSFRRPDLSTKLKLLGVDVASFGDFFADRDGPKFLPGRRPSVATIPRVKDTTEKESPVKALTYKDPFGGVYKKYLFTMDGKYLLGGMMIGDTKDYIKLNQMVKSQKELEVPPSQFILGAQNGGEENGDDLADDTQVCSCHNVTKGDIVESVKSGTCKSIGEVKSCTKAGTGCGGCMPLVQSIFNKTMLDMGQEVSNNLCVHIPHSRADLYNIVAIKQLKTFEDIMKAVGRSPDSLGCELCKPAIASILSSLFNGHIMDHEYHELQETNDRFLANIQRNGTFSVVPRVPGGEITADKLIAIGQVAKKYNLYCKITGGQRIDMFGAKKQDLLDIWTELVNAGMESGHAYAKSLRTIKSCVGTTWCRFGIGDSVGMAIRLEERYKSVRSPHKLKGAVSGCVRECAEAQNKDFGLISTEKGFNIFVGGNGGAKPRHSELLAKDVPPDMVIPIIDRYLIFYIRTADKLQRTARWIENLPGGINYLREVVIDDKLGICAEMEQQMQELVDSYFCEWTETIRNPKRRKYFQQFANTDETVDTVELVKERDQERPTYWPSEGAKEDFKGHQWSALSWQPIIKADHFSDGPPAISSANVKRGDTQLAIFKVKGKYYATQQMCPHKRAFVLSDGLIGDDDAGKYWVSCPYHKRNFELNGEQAGRCSNDEAMNIATFPVEERDDGWIYLKLPPVEELDSVLGTEKWKVKKGEAPDPFQKCDKKYKGTRGKKAGDRPSPTKQSKTIDW

SEQ ID NO: 58725 - protein, 457 aa, Zea mays
  misc_feature (103)..(103): Xaa can be any naturally occurring amino acid
MAGLLHLQSTLLPSASALRRRAGAPVPCSSRRRCRVEAKIREIFMPALSSTMTEGKIVSWTAAEGDRLSKGDPVVVVESDKADMDVETFHDGFLAAVLVARGXSAPVGSAIALLAESEEEIPVAQSQAASFSSSSPSPPPPQETAQEASPSPPPPPPSAPVAVSAPALPSPATQGGGRVVASPYAKKLAKDLGVDLFSVTGSGPGGRIVAKDVEAALAAPKKAAPVTAARPDVPLGSTVPFTTMQGAVSKNMVESLAVPTFRVGYTITTDALDQLYKKIKSKGVTMTALLAKATAMALVQHPVVNCSCRDGKSFTYNKSINIAVAVAIDGGLITPVLQDADKLDIYSLSRKWKELVDKARAKQLQPHEYNSGTFTLSNLGMFGVDRFDAILPPGTGAIMAVGASEPTVVGTKDGRIGIKSQMQVNVTADHRVIYGADLAAFLQTLAKIIEDPKDLTF

SEQ ID NO: 58726 - protein, 569 aa, Oryza sativa (japonica cultivar-group)
MDEEARAAGCSPAPPRAPAASCGAAAELCLCSPTGVEGIEQVPGCPCFEDAGAVVVSGEAPEGPGVLCSEDGAELKLAEQGALDVRLGSPAVGIHEQQLLHRGTSGSDEAGAINEISPVEVSPSEASSNLDTAGAIGGSPLMLESLPETSDTRGCEQEVMPGVVVGSSNRDASSEVGVESERGSDADGRNGLGEGELVSSVDGGGAEKSSKVTGVLSEEGVDGMETALEPCVASVGSITQVEEGVDRMETSLDDSEASDGSTTQDFDTDVETESSGSSIEEQDMGYGVHIPHTEQAICEVARGNKSSEVKSSDRMSSVTLPTLILASGAAMLPHPSKVLTGGEDAYFIACDGWFGVADGVGQWSFEGINAGLYARELMDGCKKAVMESQGAPEMRTEEVLAKAADEARSPGSSTVLVAHFDGQVLHACNIGDSGFLVIRNGEIYQKSKPMTYGFNFPLQIEKGDDPFKLVQKYTIDLQEGDAIVTATDGLFDNVYEEEIAAVISKSLEAGLKPSEIAEFLVARAKEVGRSATCRSPFSDAALAVGYLGYSGGKLDDVTVVVSVVRKSEV

SEQ ID NO: 58727 - protein, 448 aa, Oryza sativa
MSEPEFEQARKELVSTLEASSLFTKNPEYKKALEVVSVPERVIQFRVVWENDKGECQVQKGYRVQFNSALGPYKGGLRFHPTVNLSILKFLGFEQIFKNALTGLNMGGGKGGCDFDPKGKSDNEIRKFCVAFMRELNKHIGADTDVPAGDIGVGGREIGYLFGAYRAERNRWEGVLTGKGGSWGGSLIRPEATGYGLVYYVEHMINYASGGKESFAGKRVAISGSGNVAQYAALKIIELGGTVISLSDSKGALIADDDKGFTPEVINEIAALKLQRKALTALENHSFRYVEGARPWKEVKKVDVALPSATQNEVSEDEAKALIESGAKFIAEGSNMGCTQEAIEVFEAHRRENKGSAIWYAPGKAANAGGVAVSGLEMAQNSQRLSWSAEEVDEKLKGIMKDCFENCLSTAKEYFTPSEGEFPSLVGGANVAGFRKVAAAMHDQGDWW

SEQ ID NO: 58728 - protein, 453 aa, Triticum aestivum
MAAPVPPGPEVFDVVIFGASGFTGKYVIREALKFLPPNASPLRSLALAGRSRDRVAAALRWAAAPGPAPDVPILVADASDPASLAAVAARARVLLSCAGPFRLHGRQVAAACAEAGADCLDISGEPEFMERVEADLHEVAAKNGSLIVSACGFDSIPAELGFLFNSRQWTPPSAPLSVVAYVNLESDRKIVGNFGTFQSAVLGVANASELQALRRSRPRPAKPRIPGPPPPKGSLIEHDKALGLWAMKLPSADTVVVKRTLAKVTEHPEGLPGADETPEFAEHRKEFWSSIKPAHFGMKISSRSILGLFWWLCTGLFIGILGGFSFGRSLLLKFPEFFSIGLFRKTGPTEEEVRSASFKMWFIGRGYSDLARASERGGKPDKEIVTRVSGPEIGYITTPIVLVQCALVLLSQRANLPKGGVYTPGAVFGPTDLQKRLEENGLSFELISARTLP

SEQ ID NO: 58729 - protein, 219 aa, Nicotiana tabacum
WACSLQSSRRTKNLPWQNGNGLFEDSLRAAGISSGLESGTKVYVSNLDVGVTNSDIRELFSEIGELIRYAIHYDKNGRPSGAAEVVFARRSDAYQAHKRYNNVQLDGKPMKIEVVAPSTGMPLSARVDVGRGSGRRTVVTLPGSARGRGAASAAANRGSSQRGRGGFGNASGRWRNRGRGGGRGRGRGGRVRKNGVEKSAEELDKELEKYHATADAMQT

SEQ ID NO: 58730 - protein, 352 aa, uncultured bacterium
IGAANNLIAAMLDNHIKQGNELDVDLNNIIWRRCVDMNDRQLRNVVDGLGTAGDGVAREDGFDITVASEVMAVFCLATSLDDLKERLGRMVVAYSRAGKPITVADIKAEGACTALLKDAIKPNLVQTLENNPAFVHGGPFANIAHGCNSVQATMTAMKMTDYVVTEAGFGADLGAEKFIDIKCRYAGFNPSCVVIVATVRALKHHGGVAKADLNNENLEALEAGLPNLLQHVSNVKDVFGIAPVVAINAFPTDTEAELKLVQDKCAELGVNAVLAEHWAKGGEGAKALAEEVVRVCDQPNDFKFCYDVEMGIEDKIEAIAKRIYHADGVDYTPKAKKQLAQLNELGFDKLPI

SEQ ID NO: 58731 - protein, 455 aa, Kineococcus radiotolerans SRS30216
MNPVPAVDLSWTTGRTSADLAIDCSFVFVGQHVQPAATDNHSHRVPPGHPGVRGPRRRGSLTGESDVVPWTRWHVATQDAMNGHTVETHLTRSPETGTLTPAGAEPRPAARPQGAKLYQALAQQVRERGLMRRRPGWYVLRAAALLAVLGAVAVASWNLGDTWWQLLLAPVVAVVVSQVAFLGHDAAHQQVFGSPRANEVAARGLASGWAGLSYGWWLGKHGVHHSAPNQRGRDTDIESKALAFYPEAVEGKSRLHAWLLRRQGFLFFPLLLLEGLNLHVDSARNLTSRAPRPRRAVDISLVVVRWALYLAFAGAVMSPLKVLAFVAVDLACFGVLLGGAFAPNHTGMPILARGAKLDFLHRQVTSSRNVSGGWWVDLVMGGLNHQVEHHLFPSMPRPTLRKVRPIVRDFCAGHGIPYTETSFVGAFRAVVVHLNTVGLAGRRDNSCPLAAQLRS

SEQ ID NO: 58732 - protein, 368 aa, Xanthomonas axonopodis pv. citri str. 306
MKTRAAVAWGPHQPLTIEEVDLQPPRPGEVLVRLVATGICQGDAHALAHGHAGSFPAILGQEGAGVVEDVGIGVTSVRPGDHVIPLYMPECGVCKFCRSGRTNLCQAIRSSQERGLMPDGSSRFSLHGRPILHHMGTSTFSEYTVLPEIAVARIHPEAPLEQACLLGCTVTTGVGAVLNSTHVRPGDCVAVFGLGGIGLSVIQGALLAQAGRIIAVDIDPAKFALARTLGATDCLDPRDYGAPIQQVIVDLTDGGADHSFECVGDVGAMRAALECCHKGWGESVILGMADDTQEISTRPFQLVTGRVWRGSAFGGVKGRSELPGYVERYLHGDIQLAPLITRTLALDDINQALTDLRAARGIKSIVAY

SEQ ID NO: 58733 - protein, 353 aa, uncultured bacterium
IGAANNLLAAMLDNHIQQGNALGIDIKKITWKRCVDMNDRQLRFVVDGLGGRANGTPREDGFDITVASEIMAVFCLAASMADLKERLSRIIVAYTYDDQPVTAGDLKATGAMAALLRDALKPNLVQTLEGTPAFVHGGPFANIAHGCNSVMATRMAMRMGDYTVTEAGFGADLGAEKFLDIKCRMAGLVPDAVVVVGTVRALKMHGGLDKKQLANEDLAALEKGIPNLLRHVNNITNVYHLPCVVAINRFPTDTDAEIDFIVRKCRELGVNTILSTVWAEGGKGGEDLAREVVRLCEKEKGNFTFSYELDASIEEKLEAVTKKIYGGAGVALTPAAKKQAERLTQLGFDKLPV

SEQ ID NO: 58734 - protein, 113 aa, Zea mays
MATRVWLTALLLGFLVAASPFTGRVARAESEEDAAAAEVVEGADLGIVGDDTQVSSDGPLSPAPGVETVVVFPKNAGKIVLAGEETELLVGLQNDGNHYFPPISLSLSSPSPY

SEQ ID NO: 58735 - protein, 353 aa, uncultured bacterium
IGAANNLLAAMLDNHIQQGNALGIDVKKITWKRCVDMNDRQLRFVVDGLGGKANGVPREDGFDITVASEIMAVFCLASSMKDLKERLSRTIVAYTYDDKPVTAGDLKATGAMAALLRDALKPNLVQTLEGTPAFVHGGPFANIAHGCNSVMATRMAMRMGDYTVTEAGFGADLGAEKFLDIKCRMAGLTPDAVVVVGTVRALKMHGGLDKKQLAEENLEALEKGIPNLLRHVRNIREVYQLPCVVAINRFPTDTDAEIEFIIRKCRELGVNTVLSTVWAEGGKGGEDLAREVVRLCEEEKGNFTFSYDLEMSIEEKLEAVTKKIYGGAGVALTPGAKKQAERLTALGFDKMPV

SEQ ID NO: 58736 - protein, 352 aa, uncultured bacterium
ITTANNLLAAMLDNHIQQGNQLGIDTRMVVWKRCLDMNDRALRNVVIGLGAKADGVVREDHFCITVASEIMAVLCLADDMDDLKARLGRIIVAYNFEGKPVTAADLGAVGSMAALLKDALKPNLIQTLENTPALVHGGPFANIAHGCNSVRATKAALKMADYCITEAGFGADLGAEKFLDIKCRMAGLKPDAIVLVATIRALKYNGGVAKTDLVPENLEALKKGIVNLEKHIENLQKYGVPVVVTLNSFVTDTPAETAYVNQFCEERGCDFALSEVWEKGGEGGIELAKPVLNTLETKESNYHSIYTDDLSLTEKIETIAKEIYGADGVNYSAAAKTQLKKLEDLGFGNFPI

SEQ ID NO: 58737 - protein, 424 aa, Ehrlichia ruminantium str. Welgevonden
MEYHMLFLANPFFHYKSNVLNIENVSVLEITNSIGTPVYCYSLNAIKNNYIQFKENLPNNSIICYAVKSNSNLSILSLLSSLGSGADAVSEGEIRRAITAGISPNKIVFSGVGKTEQEISFALDNRILQLNVESIEELQLINKISYHKNIIAPVSIRINPNINANTNDKITTGLKVNKFGIPEESLDQVFNSSLTNIKIIGISVHIGSQIANLGIFQNTIDKVKRIVKIFEQHNIHILRVDMGGGLGIPYKNSDIFPTIQEYTNLLKNNFEKESYNIICEPGRAIVGNTGILLAKVLYHKSNYEKNHLVLDTGMNDLIRPALYNAEHTIIPAVVSSKSHLSFDIVGPICESDDTFAYSYWINNVDNNEIVAICTVGAYGSSMSSNYNSRPLVPEVIVNQDNYHIIRHRQTYNDMLKDEVTLKFK

SEQ ID NO: 58738 - protein, 495 aa, Artemisia annua
MKSILKAMALSLTTSIALATILLFVYKFATRSKSTKKSLPEPWRLPIIGHMHHLIGTTPHRGVRDLARKYGSLMHLQLGEVPTIVVSSPKWAKEVLTTYDITFANRPETLTGEIVLYHNTDVVLAPYGEYWRQLRKICTLELLSVKKVKSFQSLREEECWNLVQEIKASGSGRPVNLSENVFKLIATILSRAAFGKGIKDQKELTEIVKEILRQTGGFDVADIFPSKKFLHHLSGKRARLTSLRKKIDNLIDNLVAEHTVNTSSKTNETLLDVLLRLKDSAEFPLTSDNIKAIILDMFGAGTDTSSSTIEWAIPELIKCPKAMEKVQAELRKALNGKEKIHEEDIQELSYLNMVIKETLRLHPPLPLVLPRECRQPVNLAGYNIPNKTKLIVNVFAINRDPEYWKDAEAFIPERFENSSATVMGAEYEYLPFGAGRRMCPGAALGLANVQLPLANILYHFNWKLPNGVSYDQIDMTESSGATMQRKAELLLVPSF

SEQ ID NO: 58739 - protein, 334 aa, uncultured bacterium
MLDNHIQQGNALGIDVKKITWKRCVDMNDRQLRFVVDGLGGKANGTPREDGFDITVASEIMAVFCLSSSMADLKERLSRIIVAYTYDDKPVTAGDLKATGAMAALLRDALKPNLVQTLEGTPAFVHGGPFANIAHGCNSVMATRMAMRMGDYTVTEAGFGADLGAEKFLDIKCRMAGLTPDAVVVVGTVRALKMHGGLDKKQLANEDLAALEKGIPNLLRHVNNIKNVYQLPCVVAINRFPTDTDAEIDFIIRKCRELGVNTILSTVWAEGGKGGEELAREVVRLCEEEQGNFTFSYELDASIEEKLEAVTKKIYGGAGVMLTPAAKKQAERLT

SEQ ID NO: 58740 - protein, 444 aa, Haemophilus influenzae 86-028NP
MTNNNKTMEILMKSGDLNKYDLVKNTLVLVLAGGRGSRLHELTDKRAKPALYFGGNRRIIDFALSNCINSGLNRIGVVTQYAAHSLLRHLQTGWSFLPQERGEFVDMLPARQQIDDSTWYRGTADAVYQNMAIIKNHYRPKYILILAGDHIYKQDYSVMLMDHVNSGAKCTIGCIEVPRSEAHEFGVMAVNENLKVKAFVEKPKDPPAMVGKPDVSLTSMGIYVFDADYLYKMLDREVGTPNTSHDFGKDVLPKCLEEGALYAHPFSRSCMGRNTEGEIYWRDVGTLDSFWQSNIDLVSENPQLDIYDQSWPIRGNPVQAYPSKFFYKHSNVHPVDNSLIGGGCVITDASISNSVLFDRIKIDSFSKVDHCVVLPQVKIGKNCVLKNCIIDRECEIPDGMQIGVDMEEDKNRFRISSTGKVILVTPKMLKILEGHEIGEEGHLD

SEQ ID NO: 58741 - protein, 658 aa, Haemophilus influenzae 86-028NP
MFKIYNNGNPIPMGYSQAVENNVQITNFALFSAAAIGVELCLFDEQNQETRLPMVRTENVWHLAVTGVKTGTEYGFRIHGEFANPNKLMLDPYAKAVNGKPDLSSEESCSWFLLSDNRDNAHLAPRAVVISEDFNWENDTLPNTPWAETIVYELHVKGFSQLNEKIPAALRGTYTGLAHPVNLAYLKELGVTVVELLPVNFHINEPHLQARGLQNYWGYNPLAMFAVEPKYAATNNPLAEFKAMVKAFHNEGIEVILDVVFNHSAESEQTYPTFCQRGIDDQTYYWRNDQGRYINWTGCGNMLNLSSDVGRKWVVDCLRYWVEQCHIDGFRFDLASVLGRDTPDFNSSAQLFTDIKNEPSLQNIKLIAEPWDIGHYGYQVGNFPSYFAEWNDRFRDDLCRFWLWKSGEIGAFAERFAGSIDLFKKNDRLPHTTLNFITAHDGFTLKDLVSYNQKHNEANGEENHDGRNENYSYNHGVEGSTESLSEPQKSAVENNRTFAQSGLLMSLLLANGAPMLLAGDEFGNTQYGNNNAYCQDNEITWLKWANFNEELFELTKQTIALRKRMGSLNQDQWWSDENVQWLNIAGEPMTVEDWQNQQTKALQVVLDNRWLLLINAKAEGQVFHLPNGKWKPQIGTHNVTLEEQAELSSMGFCMLNDE

SEQ ID NO: 58742 - protein, 236 aa, Zea mays
  misc_feature (134)..(134): Xaa can be any naturally occurring amino acid
MGRSNRKSPGSSGWIPGTDEAAAGGDDVLALEDAAAPREWTAQVEPGVQITFGTIPTGGNDLKRIRFSREMFNKWEAQRWWGENYDRIVELYNVVMFSGRQQGCSTPVSSVDDSQRDSSYSRGGSTSRGSPITXRRRRRHCRRWQAKNRSPGAPYDPSRATTSSRDEASVSLSNVSDLEATEWIEEDEPGVCLTIRELGDGTRELRRIRFSREIFGEDRAKVWWEQNRERIQAEYL

SEQ ID NO: 58743 - protein, 385 aa, Aspergillus oryzae
MFATRNFALPARQCLRSTRVSPRIASPLSQLRGYAAATDERVAKFKGQKDTDGKYTVTLIEGDGIGPEISQSVKDIFAAANAPIKWEPVDVTPILKDGKTAIPDEAIESVKRNYVALKGPLATPVGKGHVSLNLTLRRTFNLFANVRPCRSVAGYETPYDNVDTVLIRENTEGEYSGIEHVVVDGVVQSIKLITKEASERVLRFAFQYARSINKKKVRVVHKATIMKMSDGLFLNLARDIAKEFPDIEFDAELLDNSCLKIVTDPTPYNDKVLVMPNLYGDILSDMCAGLIGGLGLTPSGNIGNECSIFEAVHGSAPDIAGKGLANPTALLLSSIMMLQHMNLGEHAARIQKATFDTLAEGKTLTGDLGGKAKTHEYAEAIMKRL

SEQ ID NO: 58744 - protein, 740 aa, Methylobacillus flagellatus KT
MPKTAAKRPAEPTSPPPLLPADSEDSQLTLRLREYLKQDDIDHIWDAYRFSAAAHEGQVRRSGEPYVTHPVSVAGILAELHLDPPTLIAALLHDVVEDTGVTKQEISDRFGKQVAELVDGLSKLDKIEFQSATQAQAENFRKMLLAMSQDVRVILVKLADRLHNMSTLDVMKPEKQRRIARETLDIYAPIANRLGLNEIYQTLEDLSFKYLYPMRHRVISKAVMAARGNRKEVVGKILDAINQRLKEQNIEAEVTGREKHLYSIYKKMTGKTITFSQIYDIYGFRVIVRDLPTCYAALGVLHGLYKPIPGKFKDYIAIPKANGYQSLHTTLFGPFGTPIEIQIRSREMHNIADAGVAAHWLYKTTDAHLTALQQQTHQWLQRLLDIQSESTDSLEFLEHFKVDLFPDEVYVFTPKGNIMALPKGATAVDFAYAVHTDIGNRCVAVKINQELAPLRTELHNGDHVEIITAAHAHPNPAWLNYVLTGKARAHIRHYLKSMQSTESALLGERMLNQALRALHANPAEIDESAWQRLVRDYGAKSKDEILADIGMGKRLNVMVAHQLMAQAGQQDAVTEQQKAPAKILDTITIRGSEGMAVQFAQCCRPIPGDPILGFINKDKGLVIHTHDCPAIRKFRLDPDKWLDVEWDPQGHRLYKVSLKLVVANRRGMLAKIASGIAEAGSNIDNVSMEEADNSTYTNMNFTVQVENRVHLAELMRRLRKIPDVVRINRVKGSGAEQRIQ

SEQ ID NO: 58745 - protein, 128 aa, Methylobacillus flagellatus KT
MAKQIIHTDGAPQAIGTYSQAVKVNGSTVYLSGQIGLDPATMELVDGIEAQVHRVFKNLKAVAEAAGGSLADVVKLNIFLTDLSHFALVNTIMAEYFTQPYPARAAVGVAQLPRNALVEADGVLEIGA

SEQ ID NO: 58746 - protein, 475 aa, Trichodesmium erythraeum IMS101
MVSIQSVEVNSGLQYLPKSTDSVGQSSPNQELLPLTAKVNNLDHLEIGGWDIPALVEKFGSPLYIIDEYTLRTACRQYRDGLQKYYPGESLVLYASKAWSSLAVCALCASEGLGIDVVSGGELYTAIEAGVNPDKIYFHGNNKSLAELTFAIETDCIIVVDNWLELETLAGLKKQQKDQVQNPTKIMVRFTPGIECHTHEYIRTGHLDSKFGFDPGQLNDVFAFISKEELLLLIGVHAHIGSQIFEVQPHQDLVTVMVDTMTTAMSHNLPIKEINIGGGLGIRYTETDDPPSIETWVHKVSTAMVDVCKARQLPLPKLLCEPGRSIIGPACITAYTIGSQKEIPEIRTYISVDGGMSDNPRPITYQSVYRAIVANRLSKPSTEVVTIAGKHCESGDILIKNATLPVTQPGDCFVVMATGAYNYSMASNYNRLPRPAAVLVAEKEVNIILQRETYQDLLSKDTLPERIATLPKLTT

SEQ ID NO: 58747 - protein, 255 aa, Brassica napus
MQSPSTATQESAASSSSFGFFTRLTCLASRNRSNPDGYTLSTSNALFFNGSRTTRRTRKALASLSLNAKSSAGSSLNRFINEFNSFIRFHSEKVVPDSFASIGVSSHESGARGNDGGGVLGAEGLQLSGVEADRPKKVLILMSDTGGGHRASAEAIRAAFNQEYGDEYQVFITDLWTDHTPWPFNQLPRSYNFLVKHGALWKMTYYGTAPRVIHQSNFAATSTFIAREIAQGLMKYQPDIIISVHPLMQHVPLRV

SEQ ID NO: 58748 - protein, 316 aa, Synechococcus sp. WH 5701
MESTILDVDLLAFERGDARSRRAVVDGVKRSLATGFVYTSSDLSGDLLDTAYGMLARFFALDGASKGRFTAAGASGQTGYTGLLVETAAGSERADWKEMLNWSAPIPASHPLRRRYPLLYPEPVLPEAVVPGITEVLLRFHGALADLQRRVLRVIALGLGAAESFFEEMVSEAPTLSRAIRYPPMATAPGPGHLWAAAHGDINLITALPRATGAGLEVEVAGGWVPALPPEGQVIINSGLMLERLSNGLIPAGLHRVVAPPDSAQERLSVVQFCHARPSTLLAPLASCCTAENPQRQAGVLAADALEEVLYRINLL

SEQ ID NO: 58749 - protein, 352 aa, uncultured bacterium
IGAANNLLAAMLDNHIQQGNELGIDPKRITWKRAVDMNDRQLRNIVDGLGGRMQGVPREDGFEITVASEVMAVLCLANDIPDLKKRLGSIIVGYTYAGKPVAAHDLKAEGAMAALLKDALKPNLVQTLEGTPAFIHGGPFANIAHGCNSVTATRMALKLGDYAVTEAGFAADLGAEKFFDIKCRLAGLAPSAVVIVATVRALKYHGGVPKAELNKENLEALEKGLPNLLQHVGNIKNVYGLPCVVAINAFPTDTKAELDLVEAKCKELGVNVALSEVWAKGGEGGKALAEEVVRLCEQPNHFAPSYELDLPIRDKLNAIATKIYHADGVDLVGAAVKQEKEIEAMGCGGLPI

SEQ ID NO: 58750 - protein, 352 aa, uncultured bacterium
LTSTINLIAAIIENSVFQGNKLNINPDRIVWTRALDMNDRSLRDITVTSSDSKHSITHKSEFVITVASELMAIFCIANDEEEFLDRTEKIIVAYTFDEEPITVKDLHIRGAIKKLMHTAMNPNIVQTLEENPVLVHGGPFANIAHGCNSVIATKLGLKLADVVVTEAGFGADLGAEKFLDIKCQRAGLKPDAIVLVATVRALKLHGGVKFEDLDKENIEAMKLGECNLWKHAENMKLYGVPVVISINRFPSDTDAEVETLLNDIEAKKYWGVVNTAALDSGDGAKDLATQVMVAISLDADHLACYGGFEPLYPIGDEHYSIRDKIGLICHKIYGAGNVVYTDLANEQINKYQ

SEQ ID NO: 58751 - protein, 486 aa, Magnetospirillum magnetotacticum MS-1
MGSALAARGVGVGDTVAVMAANTPAAYEAAFGVPMTGGVLCALNIRLDAEAIAFMLSHGEAKVLLTDREFAPTIKKALSLLDKKPLVIDIDDAAVTTGEMLGEMEYEAFIAGGDPDYAWVWPADEWDAIALNYTSGTTGNPKGVVYHHRGAYINALGNVVNWGMTGHPVYLWTLPMFHCNGWCFPWTLAALAGTNVCLRRVDGGHMFAAIEKHKVTHMCGAPIVMGMLINAPEKDRRPLPHPVEFMTAAAPPPAAVIERLESQGFKITHVYGLTEVYGPATVCAWHEEWDALPTEERARLKSRQGVRYVNEEAMMVADPLTLVPVPKDGVTMGEVFYRGNVVMKGYLKNPAATDEAFSGGWFHTGDLGVWHGDDYIELKDRSKDIIISGGENISTIEVEGVLYQHPAVGEAAVVARPDEKWGETPCAFIGLKEGGAATAEEIMAFCRQRLAHYKCPRTVVFTSLPKTSTGKVQKYVLREMAKKLND

SEQ ID NO: 58752 - protein, 353 aa, uncultured bacterium
IGAANNLLAAMLDNHIQQGNALGIDVKKITWKRCVDMNDRQLRFVVDGLGGKANGVPREDGFDVTVASEIMAVFCLASDMADLKKRLSRIIVAYTYDDKPVTAGDLKATGAMAALLRDALKPNLVQTLEGTPAFVHGGPFANIAHGCNSVMATRMAMRMGDYTVTEAGFGADLGAEKFLDIKCRMAGLTPDAVVVVGTVRALKMHGGLDKKQLATEDLAALEKGIPNLLRHVNNITTVYQLPCVVAINRFPTDTDAEIDFIVKKCRELGVNTVLSTVWAEGGKGGEELAREVVRLCEEEKGNFTFSYDLDMSIEEKLEAVTKKIYGGAGVSLTPAAKKQAERLTELGFDKLPI

SEQ ID NO: 58753 - protein, 597 aa, Haemophilus ducreyi
MQNIRNFSIIAHIDHGKSTLSDRLIQTCGGLSDREMEAQVLDSMDLERERGITIKAQSVTLHYKAKDGETYQLNFIDTPGHVDFSYEVSRSLAACEGALLVVDAGQGVEAQTLANCYTAIEMDLEVVPVLNKIDLPAAEPERVAEEIEDIVGIDAIDAVHCSAKTGFGIENVLEDIVKKIPAPEGDPEAPLQALIIDSWFDNYLGVVSLVRVKNGSIKKGDKIKVMTTGQSYNVDRLGIFTPKQVDTTELKTGEVGWVVCAIKDILGAPVGDTLTHQHHSATEVLPGFKKVKPQVYAGLFPISSDDYEAFRDALGKLSLNDASLFYEPENSTALGFGFRCGFLGLLHMEIIQERLEREYDLDLITTAPTVVYEVLQTNGETIYVDSPSKLPPISNIDEIREPIAECNMLVPQEYLGNIITLCVEKRGIQTNMVYHGNQIALTYEIPMGEVVLDFFDRLKSTSRGYASLDYSFKRFQTADMVRVDIMINSERVDALALIVHKDNAAYRGRELVEKMKELIPRQQFDIAIQAAIGNHIIARSTVKQLRKNVLAKCYGGDVSRKKKLLQKQKEGKKRMKSLGNVEVPQEAFLAILHVGKD

SEQ ID NO: 58754 - protein, 221 aa, Alkalilimnicola ehrlichei MLHE-1
MMSADQGKRMAAEAAMEYVEENTVIGVGTGSTVNFFIDALADMKARIDGTVSSSEASTARLRQYGIPVLDLNEVGTMPIYVDGADESNRFLQLIKGGGGALTREKIVAAAAERFVCVADESKLVDVLGEFPLPVEVIPMARSYVARELVKLGGRPQLRSGFTTDNGNVILDVRGLKIMEPIKLEQQINNIPGVVTNGLFALRPADVLLLGTAEGVRKLTAE

SEQ ID NO: 58755 - protein, 336 aa, uncultured bacterium
AAMVDNHIQQGNELGIDPRAVVWKRCLDINDRNLRNIVVGLGAKADGMVREDHFVITVASEIMAILCLADDMNDLKKRLGRIIVAYNFDGEPVTADDVGATGSMAALLKDALKPNMIQTLEHTPALVHGGPFANIAHGCNSVRATKMAMKLADYTITEAGFGADLGAEKFFDIKCNMAGLKPDCVVLVATVRALKYNGGVPKDELTNENVDALKKGICNLEKHIENLQKYNVPIVVTLNAFVSDTDREVEFVKNFCEERGCEFALSRVWELGGEGGIELAQAVIDSINNKPSNFKPLYDNSLTIEEKIETVAKEIYGAKDVAYSKAASRELARLKK

SEQ ID NO: 58756 - protein, 809 aa, Glycine max
  misc_feature (489)..(489): Xaa can be any naturally occurring amino acid
  misc_feature (669)..(669): Xaa can be any naturally occurring amino acid
  misc_feature (691)..(692): Xaa can be any naturally occurring amino acid
  misc_feature (746)..(746): Xaa can be any naturally occurring amino acid
  misc_feature (792)..(792): Xaa can be any naturally occurring amino acid
  misc_feature (803)..(803): Xaa can be any naturally occurring amino acid
MSMSVLSCQRSTMLAAQNNSPFLRRFRSFKPHRSRFRCLLDQISAPTLLTSDNVIAAAAKAASVHSAVSSAITQVAVTAVAIASGACLSTKFDFLWPKLQEQSGTVMQDGVDVTGYPIFNDAKVQKAIAFARKAHRGQMRKTGDPYLTHCIHTGRILAALVPSSGKRAVDTVVAGILHDVVDDTCQSLRDIEAEFGDDVVKLVASVSRLSYINQLLRRHRRVSVNQGVLGQEEASNLRVMLLGMVDDPRVVLIKLADRLHNMRTIYALPLQKAQAVAEETLIIWCSLASRLGLWALKAELEDLCFAVLQPQIFQKMRADLASMWSPTSRTGNPRRLSIKGNLIHLDENSSTAFCNGSLTFNEDVNRKDLLEAVVPFDILLDRRKRANYLSSIGRLEETCKKPKVVQDAGLALATMVICEEALEREMIISSSYVPGMEITLSSPLKSLYSLYSKMKRKDVSIDKVYDARALRVVVGDKNGTLHGPAVRCXYSLLDIVHRLWTPIDGECDDYIINPKPSGYQSLHTAVQGPDNSPLEVQIRTQRMHECAEQGLAAHWLYKETGNPFLSIDSMDEPETEASSYFSKDLEEGNSSDILLSKYKSLKAGHPVLRVEGSHLLAAIIISVENDERELLVAVSFGLAASEAVADRRSFQIKRWEAYARLYKKVSDEXWFEPGHGDWFTCLEKYTLCRDXXQFGRLLPTFIQVINFTEQEKSEYWAVVSAVFEGRQVDWITSRSKFDLVASTSVXAGIDNKVNLLRTMLSWEEQLRSEVNFKQTKHDVKLYDLHGSLGEVXIICWPHGEILXLKAGST

SEQ ID NO: 58757 - protein, 352 aa, uncultured bacterium
ITSAHMLLSAMLDNSIQRGNPLNIDPRRVIWKRVVDMNDRALRNIVIGLGGKAHGVPREDGFDITVASEVMAILCLASNLHDLKERLKRIVVAYNYEGKPVTAEDLHAAGAMAALLKDAVKPNLVQTLEHVPAIIHGGPFANIAHGCNSVMATRTALRLADFTITEAGFGADLGAEKFFDIKCRQAGLAPDACVLVATVRALKMHGGVAKANLKEPNVDAVKKGLPNLGKHIENIFKFGVPVVVAINIFAQDTKEELQAVYDYCAGMGVNVALSDVFAKGGEGGIELAKEVVALAESGMSRFKPIYPLEMPLRDKVAAVVKEVYGGDRVEFQTKAAQALDQYEKEGYGNLPV

SEQ ID NO: 58758 - protein, 250 aa, Oryza sativa
  misc_feature (32)..(32): Xaa can be any naturally occurring amino acid
  misc_feature (40)..(40): Xaa can be any naturally occurring amino acid
  misc_feature (48)..(48): Xaa can be any naturally occurring amino acid
  misc_feature (56)..(56): Xaa can be any naturally occurring amino acid
  misc_feature (91)..(91): Xaa can be any naturally occurring amino acid
  misc_feature (112)..(112): Xaa can be any naturally occurring amino acid
  misc_feature (172)..(172): Xaa can be any naturally occurring amino acid
  misc_feature (181)..(181): Xaa can be any naturally occurring amino acid
  misc_feature (194)..(194): Xaa can be any naturally occurring amino acid
KVSLQVRSEFLGQPHISHSVRLTQVCPPIMGXNNKYLGDXKLPVIVWXVIAHASHXDLVSVMFCWVHFLFRILCAKPTWRTPQTTDYVLQXLLYIIVSVPRVRCILLLGAVXGGKRLIPPVTFDLFLRAAFPVSMARVNATERFEAAYPLINDLVLDWFSMVQKTVKQSVGXVLAFLCYKXMQETYADLTGESXAGVFIWCLELQMQSPYKVGEDISLENVEASVVILNLIFPIGAAGPKPRGNLRGLEN

SEQ ID NO: 58759 - protein, 219 aa, Triticum aestivum
MDAADAASPCDGHRTVWSEPPKRPAGRTKFKETRHPLYRGVRRRGPAGRWVCEVRVLGMRGSRLWLGTFTTAEMAARAHDAAVLALSGRAACLNFADSAWRMLPVLAGPFSTAKEIKDAVAVAVLAFQRQHRVASMAPLSPARTTDDEKEIDGSPAPSALFMSSELLNEHWFGGMDAGSFYSEGLFMESPDTRPWREDLELCGVETPAMELLVRLKQLS

SEQ ID NO: 58760 - protein, 430 aa, Methylobacillus flagellatus KT
MKPSKVTLTFDDGSAPIELPILPGKLGPSVIDIRSLSKHGYFTYDPGFLSTASCDSNITFIDGEEGLLFYRGYPIEQLAEHSDFMEVSYLLIYGELPNAEQKEKFTNTITRHSMVHDQLTHIFRGFRRDAHPMAVMVGVVGSMSAFYHEAIDVSDPRNREFAAHRLLAKVPTIAAWSYKYNVGQPFMYPKNRFNYAENFMHMMFATPCEDYEPNPVLAKAFERILILHADHEQNASTSTVRLAGSSGANPFACVAAGIASLWGPAHGGANEATLKMLEEIGDISRIGEYIKRAKDKTDSFRLMGFGHRVYRNMDPRAAIMRQTCHQVLDELGLNDDPMFKLALELEKIALEDEYFVSRRLYPNVDFYSGIVMRAMGIPNSMFTAIFALARTVGWVAQWNEMMSDPGSKIGRPRQLYTGPERRDFLPLDQR

SEQ ID NO: 58761 - protein, 412 aa, Aspergillus oryzae
MPLLILTGYPCSGLTHRANQLATGLQETQEAVFPDAEKPPYKIHVVSTHDENRPRTVYDHARTEKEARGAAYARARRMLGKDSFVILDGMNYIKGYRYQLWCEAKALGTTCCVVHVGTPIDQCVANNEARLNRQSQSQSEPEPESQSQSETTTPATDTNTTTEKPTDPEQPYPPELLQNLIFRYEEPSTHSRWDKPLFTVPWSDEKPPIADIWTALTGIPPPSTAAAETEDQLPTLTSALTNTHLSSAASIAPSTTTKGGGSFRRERPKIKPHLATVQPTSTDSGLLYSMEKRTSAVVSAIRSFVVENPSAEGALAKAGDHADGIRIAVPEVETPVFVPAHVAMTATTDELGGAGGILAVPRLQRLRRQWITLNRAYVAKVAGGDKTSLGADQVGDAFVRFLNADFAGEGVA

SEQ ID NO: 58762 - protein, 346 aa, Silicibacter pomeroyi DSS-3
MTDRMYRIALASRPTGAPEAANFSLEEAPVPTPGPGEVLVRVHYMSLDPYMRGRMDDAKSYAAPVPIGGTMEAGGVGEVIASNDPGFAPGDFAFGMFGWATHGVQPGKMLRKIDPKVMPITTALGVLGMPGFTGWFGLMEHGRPKAGETLVVAAATGPVGSMVGQVARLAGLRTVGVAGGADKCRIATETFGFDACLDHRAYDSAADLRRALAAECPDGIDIYFENVGGKVLEAVLPLMNNFGRIPVCGMISWYNAGGLGAGASDPGLTGPAIWRSILVKFLSVNGFIISNHFDRYPAFLAEIAPKLASGEIRYLEDVAEGLENAPAAFMAMLRGGNTGKQIVKLI

SEQ ID NO: 58763 - protein, 206 aa, Oryza sativa
MAALLARQAAQALRARQMAQLGPSATAMQGHIRTYMGAGKPTRFKEDEEKEKLAKEIAKDWNAVFERSINTLFLTEMINYPFEKGPLSPRFRGEHALRRYPTGEERCIACKLCEAICPAQAITIEAEEREDGSRRTTRYDIDMTKCIYCGFCQEACPVDAIVEGPNFEFATETHEELLYDKEKLLENGDRWETEIAANLESESLYR

SEQ ID NO: 58764 - protein, 1151 aa, Coccidioides immitis RS
MAYRSSTESDGRHRSGSKSSSESSQLTPLQDGFTPLSSSAPPGWGFNTSTVASISSIVPSGPLPSSSAVTSPLHTSIDTSTRNVRNDAIDAPFLASPLPLELPESVMGIGTQSTFTDGPLGNVAFNKAPGIMRRLSRGAASKLGRRGSLNSHDKRDHSSGPVIMRRRSDSKTSVSKDSALDSSVEEDDKPDPLKARCGPDRVSFGDEYRLSLDSTAGVAPRVDPLLQCGSLLTKVTKQRKKYKTFFLDVDTAKVYWDLSNPSKRFYIDDIKEIRLGPDARNYREEHQVPIEFESRWFTIIFANPEGSKNRPVKALHLIAPTRFIVELWTTTLEQISRYRIGLMVGLAGSGQSETILKAHWQREIARRFPGSPRTFEDECLDVGAVENLCHSLHVNCSKRVLRGQFARVDADGRGKINFSQFQSFVQHLKDRKDIRKIFDSVVAESRGGLSIEEFFEFLRSAQGEDVDKNRDYWASVFERFVRRSRRSQSLPEALSSSAARMDLDAFSSFLISPANGIYPTHVPPPKFDLPLNDYFISSSHNTYLLGRQVAGASSTEAYIAALQKGCRCVEIDCWDGPDGRPIVSHGRTMTTSVLFADCISVIDRYAFLSSDYPLILSLEVHCNAEQQIAMTNIMKNEFGDKLLLEPLRADWPILPSPEALKGKILIKVKTSDESEEKISGSSKVMGRKRSSSSPFIQSTTQNSFPTNSSFSSPPTIGPIDGLPPVLTQPKRSLTGTSLSSASEESDTAFATMPFPGKRKMPKSRVIKVLADLGVYARGYKWRGFDTPESKQFNHVYSFAERSIETICRDSENKALLEAHNRLYLTRVYPSGYRLRSSNFDPNSFWRRGVQMAALNWQTFDVGMQMNQAMFAAGNDRTGYVLKPESLRVPPSSRHTMDGKPKIDRQLVRFRVDVISAQQLPRSRGMGPDDSINPYIEIEILCADDKKKGMAFGEGGVDASNRNGFSGIGLPHRRRTQIEQKNGFNPIFGDEFKFSLETKYPDLVFVRWIVWNSTDGRSFGGNNSIQLATFTAKLSSLAQGYRYLPLYDSNGDQYLFSTLFCKITKLESAPAAQRRDIEESKSERKGIFRQLGQSMFKRALSTEREKDVARQKSRLTGSIRKSDSLNREKNETSSSSSSSSSLPILSTVPSGQ

SEQ ID NO: 58765 - protein, 371 aa, Listeria monocytogenes str. 1/2a F6854
MDYEKALAFIKSNSTLEQEEGTEVIFKQAQETARGNLDPFLLKDLKQHLGGTNDAIKEAPQEIQMPDFSNLEIATAAALQMRATMGSPNIDLSNGVTTEYRVVEGDYGDIPVRIYRHEEATKPVPAFIFYHGGGFVGGTPAVVENFCKGIAEKLPAVVINVDYHLAPEFPAPAAPKDCYRVLEWVVEQSNELGIDASKIGVSGDSAGGTLAAAVSYMDYEAETNYVGFQALLYPALTLVDEDNEKYQWDISKFGASEDTLPLVAPGIIGMNSSGELLRTAYVRDENPAAPIYSPLSAVDKSIYPPTLIVSAEFDALRAFADVFAKELRASGVQTKAIVYQGMCHAFIDKYGIFPQAEDVADEIVQMMKEIF

SEQ ID NO: 58766 - protein, 518 aa, Medicago truncatula
MAGGGIPIGGGNKEYPGNLTPFVTITCIVAAMGGLIFGYDIGISGGVTSMDPFLKKFFPAVYRKKNKDKSTNQYCQYDSQTLTMFTSSLYLAALLSSLVASTITRRFGRKLSMLFGGLLFLVGALINGFANHVWMLIVGRILLGFGIGFANQPVPLYLSEMAPYKYRGALNIGFQLSITIGILVANVLNYFFAKIKGGWGWRLSLGGAMVPALIITIGSLVLPDTPNSMIERGDRDGAKAQLKRIRGIEDVDEEFNDLVAASEASMQVENPWRNLLQRKYRPQLTMAVLIPFFQQFTGINVIMFYAPVLFNSIGFKDDASLMSAVITGVVNVVATCVSIYGVDKWGRRALFLEGGAQMLICQVAVAAAIGAKFGTSGNPGNLPEWYAIVVVLFICIYVAGFAWSWGPLGWLVPSEIFPLEIRSAAQSVNVSVNMLFTFLVAQVFLIMLCHMKFGLFLFFAFFVLVMSIYVFFLLPETKGIPIEEMDRVWKSHPFWSRFVEHGDHGNGVEMGKGAPKNV

SEQ ID NO: 58767 - protein, 715 aa, Escherichia coli K12
  misc_feature (140)..(140): Xaa can be any naturally occurring amino acid
MKKVVTVCPYCASGCKINLVVDNGKIVRAEAAQGKTNQGTLCLKGYYGWDFINDTQILTPRLKTPMIRRQRGGKLEPVSWDEALNYVAERLSAIKEKYGPDAIQTTGSSRGTGNETNYVMQKFARAVIGTNNVDCCARVXHGPSVAGLHQSVGNGAMSNAINEIDNTDLVFVFGYNPADSHPIVANHVINAKRNGAKIIVCDPRKIETARIADMHIALKNGSNIALLNAMGHVIIEENLYDKAFVASRTEGFEEYRKIVEGYTPESVEDITGVSASEIRQAARMYAQAKSAAILWGMGVTQFYQGVETVRSLTSLAMLTGNLGKPHAGVNPVRGQNNVQGACDMGALPDTYPGYQYVKDPANREKFAKAWGVESLPAHTGYRISELPHRAAHGEVRAAYIMGEDPLQTDAELSAVRKAFEDLELVIVQDIFMTKTASAADVILPSTSWGEHEGVFTAADRGFQRFFKAVEPKWDLKTDWQIISEIATRMGYPMHYNNTQEIWDELRHLCPDFYGATYEKMGELGFIQWPCRDTSDADQGTSYLFKEKFDTPNGLAQFFTCDWVAPIDKLTDEYPMVLSTVREVGHYSCRSMTGNCAALAALADEPGYAQINTEDAKRLGIEDEALVWVHSRKGKIITRAQVSDRPNKGAIYMTYQWWIGACNELVTENLSPITKTPEYKYCAVRVEPIADQRAAEQYVIDEYNKLKTRLREAALA

SEQ ID NO: 58768 - protein, 391 aa, Acorus gramineus
PYEVPMTAAGALQSYKLAAKAIARLQSLPGGSMERLCDTMVREVFELTGYDRVMAYKFHEDDHGEVVAEITKQGLEPYLGLHYPATDIPQAARFLFMKNKVRMICDCRAKPVKVFQDEKLTIDLAFCGSTLRAPHSCHLQYMENMDSIASLVMAVVINDGDDDDDHVGDNNNDNSKKKRLWGLVVCHNTSPRFVPFPLRYACEFLTQVFAIHVHKELELENQMPEKNILRTQTLLCDMILRDAPLGIVSQTPNIMDLVKCDGAALLYKDKIWQLGTTPTERQIRDIAIWLTDYHMDSTGLSTDSLHDAGYPDALALGDVVCGMAAARITSKDILFWFRSPTTSEIQWGGAKHERSDQDDGRRMHPRSSFKAFLEVVKTRSLPWKDYEMDAI

SEQ ID NO: 58769 - protein, 407 aa, Acorus gramineus
ILHRIDVGLVIDLEPVNPSDVPVTAAGALKSYKLAAKAISRLQSLPSGNISLLCDVLVREVSDLTGYDRVMVYKFHEDEHGEVIAEQRKTDLEPYLGLHYPATDIPQASRFLFMKNKVRIICDCFTPPVKVVQDKKLGQPLSLCGSTLRAPHGCHAQYMANMGSIASLVMAVTINDDDDDDGNGNEQQQKGRKLWGLVVCHHTSPRFIPFPLRYACEFLIQVFSIQLNKEVELAAQMREKHILRTQTVLCDMLLRDAPVGIFTQSPNVMDLVMCDGAALYYKNQFWLLGTTPSEVQIKDLVDWLHECHNGSTGLSTDSLMEASYPGASALGNAACGMAAIKIGGTRDYMFWFRSQTAKEIKWGGAKHDPVDNDEEGQKMHPRSSFKAFLEVVKWRSLPWENAEMDAI

SEQ ID NO: 58770 - protein, 385 aa, Amborella trichopoda
PYEVPMTAAGALQSYKLAAKAISRLQSLPSGNIDRLCHTVVQEVHELTGYDRTMAYKFHEDDHGEVISEITKGGLEPYLGLHYPATDIPQAARFLFMKNGVRMICDCRARHVRVFQDEKLASDLTLCGSTLRAPHSCHLQYMENMDSIASLVMAVVVNEDEEENIADGPKRKRLWGLVVCHNTSPRFVPFPLRYACEFLMQVFAIHVNKEVELEALVREKNILRTQTMLCDMLLRDALLGIVTKNPNVMDLVKCDGATLLYENKLWRLGVTPSEVHIRDLARWLSEYHTDSTGLSTDSLVEAGYPDGVSLGDLVCGMAAVKITETDMLFWSRSHTASEIRWGGAKHDPNDKDDKRRMHPRSSFKAFLEVVKTRSFPWKDYEMDAI

SEQ ID NO: 58771 - protein, 394 aa, Amborella trichopoda
DLEPVNPADVPVTAAGALKSYKLAAKAISKLQSLPSGNIELLCDVLVREVRELTGYDRVMAYKFHEDEHGEVVAEYRRADLDPYLGLHYPATDIPQASRFLFLKNKVRMICDCTASPVKVIQDKKLDKPLSLCGSTLRAPHGCHAQYMANMGSIASLVMSVTINENDEDSSPNEPSFHKGRKLWGLVVCHHTTPRFVPFPLRYACEFLLQVFGIQLNKEVELAAQLREKHILRTQTVLCDMLLRDAPVGIVTQSPNIMDLVKCDGAALYYQKQVWLLGTTPLEAQIRDISGWLLEYHCGSTGLSTDSLMEAGYPGALALGDAVCGMAAVKITSKDFLFWFRSHTAKVIKWGGAKHDPVDRDDGRKMHPRSSFKAFLEVVKQRSLPWEDVEMDAI

SEQ ID NO: 58772 - protein, 521 aa, Methanosarcina mazei Go1
MRISLHMTQARRPLMLMILDGWGYREEKEGNAILAASTPHLDRLQKERPSCFLETSGEAVGLPQGQMGNSEVGHLNIGAGRVVYQDLTKINVSIRNGDFFENPVLLDAISNVKLNNSSLHLMGLVSYGGVHSHMTHLYALIKLAQEKGLKKVYIHVFLDGRDVPPKAALGDVKELDAFCKENQSVKIATVQGRYYAMDRDKRWERTKLAYDALTLGVAPYKTSDAVTAVSEAYERGETDEFIKPTIVTDSEGNPEAVIQDTDSIVFLNFRPDRARQLTWAFVKDDFEGFTREKRPKVHYVCMAQYDETLDLPIAFPPEELTDVLGKVLSDRGLIQLRIAETEKYAHVTFFLNGGQEKCYSGEDRCLIPSPKISTYDLKPEMSAYEVTDEVVKRILSGKYDVIILNFANMDMVGHTGDFEAAVKAVETVDNCVGRIVEALRTAGGAALITADHGNAEQMENSHTGEPHTAHTSNPVKCIYTGNGEVKALENGKLSDLAPTLLDLLEIPKPEKMTGRSLIVRK

SEQ ID NO: 58773 - protein, 357 aa, uncultured bacterium
VTSAHNTISALLDNYLYQHRKDGFSLREIFWKRVLDVNDRALRNVVTGLRGDGVVSETGFDITPASELMAILCLATSEKDLQRRIENIVLGITADGKLFKVKDLGVAGAITVLLIDALNPNLVQTTEHTPAFIHGGPFANIAHGCSSVVATKMAMTYSDYVVTEAGFGADLGAEKFFDIKCRKTGLQPRLVVIVATTQGLKMHGGVELERINEPNAAGLTEGLKNLNRHIRNMQGFGQPVVVTLNRHDTDLEEEIDIVRKNCEDLGVGFAVNEAFLKGGEGAVELAQTVIDTIDNQQPLPIRFTYKEADCLEDKIEKVCKGIYGASAVEYSKTAKKKLESLRATFTDEDKVIAHYPV

SEQ ID NO: 58774 - protein, 439 aa, uncultured proteobacterium
MAAPEYPGLDTLALHAGSQPDPATGARATPIYQSASFCFPDSDYAASLFNIERAGHVYSRLSNPTNAVLEERIAALEDGVGAIATASGQAALTLAIMTLMGAGSHIVAAAALYGGSHNLLAYTLPRLGIETTFVDARDPQAFAAAIQDNTRLVFAETVGNPGLDVLNIPEVAAVAHQAGLPLMVDSTFTTPYLIKPFEHGADIIMHSATKFLSGHGIVIGGLLVDGGRFDWDASGKFPTLTEPYAGFHNLVFSEEFGPAAFIQRARKEGLRDFGACMSPTTAFHILQGVETLGIRMHRHVENTRRIVEFLNQHEQVSRVGYPELEGHPDQALASALLPKGCSAVFSFDLVGGREAGIAFVDALNLFSHLANVGDAKSLVIHPASTTHHRMDAAALAAGGIGEGTIRLSIGLEDAKDLIADLKQGLRAAGKVAAKQSVTP

SEQ ID NO: 58775 - protein, 445 aa, Rubrobacter xylanophilus DSM 9941
MTQEPQGRSDGAASTVQKDGSLSVTDNRTGRSYEIEIKDGTVRSMDFRQIKVDEDDFGLMTYDPGYTNTASCRSAITYIDGERGILQHRGIPIEELCEHSTYLEVAYLLIHGHLPTEEELSQWVYDITHHTYVHENIKSFMDGFRHDAHPMGILLASVGALSTFYPEASDIDDEEQRNMAAIRLIAKMPTIAAFAYRHSLGLPYVYPDNDLSYTGNFLSMLFKMAEPKYEPDPRLEKALDVLFILHADHEQNASTSAVRTVGSTRADPYTAVAAGVAALYGPLHGGANVAVLKMLQRIGSVKNIPDFLETVKQGKERLMGFGHRVYKNYDPRARIIKSHVDEVLEATGKESPWLDIAVELEKRALDDEYFTSRKLYPNVDFYSGLIYEALGIPTEAFTVMFAIPRTSGWIAQWMEMLRDPELKIARPRQIYTGPRDQHYVPMSER

SEQ ID NO: 58776 - protein, 325 aa, Staphylococcus aureus subsp. aureus COL
MAQMTMVQAINDALKTELKNDQDVLIFGEDVGVNGGVFRVTEGLQKEFGEDRVFDTPLAESGIGGLAMGLAVEGFRPVMEVQFLGFVFEVFDAIAGQIARTRFRSGGTKTAPVTIRGPFGGGVHTPELHADNLEGILAQSPGLKVVIPSGPYDAKGLLISSIRSNDPVVYLEHMKLYRSFREEVPEEEYTIDIGKANVKKEGNDISIITYGAMVQESMKAAEELEKDGYSVEVIDLRTVQPIDVDTIVASVEKTGRAVVVQEAQRQAGVGAAVVAELSERAILSLEAPIGRVAAADTIYPFTQAENVWLPNKNDIIEKAKETLEF

SEQ ID NO: 58777 - protein, 352 aa, uncultured bacterium
IGAANNLLAAMLDNHIQQGNSLNIDPRRITWKRAVDMNDRQLRFIVDGLGGRINGTPREDGFDITVASEIMAVLCLASDITDLKDRLSRIIVGYTYDEQPVTAGQLKAAGAMTALLKDALKPNLVQTLEHTPAFIHGGPFANIAHGCNSVIATKMALRLGDYWVTEAGFGADLGAEKFLDIKCRMAGLKPDAVVIVATVRALKHHGGVPKTELSQENLPALEKGLPNLLQHVENITKVFGLPAVVAINRFPQDSEAELELIEKKCRELGVNVALSEVWAKGGEGGKALAEEVVRLCEQKNDFRFSYDLDMSIKDKLDAIAKKIYHADGVDLIQNAPKQLKQMESLGFDKMPI

SEQ ID NO: 58778 - protein, 309 aa, Photorhabdus luminescens subsp. laumondii TTO1
MSTAKLAVLGSINADHILNLKSFPRPGETVIGEQYQVAFGGKGANQAVAAGRSGADITFIACVGEDDIGFRICQQLAKDNINTSGIEVIKGETTGVALIFVNHQGENIIGINAGANAALTPEYFYRYQNIIEEADALLIQLESPLETVQLAATIAKQNNTKVILNPAPARKLSDQLLSLVDIITPNETEAEYLTGIKVENDSDAENAAQILHGKGIETVIITLGSRGVWLSESGQKGKIVPGFKVNVVDTVAAGDTFNGALVTALLERKSMLSAIRFAHSAAAIAVTRQGAQPSVPWRNEIDAFLIEQD

SEQ ID NO: 58779 - protein, 352 aa, uncultured bacterium
ITSANNLLCAMLDNHLLQGNELRIDPKRVVIKRCLGMNDRALRNITVGLGKRLDGVVREDHFCITVATEVMAILCLAENLEDLKARLGKIIVAYNYDNEPVTAEQLKAVGAMTVLLKDAIRPNLIQSLENNPVFVHGGPFANIAHGCNSVRATKLALKAADLVITEAGFGADLGAEKFLDIKCRMAGIKPDAVVLVATARAMKYNGGIPKDELNKENVEALKKGIVNLGKHIENLKKYNVPVVVTINKFVADTDAEVAAIKEFVEDKGCRFAISEVWEKGGEGGIELAKQVLDAVEEGSPNFKFLYEDSLSLKEKIETISKEIYGADGVEYSPEANNALKKLEALGFSNVPV

SEQ ID NO: 58780 - protein, 385 aa, Cryptococcus neoformans var. neoformans JEC21
MSSRMACRLAARAARQQRAFSATSITRNAPVTPWEPALPQGVSPAYDAAISYLADYQSRTLSKLNAFKSNLPETPSHEELQQLAKLEIEAYANDPAVRRMFKETGGEGQMDKRIMRWLGEENWKKEGGLDLLMQRALQMNVVPDLLPEIPPTAPLTITLSSPVTPGAFQRPSSFAQPPKITHQIFHHPSLPTLTNPNPAALHTLLVIDPDAPHHETHSFQERVLYMKTDIPISVVDGTVNLTDKSFGKELLAWEPPAPEQGTPYHRYVVLVFRQPSPSSVTTISREGFKLRDFLSSQGLTSHSLSGLSLFRAEWSEEEDEFINSVFREKRGVPEGAPVYGKVPKEVRYGYPMKAKLRRREEIRDQIWEGAMRELEGLGDVERVGV

SEQ ID NO: 58781 - protein, 590 aa, uncultured proteobacterium
MSNTTASTRVIYAATLTLAACSLLYELLIAQALATFAANTVTWYSVTVGLYLAGMGLGALLHDKHPTANLWARFFRVEVALSAAGAIAVPLLHLSHTGGLLLDINGYSLLGQLLFFGTGLLLITTIGVLTGVELPLLIDVANTASDKKRLTNRVLAADYMGSLLGGLAFPLLLVPHLSLVTIGLTTASMNITLAILALRTFIPSRSQFAFRFIPSGSLAVTIALGLYCAEPLDRYFTKLYYFYREQSHDLGQLFASMDNAEDVFRARSSYQRIDLVHAKKGFQADYLHGFYSNKFSEKPLLPKNYALFLNGDFQLSSNYEEYYHEFFAHFPIITNGSVPSRVLVMGGGDGLLLRELVKYADIQSIVHVDLDRELVELATTNPVLAAMNEGALNDPRIIRHFDDAYHYIRSTTDTYDAIYLDFPSPKDYNLAKLYSRELYHFARQKLRRDGFITLDAPGIETSKEMREIYTSTLAAAGFKFVTPYISKIENVNEDALEFLLASGYDSTKAKKIMARQAASMRLGFVIARDTWPDRPIYRDPEVVLYAINDARLFLTLNKNQYLPPVNPDKVNSIFRPTLQNMSVWNLRSAW

SEQ ID NO: 58782 - protein, 352 aa, uncultured bacterium
ITSANNLLCAMLDNHLMQGNELRIDPKRIVIKRCLDMNDRALRNITVGMGKRLDGVVREDHFCITVATEVMAILCLAEDLEDLKKRLSRIIVAYNYDNEPITAADLNAVGAMTVLLKDAIRPNLIQSLENNPVFVHGGPFANIAHGCNSVRATKVALKVADYVITEAGFGADLGAEKFLDIKCRMANLKPDAVVLVATARALKYNGGVAKADLSNENVEALNKGIVNLGKHIENLKKYNVPIVVTINRFTADTEAEMQAIKDFVEKAGCRFALSEVWAKGGEGGLALAEQVLDAVEEGSPNFKFLYEDSLTITEKIEAVSKEIYGADGVTYSPEAANAIKRLESLGFGNMPV

SEQ ID NO: 58783 - protein, 446 aa, uncultured proteobacterium
MGTTPERDIMSFSTLGLSESLLKAVADEGYTAPSPIQAQAIPAVLEGRDVMAAAQTGTGKTAGFTLPLLHGLSKGQPAKANQVRALVLTPTRELAAQVAESVDIYGKYLNLRSAVVFGGVKINPQMMRLRKGVDILIATPGRLLDLYQQNAMSFQKLEVLILDEADRMLDMGFIHDIRRIMKALPKKRQNLMFSATFSEDIRDLAKTIVNNPVEISVTPRNSTAVSVTQWIHPVDKNQKRHLLVELINQHNWEQVLVFSRTKRGANRLAEFLEKKDIQAAAIHGNKSQGARTRALSEFKSGKLRVLVATDIAARGLDIEQLPQVVNLDLPEVAQDYVHRIGRTGRAGATGQAISLVSADEAQLLQDIERLIQTLLPRKLVAGYEPENTLPEFALRPPLKPKKPKKPTPQRHAGSNVDGNKTGERDSRRTPTSTDPWKRRRSNNKAR

SEQ ID NO: 58784 - protein, 352 aa, uncultured bacterium
ITSANNLLCAMLDNHLMQGNELRIDPKRIVIKRCLDMNDRALRNITVGMGKRLDGVVREDHFCITVATEVMAILCLAEDLEDLKKRLSKIIVAYNYDNEPITAADLNAVGAMTVLLKDAIRPNLIQPLENNPVFVHGGPFANIAHGCNSVRATKVALKVADYVITEAGFGADLGAEKFLDIKCRMAGLKPDAVVLVATARALKYNGGVAKADLSNENVEALNKGIVNLGKHIENLKKYNVPIVVTINRFTADTEAEMQAIKDFVEKAGCRFALSEVWAKGGEGGLGLAEQVLDAIEEGSPNFKFLYEDNLSITEKIETVSKEIYGADGVTYSPEATNAIKRLEGLGFGNMPV

SEQ ID NO: 58785 - protein, 553 aa, Haloarcula marismortui
MEPIWELVEPWGLGLDDLQYFGEYTAKVKQHAIERLREQAENREQNLVLVTGMTPTPKGEGKTVTTVGLGQTLNHVGEEAMIAIREPSLGPVFGVKGGAAGGGRSQVLPMEDINLHFTGDLHALTSAHNLIAAMLDAKISQGDDLNIDINNVSWPRAIDMNDRALRETVVGLGGKTGGTPREDSFILTAASELMAVLCLASDIGDLKERVSRIIVAYDEDGDPVTVEDIEATGPATMLLRDAIKPNVVQTIEGTPALVHGGPFANIAHGTNSLVADKTAFGMGDYLVTEAGFGSDLGAEKFMDVVCRKGDMTPNAVVLVASVRALKYHGLNQWPVDYDEIGEAGVEAVEAGFSNLDKHARNLQKFGVPVVVSVNRFPDDTDEEVQAVLDHCREDLGVRAAESNVFSDGSEGGVDLAENVIEATEESNEEDFRMLYDDDDSIKEKIHTVATEIYGADDVKYTGGALDDIEQMNDLDFDDYPVVMSKTFHSLSDDASQKGAPEGWELEISEVYPSAGAGFLVALTADALTMPGLPARPAAADMDIDGDGNISGLF

SEQ ID NO: 58786 - protein, 899 aa, Vibrio angustum S14
MISQGIKSACPYCGVGCGVVTKQSEIIGDVSHPTNRGALCVKGSSLAASMSQPNRLLYPQIKGEVVEWDQATSQIAETISRVIAESGPEAIGMYLSGQLLTEDYYVANKLMKGFIGSSHVDTNSRLCMASAVAAHNRAFGEDIVATNYSDLDNTDLIVLVGSNLAWTHPIVFKRIQQAKKQNPLLKIVVIDPRKTVTAEQADLHLALANDTDIDIYNGLIRYLIENNAVDRDFIAQVTEGFDALQQEVMKDKYSLLEVSKSSGIAIEQLATFYQWIKEAPRAVTVFCQGVNQASCGTDKANSIINSHLVSGKIAKQGCGPFSITGQPNAMGGREVGGLANQLAVHRGFDDISISQVKAFWQAPNIATTAGHKAVDLFKSVENGDIRVLWIMATNPVISMPDNEQVRRALEKCEYVIVSDVTPESDTAAYADCLLPAAAWGEKSGMVTNSERMMSRQRAFTAMPGEVKADWQMICDVAKKLGFSKAFDYQSEADIFREHAALSGINNSTDLLFDISCLALLSDDDYQTWQPQQWPLNSTSNRVFEQHNNLPLFSTPTRKAQLVVTPSPTENSLSNVMLAQDVSQSIFWLNTGRQRDQWHTMTRTGHVPVLAQSEVEPSLYIHPTSAKHVGLVDGSFVCIESLESYQDLNKHLARVVFDSTLSQQQVFMSMHWAGKYGAKSAINQSVIVACDPISGQPSFKSAQVKLTPISMEFHGVSLGDIPAQLDYEYASFQTYQNEHYQHKGIWRYAGKACLDKTALLRSLSESKQQYLLVEQKWGFALVQLAKVINPDAKLNTTAIHLFSEQPINVDMTTLVNSVNQPFVMTDVLEALGCQHSKQTLVCSCFQITDLMIEQAIVTNNITSLSDLTKQLKCGTNCGTCLPQVERHFYESQQLIPTVQL

SEQ ID NO: 58787 - protein, 411 aa, Anaplasma platys
MKENAVLMCGDKKVSLPMLSGTDGIQLIDITTLYRDHKVLTYDPGFMSTAACSSEITFIDGEKGILRHRGLDIADLIGIKGGFCSVAHLLLYGVLPSDTVFEQFLAAIGAQHALSSDVLGVISSFRRDAHPMAILMACFSTLAAKYHGDNRGNEELAVLAIAQVPSLVAAIYLHRMGLELVSPDPSLSYTGNFVKMMFGALEKTRADAIEEALDAIFIMHADHEQNASTATVRMAGSAGTELFACLAAGTATLWGPAHGGANEAVIRMLESIGSPDKVEEFIGFVKDNNSKVRLMGFGHRVYKSYDPRAKILGQISRSVLDNLGCSDELLGVAEELERCALQDEYFVERKLYPNVDFYSGIVLRAMGVPVEMYTTFFALARTAGWVSQWCELLRGSESLKICRPRQLYAGK

SEQ ID NO: 58788 - protein, 159 aa, Glycine max
MGFLKAIFIIAITMALSITLTMKTITHQEEAKPPFVHHDLPSSSSTPHDQKNNNVHLPSKRESRFLAQVKNPNAADHCRKDHEICTLSGVKNSTCCNNKCIDVGYDKHNCGACKMKCKFTEVCCRGECVDTNFDKRHCGECNHRCEVGAYCVYGMCGYA

SEQ ID NO: 58789 - protein, 139 aa, Zea mays
  misc_feature (33)..(33): Xaa can be any naturally occurring amino acid
  misc_feature (44)..(44): Xaa can be any naturally occurring amino acid
  misc_feature (70)..(70): Xaa can be any naturally occurring amino acid
  misc_feature (84)..(84): Xaa can be any naturally occurring amino acid
  misc_feature (93)..(93): Xaa can be any naturally occurring amino acid
IIWCKAGLESLGPDGVRFEAAADAYSNRSLKYXETALRDYEAQXLEDDPFVHRPFYSLSDTLLDQNLCTXLSPTSRVAIAHLAXHIELPFDHXENKPADMILDKKFPGTLDQSAGCLIIFGDPHTEDILPATLETISHV

SEQ ID NO: 58790 - protein, 383 aa, Arabidopsis thaliana
METVVVIVGAGPAGLATSVCLNQHSIPNVILEKEDIYASLWKKRAYDRLKLHLAKEFCQLPFMPHGREVPTFMSKELFVNYLDAYVARFDINPRYNRTVKSSTFDESNNKWRVVAENTVTGETEVYWSEFLVVATGENGDGNIPMVEGIDTFGGEIMHSSEYKSGRDFKDKNVLVVGGGNSGMEISFDLCNFGANTTILIRTPRHVVTKEVIHLGMTLLKYAPVAMVDTLVTTMAKILYGDLSKYGLFRPKQGPFATKLFTGKAPVIDVGTVEKIRDGEIQVINGGIGSINGKTLTFENGHKQDFDAIVFATGYKSSVCNWLEDYEYVMKKDGFPKAPMPKHWKGEKNLYCAGFSRKGIAGGAEDAMSVADDIRSILATLKNN

SEQ ID NO: 58791 - protein, 392 aa, Annona sp. SM-1999
PYEVPMTAAGALQSYKLAAKAIARLQALPSGNLQKLIDTVVEEVFELTGYDRAMAYKFHDDDHGEVISEITKPGLEPYLGLHYPATDIPQAARFLFMKNKVRMICDCNAKPVKVYQDEKLKLELTLCGSTLRAPHSCHLKYMENMGSIASLVMAVVINESDNEDDNSMVEQQQQQQPKRKRLWGLVVCHNTTPKFVPFPLRYACEVLMQVFAIHVNKELELENQIREKHLRTQTLLCDMLMRDAPLGIVTQSPNIMDLVKCDGAALLYNNKFWRLGLTPSEAHMRHIVSWLNEYHMDSTGLSTDSLHDAGYPGALALGDAVCGMAAVRITSKDILFWFRTHTAAEIRWGGAKHDPSDKDDGRRMHPRSSFKAFLEVVKSSSFPWKDYEMDAI

SEQ ID NO: 58792 - protein, 295 aa, Rickettsiella grylli
MFHGSIVALVTPMQESGSIDYASLRKLVDWHIAQGTDGIVVMGTTGEASTLTSEEHVNVIKTVVEQANQNTHRHVPIIAGTGTQSTQNTIEKTQLAMKAGVNACLLVTPYYNCPTQDGLYKHFSVIANKVPIPIILYNVPKRTGCDLLAETVVKLSSIPNIVGIKEGQVERVKNILKLCGKNFDVYSGDDNTALDIMQRGGKGVISVAANLVPQSMHHFCELAKKADWEAASKIDKQLRPLYQGLFIETNPIPVKWLAAQRGIISSSTLRLPLTPLSVAHQADLKPVINLVKTLS

SEQ ID NO: 58793 - protein, 390 aa, Aquilegia sp. SM-1999
PYEVPMTAAGALQSYKLAAKAIARLQSLPSGSIDRLCDTVVEEVFQLTGYDRVMAYKFHDDDHGEVVSETTKEGLPPYLGLHYPATDIPQAARFLFMKNKIRMICDCRAKHVRVLQDEKLPFELTLCGSTLRAPHSCHLQYMENMDSIASLVMAVVINDGDEEEGTVEGASQSRKRKRLWGLVVCHNTTPRFVPFPLRYACEFLIQVFAIHVNKEFELENQILEKNILRTQTLLCDMLMRNAPIGIVSQSPNIMDLVKCDGAALLYQNKIWRLGLSPSESHIRDIASWLSEYHMDSTGLSTDSLYDAGFPGALSIGDTVCGMAAVRINSKDMLFWFRSHTAGEIRWGGAKHDPGEKDDGRKMHPRSSFKAFLEVVKTRSFPWKDYEMDAI

SEQ ID NO: 58794 - protein, 381 aa, Coccidioides immitis RS
MLSGRFVTSSLRQCSRRAVSTSNSSQIRYYAVPAAEKIAKFPGTKGPDGKYTVTLIEGDGIGPEISQSVKDIFSAAKVPIKWEPVDVTPILKDGKTAIPDEAINSVKKNYVALKGPLATPVGKGHVSLNLTLRRTFNLFANVRPCRSIAGYKTPYDNVNAVLIRENTEGEYSGIEHVVVDGVVQSIKLITREASERVLRFAFQYAQEVGKPKVRAVHKATIMKMSDGLFLRTAKEISKEFPDIEFDAELLDNTCLRMVTDPAPYNDKVLVMPNLYGDILSDMCAGLIGGLGLTPSGNIGNECSIFEAVHGSAPDIAGRALANPTALLLSSIMMLRHMGLNDHAKKIETAIFETLAEGKTLTGDLGGKAKTHEYAGAIIKRL

SEQ ID NO: 58795 - protein, 392 aa, Aquilegia sp. SM-1999
DLEPVNPADVPVTAAGAMKSYKLAAKAISKLQSLPSGNIPFLCEVLVQEISDLTGYDRVMVYKFHEDDHGEVIAEWKISDLEPYLGLHYPATDIPQASRFLFMKNKVRMIWDCTAAPVKVIQDTNLPQPLSLGGSTLRAPHGCHAQYMANMGSVASLVMSVTINDDDDDEVVNGQQKGRKLWGLVVCHHTCPRFVPFPLRYACEFLIQVFSMQINKEVELARQLREKHILQTKTVLCDMLLRDAPIGIFTQSPNVMDLVKCNGAALYYHQKFWLLGVTPTEAQIRDIVEWLVEYHNASTGLSTDSLVEAGYPGASILGNAVCGMAAAKITSKDFLFWFRSHTANEIKWGGAKHDPTEKDDGWKMHPRSSFKAFLDVVKHRSVPWEDIEMDAI

SEQ ID NO: 58796 - protein, 391 aa, Silicibacter pomeroyi DSS-3
MVRSCAPHKRKAGRRARLAFGALASHGARENTEVPMRYVLILLLALFGYLLFWPIPVAPVAYHPPETPGFTGDFAENRVLDRAEFVTLPDGEIGPEDLAVMPDGTVYTTSLAGNLYRIDGAVPQLVDRLGGRPLGLKAGPDGALYIADSFRGILRWTAPGEVETVVDQIDGAPVIYANQLDLGRDGTIYFSNSTDRFDPRTLGGTKPTSVMTVWEQSDTGYVARRTPDGRVEKIATGFVYTNGVALSPDEDFLLINETGRARVHRLWLTGDKAGQSEVFLDNLPGYPDNIEAQGDGTYWLAFASPRVPAEALMPYPFLRKVVWRLGPKVRPAPIHRGMLIQFDGTGRILRTVQDPDGRLGITTGGKQVGARFYVMTLDSPGFARMDSADLR

SEQ ID NO: 58797 - protein, 345 aa, Austrobaileya scandens
TGYDRVMAYRFHEDDHGEVVSEIRKSELEPYLGLHYPATDIPQAARFLFMKNKVRMICDCHAKSVTVHQDEKLQFDLTLCGSTLRAPHSCHLQYMANMGSIASLVMAVVVNEGEQDEEETAEPNQQPQLKRKRLWGLVVCHNTTPRFVPFPLRYACEFLIQVFAIHVNKEMELQNQLQEKNILRMQTLLCDMLLRDAPLGIVTQSPNIMDLVKCDGAAVLYGNKVWLLGVTPTESQIQDIASWLSESHMDSTGLSTDSLFEAGYPGALALGAKVCGMAAVKITLKDMLFWFRSHTAAEVRWGGAKHDPVDRDDGRRMHPRSSFKAFLEVVKSRSLPWKEYEMDGI

SEQ ID NO: 58798 - protein, 360 aa, Austrobaileya scandens
PFYAILHRIDAGLIIDLEPVNPADVPITAAGALKSYKLAAKAISRLQSLPSGNIGLLCDVLVQEVSELTGYDRVMAYKFHEDEHGEVIAEYRRSNLEPYIGLHYPATDIPQASRFLFMKNKVRMICDCFAPPIKVIQDKKLAQPLSLCGSTLRAPHGCHAQYMANMGSVASLVMSITVNDDDDETIGEQQNQQKGRKLWGLVVCHHTSSRFVPFPLRYACEFLIQVFGIQLNKEVELAAWMREKHILQMQTLLCDMLLRDAPVGIMTQSPNVMDLIKCDGAALYYGKQLWLLGTTPTEAQIRDIAGWLLEYHGGTTGLSTDSLMEAGYPAAAALGDGVCGMAAAKLTSKDFLFWFRSHTA

SEQ ID NO: 58799 - protein, 396 aa, Brasenia schreberi
PYEVPMTAAGALQSYKLAAKAIARLQSLPSGSVGRLIDTVVEEVHQLTGYDRVMTYKFHEDDHGEVVSEIRKPDLEPYLGLHYPATDIPQAARFLFMKNKVRMICDCRAKPVKVYQDENLKTDLTLCGSTLRAPHSCHLQYMDNMGSIASLVMAVVINEGEDEGDDEPEQNQGQQQQQQQKKKRLWGLVVCHNTTPRFVPFPLRYACEFLMQVFAIHVNKEVELENQMREKNILRTQTLLCDMLLRDAPLGIVTQSPNVMNLVKCDGAALLYGNKLWLLGQTPSESQMRDLAVWLSEYHRDSTGLSTDSLYEAGYPGALAIGDVVCGMAAVRITNSDMLFWFRSPTASEIRWGGAKHDPEEKDDGRRMHPRSSFKAFLEVVKTRSLPWKGFEMDAI

SEQ ID NO: 58800 - protein, 1058 aa, Fusobacterium nucleatum subsp. nucleatum
MPKRKDIKTILVIGSGPIIIGQAAEFDYAGTQACLSLREEGYEVILVNSNPATIMTDKEIADKVYIEPLTVEFLSKIIRKEKPDALLPTLGGQVALNLAVSLHESGILDECGVEILGTKLTSIKQAEDRELFRDLMNELNEPVPDSAIVHTLEEAENFVKEIDYPVIVRPAFTMGGTGGGICYNEEDLHEIVPNGLNYSPVHQCLLEKSIAGYKEIEYEVMRDSNDTAIVVCNMENIDPVGIHTGDSIVVAPSQTLTDREHHMLRDVSLKIIRALKIEGGCNVQIALDPNSFKYYIIEVNPRVSRSSALASKATGYPIAKIAAKIAVGMTLDEIINPVTKSSYACFEPAIDYVVTKIPRFPFDKFGDGDRYLGTQMKATGEVMAIGRTLEESLLKAIRSLEYGVHHLGLPNGEEFSLEKIIKRIKLAGDERLFFIGEALRRDVSIEEIHEYTKIDLFFLNKMKNIIDLEHLLKDNKGNIELLRKVKTFGFSDRVIAHRWEMTEPEITELRHKHNIRPVYKMVDTCAAEFDSNTPYFYSTYEFENESTRSDKEKIVVLGSGPIRIGQGIEFDYATVHAIMAIKKLGYEAIVINNNPETVSTDFSISDKLYFEPLTQEDVMEILDLEKPLGVVVQFGGQTAINLADKLVKNGIQILGSSLDSIDTAEDRDRFEKLLIGLKIPQPLGKTAFDVETALKNANEIGYPVLVRPSYVLGGRAMEIVYNDEDLTKYMEKAVHINPDHPVLIDRYLIGKEIEVDAISDGENTFIPGIMEHIERAGVHSGDSISIYPPQSLSEKEIETLIDYTKKLASGLEVKGLINIQYVVSKGEIYVLEVNPRASRTVPFLSKVTGVPVANIAMQCILGKKLKDLGFTKDIADIGNFVSVKVPVFSFQKLKNVDTTLGPEMKSTGEVIGTDVNLQKALYKGLTAAGIKIKDYGRVLFTIDDKNKEAALNLAKGFSDVGFSILTTEGTGIYFEEYGLKVKKVGKIDNSDYSVLDAIQNGDVDIVINTTTKGKSSEKDGFRIRRKATEYGVICFTSLDTANALLRVIESMSFRVQTL

SEQ ID NO: 58801 - protein, 98 aa, Arabidopsis thaliana
EQFSSPSSSSSSSRDALSSPDMDPSMANNPELLQFLAQEKERAMVNEMVSKMTSVCWDKCITSAPGSKFSSSESSCLTHCAQRYMDMSMIIMKRFNSQ

SEQ ID NO: 58802 - protein, 486 aa, Trichodesmium erythraeum IMS101
MRTEWIAKRSGHKNVSQMHYGRQGIITEEMNFVAQRENLPAELIRAEVARGRMIIPANINHTNLEPMCIGIASRCKVNANIGASPNTSDITKEVDKLKLSIKYGADTVMDLSTGGGNLDEIRTAIINASPVPIGTVPVYQAVESVHGRIENLTADDFLHVIEKHAQQGVDYQTIHAGILIEHLPLVRSRITGIVSRGGGIIAKWMLHHHKQNPLYTHFDDIIEIFKKYDVSFSLGDSLRPGCTHDASDEAQLAELKTLGQLTRRAWGHEVQVMVEGPGHVPMDQIEFNVKKQMEECSSPPLNALDLDPLASNANEQMEKFNVLGPAPFYVLGPLVTDIAPGYDHITSAIGAAMAGWYGTAMLCYVTPKEHLGLPNAEDVRNGLIAYKIAAHAADIGRHRQGARDRDDELSAARYNFDWNRQFELSLDPERAKEYHDETLPADIYKTAEFCSMCGPKFCPMQTKVDADALTELEKFLAKEKEVVTQS

SEQ ID NO: 58803 - protein, 1076 aa, Halomonas eurihalina
  misc_feature (697)..(697): Xaa can be any naturally occurring amino acid
  misc_feature (711)..(711): Xaa can be any naturally occurring amino acid
  misc_feature (722)..(722): Xaa can be any naturally occurring amino acid
  misc_feature (1003)..(1003): Xaa can be any naturally occurring amino acid
  misc_feature (1011)..(1011): Xaa can be any naturally occurring amino acid
MPKRTDIQSILIIGAGPIVIGQACEFDYSGAQACKALREEGFRVILVNSNPATIMTDPVMADATYIEPITWQAVEKIIEAERPDAVLPTMGGQTALNCALDLDKHGVLEKFGVEMIGANADAINMAEDRDLFDQAMKRIGLECPKAKVAHSMDEAWQIQSELGFPVIIRPSYTMGGSGGGVAYNKEEFEEICTRGFELSNNHELLIDESLLGWKEYEMEVVRDKNDNCIIVCAIENFDPMGVHTGDSITVAPAQTLTDKEYQNMRDASLAVLREIGVETGGSNVQFGVDPDTGRVVVIEMNPRVSRSSALASKATGFPIAKIAAKLAVGYTLDELSNDITGGRTPASFEPSIDYVVTKIPRFTFEKFPQANDRLTTQMKSVGEVMAIGRTFQESLQKALRGLETGNDGLDPKVTRFNDDGMAHIKGELQVAGAERIFYVADAMRAGLSVEELFRLTNIDRWFLVQLEDLVRTEAELAKRSLSELTPRELFALKRKGFSDARLAGLLGVAEKDFRRTRQAAGIRPVYKRVDTCAAEFATDTAYMYSSYEEECEAEVSDRPKIMVLGGGPNRIGQGIEFDYCCVHAALAMRDDGYETIMVNCNPETVSTDYDTSDRLYFEPVTLEDVLEIADKEKPAGVIVQFGGQTPLKLARELEAAGVPIIGTTPDAIDRAEDRERFQHMVDKLGLKQPANATARSXEEAFAKAEAIGYPXVVRPSYVLGGXAMEIVYDASELENYMTHAVKVSNDSPVLLDHFLNCAIEVDIDAVSDGHQVVIGGIMQHIEQAGVHSGDSACALPPYSLPAEVQDEMRDQVKRMAVELGVKGLMNVQLAWQDGEIYVIEVNPRASRTVPFVSKCVGTSLAQVAARCMAGISLAEQGFVEEIVPHFYSVKEAVFPFAKFPGVDPILSPEMKSTGEVMGSGDTFAEAFYKAQLGAGEAIPALEGERKAFLSVRDPDKQGVIDVARSLLGLGFTLCATRGTASALQQAGLPVDVVNKVYEGRPHXVDLLKNDXVAYIVNTTEGRQAINDSSVIRRTALARKVPYATTLAGANAVCLALEYGNAITVRRLQELHAGVSQ

SEQ ID NO: 58804 - protein, 220 aa, Trichodesmium erythraeum IMS101
MLKAILFDLDGTLANTDPLHYQTWKEILDNHGIPINHNSYKQYISGRTNPEIIQDLLPKLSTTEAEELADYKEVKFREMAKNLQPLTGLLDLIEWIKNQKLQKAVVTNAPPENAKFMLEVLKLKDTFPLVILGGEMTVGKPDPAPYKLCLEKLAISPEEAIVFEDSRSGVKSAVGAGIYTIGVASTHEPKSLLEIGASIVINDFSDHKLEETLNNWNIYR

SEQ ID NO: 58805 - protein, 390 aa, Calycanthus floridus
PYEVPMTAAGALQSYKLAAKAITRLQSLPSGSMERVVDTVVQEVFELTGYDRVMAYKFHEDDHGEVISEITKPGLEPYLGLHYPATDIPQAARFLFMKNKVRMICDCHAKPVKVCQDEKLTFDLTLCGSTLRAPHSCHLQYMENMGSIASLVMAVVINEGEEDDEVGISQQQQQRRKRLWGLVVCHNTTPRFVPFPLRYACEFLMQVFAIHVSKEIELENQLREKNILRTQTLLCDMLLRDALLGIVTQSPNIMDLVKCDGASLLYGNKMWRLGLTPTESQIHDIAMWVSEYHMDSTGLSTDSLYDAGYPKALSIGDVVCGMAAVRITAKDMLFWFRSHAAAEVRWGGAKHDPSDKDDGRRMHPRSSFKAFLEVVKTRSSPWKDYEMDAI

SEQ ID NO: 58806 - protein, 393 aa, Calycanthus floridus
DLEPVNPDDVPVTAAGALKSYKLAAKAISKLQSLPSGNISLLCDVLVREVSELTGYDRVMAYKFHEDDHGEVIAECRRSDLEPYLGLHYPATDIPQASRFLFMKNKVRMICDCLAPPVKVIQDKRLAQPLSLCGSTLRAPHGCHAQYMANMNSIASLVMSVMVHENDDRQEMSSSRKGRKELWGLVVCHHTTPRLSFPLRYACEFLIQVFGIQLNKEIELAAQMREKHILRTQTVLCDMLQRDAPVGIIRQTPNVMDLVKCDGAALYYRNQFWLLGTTPTDAQIRDIAEWLLEYHSSSTGLSTDSLMEAGYPGASVLGDAVCGMAAIRITSKDFLFWFRSHTAKEIKWGGAKHDPVDQDDDDRKMHPRSSFKAFLEVVKCRSLPWEDIEMDAI

SEQ ID NO: 58807 - protein, 293 aa, Staphylococcus aureus subsp. aureus Mu50
MATQDPRTKFKTTEYEKQEQEVPGLQSEMTPAPDCGETSYQGHQRLQGYKMLVTGGDSAIGRAAAIAYAKEGADVAINYLPSEEQDAQEVRQVIEESGQKAVLIPGDIRDEQFNYDLVEQAYQQLGGLDNVTLVAGHQQYHDDIHGFTTEAFTETFETNVYPLFWTVQKALEYLKPGASITTTSSVQGYNPSPILHDYAASKAAIISLTKSFSEELGPKGIRVNCVAPGPFWSPLQISGGQPQSKIPTFGQKTPLGRAGQPVELCGTYVLLASEESSYTTGQVFGVSGGVQID

SEQ ID NO: 58808 - protein, 352 aa, uncultured bacterium
ITSAHMLLSAMLDNSIQQGNPLNIDPRRIIWKRVVDMNDRALRNIVIGLGGKAHGVPREDGFDITVASEVMAILCLASNLHDLKERLKRIVVAYNYDGKPVTAEDLHAAGAMAALLKDAVKPNLVQTLEHVPAIIHGGPFANIAHGCNSVMATRTALRLADFTITEAGFGADLGAEKFFDIKCRQAGLAPDACVLVATVRALKMHGGVAKADLKEPNVEAVKKGLPNLGKHIENIFKFGVPVVVAINIFAQDTKEELQAVYDFCAGMGVNVALSDVFAKGGEGGVELAKEVVALAESGMARFKPIYPENMSLREKVATIVKEVYGGDRVEFQTKAAQALDQYEKEGYGNLPV

SEQ ID NO: 58809 - protein, 295 aa, Bacillus cereus ATCC 14579
MTNVTGTERVKRGMAEMQKGGVIMDVVNAEQAKIAEEAGAVAVMALERVPADIRAAGGVSRMADPTIVEEVMGAVSIPVMAKCRIGHLVEARVLESLGVDYIDESEVLTPADEVYHLNKRDYTVPFVCGCRDIGEAARRIAEGASMLRTKGEPGTGNIVEAVRHMRQVNAEIRQVASLREDELMTYAKNTGAPYEVLLEIKRLGRLPVVNFAAGGVATPADAALMMQLGADGVFVGSGIFKSENPEKFARAIVEATTHYEDYELIASLSKGLGNAMKGVEISTLLPEQRMQERGW

SEQ ID NO: 58810 - protein, 310 aa, Triticum aestivum
MATIALIVAMVLSLAQLSAGSRRLMELYVPPESDRLTYHQGGVLSGDIPVSILWYGKFTPAQRSIVSDFVVSLNSAPNGAATPSVGQWWGTIEQLYLSKAAAANGQAGATHVLLAEQVTDEQCSLGTSLTLAQIDQLAASVGAKKGGIALVFTDEDVAVEGFCSSRCGRHGSSTGGDSTHIWVGNSVKQCPGQCAWPFAQPQYGPQGAPLVAPNGNVGMDGMVMVLATMVAGTVSNPYGDGYYQGPKGASLEACTACPGVYGSGAYPGYAGNLLVDPSTGASYNANGANGRKYLLPALYDPATASCNTLV

SEQ ID NO: 58811 - protein, 183 aa, Escherichia coli O157:H7 EDL933
MTATAQQLEYLKNSIKSIQDYPKPGILFRDVTSLLEDPKAYALSIDLLVERYKNAGINKVVGTEARGFLFGAPVALGLGVGFVPVRKPGKLPRETISETYDLEYGTDQLEIHVDAIKPGDKVLVVDDLLATGGTIEATVKLIRRLGGEVADAAFIINLFDLGGEQRLEKQGITSYSLVPFPGH

SEQ ID NO: 58812 - protein, 352 aa, uncultured bacterium
IGAANNLLAAMVDNHIYQGNALDIDPRRVVWRRCVDMNDRQLRNVVDGLGGKANGYTREDGFDITVASEVMAAFCLATGLDDLKERFSRIVVAYNRSGEPVTAGQINAQGAMTALLKDALKPNLVQTLEGTPAFIHGGPFANIAHGCNSVMATKMALHFGDYVVTEAGFGADLGAEKFIDIKCRLTGLRPDAVIIVATIKALKYNGGVPKADVGKENLEALEAGLPNLLKHVENITKVFGLPAVVALNRFANDTDAEIELVTKKCAELGVNVKMSEVWGKGGDGGIELAEEVVRLCEQPNEFKFSYDENLSIREKIEAIATKVYGADGVDFAPKAAKEIDELEKFGYGNMPV

SEQ ID NO: 58813 - protein, 393 aa, Flavobacteria bacterium BBFL7
MKQDFFQYQAPTTPFAPALEVSHASGNYIYDIHGNEYLDCVAGVSALPLGHCHPAVTSAIKKQVDLYMHVMVYGEYAQEPAVQLCKKIAQHMPAPLQMTYLVNSGTEAMEAAIKLARRVTGRSELISMQKAYHGNTMGSLSLMDYEERKAPFRPLLPQVKHIKFNCQSQLNIITDKTAAVIIESIQGGAGFIVPHTSWLKALKEKCQQTGALLIIDEIQPGMGRTGSMFYFTQHDIIPDMVITGKGLAGGLPIGAITASSMHLNMFKEAPMLGHITTFGGNPVIASAALATMTELEKGDLINAVKMKELRFRESLINKHIKEIRGVGLMLAVILADEQHTAAIVDECRNRGVLFFLLLFEKKAIRITPPLTISQDEIDKACYILNEVISKFYN

SEQ ID NO: 58814 - protein, 285 aa, uncultured bacterium 311
MSLVEGKNCLITGATSGIGRSTALALSEKGANIFFIARNQQKAEELTEEVERVSGKSPNAIIADLSSFKQIERAAEEFKSLNKPIDVLLNNAGIMNTERRVTEDGLEEVFAVNHLAYFLLTNLLIEKILESGLKRVVNVSSDAHRFLKSMNFDDLQSEKEFKMFAAYGQSKLANILFTRKLSSLYQEEGLTTNCLHPGFVSTSIGAQNENLAFFARLIRWVSPLIAKPSDKGAETSIYLCSSEEVSSTSGEYFIDCKKAPITKAAESKEDAEKLWQISLELTGLK

SEQ ID NO: 58815 - protein, 352 aa, uncultured bacterium
ITSANNLLAALLDNHIQQGNELGIDTRQIIWKRAEDMNDRALRNIVVGLGAKADGVPREDHFVITVASEIMAILCLASDMNDLKARLSRIVVAYTRDGEPVTAGDLKAVGSTAALLKDAIKPNLVQTLEHTPVIVHGGPFANIAHGCNSVRATKTALSISDYTVTEAGFGADLGAEKFLDIKCRIAGLHPDAVVLVATIRALKYNGGVAKADLGTENLEALKKGIVNLEKHIENIQKYGVPVVVTLNSFLTDTEAEMEFVRNFCQERGCKFALSEVWAKGGEGGEALAKEVIETINTKPSNYAPIYTDDLSLQDKIVKVSTEIYGADGVTFAPAALKQLKKIEEMGFGKLPV

SEQ ID NO: 58816 - protein, 502 aa, uncultured bacterium 311
MTMNLYTSQETKKLDSLAIRSQKVPAFTLMQKASEFSFNVLLNNWPNTKKVFVFCGKGNNAGDGYLISHLAKEMGLESFIIQASPSNKISGASRKAFKLALESKVKRISIAAFKKKSLKDSVIVDALLGIGIKGNVRSNLSKLILEINKKSTNIPVLSVDIPSGICSNTGINLGVHIQADVTATFVGRKRGCFTSTGRTASGNVVFDDLGISSSLKSQIKTNCYLLDTEKSLLKLKNRKGDAHKGDFGHVLVIGGDKGFGGAAILASKAAVFSGAGLVSLATRSIHVEAALSSCPELMVNGIESGQDVEEILAKSTVVVLGPGLGQSAWSEQMLQRTFMEAKKRNLPVVLDADGLNLLTKLKLKSGIPRKMVITPHPGEAARLVNKEVNKIQEDRFKSVTALEKKFGSVSVLKGSGSLVCYKRGGKQRIGVCEAGNPGMAKGGMGDVLAGLIGSFLSQGLGLVEATEVAVDLHSKSADIASLELGMTITPTDVIRNIRYFLR

SEQ ID NO: 58817 - protein, 575 aa, Schizosaccharomyces pombe 972h-
MSSSSGLKQQGLAQKKKFQLEFDPSSVSKNGTKTEAKVVGTEFGVLLVRARNTYFATAGKCSHYGAPLAKGVVTSDGHIVCPWHGACFNAATGDVEDTPAIAALRTFPVTEEGDGSLWIEVEDKNDNGASVLQPEGCWRNKATEVYNKGSVETEVTAPHVCIIGGGKGASVAAEYLREKNFKGKITIFTREDEVPYDRPKLSKSLLHDISKLALRSKEYYDDLDISFHFNTDVTKIDLAEKKIYCGSDEKPTESYTKLILATGGEPNKLPIPGLDSKNVYLLRSIADASKLAAVTTEAGDKKNIVIIGSSFIGLELAVVLKDHNVSVIGMESIPFEKVMGKEVGTALKALHEQNGIAFYLENSIKEVKTSSNDSSKAEHIVLKDGQSIPADVVILAAGVKPNLRYLGNAVSLEKDGGVKVDEHCRVLGAEDVYAVGDIAHAPFAGLPSSGEKSHTRIEHWDVAGNLGRVAADHILFGNKAGYTTKSFTPYFWSAQGKQLRYCGNNAAEGFDDVVIQGSLSDYKFACFFTKGEKVVGVCSIMKDPVVSQCARLFIKDAMPSKSQLKENFDVLSIPL

SEQ ID NO: 58818 - protein, 352 aa, Enterococcus avium
MSKTMKGVSKQAPGYDQMAFIDLSVPEATDDKVLIKVAYTGICGSDIHTFKGEYKNPTTPVVLGHEFSGQVVEVGANVPKVKVGDRVTSETTFYVCGECDYCKEKQYNLCPHRKGIGTQQNGSMANYVLAREESIHLLPDHLSYEGAAMSEPLACCVHAMYQKSHLELKDTIIIMGPGPIGLYLLQIAKEIGAFVIMTGITKDAHRLALAKKLGADVIVDTMKEDLAKVVNEITDGYGVDKVYDASGAVPAVNASLPLIRKQGQFIQVGLFANKMVDLDTESIIQREIEYIGSRSQNPYDWPIAIHLLAKGAINIDEMITKKYPLTEWREAFDKVMEGNEIKVMIESNPEEF

SEQ ID NO: 58819 - protein, 289 aa, Agrobacterium tumefaciens str. C58
MTEKTAYKVGLIGADIQLSKSPALHMREGAAHGLDYSYELVDVTARKLPQSSLPALLDELEARGFAGTNITHPFKQAVIPHLHELSDDARMLGAVNTVVFRDGRRIGHNTDWYGFYESFVRGLPDAKRDRALLVGAGGAGVAVAHAALKLDIIRLDIFDRDFPRAERLADELNARFGEGRAFAVKDPADSLPFADGLIHATPMGMPAHPGMPVAAELIEQKHWVADIVYMPLVTELLATAASKGCRTLPGGGMTVFQAVGAFRLFCGREPDAKRMTAHFTELCMAEGVA

SEQ ID NO: 58820 - protein, 152 aa, Triticum aestivum
MACSPSPSPSPRLLHRASSSSPLLSVGHVRSAPSSTFGWTIQCKQSGHILYGRSHVTSFLALASADAPQGKGSSGQKVIMVDPQEAKRLAVKQMQEIRARDKLKKRHQAEAINGALAVIGLTAALVLEGQTGKGILGQLAGYLAALSSLFGQ

SEQ ID NO: 58821 - protein, 131 aa, Oryza sativa (indica cultivar-group)
MVRVTLECDKQQHQPPPHAHPPGDPLPPRRLLDEPVWSAEVNGESVGYAARREATEADERVMRLLHAMSMGAGVLPAVAADAPTSAADGEVTYMRAHFDRVVGSKDAETYYMHNPEGCATGPELTIFFIRT

SEQ ID NO: 58822 - protein, 393 aa, Canella winterana
DLEPVNPTDVPVTAAGALKSYKLAAKSISRLQSLPSGNIQLLCDVLVREVSDLTGYDRVMAYKFHEDEHGEVIAECRRSDLEPYLGLHYPATDIPQASRFLFMKNKVRMICDCSAPPVKVIQDKRLAQSLSLCGSTLRAPHGCHAQYMANMGSIASLVVSVTVSEDDDETESEQQQKGRKLWGLVICHHTCPRFVPFPLRYACEFLIQVFGIQLNKEVDLASQIREKHMLRTQTMLCDMLLRDAPVGIVTQSPNVMDLVKCDGAALYYKNQFWLLGTTPTEAQIRDITNWLVEYHNSTTGLSTDSLAVAGYPGASVLGDAVCGMAAVKFTNKDLLFWFRSHTAKEIMWGGAKHDPVDKDDDGRKLHPRSSFKAFLEVVKRRSLPWEDVEMDAI

SEQ ID NO: 58823 - protein, 391 aa, Chloranthus spicatus
PYEVPMTAAGALQSYKLAAKAIARLQSLPGGSMEKLCDTVVQEVFELTGYDRAMAYKFHEDDHGEVISETTKPGLEPYLGLHYPATDIPQAARFLFMKNKVRMICDCHAKPVKVFKMKKLAFDLTLCGSTLRAPHSCHSQYMVNMNSIASLVMAVVVNEGEEGDSSEPGQQQLQQKKKRLWGLVICHNTTPRFVPFPLRYACEFLMQVFAIHVNKELELENQIQEKNIFRTQTLLCDMLMRDAPLGIVSQNPNIMDLVKCDGAALLYNKKIWRLGLTPSESQIHDISFWLSENHMDSTGFSTDSLNDAGYPGAVAIGNAVCGMAAVWITSKDMLFWFRSHTAAEVRWGGAKHDPEDKDDNRRMHPRSSFMAFLEVVKTRSLPWKDAEMDAI

SEQ ID NO: 58824 - protein, 247 aa, Trichodesmium erythraeum IMS101
MTLMTFFKNFWSISFFLPLSLVVTAVPLQAQRLPLSENLTSLLSPEGQTLLQTSKAQTDYIPLMSQFVTQVNGAFCGVASAVMVLNALEVPSTAPSPWPQRYFTQDNIFNEKTEEVIPRSVITRRGMTLAQLSDFIATYSVEVKTFYGSDISLEQFRGLIRENLVNDNNFVLINYLGQAIGQKRGGHISPIAAYNEESDQFLVLDVSRYKYPPVWVDTKTLWASTNTIDKTSKKTRGIVLISPLSQL

SEQ ID NO: 58825 - protein, 202 aa, Rickettsiella grylli
MAHLFDKLLQGYRVFRKKYVIGDNAVMRYLADSGQKPQTMIVACCDSRVDPALILQCNPGDLFVMRNVANIVPPYQKDEALHGTSAALEFGIRVLNIKHLILLGHSQCGGIDALLNREHLSKNDFISKWVSSIKLPDNQIRNPEEIAKLSLTRSYENCMTFPWIKEKVDAQTLTIYRWFFDIKTGQMFTYSRRDHIYQALDV

SEQ ID NO: 58826 - protein, 397 aa, Chloranthus spicatus
DLEPVNPADVPVTAAGALKSYKLAAKAISRLQSLPSGNISLLCDVLVREVSELMGYDRVMAYKFHEDEHGEVIAECRRVDLEPYLGLHYPATDIPQASRFLFMKNKVRMICDCSAAPVKVIQDKRLGQPLSLCGSTLRAPHGCHALYMANMGSIASLVMSVTINEDDDETKSDPQQQQQENRRKLWGLVVCHHTSTRFAPFPLRYACEFLLQVFSLQLNKEVELAAQLREKNMLRMQTLLCDMLLRDTPTGILTQSPNVMDLVKCDGAALYYRNQFWLFGTTPTDVQIRDMAEWLLECHDGSTGLSTDSLMEAGYPCASILGNAVCGMAAVKITSKDFLFWFRSHTAKEVKWGGAKHDPIDKDGDGRKMHPRSSFKAFLEVMKQRSLPWEDMEMDAI

SEQ ID NO: 58827 - protein, 267 aa, Synechococcus sp. WH 5701
MQSSMRPAGGDGPGAGFQLIAAVAVALLILLTQTIFIVPAGTVAVVTTLGRVTGGQRSPGPNIKVPLIQATSFFDVRTQVRPEQFSTLTKDLQVIEATATVKYSIKPQEAGRIFETIATENQQIYPRIIQPSLLKALKSVFSQYELVTIATEWNSISELVQDMVAQELSKFDYVKVQGLDLTGLQIAEEYRSAIEQKQIADQRLLRAQTEVKIAEQEAKRYQILNSSLDDQVLFKLFLDKWDGQTSVVPALPGTVGGGTPVIVNGRR

SEQ ID NO: 58828 - protein, 414 aa, Degeneria vitiensis
SGKPFYAIIHRVTGSLIIDFEPVKPYEVPMTAAGALQSYKLAAKAIAKLQALPSGSMEKLVDTIVQEVFELTGYDRAMAYKFHEDDHGEVISEVTKPGLEPYLGLHYPATDIPQAARFLFMKNKVRMICDCHAKPVEVYQDEKLTFDLTLCGSTLRAPHSCHLQYMENMDSIASLVMAVVINEGEDESGGPEQQQQQLKRKRLWGLVVCHNMTPRFVPCPLRYACEFLMQVFAIHVNKEFELENQIREKNILRTQTMPCDMLLRDAPLGIVTQSPNIMDLVKCDGAALLYNNKIWRLGFTPTESQIHDISIWLSEYHTDSTGLSTDSLRDAGYPDALALGDVVCGMAAVRISPKDMLFWFRSPTAAEVRWGGAKHDPCDKDDGRRMHPRSSFKAFLEVVKTRSLPWKDYEMDGI

SEQ ID NO: 58829 - protein, 400 aa, Kluyveromyces lactis NRRL Y-1140
MGQLLSHPLTEKTIIYNDYQTSGHKLSLRHDTHQEVEIPRFYNCVGSMQGYRLTQEDAHLVKTGSESLIVSFHDPFIGKVVKYQISIFAVFDGHGDNNCSNYLAGSLYEHTHPQAHSTTDRILTEHDGLIYFIKLAFESHKYTSFSRPDGNKRQFRTLEGLICQVIKDSFKACDAAFHKHFANEASGSTAIVALLINGSMLYVANTGDSRCILSKKNKAIKPMSYDHKPQHIGELIRINDDGGTVSLGRVGGVLALSRAFGDFQFKRNVKYQNLNTLAVSSKRKYIPAEEAQVTVEPDVLPHAIDLSQDEFLVLACDGIWDVYSNKALVNFIKYHLTLGLKLDNILAKILDHGISCADSNTGVGFDNFTLIVVVLQQPGETLDEWYARIKSRLEREKGLL

SEQ ID NO: 58830 - protein, 393 aa, Degeneria vitiensis
DLEPVNPADVPVTAAGALKSYKLAAKAISRLQSLPSGNISLLCDVLVREVSELTGYDRVMAYKFHEDEHGEVIAESRRSDLEPYLGLHYPATDIPQASRFLFMKNKVRMICDCSAPPVKVIQDKRLAQPLSLCGSTLRAPHGCHTQYMANMGSISSLVMSVTINEDDDDMLSEQQQKGRKLWGLVVCHHTSPRFIPFPLRYACEFLIQVFGIQLNKEVELAAQMREKHILRMQTVLCDMLLRDTPVGIITQSPNVMDLVNCDGAALYYRNQFWLLGTTPTEAQIRDIAGWLVEYHDGTTGLSTDSLTEAGYPSAADLGDDVCGMATVKITSKDFLFWFRSHTGKEIKWGGAKHDPVDKDDDGRKMHPRSSFKAFLEVVKQRSLPWEDVEMDAI

SEQ ID NO: 58831 - protein, 388 aa, Drimys winteri
PMTAAGALQSYKLAAKAIARLQSLPGGSLKRLIDTVVLEVFELTGYDRVMAYKFHEDDHGEVISEVTKPDLEPYLGLHYPATDIPQAARFLFMKNKVRMICDCNAKPVKVYQDEKLTFDLTLCGSTLRAPHSCHLQYMENMGSIASLVMAVVINEREEQDENSGSEQQREQPRRKRLWGLVVCHNTTPKFVPFPLRYACEFLAQVFAIHVNKELELENQIQENNILRTQTLLCDMLMRAALLGIVTQSPSILDLVKCDGASLLYQNKIWRLGVAPTESQILDIALWLSEYHMDSTGLSTDSLQDAGHPGALSLGDVVCGMAAVRINSKDTLFWFRSHTAAEIRWGGAKHDPNQKDDGRKMHPRSSFKAFLEVVKTRSSPWADYEMDAI

SEQ ID NO: 58832 - protein, 200 aa, Ustilago maydis 521
MYAQTNACYLKLAGPSLVQMFIGDGAKLVRDAFELAKEKAPAIIFIDELDAIGTKRFDSDKSGDREVQRTMLELLNQLDGFSSDERIKVIAATNRIDILDPALLRSGRLDRKIEFPLPNEEARARIMEIHSRKMAVGPNVNFEELARSTDEMNGAQLKAVCVEAGMIALREGATILDHEHFHGGIQEVQAKKKNDQFYFS

SEQ ID NO: 58833 - protein, 669 aa, Streptococcus mutans UA159
MTEKQPFYITTPIYYPSGKLHIGSAYTTIACDVLARYKRMMNHDVFYLTGLDEHGQKIQQKSEEAGITPQAYVDGMAVGVKELWKLLDISYDKFIRTTDDYHEKVVADVFEKLLAQGDIYLGEYSGWYSVSDEEFFTESQLEEIFRDEDGKVIGGIAPSGHEVEWVSEESYFLRLSNYADRLVDFFHAHPDFIQPDGRMNEIIKNFIEPGLEDLAVSRTSFTWGVKVPSNPKHVVYVWIDALLNYATALGYGQDAHANFDKFWNGTVFHMVGKDILRFHSIYWPILLMMLDLKMPERLIAHGWFVMKDGKMSKSKGNVVYPEMLVERYGLDPLRYYLMRSLPVGSDGTFTPEDYVGRINYELANDLGNLLNRTVAMINKYFGGEIPAYVENVTDFDADLAAVVADNLAQYHKQMNAVDYPRALETVWNIISRTNKYIDETTPWVLAKDKAKRDDLAAVMAHLAASLRVVAHLIQPFMMTTSNAIMEQLGLAGQFDLEGLELAGLPTGVKVIAKGTPIFPRLDMDEEIAYIKEQMGDNSAIAQEEEKEWNPTTVELKNEKKAIKFDDFDKLEIRVAEVKEVSKVKGSDKLLKFRLDAGDGEDRQILSGIAKYYPNELDLVGKKLQIVANLKPRKMMGLVSQGMILSAEHADGKLTVLTVDSSVPNGSQIG

SEQ ID NO: 58834 - protein, 394 aa, Drimys winteri
DLEPVNPVDVPVTAAGALKSYKLAAKAISKLQYLPSGNISLLCDVLVREVSELTGYDRVMAYKFHGDEHGEVIAECRRSDIEPYLGLHYPATDIPQASRFLFMKNKVRMICDCTARPVKVIQDKKLAQPLSLCGSALRAPHGCHAQYMANMGSIASLVMSVTISEDDDEASTEEQRQKGRKLWGLVVCHHVTPRFVPFPLRYACEFLIQVFGIQLNKEVELEAQLREKNMLRTQTMLCDMLLRDAPVGIVTQSPNVMDLVKCDGAALYYRNQFWLLGITPTEAQIRDIAEWLLEYHNSTTGLSTDSLMEAAYPGASILGDAVCGMAAVKITCKDFLFWFRSHTAKEIKWGGAKHDPGDKDGDGRKMHPRSSFKAFLDVVKQRSLPWEDVEMDAI

SEQ ID NO: 58835 - protein, 392 aa, Eupomatia laurina
PYEVPMTAAGALQSYKLAAKAIARLQALPSGSLEKLIDTVVQEVFELTGYDRAMAYKFHDDDHGEVISEITKPGLEPYLGLHYPATDIPQAARFLFMKNKVRMICDCYAKPVNVYQDEKLAFDLTLCGSTLRAPHSCHLQYMENMGSIASLVMAVVINDGEDEDESTGSGLQPPLLKKKRLWGLVVCHNTTPRFVPFPLRYACEFLMQVFAIHVNKELELENQICEKNILRTQTLLCDMLLRDAPLGIVTQNPNIMDLVKCDGVALLYDNKFWRLGLTPTESQMRDISAWLSEYHMDSTGLSTDSLYDAGYPGALALGDVVCGMAAVRITSKDMLFWFRSHTAAEVRWGGAKHDPNDKDDGRRMHPRSSFKAFLEAVKTRSLPWKDYEMDAI

SEQ ID NO: 58836 - protein, 228 aa, Staphylococcus aureus subsp. aureus Mu50
MKDVKALKLMTLNDVLSQINGDMTLGIGTGSTMELLLPQMAQLIKERGYNITGVCTSNKIAFLAKELGIKICEINDVDHIDLAIDGADEVDPSLNIIKGGGGALFREKVIDEMASRFVVVVDETKIVQYLGETFKLPVEVDKFNWYHILRKIESYADIKVERRVNEDVAFITDNGNYILDCKLPKGIDPYKFHEYLIHLTGVFETGYFLDMADQVIVGTQEGVKILEK

SEQ ID NO: 58837 - protein, 393 aa, Eupomatia laurina
DLEPVNPADVPVTAAGALKSYKLAAKAISRLQSLPSGNISLLCDVLVRELSELTGYDRVMAYKFHEDEHGEVIAECRRLDLEPYLGLHYPATDIPQASRFLFMKNKVRMICDCSAPPVKVIQDKRLEQPLSLCGSTLRAPHGCHAQYMANMGTIASLVISVTINEDDDETPGEQQQKGRKLWGLVVCHHMSPRFVPFPLRYACEFLIQVFGIQLNKEVELAAQTREKHILRMQTMLCDMLLRDTPIGIVTQSPNVMDLVKCDGAALYYQNQFWLLRTTPTETQIRDIIGWLLEYHGDTTGLSTDSLTEAGYPGAADLGDDVCGMAAVKISSKDFLFWFRSHTAKEIMWGGAKHGPVDKDDDGRKMHPRSSFKAFLEVVKRQSLPWEDMEMDAI

SEQ ID NO: 58838 - protein, 355 aa, uncultured bacterium
IGAANNLLAAMLDASIQYGNPLNIDVRNITWKRVVDMNDRQLRFIVDGLGGKTNGTPREDGFDITVASEVMAIFCLATSISDLKARLGRIVVGYTYDGDPVTAHDLKAEGAMAALLKDALKPNLVQTLEGTPAFVHGGPFANIAHGCNSIMATRMALALGDYAVTEAGFGADLGAEKFLDIKCRLAGLKPDAVVIVATVRALKNHGGVAKADLGAENLEALEAGLPNLLQHVENITNIYKLPCVVAINQFPTDTEAELALVEAKCKELGVNVALSQVWAKGGEGGLALADEVIRLCDEGKGAETFEFCYPDELSLKEKIETIATRVYRADGVNFEPNALKEIEKLESLGFGGMPV

SEQ ID NO: 58839 - protein, 398 aa, Oryza sativa (japonica cultivar-group)
MEASLCSMAPLRGAKRRRKAAAEKKAAMAAAAAAGGAPGAGGGDWWDGFCMRMSGTLSGIQDAQRFEFIFKMPRRTFNYICGLVRDEMMVRSSSYTFLDGKVLSLEDRVAVALIRLNSGGSLVTVGSAVGVNHSTVSLITWRFVEAMEERASHHLRWPDSSEVEKIKSMFEKIHGLPNCCGVVDTTHITMCLSSAEPNCKVWLDHEKNYSMVLQAVISPDMRFMDIVTGWPGSMKESSILHSSGLFKMCEKGARLNGSKMVVSDGSEIGEYIIGDAGYPLLPWLLTPYQEKDLSDSKLEFNKRHAAAITVAPSTLANFKDTWKFLHGEMWRPDKHRLPRIIHVCCMLHNIIICLQDATIDEAAMSNDHDANYKQQVCQLADENAVRVRDKLSEHLVSR

SEQ ID NO: 58840 - protein, 352 aa, uncultured bacterium
IGAANNLLAAMLDNHTQQGNKLGIDPKQITWKRAVDMNDRQLRNIVDGLGGKAQGVPREDGFDITVASEVMAVLCLASDINDLKARCGRIIVGYTYSGEPVTAHDLKAEGAMAALLKDALKPNLVQTLEGTPAFVHGGPFANIAHGCNSVTATRMALKIGDYIVTEAGFAADLGAEKFLDIKCRMAGLRPDAVVIVATVRALKYHGGVAKADLNEENLTALEAGLPNLLQHVSNIKDVYGLPCVVAINAFPTDTKAELDMVEAKCKELGVNVALSEVWAKGGEGGKALAEEVVRLCEEPNDFRFSYDLDMSIEEKMDAICRKIYHADGVVLTPAARKQMAKLEEIGCSNMPI

SEQ ID NO: 58841 - protein, 482 aa, Kineococcus radiotolerans SRS30216
MAELTPAPPRPRALPHVVVVGAGISGLTAAWELTRSGEFTVEVLEAADVVGGVLQRAEVGGVVLDVGAESMLARRPEGVDLVRDAGLADALVHPATARASVRSPGRLDPLPSGTLMGVPRSADAVEGFLAPAEVARVRAEPDLPAPPLTEDVAVADYVAARVGQAVVDRLVEPLLGGVYAGHAAQLSLRATVPALWQHAVRGGSLLHAIAEPPAASSAPVFAGLRGGLATLPRTLAERLRERGAVVATSTPVTRLERRPDGWLVDTARCSRHADAVVVAVPAPAAARLLAEPVPAAAAELRGVETASVVIAALAVPAGELSGLTGSGLLVPPAVAAVEGLRAKALTLSGNKWDWVGDQRGDRPGGTAVLRVSLGRAGETEALGAEDADVVRWATADASRLLGRDLHPVEHAVVRWVDGLPQYAVGHLDRVERLRAAVGAAGRLAVCGSVLDGVGIPACVGAARRAAAQVRAELAPAWGRMRA

SEQ ID NO: 58842 - protein, 352 aa, uncultured bacterium
IEAANNCVSAVIDNHIFHGNELHIDPTRITWHRVVDMNDRALRSIVVGLGGPLQGVPREDHFDIVVASEIMAILCLANDMEDLRVRLDRTVVAYTYDRMPVTIKDLGITGALMMILKDAIKPNLVQTLEHTPCLIHGGPFANIAHGCNSIIATKMALSLSEYTVTEAGFGADLGAEKFLDIKCREANLTPSAVVVVATIRALKMHGGVLKEDLGKENVEALNLGFKNLEKHIENIKKYNLPYVVAINKFASDTDAELKALADWATANGHPVSLSDVWAKGGEGAIDLAKKLEAEIASNTKEFTYLYKKEDSIKSKITTICKEIYGASNVEFTSDAKNQMARLTKLGFGECLV

SEQ ID NO: 58843 - protein, 368 aa, Croton sublyratus
MSSVNLGSWVHTSSVISQATRSRSKSKPLSFSPVSIPLFYRNSKRSVSYVSAIVTKDEETIQEEQNKNSSSSLGFDFKSYMVQKASAINQALEAAVSLREPLKIHESMRYSLLAGGKRVRPALCLAACELVGGDESMAMPAACAVEMIHTMSLIHDDLPCMDNDDLRRGKPTNHIVFGENVAVLAGDALLAFAFEHIAVSTLNVSPVRIVRGVGELAKAIGAEGLVAGQVVDICSEGLSEVDLEKLEFIHIHKTAKLLEGAVVLGAIMGGGTDEEVEKLRKYARDIGLLFQVVDDILDVTKSSQELGKTAGKDLVADKVTYPKLMGIEKSREFAEKLNKEAQEQLAGFDPEKAAPLIALANYIAYRQN

SEQ ID NO: 58844 - protein, 606 aa, Cryptococcus neoformans var. neoformans B-3501A
MSDPNSDLYPIHLLMDELKSEDVVLRLSSIRRLSTIALALGPSRTREELIPFIQYQLDDEDEVLLVLAEELGNFVEYVGGKEYAHVILGPLENLTAVEETLVREKAAESISKISVLLSAQDLEQYFLPIVKRLSTGEWFTSRTSACALFAAPYPNASSSSQEEMRKLFGALCHDDTPMVRRAAAKALGPLAKVVSETSGQHDTIVSELIPMYRKLAGDDQDSVRLLTIPDLIALAAALSDEETKTNLLEPMRASITDKSWRVRYMVANEFVGLAESAGESIIREELVGAFVGLLKDNEAEVRTAASGQVPGFAKLVDKEVILARLLPCVRDLSTDSSQHVRAALAMEISGLAPLLGKDATIEHLLPLFLQLLKDEFSDVRLNLIGKLDMVNEVIGIDRLSQALLPAIMTLAEDKQWRVRQAIIEYIPLLAQQLGVEFFDDKLGSLCMSWLGDTVFSIREAATINLKKLTDVFGVEWAKTTIIPKVLEMGNHQNYLYRMTTIFAITKQTMAPSLNTAIIRDTVLDAALNLANDAIPNIRFNVAKCLETLASVLAQTPEGQELVHRRVVTALRKLQEDQDADVRFFATKAYERTTGDDVRGAEPMILS

SEQ ID NO: 58845 - protein, 354 aa, uncultured bacterium
IGAANNLLAAMIDNHIYQGNALDIDPRRIIWRRCVDMNDRQLRNVVDGLGGKAQGCPREDGYDITVASEVMAIFCLASSITDLKERLSKIIIGYSRKGEPVTAGQLNAQGAMTALLRDALNPNLVQTLEGTPAFVHGGPFANIAHGCNSVIATKTALHFADYVVTEAGFGADLGAEKFLDIKCRMAGLKPDAVIIVATIRALKYNGGVPKDKTTEENLEALEKGLPNLLKHVENITQVYHLPCVVALNRFVSDTDAEIDLVTKKCKELGVNVKMSEVWGKGGDGGIELANEVVRLCEEESNDKFEFCYDLNKPLKEKIETIAKRVYGAAEVTYDKAASDELANLEKLGFGDKPI

SEQ ID NO: 58846 - protein, 351 aa, Scoparia dulcis
MSLVNPVSTWPNPTRSSVFRPKPAILNTTHLPISFLFAGKPISAVLTKEYSHQTSSTFDFKKYMLEKASSVNKALESAVSLKEPLKIHESMRYSLLAGGKRVRPMLCLAACELVGGHPSTAMPAACSIEMIHTMSLMHDDLPCMDNDHLRRGHPTNHIVFGEDVAVLAGDALLAYSFEYLATATEGVLPERIVRVIAELAKCIRSEGLLAGQVVDICSEGVSEIGLEHLEYIHLHKTAALLEGSVVLGAILGGGNDEEVERLRKFARCIGLLFQVVDDILDVTKTSVELGKTAGKDLVADKTTYPKLIGIEKSREFAEKLNREAQEQLVGFDSDKAAPLIALANYIAYREN

SEQ ID NO: 58847 - protein, 201 aa, Oryza sativa (japonica cultivar-group)
MAVAIEAPFHVLAVDDSLPDRKLIERLLKTSSFQVTTVDSGSKALEFLGLHDHEDSPISTQSDQQEVAVNLIITDYCMPGMTGYDLLKKIKESSYLRDIPVVIMSSDNIPSRINRCLEEGADEFFLKPVRLSDMSKLKPHILKSRCKEHYQQEQNLQSNSESNNSSNPTSENSSSSTSSNSHKRKAVDEEILPHTIRPRHS

SEQ ID NO: 58848 - protein, 408 aa, Oryza sativa (japonica cultivar-group)
MSIQANPLIKTLALSPRRRMAPPAPATARRPMAAVRCSAAKRSYNVTLLPGDGIGPEVVAVAKDVLSLAGALEGVEFRFQEKLMGGAAVDAYGVPLPEETLAAAQASDAVLLGAIGGYKWDNNEKHLKPETGLLQIRAGLGVFANLRPAAVLPQLVDASTLKKEVAEGVDIMVVRELTGGIYFGQPRGFGKNDKGEDTGFNTEVYSASEIDRITRVAFEVARKRRGKLCSVDKANVLEASMLWRKRVTSLASEFPDIELSHMYVDNAAMQLIRNPKQFDTIVTNNIFGDILSDEASMLTGSIGMLPSASVGESGPGLFEPIHGSAPDIAGQDKANPLATILSAAMLLRYGLGEENAAKRVEAAVTETLNNGFRTGDIYSPGTTLVGCKRMGEEVLKTVESQSAVALNS

SEQ ID NO: 58849 - protein, 445 aa, Cryptococcus neoformans var. neoformans B-3501A
MPRRSAKYKATARARELYRMATILNHKQLKTSLSIPYHALRTSRYLNRPKKYGQLRSRDAVARITSIHEIPDEDFRRKLRVNHTEFRKLLCLIKDHPVFVSHGPRKQANPLLQLTVALYRLGHCGCAASTFEIGEQFGVSEGTSAIWTTRVIKAILSLERNNVYWPDENERKAIDRHFEEEEDIPDGCVGIIDGFHVPFAYKPARHDAVDFFSYKGRYGFNILGICDHLKRIRYFQYGYPASAHDARIFKNCSLFEEANADAQSNREAMLQGRAVHSEMISQGEYLLADSAFPAGDWCVPLFKRRRGQNDLDRPEAKFNKKCSSARVKIEHAYGILKNRWQSLRSLRVKIRNVRDEGVATCWIRACVVLHNLLIDTGDWYNQLDGDADEPDDYIDIERMQERMERVLERHREEEEDEARDARDASNLTRKRVMERMQEIERRDLL

SEQ ID NO: 58850 - protein, 411 aa, Alkalilimnicola ehrlichei MLHE-1
MNGQRPCHAPMDQFEVADGMLQVGGRPLSDLVQQAGGTPFYAYDRRLMTRRVAALRQTLPEGIALHYAIKANPMPAVVQHMAGQVDGLDVASAGELRVALDAGVSAADISFAGPGKTDDELAAAVAAGITINLESATELERLAAIAEKIGHRPHVAVRVNPDFELKTSGMKMSGGAKPFGVDAEAVPALLKRIAALDVHFRGFHIFSGSQNLRAEALVEAQGLTLDLALRLADDAPGPVEMLNIGGGFGIPYFPGDRRLDLAPVSEQLEARLPAVRERLPGVEIILELGRYLVGEAGIYVAKVVDRKVSRGRTFLVTNGGLHHHLAASGNFGQVIRKNYPVAVGNRMDASASETVDVVGPLCTPLDILAQQVDLPPAQPGDWIVVYQSGAYGYTASPTRFLGHPEPLELLV

SEQ ID NO: 58851 - protein, 117 aa, Zea mays
MASSFAVATVPSLAAPAAKKRSGGVTYVEGMNAYSGLKGLNKVNMLGVRKTADYSFAKVVASLSPAGRKRRGGAFGAQMNAAAEIFRIAATMNGLVLVGVAVGFVLLRVEAAVEESE

SEQ ID NO: 58852 - protein, 156 aa, Synechococcus sp. WH 7805
MVLQQTVGEVMSAPVLTVTPATPLKDAVTLLSDHHISGVPVVGDDGTLVGELTEQNLMVRESGVDAGPYVMLLDSVIYLRNPLNWDKQVHQVLGNTVADLMSRDSHCCAQSLPLPKAASMLHEKGTQRLIVVDEERRPVGMLTRGDVVRALASAQP

SEQ ID NO: 58853 - protein, 456 aa, Oryza sativa (indica cultivar-group)
MDVLQDDQSRKLFFNTVFRSNKCPAGYRRLETISGNILAKCGGLPLAIVSVGGMLAQAENKTPAEWMKVCDRLGSGLSTSAMMERMRRIMSLSYHDLPYHLKACFLYLSVFREGYEIKRGPLVRRWAAEGFVGGRRECTPEEAAGKYLDEFVGRSIVTPTRVVNNGVVRCCKVHDIMLEMMTEKCMEENFISLLGSPSKHGHQQHAMMVAAGHDKIRRLSVHGAHTSQGKQAGGVHDKHLCRRRIKKDEEQDDVLSSGDLSCVHSLLMLRIILRGGSTHRSNIFTEILKGYLQSRPCFWPPKVIKNNENALLEFVRVVEAKEQVVAGTLHHLTLEALEAGRKKVYEAKVWVKPWLDFKELQEFRNTGDATTFTNADLGAKKVTHSCLVEFVICALLNLKGGHEPGWRDVPVHDPVVKDAADHAVKSIQQRSNSLFPYELLEIVRAKAEVVEDFAKV

SEQ ID NO: 58854 - protein, 149 aa, Silicibacter sp. TM1040
MRPPYSYRDDSNVPLFSDNTPIAVMDGECALCSWGARMIHRLDRSGRVRICPVQSPLGRALLKHYGLCAEDPTSWLYLDAGQAYMDFEGMIHAGRSFGGWGHLVVALRLLPRPVRNWLYRRLARNRYMLFGKGDICALPDPEFRKRLIE

SEQ ID NO: 58855 - protein, 953 aa, Candidatus Protochlamydia amoebophila UWE25
MNKVNHNLNPTTLIAFSDNHDYQQSNKALKFSSRINLLCKTIFQTLLHLIFDCFDKNQLRSQWKKIVWDQKKSVISKNVIIRPRSDVSLPSTNLIPPLSSSSLMKTNAYLTTLDSELAQFCKIFEIYNTRIISLAEKNLHILPSSFGNLNQLNHLDLTNNQLQTLPNSFENLTNLRSLNLCNNQFSEIPDCLFRLPSACDINLKENPLSQEILDQLNQRVNQTNYQGPKFQVSSPTPSFCSELMDQIIPRSEPILLDDALAQFCRFFEIHDTSMISLTEKNIQLLPSSFGNLINLFFLNLINNQLQTLPDSFGNLTNLQFLYLYNNKLELLPTSFGNLNQLNKLNLANNQLQILPQFFGNLTNLTKLYLNNNKLELLPTSFGKLTQLKKLQIAYNQLQSLPELFTNLINLQTLDLNNNNLRTLPDSFGNLNRLHVLNLSNNQLQVLPHSFGNLTQLRDLHIAYNQLQSLPGSLTNLVNLQTLDLNNNNLQTLPNSFGNLNQINYLNLANNQFHSLPESFGNLTKLQCLYLYNNQIQILPETFSNLINLTELHLNYNQLQTLPETFTNLTNLRNLNLTGNNFETIPECLFHLSSECEIYLEANPLSREILDQLNRRTSQSNYQGPRFHVSIYTPSFHNNQTNQIFLNFESILKEWCNKNCQTKLLSNLPQTAKNNLLNWFSRVKSTPFYTSNPQAAKEKISSFLDWMANENNLDYLQVAYQILADATSTCGDRMATSVNELMLHMRLCQSQNLSPEELKTLIIGSARLNKLFKIAQKTSASQRMTDPIEVHLCYQIHLKEALELPIETNSMLYERMACLSEQNIQIAKERILRKTSTFEQQTNILMASSFWMNAVKSQLSTSHIEKLRAFYNLNLNSNDSQFITIDSLLNKIEFESRQSIYEQLAELCEQVKANKMNEIDIEDGEAVSAYFSQFHINEKTIWNPAYIATLAFLS

SEQ ID NO: 58856 - protein, 396 aa, Hedycarya angustifolia
DLEPVNPADVPVTAAGALKSYKLAAKAISKLQSLPSGNISVLCDVLVREVSELTGYDRVMAYKFHDDEHGEVIAECRRSNLEPYLGLHYPATDIPQASRFLFMKNKVRMICDCSAPPVKVIQDKSLAQPLSLGGSTLRAPHGCHAQYMANMGSIASLVMSVTINEDDDETSSGSEQQQQKGRKLWGLVVCHHTSPRFVPFPLRYACEFLIQVFGIQLNKEVELAAQMREKHILRTQTVLCDMLLLDAPVGIITKTPNVMDLVKCDGAALYYLNQFWLLGTTPTEAQIRDIVSWLQEYHNGSTGLSTDSLMEANYPGAFVLGDAVCGMAAVRITSKDFLFWFRSHTAKEIKWGGAKHNIVDKDDDGRKMHPRSSFKAFLEVVKRRSLPWEDIEMDAI

SEQ ID NO: 58857 - protein, 171 aa, Oryza sativa (japonica cultivar-group)
MPPSPSAPPPLRLRLALASTAPHNNGVYTVGDFMTKRPNLHVVTPATSVDEALETLVQHKISGFPVVDDTGKLVGVVSDYDLLALDSISGSGLTGTNTSMFPEVDSTWKTFREIQRLLSKTNGKVIADVMTYSPLAVRESTNLDAATRLLLETKYRRLPVVDSTGKLIFGI

SEQ ID NO: 58858 - protein, 392 aa, Arabidopsis thaliana
MERLVSGETTTSSNMKKKKKKVSSTTNPSLPDDLVLVIIARVSILYYPILSLVSKSFRSLLASPELYKVRSLLGRRESRLYVCINMYSYKNGPSWFTLCRKPDRTTTSSNKEQEEDRSSGYVLARIPIPHSPLTQRYSLAAVGSNIYNIGVTRYHHLTSSSVWVLDCRSHTWRQAPSLPVELFRVSVSVLDQKIYVAGLHQEDGSDSLKNSVTVLDTETQVSDRVAIPCSVSQGKEIFISTSVGGKVNLVTGRKVVDYNPVEGSWEEVGDTMCEFMFSKCFCVVGNVLYSCAIDRVFRWYDTEVRTWRNLECLIGGRLPKLSPRAFVSLADYGGKLAVFWNQGVGDWQMLWCAVIALERRNTCEILGNVEWSDHVLHVPKIRSYYNALSATL

SEQ ID NO: 58859 - protein, 398 aa, Hernandia lychnifera
DFEPVKPYEVPMTAAGALQSYKLAAKAIARLQSLSSGSMQKLVDTVVEEVYELTGYDRVMAYKFHDDDHGEVISEIKKPDLEPYLGLHYPATDIPQASRFLFMKNKVRMICDCNMKPVKVYLDEKLTYDLTLCGSTLRAPHSCHLQYMANMGSIASLVMAVVINEGEEERIAQKLHNHHHSQKRKRLWGLVVCHHTTPRFVPFPLRYACEFLMQVVAIHVNKEFELENQIQEKNILRTQTLLCDMLLRDAPLGIVTQSPNIMDLVKCDGAALLYGNKIWKLGTTPTELQIRDISLWLSEYHMDSTGLSTDSLYDAGYPGALSLGDAICGMAAVTITPKDFLFWFRSHTAAKVRWGGAKHDPTDKDDGRTMHPRSSFKAFLEVVKTRSLPWKDYEMDAI

SEQ ID NO: 58860 - protein, 392 aa, Houttuynia cordata
  misc_feature (248)..(248): Xaa can be any naturally occurring amino acid
DLEPVNPSDVPVTAAGALKSYKLAARAISRLQSLPSGDISLLCDVLVREVSDLTGYDRVMAYKFHEDEHGEVVAECKRADLEPYLGLHYPATDIPPASRFLFMKNKMRMICDCLAQPVKVIQDKRLPQPLSLAGSTLRAPHGCHAQYMSNMGSIASLVMSVVVSEGDDDSNNGEKTGRKLWGLVVCHHTSPRFIPFPLRYACEFLIQVFAIQLSKEVELAAQMKEKHILRMQTVLCDMLLRDAPMGIXTQSPNVMDLVKCDGAALYYRCQCWLLGTTPTENQIRDLAEWLLQYHNSSTGLSTDSLVDAGYPGAHELGDAVCGMAAIRITSRDFLIWFRSHTAKEIKWGGEKHDPSDKDAFESKMNPRTSFKTFLEVVKRRSLPWEDVEMDAI

SEQ ID NO: 58861 - protein, 414 aa, Idiospermum australiense
SGKPFYAIIHRVTGSLIIDFEPVKPYEAPMTAAGALQSYKLAAKAITRLQSLPSGSMERLVDTVVQEVFELTGYDRVMAYKFHEDDHGEVISEITKPGLEPYLGLHYPATDIPQAARFLFMKNKVRMICDCHARPVKVYQDEKLTFDLTLCGSTLRAPHSCHLQYMENMDSIASLVMAVVINEGEEDDEVESAQQQQQKRKRLWGLVVCHNTTPRFVPFPLRYACEFLMQVFAIHVSKEFELENQLREKNILRTQTLLCDMLLRDAPLGIVTQSPNIMDLVKCDGAALLYGSKIWRLGLTPTDSQIQDIAMWLSEYHMDSTGLSTDSLYDAGYPKALSIDDVVCGMAAVRITAKDMLFWFRSHAAAEVRWGGAKHDPSDKDDGRRMHPRSSFKAFLEVVKTRSLPWKDNEMDAI

SEQ ID NO: 58862 - protein, 516 aa, Zea mays
MRDEKPPPAAAAAAPAPPRVTHRARIVRPQPQNPVFKRCGTLVERRGQSRGPPPDRAGAGGVAAPARPSGGEGAGMVLGGGMAAAAVGGDDAVVMQLGGAEGEETVVTVNCPDQTGLGCDLCRTILEFGLRITRADVSTDGHWCFVVFWVVPRSSSIKVRWASLKNRLMSMCPSSYSIPFFYRDVSQPEPGPLQFYLLKLMSPDRKGLLHDVTHILSDLELIIHRVKVSTTPDGRVVDLFFITDGMELLHRKERQEETCSALTATLGPSISCEVVPAEGFQQGFSSLPPEIAEELFRAELADTDSEVCSSPLSAELRKVRTTATVNFDNSLSPAHTLVQIVCADQKGLIYDILRTMKDCNIQIFYGRFRSDKKGSASKGSSGCREVDLFVKQVDGKKVTDPAKQDALRSRLRSETLHPLRVMVVGRGPDTELLVANPVEASGKGRPRVFYDATLALKALGICIFSAEIGRQAASERHWEVYRFLLDDSKEFPLASSLANRNCVVDRARKTLMGCYN

SEQ ID NO: 58863 - protein, 302 aa, Pseudomonas aeruginosa PAO1
MQQLLNEILDEVRPLIGRGKVADYIPALAGVEPNQLGIAVYSRDGELFHAGDALRPFSIQSISKVFSLVQAIQHSGEDIWQRLGHEPSGQPFNSLVQLEFERGKPRNPFINAGALVICDINQSRFAAPAQSMRDFVRRLCGNPEVVSDSVVARSEYQHRSRNAAAAYLMKSFGNFHNDVEAVLFSYFHHCALRMSCVDLARAFCFLADKGFCKHSGEQVLNERQTKQVNAIMATSGLYDEAGNFAYRVGLPGKSGVGGGIIAVVPGRFTVCVWSPELNAAGNSLAGIAALEKLSERIGWSIF

SEQ ID NO: 58864 - protein, 395 aa, Idiospermum australiense
DLEPVNPADVLVTAAGGLKSYKLAAKAISKLQSLPSGNISLLCDVLVREVSELTGYDRVMAYKFHEDEHGEVIAECRRSDLEPYIGLHYPATDIPQASRFLFRKNKVRMICDCLAPPVKVIQDKRLAQPLSLCGSTLRAPHGCHAQYMANMNSIASLVISVTVHEDDNETGSEQQQQPKGRKLWGLVVCHHTSPRFVPFPLRYACEFLIQVFGIQLNKEIELAAQMNEKHILRTQTVLCDMLQRNAPVGIITQTPNVMDLVKCDGAALYYRNQFWLLGTTPTEAQIRDIVEWLMEYHSSSTGLSTDSLMEAGYQGAAILGDAVCGMAAIRITSKDFLFWFRSHTAKEIKWGGAKHDPVDQDDDGRKMHPRSSFKAFLEVVKRRSLPWEDVEMDAI

SEQ ID NO: 58865 - protein, 591 aa, Oryza sativa
MAALRDVLLSIAQTPHRLRRRALVTWTPAQETSEVRDRSGARMKRRLEWYDLVGLGVGGMLGAGVFVTTGRVARDTAGPAVFASYVIAGVSALLSSFCYAEFSVRVPAAGGAFSYLRVTFGELVGFFGGANILMEYVLSNAAVARSFTDYLASTCGITEPDAWRIQVDGIAKGYNALDFPAVALILVLTLCLCYSTKESAMLNMVITVFHLLFFVFIILAGLWNGSARNLVSPHGLAPYGVRGVLDGAAIVYFSYIGYDSASTMAEEIRDPARALPVGIAGSVLVVSALYCLMSLALCAMLPYTEIAESAPFSAVFREKAGWEWAGSVVGAGASLGIVASLLVAMLGQARYLCVIARARLVPAWLAKVHPSTGTPMNATIFLDRANGSIKYTNNFTEVKVLTTVSDHENCNAGLCTASIALFTELQVVFEMISIGTLLVFYLVANALIYHRYAKLGANRSLHVLLFLLILTLSSLGFSLSRRIHGQCRWGMALFGATSVTITAMFHCAVRRDMPEPPSEWMVPLMPWPAAASVFLNVFLMTTLKVMSFQRFGLWSFVIIVFYVCYGVHSTYSAEENEAVNAMIHHANMDIS

SEQ ID NO: 58866 - protein, 390 aa, Lactoris fernandeziana
PYEVPMTAGALQSYKLAAKAISRLQSLPSGSMERLVDTVVQEVFELTGYDRIMAYKFHEDDHGEVISEVTKPDLEPYLGLHYPATDIPQASRFLFMKNKVRMICDCRAKPVKVYQDEKLSFDLTLCGSTLKAPHSCHLQYMENMGFIASLVMAVVVNEGEEEVDSQESSQQQAPKRKRLWGLVVCHNTTPRFVPFPLRYACEFLMQVFAIHVNKEFELENQILEKNILRTQTLLCDMLFRDAPMGIVTQSPNIMDLVKCDGAVLLYQNKVYRLGLAPTESQIHDIAQWLSEYHKDSTGLSTDSFHDAGYTRARSLGDIVCGMAAVRINSGDMLFWFRSHTAAEVRWGGAKHDPDEKDDGRRMHPRSSFKAFLEVVKYRSFPWKDYEMDAI

SEQ ID NO: 58867 - protein, 412 aa, Oryza sativa (japonica cultivar-group)
MAEDPAGSRRWRCDAGDEHGCWLSSSAGGGGDDHFDRLPDPLLLVIFNRIGDVKALGRCSLVSRRFHDLVPLVDSVLVRVDCVIPDDPASSSSSSSSPSAAPSSPTASARARTVFSQIARIVLGGIVKPIQALGQILSPANSASVLAASVTSSPSSSSSSSSSSPPLPGDVSHHSPSEVLRSFKELRRLRIELPAGELSMEEGVLLKWKADFGSTLGSCVILGASSAGKDGGAGAAPAVDCGESDETGSIPESFYTNGGLKLRVVWTISSLIAASARHYLLQPIIADHTTLESLDLTDADGQGVLTMDKWQLQELRVKPVSASGGSHRTLMPALSMRLWYAPHIELPGGLVLNGATLVAIKPTEEATRDTVGSGIAGSAGGCWVSDAFEEPYRTAVGMLLKRRTYSLEMNSF

SEQ ID NO: 58868 - protein, 393 aa, Lemna gibba
DLEPVNPSDVPVTAAGALKSYKLAAKAISRLQSLPSGNISLLCDVLVREVKDLTGYDRVMAYKFHEDEHGEVVSECRGSDLEPYLGLHYPATDIPQASRFLFLKNKVRMICDCSAQPVRIIQDKRLSQPLSLCGSTLRAPHGCHAQYMKNMGSIASLVMSVTINDEGVDHGGEEQQKSRKLWGLVVCHHSSPRFIPFPLRYACEFLMQVFAIQVNKEVEIAAQKREKHILKTQTFFCDMLLREAPVGIFTQSPNVMDLVKCDGAALYYRNQFRLLGVTPTEAQIKDLCDWLMDWHNNTTGLSTDSLSEAGFPGASSLGDAVCGMAAIKITGKDFVFWFRSHVAKEIKWGGAKDESVGRSEEGRKLYPRSSFQAFLEIVKRRSLPWEDVEMDAI

SEQ ID NO: 58869 - protein, 373 aa, Zea mays
MVAITAPSSIEQIPLMRCPRANAVQQAGAAVPCVDLSAPGAGAAVADACRSVGFFRATNHGVPARVADALEARAMAFFALPAQEKLDMSGAARPLGYGSKSIGANGDVGWLEYLLLSVSANTVKISSLPPSLRAALEEYTAALREVCGRVLELIAEGLGVERSLLRAMVVGREGSDEVVRVNHYPPCPLLPPVDCGVTGFGEHTDPQIISVLWSNRTAGLQIKLRDGRWVPVPPTPESLFVNVGDSLQVLTNGRLRSVKHRVVAPAPAPDGARSRLSVIYFGGPAPSQRIAPLPQVMRDGEQSLYREFTWAEYKRAMYKTRLADHRLGPFELRASTNGGNRPGEPAAGSADPAHCSGGSACGMPQPQQVARVH

SEQ ID NO: 58870 - protein, 352 aa, uncultured bacterium
IGAANNLLAAMLDNHIQQGNELGIDVKQITWKRAVDMNDRQLRHIVDGLGGKVQGVPREDGFEITVASEIMAVLCLASDLKDLKERLARIIVAYTYDGRPVTAHDLKAEGAMAALLKDAIKPNLVQTLEGTPAFIHGGPFANIAHGCNSVTATRTALKLADYVVTEAGFAADLGAEKFFDIKCRMANLCPSAVVIVATVRALKYHGGVPKADLNNENLTALEKGLPNLLQHVSNIRDVYGLPCVVAINAFPTDTKAELQMVEARCKELGVNVALSEVWAKGGEGGKALAEEVIRLCEQPNRFSFSYPLEMSIEDKLDTICRRIYHADGVALTADAQKQAKQLADLGFGYLPI

SEQ ID NO: 58871 - protein, 1121 aa, Mycobacterium leprae
MPRRTDLNHVLVIGSGPIVIGQACEFDYAGTQACRVLRAEGLQVSLVNSNPATIMTDPEFADHTYVEPITPAFVERVIVQQAERGNRIDALLATLGGQTALNTAVALYENGVLERYGVELIGADFEAIQRGEDRQRFKDLVAKVGGESARSKVCFTMDEVRETVEDLGLPVVVRPSFTMGGLGSGMAHSDEEVGRMAGAGLVASPSANVLIEESVYGWKEFELELMRDGHDSVVVVCSIENVDPMGVHTGDSVTVAPAMTLTDWEYQRMRDLGIAILREVGVDTGGCNIQFAINPHDGRLIVIEMNPRVSRSSALASKATGFPIAKIAVKLAVGYTLDEILNDITKETPACFEPALDYVVVKAPRFAFEKFPGADPTLTTTMKSVGEAMSLGRNFVEALGKVMRSLETGRFGFWTAPDPQGDVDQVLLRLKTPTEGRLYDVELALRLGASTEKVAQVSGIDPWFVAQIGELVKLRDELVAAPVLDAELLRRAKHNGLSDRQITALRPELLGEDGVRSLRKRLGIHPVYKTVDTCAAEFEAKTPYHYSSYELDPAAETEVVPQTEKPKVLILGSGPNRIGQGIEFDYSCVHAAITLSHNGFETVMVNCNPETVSTDYDTADRLYFEPLTFEDVLEVFYAEEQSAAGGAGVAGVIVQLGGQTPLGLAQRLADAGVPIVGTSPEAIDLAEDRGAFGDVLTAAGLPAPKYGTATTFAQARRIAAEIGYPVLVRPSYVLGGRGMEIVYDEETLKDYITRATALSHEHPVLVDRFLEDAVEIDVDALCDGTEVYIGGVMEHIEEAGIHSGDSACALPPVTLGRSDLEKVRQATEAIARGIGVVGLLNVQYALKEDVLYVLEANPRASRTVPFVSKATAIPLAKACARIMLGSSISQLRFEGMLAASGDGGNVASHAPIAVKEAVLPFNRLRRADGAAIDSLLGPEMKSTGEVMGIDHDFGRAFAKSQTAAYGSLPTQGTVFVSVANRDKRLLVFPVKRLADLGFHVIATEGTAEMLRRKGIPCDEVRKHFEPPKAGRPALSAVDAIRAGDVDMVINTPYGNSGPRIDGYEIRSAAVSVNIPCVTTVQGASAAVQGIEAGIRGDIGVRSLQELHSAIGAGIAADNEVQ

SEQ ID NO: 58872 - protein, 104 aa, Oryza sativa
HEGRYGKYKPIVEPAKCQKCGKRNVRQAYHNVCTACSEDLGICAKCCTCVKALVGRDLSEQESERKELEEAIRGARERERRTLLRLVSTYYGMFLMIYLYLIRY

SEQ ID NO: 58873 - protein, 232 aa, Clostridium novyi
SRMSDPKMIKEIIDAVSIPVMAKVRIGHVVEAQILQAIGIDYIDESEVLTPADDLFHINKKEFNVPFVCGARNLGEALRRIGEGACMIRTKGEAGTGNVIEAVRHMRTIQSQIRKLKVMPKEELMIAAKELGAPYDLVEYVRENGKLPVINFAAGGIATPADAALMMQLGCDGVFVGSGIFKSENPAKRAKAIVEAVKNYNNPLKIAEVSEGLGEAMTGLEIDKLDVTFAER

SEQ ID NO: 58874 - protein, 255 aa, Triticum aestivum
RLCTCLPLPSIKSPFSIPISISKSVTMSTTNSGQESEKVNTNIVTLTRFLTEEQAKHPEATGDFTLLCHALQFSFKSIAYYIRRATLVNLTGLAGSSNITGDDQKKLDVISNDLFIEAMRSSGKCALLVSEEEDEIIYFKDASDARYAVACDPIDGSSNLDAGVSVGTIFAIHKLPEGSKGCKEDILKPGTELLAAGFTMYGASAQLVITMRGGTVNGFTLDNGVGEFILSHPNMRLPKSRDIYSCNEGNSLYWG

SEQ ID NO: 58875 - protein, 522 aa, Ipomoea batatas
MAAATIGALSSPYTGGVGERIDGDVSKASFRRLSFASSHLSGDKLMPLPPRRLRSGGKSSEVRTAPFIVSPKAVSDSQNSQTCLDPDASRSVLGIILGGGAGTRLYPLTKKRAKPAVPLGANYRLIDIPVSNCLNSNISKIYVLTQFNSASLNRHLSRAYASNMGGYKNEGFVEVLAAQQSPENPNWFQGTADAVRQYLWLFEEHNVLEFLVLAGDHLYRMDYERFIQAHRETDADITVAALPMDEKRATAFGLMKIDEEGRIIEFAAKPKGEQLKAMKVDTTILGLDDQRAKEMPYIASMGIYVVSKDVMVNLLRQKFPGANDFGSEVIPGATSIGLRVQAYLFDGYWEDIGTIEAFYNANLGITKKPVPDFSFYDRSAPIYTQPRYLPPSKMLDADVTDSVIGEGCVIKNCKIHHSVVGLRSCISEGAIIEDTLLMGADYYETDADRRLLAAKGSVPIGIGRNSHIKRAIIDKNARIGNDVKIINNDNVQEAARETEGYFIKSGIVTIIKDALIPSGTII

SEQ ID NO: 58876 - protein, 523 aa, Ipomoea batatas
MAAAIGAPKLAPYTCAAERNDGSARRAARFKSLSFASSNLSGDKLASLVSRRCSRSGGKSSERRNAPIIVSPKAVSDSQNSQTCLDPDASRSVLGIILGGGAGTRLYPLTKKRAKPAVPLGANYRLIDIPVSNCLNSNVSKIYVLTQFNSASLNRHLSRAYASNMGGYKNEGFVEVLAAQQSPENPNWFQGTADAVRQYLWLFEEHNVLEFLVLAGDHLYRMDYERFIQAHRETDADITVAALPMDEKRATAFGLMKIDEEGRIIEFAEKPKGEQLKAMKVDTTILGLDDQRAKELPFIASMGIYVISKNVMLNLLREKFPGANDFGSEVIPGATSIGMRVQAYLFDGYWEDIGTIEAFYNANLGITKKPVPDFSFYDRSAPIYTQPRYLPPSKMLDADVTDSVIGEGCVIKNCKIHHSVVGLRSCISEGAIIEDSLLMGADYYETDADRRLLAAKGSIPIGIGRNSHIKRAIIDKNARIGDNVKIINSDDVQEAARETDGYFIKSGIVTVIKDALIPSGTVI

SEQ ID NO: 58877 - protein, 303 aa, Vibrio vulnificus YJ016
MKLIVKEIQMDLNSLPALTVLSDCVTIVEKDNVKIVRVIHEKATAGISLFGGHVVSYQPTGKADVIWMSDKAVFDGKTALRGGIPVCWPWFGRIAAPAHGFARTSEWELVEHRENDNGVIVELALFPTEESHNLWPHMFDVRLIVEIGDELKVSLNILNIDDDAFTFSGALHTYLNVGDIEQTQTMGMGSEYIDSLKAGELCNGGEVLQLTDTIDRVYTQPEKEIVVKDPVIERTLCIENQGHNCAVLWNPWAQGAAGMADMSDDGYKTMLCVESTLHADSITQGKTLNPGESHQLITVLSAR

SEQ ID NO: 58878 - protein, 367 aa, Vibrio vulnificus YJ016
MTLNKLSPIITCRCLLDSVILLPVIFNQKLSCGATIMTIKVGINGFGRIGRFVFRAAQERADIEVVGINDLIDVDYMAYMLKYDSTHGRFNGTVEVEGGNLIVNGKTVRVTAERNPEDLKWDAIGVDVVAEATGLFLDDATARKHITAGAKKVVLTGPSKDATPMFVMGVNHTSYAGQDIVSNASCTTNCLAPIAKVLNDKFGIESGLMTTVHATTATQKTVDGPSAKDWRGGRGASQNIIPSSTGAAKAVGVVLPELNGKLTGMAFRVPTANVSVVDLTVNLKNGASYEAICAAMKEASEGELKGVLGYTEDAVVSQDFIGEVQTSVFDAKAGIALTDNFVKVVSWYDNEIGYSNKVLDLIAHISK

SEQ ID NO: 58879 - protein, 618 aa, Alkalilimnicola ehrlichei MLHE-1
MAGLCGWFSTGGGQDGRDIRSRADTLAARRGAGMDSRSNPRAACLVRDGWLAEDDQGRMVALVGHPHWRDGELAELARAQDPAQALLEAWRRHGPGLLDCLAGDFALAVIDTAQGRVLAGVDRMGQQPLHYARIPGGVVFGSTADSVLAHPGLSRTPTPEGLYHYLFFHMLPAPVSLFPDLAKLQGAHCLQAEGGAVEATPYWQPRFQEPDGADGAELGEELRGLLHESVRRRADVDRPGAFLSGGLDSSTVAGMLAGVRPEGADTFSIGFHAEGYDELPYARIAARHFGTRSHEYYVTPEDVVEAVPLIAASYDEPFGNSSALPAYFCARVAAEQGVTRMLAGDGGDELFAGNARYAKQGVFEHWGRLPAPARRALEPLFTRLPRGLPVLGKARSYVEQARIPLPDRLQTYNYLHRLAVEEMLEPDFLGQVDREAPWGLMRSIYQRPQGASALNRMMYLDWQQTLADNDLRKVSRMVQLAGLDVVYPMLDDDLVVFSCRVPSALKLHKGRLRHFYKEALSGFLPAEIIDKKKHGFGLPFGVWMHEHPPLREMAYDSLLRLKGQGFLRPAFIDELIRLHREGHSAYYGDFVWILMMLDLWLEAHPAEGAGRLPRAAQA

SEQ ID NO: 58880 - protein, 517 aa, Ipomoea batatas
MEFCATLKSSAHLPRETEFFGGRIRGSLNNNVLLSQSRKSLRLDGNKRKIKPGVAFSVLTRENGTETLTVEAPILERRRANPKNVAAIILGGGAGTHLFPLTNRAATPAVPLGGCYRLIDIPMSNCINSGVNKIFVLTQFNSASLNRHISRTYFGNGVSFGDGFVEVLAATQTQGETGMKWFQGTADAVRQFTWVFEDAKNKDIDNIVILSGDQLYRMDYMDLVQNHIERNSDITLSCATVGDSRASDFGLVKIDRRGRVVQFCEKPKGTDLKAMQVDTTLLGLPPQDARLNPYIASMGVYVFKTDVLLRLLRWRYPTSNDFGSEILPAAVMEHNVQAYIFRDYWEDIGTIKSFYDANLALTEEFPKFEFYDPKTPFYTSPRFLPPTKIDNCKIKDAIISHGCFLRECTVEHSIIGERSRLDCGVELKDTLMMGADNYETESEIASLLADGKVPIGVGENTKIRNAIIDKNVRIGKDVVITNKDGVQESDRPDEGFYIRSGITIIMEKATIRDGTVI

SEQ ID NO: 58881 - protein, 638 aa, Agrobacterium tumefaciens str. C58
MKKLDLITIGRSSVDLYGSQVGGRLEDMASFAKYIGGSPTNIAAGAARLGLNSAVITRVGDEHMGRFIREQLVREGVDVRGVKTDPERLTALVLLGIRDQNQFPLIFYRENCADMALSEDDIDPAFIADAGCICATGTHLSHPNTEAAVLKALKLARENGAKTALDIDYRPNLWGVAGHGDGESRFVESQKVTAKLQSTLHLFDLIVGTEEEFHIAGGSTDTLTALNAVRKVSNATLVCKRGPMGASVFTGDIPDSLDDGETGEGFPIEVFNVLGAGDGFMAGLFRGWLRGEDWPTTLKYANACGAFAVSRHGCTPAYPSWEELQYFFKAGIRNKALRKDEALEQVHWSTNRKGDWDTMRVFAFDHRMQLEAIADELGVKHEQIGAFKKLCLQAAQKVSGGEAGYGILCDGRLGRDALFAASGSGLWIGRPVEWPGSRPLTLEPDLGKDFGGLSEWPLENVVKVLCFYHPDDTDEMRAAQEETVIRLFEAARRNRLEMLLEVIPSKVGPTDDLTAARIIERFYEIGVYPDWWKLEPMKTTAAWKNACDAVHRNDPYVRGIVVLGLDAPQSELEESFRLAAGFDLVKGFAVGRTIFADAARGWLGGKITDEEAVKDMAQRYTSLCRIWDEARAKKGEAA

SEQ ID NO: 58882 - protein, 145 aa, Arabidopsis thaliana
  misc_feature (104)..(104): Xaa can be any naturally occurring amino acid
  misc_feature (114)..(114): Xaa can be any naturally occurring amino acid
  misc_feature (136)..(136): Xaa can be any naturally occurring amino acid
MASSMLSSATMAASPAQATMVAPFHGLKPSAAFPATRKVNNDITSITRNGGSVHWMHVWPPIAKKKSGTLSYLHDLTDSELPKEDDYLIRNPRIPCAEFELGYXLVSREHGTSXPGHYDVRYWTKGKLPLFGCTDXSAQVLKRAE

SEQ ID NO: 58883 - protein, 251 aa, Glycine max
MGNPRKPSTADELHTAARSGDLIAVNSILASNPLAVNSRDKHSRTPLHLAAFSGQAEVVTYLCKQKADVGASAMDDMAAIHFASQKGHLEVVRALLSAGASLKATTRKGMTSLHYAVQGSHMELVKYLAKKGANLGAKTKAGKTPLDLATNEEIRSFLEDYEKSAKNGELGKKDKDKAEESDPKTSTLGSEGDLSSEPAAAAIDEEDNVGEKRKKGNEDGTREEESSQPKKARVNLSHLQSSDDTQEEENL

SEQ ID NO: 58884 - protein, 450 aa, Streptococcus pyogenes MGAS8232
MVIPYDYIVIGGGSAGIASANRAAMHGAKVLLAEGKEIGGTCVNLGCVPKKVMWYGAQVADILGTYAKDYGFDFKEKAFDFKQLKANRQAYIDRIHASYERSFEQNGVDRIYDYAVFKDAHTVEIAGQLYTAPHILIATGGHPVFPDIEGAQYGISSDGFFALDEVPKRTAVVGAGYIAVELAGVLHALGSKTDLFIRHDRPLRSFDKAIVDVLVEEMTVGGPCLHPHSEVAKVVKNTDESLTLYLKDGQEVEVDQLIWAIGRKPNLEGFGLDKTGVTLNDKGYIETDAYENTSVKGIYAVGDVNGKLALTPVAVAAGRRLSERLFNNKTDEKLDYQNVATVIFSHPVIGSVGLSEEAAVKQYGQEAVKTYQSRFTSMFTAITNHRQPCLMKLVTVGDTEKIVGLHGIGYGVDEMIQGFAVAIKMGATKADFDNTVAIHPTGSEEFVTMR

SEQ ID NO: 58885 - protein, 389 aa, Salmonella typhimurium LT2
MTDTTILQNNTHVIKPKKSVALSGVPAGNTALCTVGKSGNDLHYRGYDILDLAEHCEFEEVAHLLIHGKLPTRDELNAYKSKLKALRGLPANVRTVLEALPAASHPMDVMRTGVSALGCTLPEKEGHTVSGARDIADKLLASLSSILLYWYHYSHNGERIQPETDDDSIGGHFLHLLHGEKPTQSWEKAMHISLVLYAEHEFNASTFTSRVIAGTGSDVYSAIIGAIGALRGPKHGGANEVSLEIQQRYETPDEAEADIRKRVENKEVVIGFGHPVYTIADPRHQVIKRVAKQLSEEGGSLKMYHIADRLETVMWETKKMFPNLDWFSAVSYNMMGVPTEMFTPLFVIARVTGWAAHIIEQRQDNKIIRPSANYTGPEDRPFVSIDDRC

SEQ ID NO: 58886 - protein, 357 aa, Synechococcus sp. WH 7805
MTHHRVVLLPGDGIGPEITAVTRQLLDVVSERHGFQLDFDEQLIGGAAIDATGEPLPSTTLEACRSADAVLMAAIGSPRFDSLPREKRPESGLLALRSGLKLFANLRPVKIVPALIEASSLKPDVIDGVDLMVVRELTGGIYFGQPKGRVEADGEERGFNTMTYSASEVDRIAKVAFELARERGGRLCSVDKANVLDVSQLWRDRVDAMAPSYGDVEVSHLYVDNAAMQLVRAPRQFDVLLTGNLFGDILSDEAAMLTGSIGMLPSASLGSDGPGLFEPVHGSAPDIAGEDKANPMAMVLSAAMMLRIGLKQKAAADALEQAVDRVLAAGFRTGDLMAEGCTQLGCEAMGEELRKVL

SEQ ID NO: 58887 - protein, 391 aa, Magnolia x soulangeana
DFEPVKPYEVPMTAAGALQSYKLAAKAIARLQALSSGSMEKLVDTVVQEVFELTGYDRVMAYKFHEDDHGEVISEITKPGLEPYLGLHYPATDIPQAARFLFMKNKVRMICDCNAKPVKVYQDEKLTFDLTLCGSTLRAPHSCHSQYMENMSSIASLVMAVVINEGVDEEEGMEPAQQEQQQLKRKRLWGLVVCHNTTPRFVPFPLRYACEFLMQVFAIHVNKELELENQIQEKNILRTQTLLCDMLLRDALVGIRTQNPNIMDLVKCDGAALFYNNKIWRLGLTPTDSQMRDISVWLSEYHMDSTGLSTDSLYDAGYPGALALGDVVCGMAAVRINPKDMLFWFRSHTAAEVKWGGAKHDPSDKDDGRRMHPRSSFKAFLEVVKTKSLPW

SEQ ID NO: 58888 - protein, 473 aa, Rickettsiella grylli
MIKISNPNGLVYTISGFAALAGLLFGYDTGIISGAILFIKKDFFLTNFQIECVVSAVLLGALIGSGVSGRVSDLFGRRKILLFTSMTFILGSLITAFSPNLTFLMIGRIVLGLAIGIGSFTAPLYLAEIAPKRIRGLLVSLNQLAITIGIVFSYMINYYFSVSGGWPWMFGLGVIPAIILFLGTLYLPESPRWMILKGWNQKARTVLQYLRHNENITKEFDEICQTVAIEKGTHRQLLAKWLRPILFISLGLSFFQQVTGINAIVYYAPTILQLAGFKYASNAILATLGIGIINVLFTLVALPLIDRWGRRPLLLYGLLGMFISLVSLGLAFYLPGFTQLRWVAVASMILYIASFAMSLGPIMWLIISEIFPLNIRGVGASLAISMSWGFNLLVSLTFLTLIEWIGTSYTFWLYSFLCILGWIFVYFIVPETKNCSLEQIENNLRLGRPSRELGAALRLSSLFEKLKKTVAFF

SEQ ID NO: 58889 - protein, 389 aa, Nelumbo nucifera
PYEVPMTAAGALQSYKLAAKAIARLQALPSGCMDRLCDTVVQEVFELTGYDRVMAYKFHEDDHGEVVSEITKPGLEPYLGLHYPATDIPQAARFLFMKNKVRMICDCRAKHVKVLQDEKLPFDLTLCGSTLRAPHSCHLQYMENMDSIASLVMAVVVNEGDEEGEASGSSQQQKRKKLWGLVVCHNTTPRFVPFPLRYACEFLIQVFAIHVNKEIELENQILEKNILRTQTLLCDMLMRDALLGIISQSPNVMDLVKCDGAALLYKNKIWQLGTTPTEFQIHDIASWLSEYHMDSTGLSTDSFYDAGFPGALSLGDAVCGMAAVRITSKDMLFWFRSHTAAEVRWGGAKHDPDEKDDGRRMHPRSSFKAFLEVVKTRSLPWKDYEMDAI

SEQ ID NO: 58890 - protein, 337 aa, Hyphomonas neptunium ATCC 15444
MKLYTLKTEIDAVPVADDFIAIEAPRPDCPDGGIVARVIYLSLDPYVGSRLRGRHMGEAPPKPMEGAIPGAIVGQVVKSRAAGVSEGDFVHAMEGGWQEFAAIPAGHFRKLDPKSAPLRAHIGVLGMPGLTAWAGITQLAKVMAGDVVLIDAAAGAVGGTAGQIARIKGASKAVGIAGGPEKCRLVTETYGFDACIDYKAEGWQAALKEALPEGASVFFENVSAEMAMTALSVSQTYVRGVLCGLADAYQSSGPAPHALNAGAIIGKRAQLRGLVVYDFYSRWDEYAAEAAAWIRDGKLAFAEDHADGLDQAPALFAKLMRGANVGKPIITVSEEQA

SEQ ID NO: 58891 - protein, 311 aa, Rickettsiella grylli
MSKMKHIGAIGEAMLELSHQTPTLLSLSYAGDTLNFSIYLCRLLQNQAYKVHYITALGQDFYSEAMLLDWKKKGLQTNLICRIENKLPGLYLIRTDNNGERTFYFYRSNSAARDLFKGNNRNDLSRQLIEMDYLYFSGISLAILDEMSRKYLLCIVEKAKQRGATIIFDSNYRPSLWTNPESAKKVTQDFLKFVDIALTTFIDEQLIFGDTNPEACVQRLLKYGITEIVIKCGSDPALVATTEGQQRVPACPVSRIVDTTAAGDSFNSAYLASRFLGFDPIHASLYGHQLAARVITHPGAIIPQSLMPSLF

SEQ ID NO: 58892 - protein, 391 aa, Nelumbo nucifera
DLEPVNPADVPVTAAGALKSYKLAAKSISRLQSLPSGNISLLCDVLVREVSDLTGYDRIMVYKFHEDEHGGVVAECRRPDLESYLGLHYPATDIPQASRFLFMKNKVRMICDCLAPPVKVIHDKKLAQPLSLCASTLRVPHGCHAQYMANMGSIASLVMSVTINDDDNEMESDQPKGRKLWGLVVCHHTSPRFVPFPLRYACEFLVQVFGIQLDKEVELAAQLREKHILKTQTLLCDMLLRNAPVGIFTESPNVMDLVKCDGASLYYKNKFWLLGITPTEAQIRDIAGWLLEHHDGSTGLSTDSLMEAGYPGASVLGDAVCGMAAIKITSKDFLFWFRSHTAKKIKWGGAKHDPVVKDGGRKVHPRSSFKAFLEVVKRRSLPWEDVEMDAI

SEQ ID NO: 58893 - protein, 415 aa, Nymphaea odorata
GKPFYAIVHRVVSGLVMDFEPVKPSELPITAAGALQSYKLAGKAISRLQSLPGGSITRLCDTVVEEVHQLTGYDRVMTYKFHDDDHGEVVSEIRKPDLEPYLGLHYPATDIPQAARFLFMKNKVRMICDCRAKPVKVYQDENLKTDLTLCGSTLRAPHSCHLQYMENMSSIASLVMAVVINEGEDEGEDETDPNQRSQKRKRLWGLVVCHNTSPRFVPFPLRYACEFLAQVFAIHVNKEVELENQNALKKNILRTETLLCDMLLRGSPLGIVSQTPNIMDLVKCDGAAFLYGSKLYLLGRTPAESQIRDIAIWLSEYHKDSTGLSTDSLCEAGYPGALAIGSPVCGMAAVRITANDMLFWFRSHTASEIRWGGAKHDPEEKDDGRRMHPRCSFKAFLEVVKTRSLPWKDFEMDAI

SEQ ID NO: 58894 - protein, 370 aa, Bordetella bronchiseptica RB50
MSEQNRLLLIGGDGVGAEVVHEAGRIAQWFAARRGLPLSIGQAAFGVEVLNRTGRIMTDDTLAQIRAADAVLFGAIGGPEYDRLPLEQVREEGLLRIRRELGLYANLRPVRYWPALAELCPFVPERVEKVDMMIVRELAGGIYYASPRGIDQTGDGRRVGTNTQRYDDLEIRRIARVAFELARARGGRVCSVDKSNVLESGLLWREEVQACRDAEYPDVELEHILVDNCALQLCLRPARFDVLLADNLFGDILSDAAGAVAGSLGMLPSASFGAEDGGRRRGFYEPVHGSAPDIAGQGIANPLGAILSLALALRWTFRQPAEADLLERAVERALAGGARTLDLLAGAAAPALSTRAMADAVLQALETLAA

SEQ ID NO: 58895 - protein, 407 aa, Nymphaea alba
PFYGILHRIDVGLVIDLEPVNPTDVPVTAAGALKSYKLAAKAISRLQALPSGNIGLLCDVLVREVSELTGYDRVMAYKFHEDHHGEVIAECKKPDLEPYLGLHYPATDIPQASRFLFMKNKVRMICDCTAPSVKVIQDKQLEAAVELCGSTLRSPHGCHAQYMVNMGSIASLVMSVVIMNHDEEPANDNPQKGSKLWGLVVCHHTSPRFIPFPLRYACEFLIQVFAVQLNKEVELAAQLREKHILRTQTVLCDMLLRDAPVGIVTPSPNVMDLVKCDGAALYYGKQFWLLGTTPTETQVRDIAGWLYECHGGSTGLSTDSLMEAGYSGAVALGDAACGMAAVKITYRDFLFWFRSHTAKEIKWGGAKHDTVDKDAGKRMHPRSSFKTFLEVVKHRSHPWENAEMDAI

SEQ ID NO: 58896 - protein, 334 aa, Pseudomonas aeruginosa PAO1
MTSQINRQYQLAQRPSGLPGRDTFSFVETPLGEPAEGQILVKNEYLSLDPAMRGWMNDARSYIPPVGIGEVMRALGVGKVLVSKHPGFQAGDYVNGALGVQDYFIGEPKGFYKVDPSRAPLPRYLSALGMTGMTAYFALLDVGQPKNGETVVISGAAGAVGSVAGQIARLKGCRVVGIAGGAEKCRFLVEELGFDGAIDYKNEDLAAGLKRECPKGIDVFFDNVGGEILDTVLTRIAFKARIVLCGAISQYNNKEAVRGPANYLSLLVNRARMEGMVVMDYAQRFPEGLKEMATWLAEGKLQSREDIVEGLETFPETLLKLFSGENFGKLVLKV

SEQ ID NO: 58897 - protein, 1115 aa, Gibberella moniliformis
MSATALFTRRSVSTSNPELRPIPGPKPLPLLGNLFDFDFDNLTKSLGELGKIHGPIYSITFGASTEIMVTSREIAQELCDETRFCKLPGGALDVMKAVVGDGLFTAETSNPKWAIAHRIITPLFGAMRIRGMFDDMKDICEQMCLRWARFGPDEPLNVCDNMTKLTLDTIALCTIDYRFNSFYRENGAAHPFAEAVVDVMTESFDQSNLPDFVNNYVRFRAMAKFKRQAAELRRQTEELIAARRQNPVDRDDLLNAMLSAKDPKTGEGLSPESIVDNLLTFLIAGHETTSSLLSFCFYYLLENPHVLRRVQQEVDTVVGSDTITVDHLSSMPYLEAVLRETLRLRDPGPGFYVKPLKDEVVAGKYAVNKDQPLFIVFDSVHRDQSTYGADADEFRPERMLKDGFDKLPPCAWKPFGNGVRACVGRPFAMQQAILAVAMVLHKFDLVKDESYTLKYHVTMTVRPVGFTMKVRLRQGQRATDLAMGLHRGHSQEASAAASPSRASLKRLSSDVNGDDTDHKSQIAVLYASNSGSCEALAYRLAAEATERGFGIRAVDVVNNAIDRIPVGSPVILITASYNGEPADDAQEFVPWLKSLESGRLNGVKFAVFGNGHRDWANTLFAVPRLIDSELARCGAERVSLMGVSDTCDSSDPFSDFERWIDEKLFPELETPHGPGGVKNGDRAVPRQELQVSLGQPPRITMRKGYVRAIVTEARSLSSPGVPEKRHLELLLPKDFNYKAGDHVYILPRNSPRDVVRALSYFGLGEDTLITIRNTARKLSLGLPLDTPITATDLLGAYVELGRTASLKNLWTLVDAAGHGSRAALLSLTEPERFRAEVQDRHVSILDLLERFPDIDLSLSCFLPMLAQIRPRAYSFSSAPDWKPGHATLTYTVVDFATPATQGINGSSKSKAVGDGTAVVQRQGLASSYLSSLGPGTSLYVSLHRASPYFCLQKSTSLPVIMVGAGTGLAPFRAFLQERRMAAEGAKQRFGPALLFFGCRGPRLDSLYSVELEAYETIGLVQVRRAYSRDPSAQDAQGCKYVTDRLGKCRDEVARLWMDGAQVLVCGGKKMANDVLEVLGPMLLEIDQKRGETTAKTVVEWRARLDKSRYVEEVYV

SEQ ID NO: 58898 - protein, 1102 aa, Oryza sativa
MAATAAALAVTDELALPLRAVGDLAAAAGFSREEVVVITQCASLGGKLPFDDASVGSVLAVIKKVENLGDLFITEISRVLKAGGMVLIQSSPSDQDPNNSIQRKLLLGGFVDVQASAASSQDSEHSVTIKAKKVSWSMGSSFPLKKATKGLPKIQIDDDSELIDEDSLLTEDDLKKPELPVVGDCEVGATRKACKNCTCGRAEAEEKVEKLNLTSEQINNPQSACGNCGLGDAFRCGTCPYRGLPAFKPGEKVMTSLPDRGVSSSSSDPLCEGNIAPCSSSSEQKEDCSLKQSKTSILSCVFNSPFNIFEAHQDSSANKSPKSSSGSYDWSRVLRRIVCSGSMWRFLGTSKVLTSSDVWFLGKCYKLSSEESSSDSDSESGHATFLEDFSSRIWITYRRGFDAISDSKYTSDVNWGCMVRSSQMLVAQALIFHHLGRSWRRPLEKPYNPEYIGILHMFGDSEACAFSIHNLLQAGNSYGLAAGSWVGPYAMCRAWQTLVRTNREQHEVVDGNESFPMALYVVSGDEDGERGGAPVVCIDVAAQLCCDFNKGQSTWSPILLLVPLVLGLDKINPRYIPLLKETFTFPQSLGILGGKPGTSTYIAGVQDDRALYLDPHEVQMAVDIAADNIEADTSSYHCSTVRDLALDLIDPSLAIGFYCRDKDDFDDFCSRATELVDKANGAPLFTVVQSVQPSKQMYNQDDVLGISGDGNINVEDLDASGTDAGGVGVTYGMRGTTMPPPADVARFLSRDTIFDRVRLLDADPRALRAFAGTGLAVDVTVPNADVPRLAASRASARRWVRASVAPYAEATNVSRVLVGDEVISQANRTLLLSLVPAMRNLHAALAAVLPPSPRRREIIKVSTPHSLGILAASTPPSAGRFHDGYDTAVVKPLLGFLRATGAPFMVNAYPFYGGLTNETLDYVLFRGLQQERHPPPRLPRGTPLMPNRTFELSIFSLFDENLKPGPVSERNFGLYHADMTPVYDAGILTAPQEIVGTKVTPAPAPALAPAEDGRRRWCVPKPAADEVALQVNIDFVCGQGGIDCGAIRAGGSCYDPNNVQAHAAFAMNLYFQSNGQHEFDCDFGQTGVITTVDPSYKSCKFT

SEQ ID NO: 58899 - protein, 394 aa, Sagittaria sp. Mathews 383
PYEVPMTAAGALQSYKLAAKAISRLQSLPGGSMQKLCDTVVQEVFELTGYDRVMAYKFHEDDHGEVVSEVTKPGLDPYLGLHYPATDIPQAARFLFMKNKVRMICDCRAKPVKVYQDEKLAFDLTFCGSTLRAPHSCHLQYMENMDSIASLVMAVIVNEGDEEDEVLGSRAQQQQQQQQRRKRLWGLVVCHNRTPRFIPFPLRYACEFLMQVFAIHVNKEFELENQMREKNILRTQTLLCDMLFRDALLGIISQNPNIMDLVRCDGAALVYQSKIWRLGMAPTESQICDIAAWLSEYHMDSTGLSTDSLHDAGYPGVLALGDSVCGMAAARITSKDILFWFRSHTAAEIRWGGAKHDPADEDDGRRMHPRSSFKAFLEVVKTRSMPWKDYEMDA

SEQ ID NO: 58900 - protein, 657 aa, Erwinia chrysanthemi
MGELLAGRPRPLGSHFDGEGVNFALFSSGASRVELCIFDGLREQRLPLTARTGDIWHGYLPDAQPGLCYGYRVDGAFDPSRGQRFNANKLLLDPCARQMDGWVVDDQRLHGGYHQPDPSDSAEVMPPSVVVDEHYDWQGDRLPRTPWSQTVLYEAHVRGLTRRHPGIPAAIRGTYAALAHPVMLDYLTQLGVTALELMPVQQHADEPRLQSMGLRNYWGYNTLLPFAVDNSLAASDDPLNEFRDTVRALHQAGIEVILDVVFNHSAELDVDGPTLTLRGIDNASYYWLTENGDYHNWAGCGNVLRLEHPAVLHWVIECLTFWHEVCHVDGFRFDLATILGRLPDFSSSAPFFTALRNHRSLRDCKLIAEPWDISPGGYQLGQFPAPFAEWNDRFRDDMRRFWLHGDLPIGVLARRFAASSEVFERGSRQPWASVNMLTSHDGFTLRDLVCFNHKHNDANGEQNRDGTNSNFSFNHGTEGLEADETTQARRRVSQQALLTTLLLSQGTPMLLAGDEFGNSQQGNNNAYCQDNALAWLHWDQADDALLAFTSGLIRLRRSIPALQRGRWWRDDDEDDVRWLNAQGEALTPYEWEQGTHQLQIQLSERWLLLVNATPQVSDFSLPEGEWRVAPPFSATDHLLDGQTWRGQANAVCVLVKQ

SEQ ID NO: 58901 - protein, 397 aa, Sagittaria sp. Mathews 383
DLEPVNLSDVPVTAAGALKSYKLAAKAISRLQSLSSGNISLLCDVLVREVRDLTGYGRVMAYKFHEDEHGEVISESRRSDLEPYLGLHYPATDIPQASRFIFMKNKLRMICDCTAQPVKVIQDKKFTQPLSLCGSTLRAPHGCHAQYMANMGSIASLVMSATISDEDEDDASSGQQRKRRKLWGLVVCHLTSPRFVPFPIRYACEFFMQVFAIQLNKEVELAAQTMEKYIFRTQTFLCDMLLRDAPVGIFTQSPNAMDIVKCDDAALYYKNQFWLLGITPAEGQIRGIAGWLRDCHNTTTGLSTDSLTAFSEAGYRGASTLGDAVCGMTAIKFTSRDFIFWFRSHTAKEIKWRGAKHDPVDKDDDGRKMHPRSSLKAFLDVVKRRSLPWEDVEMDAI

SEQ ID NO: 58902 - protein, 250 aa, Brassica napus
MASPSPPFPISLHATLHQTTTARSTPLKFSSTRVLTRPIKASTSETPPDLAVETRTGSGSKDLPIRTIPGSYGLPIIGPLKDRNDYFHKQKPEEFFKSRIRKYNSTVFRVNMPPGGFIADNPQVVALLDGKSFPVLFDVDKVEKKDLFTGTYMPSTELTGGYRILSYLDPSEPNHAKLKSLLFHLLKSSRNRIFPEFKATYSELFDSIEKELAVNGKADFGGPGDAAAFNSLARAMYGKNPADTKLGSDA

SEQ ID NO: 58903 - protein, 249 aa, Triticum aestivum
RPGRALSPGSYPPLPHSPISRASSRSARTPVQTQERQPWLRRRPSARSTSSWWARASLAAVRRTRRRPGARACSCSSASTCCTSAARRTASPAPPAPPTRGRSTLPWSGFYGTPSMEYPGLIKVCRNGGPPCDPDGRDWATGTGAGGIAEIVARWIDEFMPGVVDTAGGPVLRQPCMCCMTPDEDFVIDFLGGEEFGKDVVIGAGFSGHGFKMGPAVGKILAELALDGESGTAAEAGLELEHYLIGRFE

SEQ ID NO: 58904 - protein, 94 aa, Cannabis sativa
RPLSAVPLVALAGFGLYELGCPGVAKCVEIGLPQLVLLVFVSQYLPHLFHSGKHIFDRFAVLFTVVIVWIYAHLLTVGGAYNDSAPKTQMSCRT

SEQ ID NO: 58905 - protein, 515 aa, Ipomoea batatas
MDAYCATLKSTTHLPRESELWGKRMLKNRVLVKQFGKSLKLERNGRKIKPGVAFSVLTRETGKETLTVEAPRLERVRANPKNVAAIILGGGAGTQLFPLTNRAATPAVPVGGCYRMIDIPMSNCINSGINKIFVLTQFNSASLNRHIARTYFGNGVSFGDGFVEVLAATQTSGETGMKWFQGPADAVRKFTWVFEDAKNKDIENILILSGDQLYRMDYMDLVQNHLDRNSDITLSCAPVGDSRAVDFGLVKIDHRGKVVQFQEKPKGADLEAMQVDTTRLGLSPEDAKRNPYIASMGLYVFRRDLLLNLLRWIYPTANDFGSEIIPAVITEHNVQAYFFKDYWEDIGTIKTFYNANLALAEEFPKFEFYDPKTPFYTSPRFLPPTKIDNCKIKDAIISHGCFLRECIVEHSIVGERSRLDFGVELKDTLMMGADYYETESEIASLLADGKVPIGIGHNTKISNCIIDKNVRIGKDVIIANKDGVEEADRPEEGFYIRSGIPVIMEKAVIKDGTVI

SEQ ID NO: 58906 - protein, 104 aa, Zea mays
  misc_feature (21)..(21): Xaa can be any naturally occurring amino acid
  misc_feature (54)..(54): Xaa can be any naturally occurring amino acid
MTGRVKRAKGMGKAGAKRHRXVLRDNIHGITKAKIRRMDQAGAAVKRISGLIYXETRGGLKIFLENDIRERATYTEHARRKTVTAKDVVYALKRQGRTLYGIDG

SEQ ID NO: 58907 - protein, 800 aa, Staphylococcus aureus subsp. aureus COL
MLISNEWLKEYVTIDDSVSNLAERITRTGIEVDDLIDYTKDIKNLVVGFVKSKEKHPDADKLNVCQVDIGEDEPVQIVCGAPNVDAGQYVIVAKVGGRLPGGIKIKRAKLRGERSEGMICSLQEIGISSNYIPKSFESGIYVFSEAQVPGTDALQALYLDDQVMEFDLTPNRADALSMIGTAYEVAALYNTKMTKPETTSNELDLSANDELTVTIENEDKVPYYSARVVHDVTIEPSPIWMQARLIKAGIRPINNVVDISNYVLLEYGQPLHMFDQDAIGSQQIVVRQANEGEKMTTLDDTERELLTSDIVITNGQTPIALAGVMGGDFSEVKEQTSNIVIEGAIFDPVSIRHTSRRLNLRSESSSRFEKGIATEFVDEAVDRACYLLQTYANGKVLKDRVSSGELGAFITPIDITADKINRTIGFDLSQNDIVTIFNQLGFDTEINDDVITVLVPSRRKDITIKEDLIEEVARIYGYDDIPSTLPVFDKVTSGQLTDRQYKTRMVKEVLEGAGLDQAITYSLVSKEDATAFSMQQRQTIDLLMPMSEAHASLRQSLLPHLIEAASYNVARKNKDVKLFEIGNVFFANGEGELPDQVEYLSGILTGDYVVNQWQGKKETVDFYLAKGVVDRVSEKLNLEFSYRRADIDGLHPGRTAEILLENKVVGFIGELHPILAADNDLKRTYVFELNFDALMAVSVGYINYQPIPRFPGMSRDIALEVDQNIPAADLLSTIHAHGGNILKDTLVFDVYQGEHLEKGKKSIAIRLNYLDTEETLTDERVSKVQAEIEAALIEQGAVIR

SEQ ID NO: 58908 - protein, 518 aa, Ipomoea batatas
MDALCASMRAHPVPVSKGFGYGDSGLWGEKIRGCSRIKTERHEGMPKKVNLGVACSILTHDINQEHLSFETQHFEEHSQGDPRNVASIVLGGGAGTRLFPLTRSRAKPAVPIGGCYRLIDVPMSNCINSGIRKIFILTQFNSFSLNRHLARAYGIGNGVNFGDGFVEVLAATQTPGEAGKMWFQGTADAVRQFIWVFEDAKNKNIDNILILSGDHLYRMDYMDFVQRHIDTNADITVSCVPMDDSRASDYGLMKIDGSGRIVHFAEKPKGPALKTMQVDTSLLGLSENEAKKYPYIASMGVYVFRTEVLLNLLRSQYPSCNDFGSEIIPAAVKDHNVQAYLFSDYWEDIGTVKSFFDANLALTEQPPMFDFNDPKTPFYTSPRFLPPTKVDKCKIVDAIISHGCFLRECSVKHSIVGIRSRLDYGVELEDTMVMGADYYQTESEIASLLATGKVPIGIGTNTKIRNCIIDKNARIGKDVVIANKDGVDEADRADEGFYIRSGITIVLKNATIRDGTVI

SEQ ID NO: 58909 - protein, 525 aa, Ipomoea batatas
MAVTADGRIALLAARQLREGAAMTVSSCRLSVKFCNGEFMGKKIKLRKFQQRNGTKYNVVARPRVSMSLTTDVAGEAKLKDYGMEKTDPRTVVAIILGGGAGTRLFPLTKRRAKPAVPIGGAYRLIDVPMSNCINSGINKVYILTQFNSASLNRHLARAYNFGSGVTFGDGYVEVLAATQTPGEAGKRWFQGTADAVRQFHWLFEDPRSKDIEDVLILSGDHLYRMDYMDFVQSHRQSGADITISSLPIDDRRASDFGLMKIDDKGRVLFFSEKPKGDDLKAMAVDTSVLGLSPEEAKQKPYIASMGVYVFKKEILLNLLRWRFPTANDFGSEIIPASAREFYIQAYLFNDYWEDIGTIRSFFEANLALTEHPPRFSFYDATKPIYTSRRNLPPSAITNSKIVDSIISHGSFLSDCFVEHSVVGIRSRINSNVHLKDTVMLGADFYETGSEIASLLTEGGVPIGIGENSRIKECIIDKNARIGKNVVIANSEGIQEADRTSEGFYIRSGVTVIFKNSTIPDGLVI

SEQ ID NO: 58910 - protein, 506 aa, Coprinopsis cinerea okayama7#130
MSFRSSRGSSSSSSGSSSASSTVPKSKSKSRSNVSSLSNDKCYTPLPIPLSSPYDDDPRRDLTPTEQELYDQVVAHFTRPGYCLPEWEDSLEEGAGGGGGGKAKDGAGEGQLSEKEKFWLSRDCLLRYLRASKWNTHVAAQKLESTLKWRREYGLYDTLTASAIEHEAVTGKHVYFGYDVEGRPAFYAFPSRQNTDSIDGHLKFAFWMVERGIELMGPGVETLTHRIPHHQKKRTLHILLNFAERASKPSISEATSLIHIMQEHYPERLGLCSIINIPFFINAFLKLVLPFLDPRTRGKLRFNQRVVGEEEQEEGVGKEKKGKDKDKVSEKDKTKEGSGGGGLFKRDMLMKEWEGDRVFEYVHEKYWPALLEMCEKNVQKWMRRWRELGGTVGISEWDYKHEAGELGAGASTTASGKVSENGAANQISGNGSANQESANGSVNQQPSTNGHPIANGNHGDAATSDPPPKEAKPSASSPESKMTSDSLSSSTTLPTACPVVEAPKSN

SEQ ID NO: 58911 - protein, 619 aa, Candida tropicalis
MSEQNQGQPDQQHSGDHQHHHHHHHHHHHSQQPAQPIPIDPNVNPANRIGRYQIIKTLGEGSFGKVKLAQHVGTGQKVALKIINRKTLAKSDMQGRVEREISYLRLLRHPHIIKLYDVIKSKDEIIMVIEFAGKELFDYIVQRGKMPEDEARRFFQQIIAAVEYCHRHKIVHRDLKPENLLLDDQLNVKIADFGLSNIMTDGNFLKTSCGSPNYAAPEVISGKLYAGPEVDVWSSGVILYVMLCGRLPFDDEFIPALFKKISNGVYTLPNYLSPGAKHLLTRMLVVNPLNRITIHEIMEDEWFKQDMPDYLLPPDLSKIKTSKIDIDEDVISALSVTMGYDRDEIISVIEKANREAAAGGATPTNQSKSTNEVLDAYLLMKENHTLVKDLKKSKSENIESFLSLSPPPSSSFPNPGSTSSAPGVQQSLTYQTLATVPDLSTLPNSTIAILPTSLPSIHRAYMMETKVNDPQQQIPAPQPTKKLKTRWHFGIRSRSYPLDVMGEIYRALKNLGAEWAKPTEEELWTIRVRWKYDSTPQLRVWQRTNLMKMQIQLFQLEPNNYLVDFKFDGWEQTSDESKNDASLDYKQQDLDEVGSFSAYPFLHLATRLIMELAVNSQSG

SEQ ID NO: 58912 - protein, 536 aa, Escherichia coli
MVSAPVDGAISGLSVQNGIAIGPVKWFTCERPEITQRTVDSPQEELSRIESAIDIVVCELADKAAGPEGDIFAAHKMMLEDPEINRQLQQRLAKGKQAEFAWLEVMQALAEQYCQAETLYLREREADIRDLTRQVLNQLCGVSEQHFITTAPCILLANDLLPSQITSLNKAHILGICLHNGGTTSHTAILARAMGIPAIVKAAITPQNVRDNDTVILDGETGRLWLQPDEVTRLDLLQRAEAWRQQRDRQLADAMLPAVTQGGRKISVLANIGDLQDIEAALSHGAEGVGLLRTEFLFHESATLPDEEEQFRVYCSVAQAFGDKPVTIRTLDIGGDKPLPSYPLPAEDNPFLGLRGIRLCLAHPQIFIPQLRALLRAGKEYPTLQIMLPMVSTLEEVNAVKTLIQTQAKLLGLTAENLPALGIMIEVPAAVMVAEKLASEVDFFSIGTNDLTQYIMAADRGNSTVAKLVDYRNDAVINAIAMVCQAGRNNEIPVSMCGEMAGDTQQTARLLTMGIDKLSASPSRLPALKAAIRASH

SEQ ID NO: 58913 - protein, 549 aa, Candida glabrata CBS 138
MSEESQSAFSASNSKVEREEDFKAYADEDGQPMVEIPKKPASAYTLIFILCLFIAFGGFVFGWDTGTISGFVAEEDFIKRLGQRRANNTYYLSKVRTGLIVSIFNIGCAIGGVVLSKFGDMYGRKIGLIIVIVVYIVGIVIQIATIDKWYQYFIGRIVSGLGVGGIAVLSPMLISEVSPKHMRGTLVSCYQLMVTCGIFLGYCTNYGTKNYPNSVQWRVPLGLCFAWALFMIGGMLCVPESPRYLVEVGKFEEARRSIAISNKLTPEDPAVTFELENVQAGVEAERLAGSASWGELFSTKTKVLQRLIMGIMLQCLQQLTGDNYFFYYGTTVFKAVGLEDSFQTSIVIGIVNFASTFVALYVVDRFGRRKCLLWGAASMTACMVVFASVGVTRLYPNGMDQPSSKGAGNCMIVFTCFYIFCFATTWAPTPWVINSETFPLRVKAKCMAICQAANWIWGFLIAFFTPFITGAINFYYGYVFMGCLCFSYFYVFFFIPETKGLTLEEVNTMWEEGVLPWKSPDWIPPSKRDATYDADAMMHDDKPWYRRMW

SEQ ID NO: 58914 - protein, 156 aa, Triticum aestivum
  misc_feature (101)..(101): Xaa can be any naturally occurring amino acid
  misc_feature (126)..(126): Xaa can be any naturally occurring amino acid
  misc_feature (145)..(145): Xaa can be any naturally occurring amino acid
MAFRGRGRGTGANFSGGGSRGGGGFGARGGRGGFGRDNGPPSEVLEMGSFLHSCEGEMVCESINTKIPYFNAPIFLQNKTSIGKVDEILGPINSLYFTIKXSEGIQPTSFKSGDKFYIGNDKLLPXEKFLPKPKPPPGAPKPKRXPGERGGPCSSL

SEQ ID NO: 58915 - protein, 392 aa, Saruma henryi
PYEVPMTAAGALQSYKLAAKAISRLQSVPSGCLDRLIDTVVQEVYELTGYDRVMAYKFHEDDHGEVISEVTKPDLEPYLGLHYPATDIPQAARFLFMKNKVRMICDCRAKSVKVYQDEHLSFDLTLCGSTLRAPHSCHLQYMGNMSSIASLVMAVVINEGEEDDDGPDSTQQQAQPKRKRLWGLVVCHNTTPRFVPFPLRYACEFLMQVFAIHVNKELELENQIREKNILRTQTLLCDMLLRDAPLGIVTQSPNIMDLIKCDGAALLYENKVYRLGVTPTESQLHEIVQWLSEHHMDSTGLSTDSLHEAGYPKALSLGDIVCGMAAVRITTHDMLFWFRSHTAAEVKWGGAKHDPSDKDDGRRMHPRSSFKAFLEVVKTRSLPWKDYEMDAI

SEQ ID NO: 58916 - protein, 218 aa, Panax ginseng
MADEVVHHPLDKSSEVETTDRGLFDFLGAKKDEGKSAPADYQQQEEIATEFEQKVHVSETEPKFEESKVEEEEEEKKPSLLDKLHRSGSSSSSSSSDEEEVEEGGEKKKKKKKSLKEKIHKEEDTSVPVEKIEETVVVEQEEKKGFLDKIKEKLPGGGHKKAEDQEFPSPAPPAAVESYATVEGEPAKEKKGILEKIKEKIPGYHSKTSDEDKKEEKE

SEQ ID NO: 58917 - protein, 337 aa, Hyphomonas neptunium ATCC 15444
MTLAPKPKSKAQLSSITERMQALVADDLAAVERLLATRAASPVAVIPDLSGYIVSAGGKRLRPMITLIAAHAVGKANAATHALAAAVEFIHTATLLHDDVVDESDLRRGKPAAKAIWGNKAAILVGDFLFARAFNLLVEANSLDILNRLATASTVIAEGEVRQLAAMATRDLPTEEYLAIVEAKTGALFEAAAETGAMSAGGEEYSDALATYGKNLGLAFQIIDDALDYGGTTSVIGKSVGDDFREGKITLPVIIARRRGSDEDRAFWDRALNPETQEDSDLAHAVHLIRATGAAEATVQEAEAYAALAKGALRTLPASTYRDALEDLADFCVSRAY

SEQ ID NO: 58918 - protein, 391 aa, Saruma henryi
DLEPVNPDDVPVTAAGALKSYKLAAKAISRLQSLPSGNISLLCDVVVREVSDLTGYDRVMAYKFHEDEHGEVIAECKRSDLEPYHGLHFPASDIPQASRFLFMKNKVRMICDCSAPPVKVIQDKRLAQPISLGGSTLRAPHGCHAQYMANMGSIASLVLSVTISEDDDETCSKQKGRKLWGLVVCHHTSPRFIPFPLRYACEFLIQVFGIQLNKEVELAAQMRETHILRTQTMLCDMLLRDAPMTIVTQSPNVMDLVKCDGAALYYRKESWLLGVTPTKAQIQDLAEWLLKDHNGTTGLSTDSLVEAGYPRAHNLGDMVCGMAAVRITNQDFLFWFRSHTAKEVKWGGAKHDPADKDDDRGKMHPRSSFKAFLEVVKRRSLPWEDVEMDAI

SEQ ID NO: 58919 - protein, 414 aa, Saururus cernuus
SGKPFYAIVHRVTGSLIIDFEPVKPFEVPMTAAGALQSYKLAAKAISRLQSLPSGSMERLVDTVVQEVFELTGYDRVMAYKFHEDDHGEVISEVTIPHLEPYIGLHYSATDIPQAARFLFMKNKVRMICDCHAKPVKVYQDDKLSFDLTLCGSTLRAPHSCHLQYMENMGSIASLVMAVVVNEGGDEDKGPDSSQQLGDNRRKRLWGLVVCHNTRPRFVPFPLRYACEFLTQVFAIHVSKELELERQIREKNILRTQTLLCDMLLRDAPMGIVNQSPNIMDLIKCDGAALFYKDKVFRLGNAPSETDIRDIAQWLFAHHMDSTGLSTDSLHDAGYPKAAFLGNLVCGMAAVKITCSDMLFWFRTHTAAEIRWGGAKHDHSERDDGKRMHPRSSFKAFLEVVKTRSLPWKDYEMD

SEQ ID NO: 58920 - protein, 179 aa, Silicibacter pomeroyi DSS-3
MSRTKSVQDYIRTIVDFPHEGILFRDVTTLFADPRGFRIAIDQMLHPYAGERIDKVVGLEARGFILGGAIAHQLSVGFVPIRKKGKLPGTTISQDYKLEYGEAIVEIHDDAIQPGEKILLVDDLLATGGTAAAGIKLVERLGGEIVSCAFIIDLPDLGGRKVLESMGMDVHALCAFDGL

SEQ ID NO: 58921 - protein, 679 aa, Kluyveromyces lactis NRRL Y-1140
MSQYTDIDRLAVSTIRLLAVDQVSAANSGHPGAPLGLAPAAHVIWKQMRLNPKNPEWINRDRFVLSNGHACALLYSLLHLFGYDMSIEDLKHFRHLGSKTPGHPEFELPGVEVTTGPLGQGISNAVGMAIAQANFAATYNKPDYELSDSYTYVFLGDGCLQEGVSSEASSLAGHLRLKNLIAFYDDNQITIDGNINVSFDEDVSKRYEAYGWEVLHVENGNDDLDAISKALEQAKLSDRPTLIKLTTTIGFGSLNAGSHSVHGAPLKADDVKQLKVKFGFNPEESFVVPQEVYDLYNKSTIEPGIEANKQWDALLDAYVGQFPELGAEVKRRLAGEFPEGWESKLPTYTPEDSAVASRKLSEIVLDNVFDTLPELLGGSADLTPSNLTRSKGAVDFQPPITGLGDYSGRYIRYGVREHGMGAIMNGISAFGANYRPYGGTFLNFVSYASGAVRLSALSGHPVIWVATHDSIGLGEDGPTHQPIETLAHFRAIPNLQVWRPADGNEVTAAYKVALTNKHTPAIIALSRQNLPQLQGSSVEKAVKGGYILQDVDQPDLAIVSTGSEVGIAVEAAKVLAEKNIKARIVSLPDFHSFGQQSKEYQLSVFPDGVPILSVEVLATSGWSKYAHQSFGLDRFGASGKGPAVYEKFEFTPQGIATRAEKTVEFYKGKQVISPLNTAF

SEQ ID NO: 58922 - protein, 174 aa, Panax ginseng
MADNYGYGYGQQHHGGRQTDAYGNPIPQTNAYGNPVRQTDDYGNPVHHTTTGAATMGDYSTAGTVGAYGTGTPTGGFGAPNVTGTGTHEQFHLRRSGSSSSSSSEDDGMGRRRKKKGIKEKIKEKLPGGTGHKDTSTTTPGGYGYGSAAGGGEAHGHEKKGMMEKIKEKLPGHH

SEQ ID NO: 58923 - protein, 391 aa, Saururus cernuus
DLEPVNPSDVPVTAAGALKSYKLAAKAISRLQSLPSGNISLLCDVLVREVSDLTGYDRVMAYKFHEDEHGEVVSECKRADLEPYLGLHYPATDIPQASRFLFMKNKVRMICDCLAQPVKVIQDKRLAQPLSLAGSTLRAPHGCHAQYMANMGSIASLVMSVMVSEGDDDSNEEKTGRKLWGLVVCHHTSPRFIPFPLRYACEFLIQVFAIQLSKEVELAAQMREKHILRMQTVLCDMLLRDAPMGIMTQSPNVMDLVKCDGAALYYRYQCCLLGTTPTENQIRDITEWLLQYHNSSTGLSTDSLVEAGYPGAHELSDAVCGMAAIRITSKDFLFWFRSHTAKEIKWGGEKHDPLDKDAFESKMNPRTSFKTFLEVVKRRSLPWEDVEMDAI

SEQ ID NO: 58924 - protein, 401 aa, Trochodendron aralioides
GKPFYAIVHRVTGSLIIDFEPVKPYEVPMTAAGALQSYKLAAKAIARLQSLPSGSIERLCDTLVQELFELTGYDRAMVYKFHEDDHGEVVSEITKPGLEPYLGLHYPATDIPQAARFLFMKNKVRMICDCRAKNVKVLQDEKLPFDLTLCGSTLRAPHSCHLQYMENMNSIASLVMAVVVQEGDEQARALVPHSLRRRKRLWGLLVCHHSTPRFVPFPLRYACEFLAQVFAIHVNKELELENQILEKNILRTQTLLCDMLMRDAPLGIVSQSPNIMDLVKCDGAVLLYKNRTWRFGSTPSELQIHDIALWLSEYHMDSTGLSTDSLYDAGFPGALTLGDGVCGMAAVRITSKDMLFWFRSHTAAEVRWGGAKHEPGEKDDGRRMHPRSSFKAFLEVVKSRS

SEQ ID NO: 58925 - protein, 411 aa, Oryza sativa (indica cultivar-group)
MAVAAKGEEMTPEHEEEVIIVGAGQSGLAAAACLSVRGVASCLVLERDDCVASLWRHRAYDRLRLHLPKRHCALPRAPHAAAAPDYLPRDDFAAYLDAYASRFGVRTRLRREVRSARHDAARARWLVDAVDLATGKAERYAARHLVAAAGENDERVVPEVPGMDTFPGKVVHSADYRSAGAFKGRSVLVVGCGNSGFEIAYDLAAGGAAAVSIAVRGEVHLVSREVWSVGMALQRYLPTWAVDKVVLLMCAVVFGGDTARYGLRRPAVGPFAMKMTTPAYPVFDVGTFAKIRSGEIRVVPAGIKSVRGGDVEFADGRRHAFDAIVFATGYRSTTKQWLKSDDGLIGDDGMAGRSYPNHWKGENGLYCAGMVRRGIYGSGEDAELIADDISKQMKRRSSEPVHNGHISNGSP

SEQ ID NO: 58926 - protein, 390 aa, Trochodendron aralioides
DLEPVNPADVPVTAAGALKSYTLAAKAISRLQSLPSGNLSLLCDVLVREVSELTGYDRVMVYKFHEHKHGEVVAECRISDLEPYLGLHYPATDIPQASRFLFMKNKIRTICDCLAPPVKVIQDKRLVQPLSLCGSTLRAPHGCHAQYMENMGSIASLVMSVMNHEDEDEIESDRKGRKLWGLVVCHHTSPRFVPFLLRYACEFLIQVFGIQLNKEVELAAQLREKHILRTQTVLCDMLLRDAPVGIVTQSPNVMDLVKCDGAALYYRNTIWLLGVTPTEAQIRDIAGWLLEYHNGSTGLSTDSLMEAGYSDALLLGDAVCGMAAVKITSKDFLFWFRSHTAKEIKWGGVKHDPVDKDDGRKMHPRSSFKAFLEVVKRRSLPWEDVEMDAI

SEQ ID NO: 58927 - protein, 590 aa, Kluyveromyces lactis NRRL Y-1140
MSQRKLQQEVDKVLKKVKEGLEEYEDIYEKFQNTESDNQSYREKLESDLKREIKKLQKHREQIKNWLSKDDIKDRADVLMENRRLIESGMERFKSIEKIMKTKKFSTEALTNPDLIKDPRELKKRDQFLFVEECLEELQKQLDTFEVENNEEQIEKHTFHISNLENILKLLQNDDLDPETVQEFQEDIRYYVDNNDDPDFVDYDTIYQDMGCEIQPEDLLKEQSTPSKPKRSERSPRKKASPAPLSLKSKTSSPDITATSIASAAQPSHENGQEPTAPAAVAAAVAAAVAATAASNAVTDASTNASSSNNNNNNVEKSPNQSTVSSATSPSSTAAAAALAAANGVSANGPPSSVNQISGANPVVKKEKESTPAPQTEELPPPKDLSHEIEEILAKDLEDKLAFKNPLFKEELPYWLETKKKLIQPPNEIDEFTLKHLESSLLNCPDSLDADTPRLFENPLSLPHPTSIFFPHEPIRFMAQDLPAKGDDLYGKISVAKIMSKFALDTLFFIFYHYQGSYDQFLASRELSLRGWTFNKVNRCWFHKEVEKLPPGIEGKEEVTWRYFDYQKAWLSRRCGPDFEYKEEEFEKLW

SEQ ID NO: 58928 - protein, 1043 aa, Geobacillus stearothermophilus
MPKDSSLQSILLIGSGRSSSAKAAEFDYSGTQACIAFKEEGYRVILVNNNPATIMTDDVHADAVYFEPLTVEAVEAIIAKETPDGLLATFGGQTGLNLAFQLHEAGVLKKYGVRLLGTPIEAIKRPRGGPRTFRALMHELGEPVPESEIVTSVEEAVAFAEQIGFPIIIRPAYTLGGTGGGIAENMEQFLALVEKGLNESPIHQCLIERSVAGFKEIEYEVMRDQSNTCITVCNMENVDPVGIHTGDSIVVAPSQTLTDEEYQMLRSSAVKIISALGIIGGCNIQFALDPNSKQYYLIEVNPRVSRSSALASKATGYPIAALPAKLAVGYTLAELVNPVTKTTYASFEPALDYVVVKFPRLPFDKFPHADRKLGTQMKATGEVMAIDRNMERAFQKAVQSLEGKNNGLLLPELSVKTNDELKQLLVDKDDRRFFAILELLRRGVAVEAIHKWTKIDRFFLCSFERLVALEKQAAAATLDTIEEQTFRFLKEKGCSDAFLAETWGVTELDVRNKRKELGIVPSYKMVDTCAAEFHSETDYYYSTYFGEDERKQPSGKEKVLIIGAGPIRIGQGIEFDYSSVHSVFALQKEGYETVMINNNPETVSTDFAVADRLYFEPLTLESVLDVIEAEQIKHVIVQFGGQTAINLVKGLEEAGVPLLGVTYDMIDQLEDRDRFYQLLEELDIPHVPGLVANNAEELAAKAAEIGYPVLLRPSYVIGGCGMFIVHSEAQLAALIEQGELTYPILIDAYLDGKEAEADIVTDGTDIVLPVIIEHVEKAGVHSGDSYAWLPAQTLTGEEKAKIIDYAGRIAKKLGFKGIMNIQYVIADGNVYVLEVNPRASRTVPIVSKTTGVPLAQIATKLLLGKSLVDIVDEKARGLAVMPYAVLKYPVFSTHKLPGVDPMVGPEMKSTGEGISIAATKEEAAYKAFYPYLQKKANANEVYVIGNIDAELEAEMTAKQLTIVADVPFSDWVKRDTALAVIDLGKEEGEANKRMTALSRQLLVFTERETLKLFLQALDVDHLDVQPIHGWLEKKKQAEQAVIA

SEQ ID NO: 58929 - protein, 490 aa, Xanthomonas axonopodis pv. citri str. 306
MPRFPDQLLYIGGRYVPARGGHTLEVVNPATGEVLANVHNAGVDDLDAAVDSAKAGQQRWAALTTVERSRILLRAVALLRERNDALAQLETLNTGKPLSETRSVDVVTGADVLEYYAGVAQALQGAQVPLREGSFFYTRHEPLGVVGAIGAWNYPIQIALWKAAPALAAGNAMIFKPSEVTPLTALKLAEIFTEAGLPDGVFNVLPGDGASVGTALTEHPQIEKISFTGGTATGRKVMASASSSSLKEVTMELGGKSPLIVCADADLDVAADIAMMANFYSSGQVCTNGTRVFVPRALRHAFEARLLARVQRIHIGDPLDERTTFGPLASAAHMQRVLEHIEQGKAEGARLLCGGERLQDGALVQGYYVAPTIFSDCTDVMTIVREEIFGPVLSLLTYDDEDEAVTRANATTYGLAAGVVTPDLARAHRLIHRLEAGICWVNTWGESPAPMPVGGYKQSGVGRENGLATLQAYTRTKSVQIELERYASVF

SEQ ID NO: 58930 - protein, 221 aa, Brassica napus
QLEAAAAVENPPAEEPPSVKFMWLIPGFTRLNTRKHYSDVFVAGGYKWRVLIFPKGNNVDHLAMYLDVADAASLPYGWCRYSHFGLTVVNQINNRYSVRKETQHQFNARESDWGFTSFMPLGELYDPTRGYLVNDTVLIEAEVSVRKVLDYWAYDSKKETGFVGLKNQGATCYMNSLLETLYHIPYFRKAVYHMPTTENDAPTASIPLALQSLFYKLQYND

SEQ ID NO: 58931 - protein, 645 aa, Rubrobacter xylanophilus DSM 9941
MSEARERPLDIICIGRTCVDLYAEQEGARLEDVQSFRKYVGGSAANIAFGTARLGVRSAMLTRVGEEQMGRYVRRALEEAGVDVSRVRFDPEHLTPYVLLAVRETEGFPRLFAYGEAADMALEPGDVEPGFIASARALLITGTPLSREGSRAACRKAVRAAREAGARVVFDLDYRPVFWGVVPRERGGEMFAESERVTREYRAVLPECDLVVGTEEEIRIAGGSADTREALLGIRERSGATIVLKVGAMGAVVFPDEIPEKIQDGVRVPGFRVEVFNSVGAGDAFMSGFLSGWLRGEPLEECLRLGNACGAIVVSRHGCSPAMPTREELGYFLSLGESPGDLRKDAWLEHLHRATTRRAPEELHVLAIDHRWQLEELADELGVERGRLADLKRLLARAFRRAAEGRGEAGVLLDDVYGRRALEELTGQGFWVARAVEAAGSRPVEFNGGANVAAAIRGWPQEHVVKCNLYMHPQDDPQTRRLQEQRVLQLYDACVSNERRLLLEVQPPRGASYGKSGAAEVLERLYRLGVRPDWWKLPPALEPEVWEGIGEVVRGHDPYCAGLLVLGQGLPEEKLAGSFAAASSEPLCRGFAIGRSIYAGPARRWLAGEIGDEELVSEVAAGYGRVSELWRRRVQRREKQPEAKR

SEQ ID NO: 58932 - protein, 214 aa, Xanthomonas axonopodis pv. citri str. 306
MSLLIEQARYHLSAHNARQLPDDGGYEVAFAGRSNAGKSSALNALTRQNALARVSKTPGRTQQLVFFQIQPERYLVDLPGYGYAKVPQDLQAHWQAFIDRYFRTREALRGLVVVMDIRHPLKDYDLQMLGYAAERGLPAHGLLTKADKLGRGQQMQTLQKVKKEVTSRFGDSVTVQTYSGESRQGVDELRGIVGGWLGLDGAPPAAEGEPGQAP

SEQ ID NO: 58933 - protein, 83 aa, Zea mays
TEAINGLATCLICGRKLADVRPAARSIRKPRAVAGVAKYGDKSVYFDLIDIFNTTGQWDLYGSDAPSPYNPLLSKFFRDGPRL

SEQ ID NO: 58934 - protein, 373 aa, Oryza sativa (japonica cultivar-group)
MASGTDEKAKMEGLTSAAAFVEGGIQDACDDACSICLEAFCESDPSTLTGCKHEFHLQCILECQELLEAVERERNVRTNQTRNTTIFHHPALGDFEVQHLPVVGNDAELEERILQHLAAAAAMGRSHHLGRREGHRGRSGSHGRPQFLVFSSHPNMPSAGSVSSSSVQGEVDNESSPVHTTGELSLHANTHEEAGNQSPGMLTYDADQDAVVSSGNSTPVSSPRFFNRRHSTGQSTPVNNDRAGPSDLQSFSDSLKSRLNAVSMKYKESITKSTRGWKERLFSRHSSVADLGSEVRREVNAGIASVSRMMERLETRGSNGRTSDGPAISTSEVIPSTESSNERVTENNPTTAATSSGNTSASSAPCVTTTGSN

SEQ ID NO: 58935 - protein, 337 aa, Streptococcus mutans UA159
MVVKVGINGFGRIGRLAFRRIQNVEGVEVTRINDLTDPNMLAHLLKYDSTQGRFDGNVEVKEGGFEVNGKFVKVSAERDPEQIDWAADGVEIVLEATGFFASKAAAEKHLHANGGAKKVVITAPGGNDIKTIVFNTNHDVLDGTETVISGASCTTNCLAPMAKALHDNFSIKEGLMTTIHAYTGDQMVLDGPHRKGDLRRARAAAANIVPNSTGAAKAIGLVIPELNGKLDGAAQRVPVPTGSVTELVAVLDKKVTVDEVNAAMKAAANESYGYTEDPIVSSDIVGMSFGSLFDATQTKVLDVDGKQLVKVVSWYDNEMSYTSQLVRTLEYFAKIAK

SEQ ID NO: 58936 - protein, 398 aa, Streptococcus mutans UA159
MAKLTVKDVDLKGKKVLVRVDFNVPVKDGVITNDNRITAALPTIKYIIEHGGRAVLFSHLGRVKEEADKKGKSLAPVAADLAKKLVQEVVFPGVTRGEQLEAAINALKNGEVLLVENTRFEDVDGKKESKNDPELGKYWASLGDGIFVNDAFGTAHRAHASNVGISANVDKAVAGFLLENEIAYIQEAVDNPVRPFIAILGGSKVSDKIGVIENLLKKADKVLIGGGMTYTFLKAQGIEIGDSLVEEDKLDIAKDLLAKANGKLILPVDSKEANAFADYTEVKDTEGAAVDPGFLGLDIGPKSIAKFDDELTGAKTVVWNGPMGVFENPDFQAGTIGVMDAIVKQPGVKSIIGGGDSAAAAINLGRADKFSWISTGGGASMELLEGKVLPGLAALTEK

SEQ ID NO: 58937 - protein, 103 aa, Mortierella alpina
MSGRGKGGKGLGKGGAKRHRKILRDNIQGITKPAIRRLARRGGVKRISGLIYEETRSVLKVFLENVIRDAVTYTEHAKRKTVTSLDVVYALKRQGRTLYGFGG

SEQ ID NO: 58938 - protein, 229 aa, Panax ginseng
MADEVVHHPLDKSSEVETTDRGLFDFLGAKKDEGKSAPADYQQQEEIATEFEQKVHVSETEPKFEESKVEEEEEEKKPSLLDKLHRSGSSSSSSSSDEEEVEEGGEKKKKKKKSLKEKIHKEEDTSVPVEKIEETVVVEQEEKKGFLDKIKEKLPGGGHKKAEDQEFPSPAPPAAVESYATVEGEPAKEKKGILEKIKEKIPGYHSKTSDEKKKRKKRKKKKKKTRGWS

SEQ ID NO: 58939 - protein, 771 aa, Thellungiella salsuginea
MVASAFLPELWTEILVPVCAVIGIAFSLFQWFIVSRVRVTADQGASSSSGGSNNGKNGYGDYLIEEEEGLNEQSVVAKCAEIQTAISEGATSFLFTEYKYVGVFMVFFAAIIFVFLGSVEGFSTKNKPCTYDDTKTCKPALATAAFSTVAFVLGAVTSVLSGFLGMKIATYANARTTLEARKGVGKAFIVAFRSGAVMGFLLAASGLLVLYITINVFKIYYGDDWEGLFEAITGYGLGGSSMALFGRVGGGIYTKAADVGADLVGKIERNIPEDDPRNPAVIADNVGDNVGDIAGMGSDLFGSYAEASCAALVVASISSFGINHDFTAMLYPLLISSMGILVCLITTLFATDFFEIKAVKEIEPALKNQLIISTVIMTVGIAIVSWVGLPSSFTIFNFGTQKVVKNWQLFLCVCVGLWAGLIIGFVTEYYTSNAYSPVQDVADSCRTGAATNVIFGLALGYKSVIIPIFAIAASIFVSFSFAAMYGVAVAALGMLSTIATGLAIDAYGPISDNAGGIAEMAGMSHRIRERTDALDAAGNTTAAIGKGFAIGSAALVSLALFGAFVSRAGVHTVDVLTPKVIIGLLVGAMLPYWFSAMTMKSVGSAALKMVEEVRRQFNTIPGLMEGTAKPDYATCVKISTDASIKEMIPPGCLVMLTPLIVGFFFGVETLSGVLAGSLVSGVQIAISASNTGGAWDNAKKYIEAGVSEHAKSLGPKGSEPHKAAVIGDTIGDPLKDTSGPSLNILIKLMAVESLVFAPFFATHGGILFKYL

SEQ ID NO: 58940 - protein, 215 aa, Ustilago maydis 521
MALHIGTLLALLLIILHLWLAVISGFYDDYPKKGIRFCDILPVLRDPLAFELLLTNIVSHIFTHTIPSLDDDTPAPAAPTPLEPGAKSYGNRKIDAVVGLDARGFLLGPAIAQRLGCGFVPVRKVGKLPGECVQASYQKEYGEDVFEMQKEALAPNSRVLVIDDLIATGGSAKAAGELVNKCGSKVVEYVFVVAIPFLKGADQLDAPSYHLVEVD

SEQ ID NO: 58941 - protein, 447 aa, Methanosarcina mazei Go1
MVQMKKCTTKEDVLEAVKERDVKFIRTQFTDTLGIIKSWAIPAEQLEEAFENGVMFDGSSIQGFTRIEESDMKLALDPSTFRILPWRPATGAVARILGDVYLPDGNPFKGDPRYVLKTAIKEAEKMGFSMNVGPELEFFLFKLDANGNPTTELTDQGGYFDFAPLDRAQDVRRDIDYALEHMGFQIEASHHEVAPSQHEIDFRFGDVLCTADNVVTFKYVVKSIAYHKGYYASFMPKPLFGVNGSGMHSNQSLFKDGKNVFYDPDTPTKLSQDAMYYIGGLLKHIREFTAVTNPVVNSYKRLVPGYEAPVYISWSAQNRSSLIRIPATRGNGTRIELRCPDPACNPYLAFALMLRAGLEGIKNKIDPGEPTNVNIFHLSDKEREERGIRSLPADLKEAIDEMKGSKFVKEALGEHVFSHYLCAKEMEWDEYKAVVHPWELSRYLSML

SEQ ID NO: 58942 - protein, 541 aa, Oryza sativa (indica cultivar-group)
MRPALRGPDRHKSQPYLATRSSQGILGKGGGEFARGFCLMANIRALLIGLNYSIVAGLRVNTKFDARLCIAHFLTECLSSRPSYLASLGRHYKVPMEIRWLSSTAIGPARLLWQQLIGLQQQAMGTVSACSSWIRPTARFPPHLVVGMPALSPTMNQGNIAKWRKQEGEKIEVGDVICEIETDKATLEFESLEEGYLAKILAPEGSKDVQVGQPIAVTVEDLEDIKNIPADASFGGEQKEQSIASEAQKVETDAAKESSIITRISPAAKLLIKEHRLDQSVLNASGPRGTLLKGDVLAALKLGASSSSTKQKNAPAAPSSQPTHDFQAQSVTIPQQNDAYEDIPNSQIRKVIAKRLLESKQTTPHLYLSQDVILDPLLAFRNELKEQHGVKVSVNDIVIKAVALALRNVPEANAYWNNDKEQAQKCVSVDISIAVATEKGLMTPIIRNADQKTISAISSEVKQLAEKARAGKLAPNEFQGGTFRHSGILAVGRGNKIIEPVVDSDGTEKATVVTKMSLTLSADHRVFDGQVGGTDILRPVV

SEQ ID NO: 58943 - protein, 549 aa, Rubrobacter xylanophilus DSM 9941
MLREEKRPWLSVYGDRIRPRIIEESLPAFLEDAARRFSSHTALTMGEREISYRELLELSEGFAAALAGSGVCKGDRVGLMLPNCPEYVIGFFGTVRAGAAATQINPLYTGRELEHILSNSGTQTAVVHAATYAKVKEVQPRTPLRRVVCVGEPEGGLSGGDTTFEEFLRSAPGPPPEVKIDPEEDLASLQYTGGTTGVSKGAMLTHRNLLGGVQQTIDFLIEDPGDFPENGKVVAVAPLFHIFGMTMVLLFGLRHGWNLLLVPKFQPDEMMQLIKREQPIMLAGVATLYMALHSYPRMEDYGLDRVLLYTSGGASVPVGLMRSFKQKTGRDIWEGYGLSEGAPVSFNTYLRGPVPGSVGVPIPGTDVRVVDPETGEREMPVGEPGELVVKGPQVMKGYWNMPEETSLALRDGWLYTGDIVRMDEEGYLYIVDRKKDMINVSGYKVYPREVEEVIYSHPEVVEAVVVGSPDPYRGEVPKAFVVIRRRGGEGTSVSEEELIEHCRRELAPYKVPREVEFREELPKSAVGKLLRRVLAQEERSRGQEQGSAG

SEQ ID NO: 58944 - protein, 238 aa, Gibberella zeae PH-1
MVAEEPRQRKDPAVSGKENSKQQRRRTAENLAPPFFALLFALLAFYILFSPPSSSLSPPVPVCHSTISSSVSSSQVIPDKNIAKMSSSEQTFIAIKPDGVQRGLVGPIISRFENRGFKLAAIKLMTPGKEHLEKHYADLAGKPFFAGLIEYMNSGPICAMVWEGRDAVKTGRSILGATNPLASSPGTIRGDYAIDVGRNVCHGSDSVENAQKEIALWFKEGEVVSWKSAQFNWVYEKA

SEQ ID NO: 58945 - protein, 505 aa, Oryza sativa (indica cultivar-group)
MGHELWVLWATLAVSLLCYLYLTSHRLGSRRRRWPPGPRPLPLLGNLLDLRGGNLHHTLARLARAHGAPVMRLQLGLSPAVVISSPGAAREAFTAHDRRLAARAVPDANHALGFCDRSMIWLPSADPMWRTLRGVVAAHAFSPRALAAARAVHERKVRDLVAYLRGRAGREVDVKDAVYGGVLNLVSSALFSADVVDVGGESAQGFRELVEELIESIAKPNVSDLFPFLRPFDLQGWRRWTSGHLAKIYKVLDDIIDRRSAEDDAAMDKRGDFLDVLLELMSTGKIAREYLTNILFDVFTAGSDTMSLTVVWAMAELLRNPGVMAKARAEIDAALGGREAVEEADVARMPYVQAVLKEAMRLHPVAPVMLPRKAAEDGVEIGGFEVPRGCAVIFNTWAIMRDPAAWERPDEFVPERFVGRSRATEEMDFRGKDFGFLPFGSGRRLCPGVPMAERVLPLIMASLLHAFEWRLPDGMSAEQLDVSEKFTTANVLAVPLKAVPVVIAC

SEQ ID NO: 58946 - protein, 448 aa, Streptococcus mutans UA159
MAITAADIRREVKEKNVTFLRLMFTDILGTMKNVEIPATDEQLDKVLSNKAMFDGSSIEGFVRINESDMYLYPDLNTWTVFPWGDENGAVAGLICDIYTAEGEPFAGDPRGNLKKALRHMESLGYKSFNLGPEPEFFLFKMDEFGNPTTEVNDKGGYFDLAPTDLADNTRREIVNVLTKMGFEVEASHHEVAIGQHEIDFKYADVLTACDKIQLFKLVVKTIARKHGLYATFMAKPKFGINGSGMHCNMSLFGSDGKNAFFDPQDPKGMQLSEVAYQFLGGLVKHAYSYTAIMNPTVNSYKRLVPGYEAPVYIAWAGRNRSPLIRVPASRGVSTRLELRSVDPTANPYLALAVLLESGLDGIENKIEAPAPVESNIYVMTVEERKEAGIADLPSTLHNALKALQEDEVVKAALGNHIYTSFLEAKRIEWSSYAAFVSQWEVDNYLDLY

SEQ ID NO: 58947 - protein, 232 aa, Oryza sativa (japonica cultivar-group)
MTVVDAESRFHVLAVDDSLIDRKLIEMLLKNSSYQVTTVDSGSKALELLGLRDEGDDSSSSPSSSSPDHQEIDVNLIITDYCMPGMTGYDLLKRVKGSSSLKDIPVVIMSSENVPARINRCLEDGAEEFFLKPVKLADMKKLKSHLLKRKQQLPMAAAAPDKPPHKPDEAAASAAAIAEAATAQTDGIISDCSCSGSSKRKAAAMEQEVISSPDQRTKPRLSSTSSGLAVET

SEQ ID NO: 58948 - protein, 300 aa, Saccharomyces cerevisiae
HHGMASMSVSTASTEMSVRKIAAHMKSNPNAKVIFMVGAGISTSCGIPDFRSPGTGLYHNLARLKLPYPEAVFDVDFFQSDPLPFYTLAKELYPGNFRPSKFHYLLKLFQDKDVLKRVYTQNIDTLERQAGVKDDLIIEAHGSFAHCHCIGCGKVYPPQVFKSKLAEHPIKDFVKCDVCGELVKPAIVFFGEDLPDSFSETWLNDSEWLREKITTSGKHPQQPLVIVVGTSLAVYPFASLPEEIPRKVKRVLCNLETVGDFKANKRPTDLIVHQYSDEFAEQLVEELGWQEDFEKILTAQ

SEQ ID NO: 58949 - protein, 416 aa, Arabidopsis thaliana
MTRKYIYIYIYIILKVRARVGANNKTLINNQSHLIEMRNTLMLSDLPGDLLEEILCRVPATSLKQLRSTCKQWNNLFNNGRFTRKHLDKAPKDFQNLMLSDSRVFSMSVSFHGIPSVEATCELSLIDSFSSFEDKFEISQVFHCDGLLLCTDADNTRIVVWNPCTGKTRWIEPNNRCYYYAFGSYLDKSYGNSYKILSYSGYGYENQELAIYEINSQSWRFLDVTRDCILERYTDYGVSLKGHTYWFASDEKEKNLSVFLVSFDYTTERFRRLRLPYQCPDYNTASLSVVREEKLAVLLQRENTSRTEIWVTSRIGETKVVSWSMVLAVDFPSELFILSGISFLVDAEKKFVVCCDNYFGEDEYDTKNLVHIVGENNKVREVNFGVSESSWPFLFNYVPSLIQIWEGVGGKRKRVE

SEQ ID NO: 58950 - protein, 402 aa, Zea mays
VSNLSHLSKLARRNDTASRIDEADRLRIVFLAMEDARAVLIKLADRLHNMRTLDSLSKTKQQSVAKETLEIFAPLANQLGILNWKEQLENLCFKYLYPENFDELSTKLIEIYNIDMIAAATRRLEQALQVRGLSYYAIYGRHKSMYSIYRKMARKKLVMDKIYDIHGVRVILENKADCFATLEIIHHLWPRIPGKFKDYINSPKPNRYQSLHTVVLTEQTLPLEIQIRTRDMHLQAEFGIAAHWRYKEGERSCCTSVSEIVEWVRWVTWHCQTLNTGYPSSLACDASSKETHTIPSHSEACLLSYSKQCDHKGPVLVILLENEKMSVQEIPQNWTILDLLKRSSNYGMPLRLRLNCHAVHNWNQELKMGDVLELIPSTPCKSRGRTRELHQKFDHRLAVSQS

SEQ ID NO: 58951 - protein, 289 aa, Saccharomyces cerevisiae
TASTEMSVRKIAAHMKSNPNAKVIFMVGAGISTSCGIPDFRSPGTGLYHNLARLKLPYPEAVFDVDFFQSDPLPFYTLAKELYPGNFRPSKFHYLLKLFQDKDVLKRVYTQNIDTLERQAGVKDDLIIEAHGSFAHCHCIGCGKVYPPQVFKSKLAEHPIKDFVKCDVCGELVKPAIVFFGEDLPDSFSETWLNDSEWLREKITTSGKHPQQPLVIVVGTSLAVYPFASLPEEIPRKVKRVLCNLETVGDFKANKRPTDLIVHQYSDEFAEQLVEELGWQEDFEKILTA

SEQ ID NO: 58952 - protein, 125 aa, Vibrio vulnificus YJ016
MRKICSHSVNEEAMETIDKIKQQIAENPILLYMKGSPKLPSCGFSSQAAQALMACGEKFAYVDILQNPDIRAELPKYAEWPTFPQLWVEGELIGGCDIVIEMFQKGELQPLIKEAAARAAGSDAE

SEQ ID NO: 58953 - protein, 219 aa, Methylobacillus flagellatus KT
MATQDELKQQVAKAAIEYVKGGIIGVGTGSTANFFIDELAKVKDRIDGAVASSEATAQRLRGHGIKVFDLNDVDGMEIYVDGADEITEKLHMLKGGGGALTREKIVAACAKDFICICDQTKLVPVLGKFPLPVEVIPMAREYVARELVKLGGQPKLRDFTTDNGNVILDVHGLTITDPVALESRINEIVGVVTNGLFASRPANVLLLATADGVKTLTAR

SEQ ID NO: 58954 - protein, 314 aa, Nicotiana sylvestris
MEAANHNNNGCTNESPYISSVLPGWFSEISPLWPGEAHSLKVEKILFQGKSDYQNVMVFQSSTYGKVLVLDGVIQLTERDECAYQEMIAHLPLCSIPNPKKVLVIGGGDGGVLREVSRHSSVEQIDICEIDKMVVEVSKQFFPDVAVGYEDPRVNLHIGDGVAFLKNVAAGTYDAVIVDSSDPIGPAQELFEKPFFESIARALRPGGVVSTQAESIWLHMHIIEEIVANCRQIFKGSVNYAWTTVPTYPSGMIGFMLCSTEGPAVDFKNPINPIDDDASHNKTLGPMKFYNSELHKASFCLPSFAKRVIESKGK

SEQ ID NO: 58955 - protein, 268 aa, uncultured marine bacterium
QPNAMGRREVGGLANQLAAHMDFATRMQSNWSSAFGQAPNMAQENGLKAIDMFQAVEQGKIKVLWIMSTNPMVSLPDTEQVRRALEKCELVIVSDCKQSTDTTAYADVLLPALPWSEKDGTVTNSERRISRQRGLLPARGEAKADWWAICQVAGAMGYQSAFSYRSVHDIFREHAALSGFENHGKRDLDISLFSNISEQAYQDLLPIQWPVTKESPNGTARMFTDGRFFTADRKANFIPIDVKEPQIAPDEDWPFVLNTGRVRDQWHT

SEQ ID NO: 58956 - protein, 285 aa, Zymomonas mobilis subsp. mobilis ZM4
MIWRKPSMPIWLNGVLANNAVAEFNLNDKGLLLGYGVFDTALVIADKVAYREAHLEKLTKSCAALSLPVASSFLSEMMEKAAKDLPLGVIRITVTGGVGPRGMAFSPEAKPNVIVSASPIAATIFCPEIRLVLTPLRRNESSFTARIKTLNYLDAIMAVTEARQKSFDDALFLNTAGHVACSSTANLFMIRDGCLITPPVSDGILAGIMRANILRFAKSRDIPVEERSIGYEELLEADDIFLTNSLRLISQVTHLGEVALPRRSAALMALLESMVFDEINYSRSQ

SEQ ID NO: 58957 - protein, 419 aa, Zea mays
TACGVGWGVLLETETDTERRENVLAARFRDTERESAGVGLTTLLHIHPLFCPAWIPSAPTSVSLLPSKLCPSGMGPTLDGAAGGGKKRKRVPPGLADLHDDMLERVLARLPPASYLRLRGVSRRWRAAAESSTFRAACARVTARDPWFLMLDDPDHQDEQRPRYTAAAVVFDAAERAWARWRGAPGPQRPVAAAGGLLLYRDPGTGDLTVVNPLTGAAHALPPPPPPALTRALQAIAMYGAPYRVVLILGELPDLSTVAYDSSTDAWGEEAALSRKPEEEGGGGGGDGTVYFLSKSGDVVATTTQRSAARQYSSAVACGAGADAVAYFLSRSGTVVACDLARRAFAELPRILPAHHEHSVDVAACGGAAYAVVLSEFLDAASLRVWEFARGAWRQVAAMPPAMAHAFRGAKADVNCVGH

SEQ ID NO: 58958 - protein, 114 aa, Glycine max
  misc_feature (18)..(18): Xaa can be any naturally occurring amino acid
  misc_feature (30)..(30): Xaa can be any naturally occurring amino acid
  misc_feature (67)..(67): Xaa can be any naturally occurring amino acid
  misc_feature (78)..(78): Xaa can be any naturally occurring amino acid
  misc_feature (94)..(94): Xaa can be any naturally occurring amino acid
  misc_feature (108)..(108): Xaa can be any naturally occurring amino acid
CETTFKRSRASMVAPFTXLKSMDGLPHYEXTNNDITSIANNGERVQCMLLCAPIDNNEVQTLSYLPXLDDAQLGKEGXYLLRKGWIPCLEFELXHGFMYREHNRSPGXYYDGRY

SEQ ID NO: 58959 - protein, 271 aa, uncultured marine bacterium
QPNAMGGREVGGLANTLAAHFEFGDPQSHQTVSEFWQADNLATHAGLKAIDLFDAMNEGKIKAVWIMATNPVVSLPDSEKIKTALEKCPFVVVSDCIVDTETTRLADVVLPAQGWSEKSGTVTNSERRISRQRRVLPSPGEAKPDWWILKEVAQKMGFKDQFDYRHEGQIFKEYCEMTALGNETGKARDLCLIGLTKLDEQGYGELTPHEWPVMEYQPEIIEQRMFTNGEFFTEPGKAQFIAVEHDKPIADTSVEFPLIMNTGRIRDQWHT

SEQ ID NO: 58960 - protein, 316 aa, Vibrio sp. Ex25
MSNKLEQLRKLTTVVADTGEIDAIKKYQPEDATTNPSLILKAAQIAEYAPLIDASIEYAKAQSNDKAQQVQDTCDMLAVNIGKEILKTIPGRISTEVDARLSYDMEGSVAKARQLVKMYNDAGITNDRILIKLASTWEGIRAAEILEKEGINCNLTLLFSFAQARACAEAGVFLISPFVGRIMDWYKAKEGRDFEASEDPGVLSVTKIYNYYKEYGYKTVVMGASFRNIGEILELAGCDRLTIAPALLAELEAAEGEVVEKLVDSKGAAERPAPMTHSEFLWEHNQDPMAVEKLAEGIRNFAVDQGKLEAMIEAKL

SEQ ID NO: 58961 - protein, 663 aa, Vibrio sp. Ex25
MDRKYLANAIRALSMDGVQQANSGHPGAPMGMADIAEVLWRSHLNHNPSNPEWADRDRFVLSNGHGSMLIYSLLHLSGYELSIDDLKNFRQLHSKTPGHPEYGYAPGIETTTGPLGQGITNAVGMALAEKALAAQFNKEGHDIVDHFTYVFMGDGCLMEGISHEACSLAGTLGLGKLIAFWDDNGISIDGHVEGWFSDDTPKRFEAYGWHVIPAVDGHDSEAINAAIEAAKADPRPTLICTKTIIGFGSPNKSGSHDCHGAPLGAEEIAATRKELGWEHGPFEIPQEVYAEWSAKETGAAKEAAWNEKFAAYEAAYPELAAEFKRRVNGELPAQWEEKASQIIADLQANPANIASRKASQNALEAFGTLLPEFMGGSADLAPSNLTMWSGSKSLEASDFSGNYIHYGVREFGMTAIMNGIALHGGFVPYGATFLMFMEYARNAMRMAALMKIQNIQVYTHDSIGLGEDGPTHQPVEQMASLRLTPNMSTWRPCDQVESAVAWKLAIERKDAPTALIFSRQNLAQQERDTEQLANIAKGGYILKDCEGKPELILIATGSEVELAVEAAAQLTAEGKKVRVVSMPSTDAFDKQDAAYREAVLPSDVTARIAIEAGIADFWYKYVGFDGRIIGMTSFGESAPAGELFKMFGFTTENVVNTAKELLA

SEQ ID NO: 58962 - protein, 268 aa, uncultured marine bacterium
QPNAMGGREVGGLANMLAAHMDIENPEHRQWVQEFWDSPTICTEPGLKAIDLFDSMEQGKVKAVWIMATNPLVSMPNRGKITRALENCDFVVVSDCVEQNDTLALADVKLPATAWSEKEGTVTNSERSISRQRAFKAATGGAKNDWQIICDVAQKMGYSEGFDFQTPHQIFVEHARLSGVNNFGDRDFDISALADLSLKDYQQLKPVQWPVNQRYPDGCKRLFTDGRFFTPSGKARFIPLHPELPQQQTCKDYPLILNSGRIRDQWHT

SEQ ID NO: 58963 - protein, 293 aa, Kluyveromyces lactis NRRL Y-1140
MSELTHPTIVDGWFREISDTMWPGQAMTLRVEKILHHEKSKYQDVLVFKSTDYGNVLVLDNAIQVTERDEFSYQEMIAHLALNSHPNPKKVLVIGGGDGGVLREIVKHDSVQEAWLCDIDEAVIRVSKEYLPEMAKSYSHPKVKTHIGDGFQFLRDYQNTFDVIITDSSDPEGPAASLFQQSYFELLNGALTEKGVISTQAESMWIHLPIIKELKKACKEVFPTVGYAYTTIPTYPTGQIGFMVCSKDANVDVTKPLRSISEEEEEAKYRYYNKKVHEASFVLPTWVAKELDL

SEQ ID NO: 58964 - protein, 259 aa, uncultured marine bacterium
QPNAMGGREVGGLANQLAIHRGFDPDSIKLISEFWQTDNLATRPGLKAIELFEAVERGDIEVIWIMATNPVVSMPDNVFIQRALQKCPLVIVSDVTHDSDITQYADLLLPAAGWGEKQGMVTNSERMLTRQRKFLTSKGEAKPDWKIIAEVGKKLCERLDKPNAFDFKSESSVVREYAAMTGLNKDTPLLLDLSKYAEISDEEYESWNPVQWGSSRPFADGKFSTENRKARFVVTTAPLIKGESRLWLNTGRQRDQWHT

SEQ ID NO: 58965 - protein, 525 aa, Synechococcus sp. WH 7805
MRSRLGANAEAMTYSLTTPLYYVNAKPHLGSVYTTIACDALARFQRLEGEEVVFITGVDEHGQKIQRTAEAQSISPADHCDRISALYADLWARWDITNDRFVRTTSPRHRPLVQAFFQRCEAAGHIRTGHQEGWYCVDCEEFKDDLADAKNPDCAIHRKPLEWRDEENLFFCLSQFQERIESLIADPQFIAPSSRRREIENFVAGGLRDFSISRVNVSWGLPVPGHQGHTFYVWFDALLGYLTALLDDGGPVDLDRLTDVGWPVDVHVIGKDILRFHAVYWPAMLMSAGLPVPKRVFGHGFLTREGQKMGKALGNVLDPETLLERCGTDAVRWYLLRDIQFGEDGDFQQQRFMDLVNNDLANTIGNLLNRTASMSRKWFDASLPPVSAAVRSDHPLKDTTERTIDRVRQSIPAFAFKDAAEAVLQLAIEANGYLNEQAPWSLMKQPGHEQKVGDDLYAVLECCRVIGLLLQPLVPGLSSRILAQLDQSPSEKGWTHALSWGQLEPGASLSKPEPVMQRLELESPL

SEQ ID NO: 58966 - protein, 259 aa, uncultured marine bacterium
QPNAMGGREVGGLANQLPIHRGFDPDSIKLISEFWQTDNLATRPGLKAIELFEAVERGDIEVIWIMATNPVVSMPDNVFIQRALQKCPLVIVSDVTHDSDITQYADLLLPAAGWGEKQGMVTNSERMLTRQRKFLPSKGEAKPDWQIIAEVGKKLCERLDKPNAFEFKSESSVFREYAAMTGLNKDTPFLLDLSKYAEISDEEYESWNPVQWGSSRPFADGKVSTENRKARFVVTTAPLIKGESRLWLNTGRQRDQWHT

SEQ ID NO: 58967 - protein, 417 aa, Oryza sativa
MPALGTLSGGAAGVAGLLRLRRATPSPAVATPFPAAAAARCAAAAAAVVPDGGQLVWGRQLRPALLLPAAGGLLQPPTSPSSSQAGRRQALRPPAAATSGEAKPAGFLEKYPALITGFFFFMWYFLNVIFNILNKKIYNYFPYPYFVSVIHLLVGVVYCLVSWTVGLPKRAPINSTLLKLLFPVALCHALGHVTSNVSFATVAVSFAHTIKALEPFFNAAATQFVLGQTVPLSLWLSLAPVVLGVSMASLTELSFSWKGFINAMIPNISFTYRSIYSKKAMTDMDSTNVYAYISIIALVVCIPPALIIEGPQLVQYGLNDAIAKVGMTKFVSDLFLVGLFYHLYNQIATNTLERVAPLTHAVGNVLKRVFVIGFSIIIFGNKITTQTGIGTCIAIAGVALYSYIKAKIEEEKRAKAA

SEQ ID NO: 58968 - protein, 227 aa, Ustilago maydis 521
MSFRGGGRGGGDRGGRGGFSSRGGRGGFGGGGRGGYANAGPPETVQPMGSFMHAVEGEMLCQSTDAKHVPYFNAPIYLENKSQIGKVDEILGPINEVFFTVKMDPGMVATSFKADDKVYISGDKLLPIERFLPKPKSLTKAPKKKGGARGGAAGGRGGFGGGRGAPRGRGGFGGGRGGARGGGFGAPRGGGRGAFGGGRGGAFSGGRGGAAGARGGFGGRGRGRGGY

SEQ ID NO: 58969 - protein, 537 aa, Zea mays
MVAATATATAMATAASPLLNGTRIPARLRHRGLSVRCAAVAGGAAEAPASTGARLSADCVVVGGGISGLCTAQALATRHGVGDVLVTEARARPGGNITTVERPEEGYLWEEGPNSFQPSDPVLTMAVDSGLKDDLVFGDPNAPRFVLWEGKLRPVPSKPADLPFFDLMSIPGKLRAGLGALGIRPPPPGREESVEEFVRRNLGAEVFERLIEPFCSGVYAGDPSKLSMKAAFGKVWRLEETGGSIIGGTIKTIQERSKNPKPPRDARLPKPKGQTVASFRKGLAMLPNAITSSLGSKVKLSWKLTSITKSDDKGYVLEYETPEGVVSVQAKSVIMTIPSYVASNILRPLSSDAADALSRFYYPPVAAVTVSYPKEAIRKECLIDGELQGFGQLHPRSQGVETLGTIYSSSLFPNRAPDGRVLLLNYIGGATNTGIVSKTESELVEAVDRDLRKMLINSTAVDPLVLGVRVWPQAIPQFLVGHLDLLEAAKAALDRGGYDGLFLGGNYVAGVALGRCVEGAYESASQISDFLTKYAYK

SEQ ID NO: 58970 - protein, 200 aa, Nicotiana langsdorffii x Nicotiana sanderae
TGFNAFWYSHHLFIIVYALFIVHGEKLYITKDWYKRTTWMYLTIPIVLYASERLIRAFRSSIEAVKILKVAVYPGNVLALHMSKPQGYKYKSGQYMFVNCAAVSPFEWHPFSITSAPGDDYLSVHIRTLGDWTRQLKTVFSEVCQPPPNGKSGLLRADYLQGENNPNFPRVLIDGPYGAPAQDYKKYEVVLLVGLGIGAA

SEQ ID NO: 58971 - protein, 141 aa, Vibrio parahaemolyticus RIMD 2210633
MALERTFSIVKPDAVERNLIGEIYNRIEKAGLRIIAAKMVHLTEEQASGFYAEHEGKEFFQPLKEFMTSGPIMVQVLEGENAIARYRELMGKTNPEEAAAGTLRADYALSMRHNSVHGSDSPESAAREIEFFFPESEICPR

SEQ ID NO: 58972 - protein, 481 aa, Rubrobacter xylanophilus DSM 9941
MAQLLVGGERVSARGGGEMPVVNPATEEVVDTVPKGTAEDVEAAVAAAKGALAEWSGKDPDERAAIMRAGIGAVKERGREIAELLVREQGKPLSEAMGELHHFIHGMDFYADLASKVRGAYAPLPSSLGKSYGMVIKRPVGVCAAIVPFNFPLTLMGTKVGPALAGGNTVVVKPAETTPLATLRVAELFAEAGLPAGVFNVVTGEGPEVGEALVAHPDVRRVAFTGSTEVGRRIMELAGPQFKRVSVELGGSDPVIVCPDADVDAAVKGVNIGRFFNAGQACLAAKRVYVFDEVYDEFMEGLIKRVSRYELGDGLTKAEKPKIRMGPMNSARYRDQVASQLEEALGRGARVVYQGEWGGEKGYFFPPAVIEGAPHDSRVVREETFGPLLPVFRVGDLDEALRLANDSRYGLGSSIWTRNIRWIHRAAQEIEAGMTWVNQLHYGYDELPFGGVKDSGVGREHGPEALEYYLESKSVVIGGLD

SEQ ID NO: 58973 - protein, 375 aa, Vibrio parahaemolyticus RIMD 2210633
MTTEKINLLDFDRKGMRQFFAEELGEKAFRADQVMKWIYHFGVDDFDNMTNINKKLREKLQHKCEIKAPTVAEAQHSSDGTIKWAMKVGDQDVETVYIPEEDRATLCVSSQVGCALECKFCSTAQQGFNRNLKVSEIIGQVWRAAREIGLQKETGRRPITNVVMMGMGEPLLNMKNLIPALEIMLDDLGFGLSKRRVTVSTSGVVSGLDQMTGKIDVALAISLHAPNDKLRSEIMPINDRWDIQDFLASVRRYIASSNANRGKVTVEYVLLDHVNDDMGHARELAELMKDTPCKINLIPFNPYPGSPYKKPSNSRIDRFQKTLMQYEHTVTVRKTRGDDIDAACGQLVGDVIDRTKRTAALKAARGAETIDVKAV

SEQ ID NO: 58974 - protein, 192 aa, Arabidopsis thaliana
MFAVENGLQGDPRLKAISDAIRVIPHFPKTGIMFQDITTMLLDPVAFKHVVDIFVDRYKHMNISLVAGVEARGFIFGPPIALAIGAKFVPLRKPGKLPGRVISEEYELEYGRDCLEMSVEAVKSEERALIIDDLVATGGTLSASINLLERAGAEVVECACVVGLPKFKGQCKLKGKPLYVLVEPNQFDELTL

SEQ ID NO: 58975 - protein, 86 aa, Oryza sativa (indica cultivar-group)
MEVAKLRCSDSYTEYLKDIEAGKIENVPTPPIAIDYWRLPADATLKDVVVVVRADEAHHRDVNHFASDVHFQGMDLKDTPALLDYH

SEQ ID NO: 58976 - protein, 456 aa, Salmonella typhimurium LT2
MESNNKLKRGLSTRHIRFMALGSAIGTGLFYGSADAIKMAGPSVLLAYIIGGVAAYIIMRALGEMSVHNPAASSFSRYAQENLGPLAGYITGWTYCFEILIVAIADVTAFGIYMGVWFPAVPHWIWVLSVVLIICAINLMSVKVFGELEFWFSFFKVATIIIMIVAGIGIIVWGIGNGGQPTGIHNLWSNGGFFSNGWLGMIMSLQMVMFAYGGIEIIGITAGEAKDPEKSIPRAINSVPMRILVFYVGTLFVIMSIYPWNQVGTNGSPFVLTFQHMGITFAASILNFVVLTASLSAINSDVFGVGRMLHGMAEQGSAPKVFAKTSRRGIPWVTVLVMTIALLFAVYLNYIMPENVFLVIASLATFATVWVWIMILLSQIAFRRRLPPEEVKALKFKVPGGVVTTIAGLIFLVFIIALIGYHPDTRISLYVGFAWIVLLLIGWIFKRRRDRQLAQA

SEQ ID NO: 58977 - protein, 335 aa, Methylobacillus flagellatus KT
MAHMGISKLKPSNSATTLLQLAREVLAIEAREVQALAGRLDQSFVNAVELILQCRGRVVVTGIGKSGHIGNKIAATLASTGTPAFFMHPAEASHGDLGMITRDDVVIALSNSGEADELLALLPPLKRIGTPIISISGNRHSTLSKAADIFLDAHVSQEACPLGLAPTASTTAALALGDALAVTLLDQRGFSREDFALAHPGGSIGRRLLLHVQDVMRSGDDIPAVSVSSSLKDGLLEMSRKGLGMTAVLDAADKPVGIFTDGDLRRAFEAGIDINGTRMADVMHAHPRSILPGQLAVDALALMEQYSISSLLVVDQQGNLVGALNMHDLLMAKVV

SEQ ID NO: 58978 - protein, 84 aa, Glycine max
  misc_feature (15)..(15): Xaa can be any naturally occurring amino acid
ICDCKIHHSVDGLRXISEGDIIEDSLLMGTDYYETEADKELLADKGGIRISIGKNSCIRRAIIDDNARIGDNVKILIAVIVQEA

SEQ ID NO: 58979 - protein, 267 aa, Clostridium oceanicum
QPNAMGGREVGGLANQLAAHMGFSAEKTDRVQRFWQSPRIARQPGLNAVALFQAIAAGQVKAVWIMGTNPAVPLPDADAVRQALKQCPLVVVSDVMAMTDTAELAHIHLPALAWGEKEGSVTNSERCISRQRAFLSPPGQARADWWILSQVAQRMGYGEAFGYQHPSEIFSEHAALSAFENNGTRAFDIGLLAGWDKQQWLGMTPVQWPVNEQHPAGCLRLSGDKRFFHADGKARLLPVTPRLPQNAVSQRYPLVLNTGRIRDQWHT

SEQ ID NO: 58980 - protein, 268 aa, Fischerella sp. AEA-2001/1
QPNAMGGREAGGLAHLLPGYRLVKNPQHRAEVEEIWGLKRGQISPNPGLTAWDMITGLEDGNVGLLWIAATNPAVSMPDLERTKAALMRSPFTIYQDAYYPTETATYAHVLLPAAQWSEKTGVMTNSERRVTLCPAFRRPPGQAEPDWEIFAEVGRRLGFVGEFAFANSAEVFAEFVKLTCDRPCEMTGLSHEQLQPQGPTQWPHPDKEIEKRGNGESKRLYTDLRFHTPDGRARFGAYHSRGLAEPPDPDYPFVLTNGRLYGHWHTL

SEQ ID NO: 58981 - protein, 273 aa, Klebsiella pneumoniae
QPNAMGGREVGGLANMLAAHLDLDNEDHVQAVQTYWNAPLMPAQQGLKAVDLFNAVEQGKVKFIWIMGTNPVVSMPNRLQVKRALRKCDMVVVSDIVASNDTLNFAHVALPATGWSEKNGTVTNSERRISRQRGILAAPGEAKHDWQIMCEVAKAMGFANAFSFSHPAQIFSEYAGLTAYQNNGKRLLNLSPLQGLSEAQYDELSPIQWPIRHAFEQGNELVSLRLSPINKFSTANGKAPVSTRKNLTHRCNLPNAAYPFIVNSGRVRDQWHT

SEQ ID NO: 58982 - protein, 821 aa, Ustilago maydis 521
MHGNTSHASSPGGVESDQSSRYTSARSRPRSRPRTHHQRGLGQDSDEDTTSIQMDEYELDHRPGGSSKRHVDNVKSADNEDEEDLEQGEDALMLGPASASASGLDEHGEAYELGRSKPKHRAGRRHVSTGSISDKYDPDDPMHLVSKAVPEHDDPTLPALTWRALLIGSFFCVIGAAIAQLFFYKSNSPSFSSYFVILISLPMGRWLANRLPERTIKVSRWSVQLNPGPFSIKEHMLVAIIASSGATSAYASDIINIQELFYHQHMNWLSSLTLLITTQVLGFGFAGMVTNLLVKPTSMIWPSTLVTTSLFHTLHDKQAPNNRARLRLFAFAFVAIYVYQFLPALLAPTLSSVAMLCLVDNKIPAFRFLSSGYHGLGFLNLTFDWNAAGMSGPFYQPWWAALNFYAGFAGMMYIAMPILYWGFNFWNAQSFPEILSAGLYNKEYKKFAVDTLLNKDNTLNAQAWETQKPMLLTPYFALSYGLGFATLTSTVTHVLLWHWKDIKKAASNDVHDDVHNRLMRAYQPVPRRWYATTFALTTAAAVMLVVLTPALQLPVWALLLAIVMGLLFIAPLGILRAVSDTGVGLNIISEFVIGYIMPGNPIGNILFKTMAYMSLNQALDLVNDLKLGHYIKIPPKHMFVAQLWGTMIGCVVNLTVVNIVLDPASGYRAFLDGTVEDPSGQWDGRKVHIFFSASVIWGLVGPAEFFSGDYRKLYSGFLFGALLPLIPYFLHRRYKLKWLPKVAFPIILHSAALPPAVPTNVIMTGFFFSWLSQKHLREKHPVWFEKFNYVLSAALDAGSSVNALTIFVLTISLLNQSASGC

SEQ ID NO: 58983 - protein, 172 aa, Glycine max
  misc_feature (81)..(81): Xaa can be any naturally occurring amino acid
  misc_feature (86)..(86): Xaa can be any naturally occurring amino acid
  misc_feature (111)..(111): Xaa can be any naturally occurring amino acid
  misc_feature (119)..(119): Xaa can be any naturally occurring amino acid
  misc_feature (130)..(130): Xaa can be any naturally occurring amino acid
  misc_feature (140)..(140): Xaa can be any naturally occurring amino acid
  misc_feature (155)..(155): Xaa can be any naturally occurring amino acid
MASSMISSPAVTTDNRAGAGMVAPFTGLKSMAGFPTRKTNNDITFLACNGGRVQCMHVWPPVGKKKFETLSYLPDLDDAQXAKEVXYLLKKGWIPRLEFEFGAPVFVYREXHNRSPRYXMDAYWNLWKAXPMLGATESSXGVKGTSEAKNAYPNXGFIRIIGFETVAQGEGI

SEQ ID NO: 58984 - protein, 267 aa, uncultured marine bacterium
QPNAMGGREVGGLANQLAAHMGFSAEETDRVQRFWQSPRIARQPGLNAVALFQAIAAGQVKAVWIMGTNPAVSLPDADAVRQALKQCPLVVVSDVMAMTDTAELAHIRLPALAWGEKEGSVTNSERCISRQRAFLSPPGQARADWWILSQVAQRMGYGEAFGYQHPSEISSEHAALSAFENNGTRAFDIGPLAGRDKQQWLGMTPVQWPVNEQHPAGCLRLFGDKRFFHADGKARLLPVTPRLPQNAVSQRYPLVLNTGRIRDQWHT

SEQ ID NO: 58985 - protein, 378 aa, Oryza sativa
  misc_feature (366)..(366): Xaa can be any naturally occurring amino acid
MATGKVIKCKAAVAWEAGEALSIEEVEVAPPQRMEVRVKILYTALCHTDVYFWEAKGQTPVFPRILGHEAGGIVESVGEGVTELAAGDHVLPVFTGECKECDHCKSEESNMCDLLRINVDRGVMIGDGKSRFTIKGKPIFHFVGTSTFSEYTVIHVGCLAKINPEAPLDKVCILSCGFSSRFGATVNVAKPKKGQTVAIFGLGAVGLAAMEGARLSGASRIIGVDLNPAKFEQAKKFGCTDFVNPKDHSKPVQVLIEMTNGGLDRAVECTGNINAMISCFECVHDGWGVAVLVGVPTKDDVFKTHPMNFLNEKTLKGTFFGNYKPRTDLPNVVELYMKKELELEKFITHSVPFSEINTAFDLMLKXGESLRCVMRMDE

SEQ ID NO: 58986 - protein, 273 aa, uncultured marine bacterium
QPNAMGGREAGGLCNILPGYRLVNNPQHRAEVEQFWGVRPGTIQPQRGRTAWEMIQGLETGEVGFLWIAATNPAVSMPDLKRTQAALKRSPFTVYQDAYYPTETAAYAHILLPAAQWSEKTGVMTNSERVVNLCPQFRDPPGVARADWEIFAEVGQRLGFEKQFSFPNSAQVYAEFVKITEGRPCDSSGLSYEKLRRYGPLQWPYADTWPYLEGEELDRQNRTNMRLYTDFCFNTPDGRARFGAYHSRGLAEPSDQAYPFVLTTGRLYGHWHT

SEQ ID NO: 58987 - protein, 431 aa, Bordetella bronchiseptica RB50
MSEPKQPSWRLETIAVHGGYRPDPTTRAVAVPIYQTVAYAFDDTQHGADLFDLKVPGNIYTRIMNPTTDVLEQRVAALEGGVAALALASGQAAVTYAILTIAEAGDNIVSSSTLYGGTYNLFAHTLPQYGITTRFADPRNLASFEALIDERTKAIFAESVGNPLGNVTDIAALAEIAHRHGVPLIVDNTVPSPYLLRPIEHGADIVVQSLTKYLGGHGTSLGGAIIDSGKFPWAEHKARFKRLNEPDVSYHGVVYTEAFGAAAYIGRARVVPLRNTGAAISPFNAFQILQGIETLALRVDRIVENSVKVAGFLRDHPKVEWVNYAGLPDHADHALVRKYMGGKAPGLFTFGVKGGREAGARFQDALQLFTRLVNIGDAKSLATHPASTTHRQLNPEELEKAGVREETVRLSIGIEHIDDLIADLEQALAQV

SEQ ID NO: 58988 - protein, 850 aa, Candida glabrata CBS 138
MKVSDGSKEVVCRERKLSSESRTSSESFSFLRRSNSSRSLLDDILSSSSSTSVKKNLKSVKKMAPFLNYKDLGESIGAITYPYSMAPWVPNLLEVDNSGIKLDSDLERVMGVMREGVVLKKVTRKKQREYMFKLEKNKYITWKDGLKKLNLDSIKSIRPGELGSNYREEYNVDASYSKYWVTIIYKVSNKLKALHVIARDESDYNVFCSLVFGLVRTRRELMESLAVPDHDKFADIHWNRALSRNPDEKAEEVLGFEDVRQMCQRFHIYCSAGYLRRFFDAADTNNSGTLSFEEFQVFVKLLKARKEIDDVWQEAVGLHEDKLTFDTFYKFLTEIQRERMDEDEARHLYERYETAGGGINKQGFEKYLTTSPYMLPNNEDYSRPMNQYYIASSHNTYLTGKQIGGAPSVEGYIQALQQGCRSVEIDMWDGESSPVVCHGVLTSALPLSSVTQIIRKYAFITSPYPLIISMEVRCNSKNQRIAASIFKDTFGDLLYTCEDRSELPSPLELRHRILLKIKKTKTVIGDCHSDKSMNVVVSSSSSSRSSYDESTAMTKTGSRIRRLSFSKRQVAIVDELYELAGLRGVKFRNFSLPESKTLYHCFSLDERRLDKMLGDAQVAAAVDKHNRRHMMRVYPHALRYRSTNFEDPVRFWRLGVQMVATNWQTNDVGHQLNVAMFQLNTRNQQQMPSGYVLKPGWLARPPSKRRRERCGAVLRVTFEVISAQLLPNLSESTETKSQAASIGAAETEDPYYTQVTCEMFSCGSTVEKSSKCHENGFSPVWRSALSQDVRRDEYPFVFVRVVVRRCEEVVATTCVRVCQLREGYRHIPLCSPDGEQYVFSTLFVRYRVTV

SEQ ID NO: 58989 - protein, 443 aa, Colwellia psychrerythraea 34H
MTVKLTLPTQSKMLSKDFVYGVATASFQIEGGKASRLPCIWDTFCDTPNTIADGSNGEMACDHFNRWQDDIELIDSIGVDAYRLSISWPRVITESGELNQEGVAYYMNILDTLKSKRIKAFVTLYHWDLPQHLEDKGGWLNRETAYEFRNYANLISKVFGNRVHAYATLNEPFCSAFLGYEVGTHAPGIIGKEFGKKAAHHLLLAHGLAMEVLAKNSPNTLNGIVLNFTPCYPESESLADINAAAFADDYFNQWYIKPLFDGKYPEILSTLPAAHQPDIHEGDMAIIAHSMDYLGVNFYTRAIYRADVDEHFLQIDPPEPRTDIGWEIYPKAFTELLVSLNEKYRLPPVYITENGAAMADKIIDGVVNDQDRVDYYQQHLNAVNDAIEQGVKVDGYFAWSLMDNFEWAEGYLKRFGIVYVDYETQVRTIKASGFAYKALITNR

SEQ ID NO: 58990 - protein, 286 aa, Pseudomonas aeruginosa PAO1
MSDYQETLYQGYGQRFSIDNMLHEVRTEHQHLVIFENARMGRVMALDGVIQTTEADEFIYHEMLTHVPILAHGAARRVLIIGGGDGGMLREVAKHKSVERITMVEIDGTVVDMCKEFLPNHSQGAFDDPRLNLVIDDGMRFVATTEERFDVIISDSTDPIGPGEVLFSENFYQACRRCLNEGGILVTQNGTPFMQLEEVRTTAARTDGLFADWHFYQAAVPTYIGGAMTFAWGSTHEGLRRLPLETLRQRFRDSGIATRYYNADIHLGAFALPQYVLQAIGKQDND

SEQ ID NO: 58991 - protein, 492 aa, Arabidopsis thaliana
MLLRTMAATSPRPPPSTSLTSQQPPSPPSQLPLRTMPGSYGWPLVGPLSDRLDYFWFQGPDKFFRTRAEKYKSTVFRTNIPPTFPFFGNVNPNIVAVLDVKSFSHLFDMDLVDKRDVLIGDFRPSLGFYGGVCVGVNLDTTEPKHAKIKGFAMETLKRSSKVWLQELRSNLNIFWGTIESEISKNGAASYIFPLQRCIFSFLCASLAGVDASVSPDIAENGWKTINTWLALQVIPTAKLGVVPQPLEEILLHTWPYPSLLIAGNYKKLYNFIDENAGDCLRLGQEEFRLTRDEAIQNLLFVLGFNAYGGFSVFLPSLIGRITGDNSGLQERIRTEVRRVCGSGSDLNFKTVNEMELVKSVVYETLRFNPPVPLQFARARKDFQISSHDAVFEVKKGELLCGYQPLVMRDANVFDEPEEFKPDRYVGETGSELLNYLYWSNGPQTGTPSASNKQCAAKDIVTLTASLLVADLFLRYDTITGDSGSIKAVVKAK

SEQ ID NO: 58992 - protein, 129 aa, Triticum aestivum
  misc_feature (80)..(80): Xaa can be any naturally occurring amino acid
AGVHKVVEQTVCVLLEGDIETSYTKADNSVVVATDTQKQTTYILAKQNPIDPPEQFAAIIGDHFVKTYPHIHAAHVKIVXHRWTRMTIDGKDHPHSFFRDGEETRVVQSVTRQNEGISIRSKDREAAPG

SEQ ID NO: 58993 - protein, 461 aa, Rubrobacter xylanophilus DSM 9941
MVDPATGEEVDSVPVCGEAEVDAAVRGAAGAFPGWSGTPASRRGELLARAAEAVLGARDELAGLLTAEQGKPLREARLEIRRFVHTLEHYAGLAKNIRGGYVPDLDEGAYGLILRRPVGVVGAIVPWNFPTTLLANKLGPALVAGNVVVAKPAETTPLTTLRIAEIMHGAGLPAGVFNVVTGDGPTTGQALAGHPSVRKVAFTGSTPVGKKLAALAAGDLKRVTLELGGSDPMIVCDDADLDRAASAASVGRFFNCGQACLAVKRLYVFESVAEEFVEKLVGKAKRLRVGPGRAEGTIIGPLHTPEGRELLEGQVRDAVESGARVLAGGRRPEGEVFERGNFYEPTLLLEPSHESRVATEEVFGPALPIWRVGDLEEAIERANGSIYGLGSSVWTADLDRATEAAERIEAGYTWINSPQVIYDELPFGGWKQSGYGKEHGMEAIEYYTETKSVVVRRAYQG

SEQ ID NO: 58994 - protein, 938 aa, Oryza sativa (indica cultivar-group)
MADPAAEETVPAPPPTPAVDPAEGASDAPQPVELPADTAAASPEKVSSPPPEPAPAVRSRGFRLLGEDTSVHKALGGGKTADVLLWKDKKTSAVVIGGATVIWILFEVLDYHLLTLLSHVMIGALAILFLWSKATTFIKKSPPDIPVVQIPEDVAVNVSRALRSDINRALHLFREIALGHDLKKFLGVIVALWVLSEVGSCCDFLTLIYVAVLMLHTVPILYDKYQDKVDHFAGRAHSEACKHYEVLDAKVSVIKHDKPLFMIFVLFDLPHPRWRVRRKPPEPAIDAYDGDSNNGGGYGDSHNGGGYGDGSTVGGYGADNTGGVYGGGGTRPLYWAEHRFGAGISTRDFLAQPLYPSREGGHTSFTFGGFGKGSSSSQNPSQLEFGALDLNSAYEWSAMHGYQDLRSGGREGSQCPLGLHVRLGARTARSGFVGAPMVKEQADMGRSDGGTRSRRPAFDWCWVRTANATAIWRCRPRRRLRASHPSSGSGRIVGARPRQGLWCTASAHRVKLRTYTGLGHWPDGTVVASDKWWDDNTKNHAELKKPKNGMPKYLDELDRMFMGVHNELQKDKVAAMDNYLGRREKKKDDEMARVREVAERIMGLSRECGVTDKTPKLWVGILKMLKDPVGINVFELSNPGGRKTLIENYARPPACTCARHERCRSCPVPTTNAVAAVVHSVWHDNFDTESTRLLTIAPRAIHVTVSVQYPGCAVAQAGTGGRRKYAQLTTEERYDMVKANVNELHPIQVGLAIRTDDGGGELVVFEFNLRGFDINNPANLRDPASIAHLRGRGVDFGRLPHARIEPHRLRSLLLGSGLLQTRPSWATFTGAYHIGYLMKILTGAEVPSGLDAFMAMATATLREGVYDVKRLAAEVNTANRFLLREIATCLGVVPAVAQGMVTGADTVSTLQCFEALRERLGEVRVVMHSHQLCGLPIY

SEQ ID NO: 58995 - protein, 437 aa, Arabidopsis thaliana
MAEEKSFKYVIVGGGVAAGYAAREFFNQGVKPGELAIISREQVPPYERPALSKGYIHLENKATLPNFYVAAGIGGERQFPQWYKEKGIELILGTEIVKADLAAKTLVSGTGQVFKYQTLLAATGSSVSTIYPCTSYFGSADAKNIFYLRELEDADYLAYAMETKEKGKAVVVGGGYIGLELGAALKANNLDVTMVYPEPWCMPRLFTAGIASFYEGYYANKGINIVKGTVASGFTTNSNGEVTEVKLKDGRTLEADIVIVGVGGRPIISLFKDQVEEEKGGLKTDGFFKTSLPDVYAIGDVATFPMKLYNEMRRVEHVDHARKSAEQAVKAIKAAEEGNSIPEYDYLPYFYSRAFDLSWQFYGDNVGESVLFGDNDPESPKPKFGSYWIKERKVVGAFLEGGSPEENNAIAKLARAQPSVESLEVLSKEGLSFATNI

SEQ ID NO: 58996 - protein, 271 aa, Legionella pneumophila str. Paris
MPTRVIEDKGDMTPSFGIDDRIFLGEGLFETIRVNSSKPSFAYMHWERLGNSARQLGIPFEISFDDWFEHLIQKIQKDNLYHGGIKAILSGGPASRGLAERGQVSQLIFQTFNYSIQKHPVRLISINWLRDKANPLYQLKSVNYLEAIIAQRQAIAVGADDALFFNTENHVTETTCANLFLIENNILYTPRVDDGILPGITRARLISHCQQHKMSVQEISLTKKRIEDADAVFLTNSLQGIRRVLSLDNIIFEVNHPIIDKLIFLLNQDES

SEQ ID NO: 58997 - protein, 338 aa, Cordyceps bassiana
MAPVKVGINGFGRIGRIVFRNAVEHNDIDVVAVNDPFIEVKYAAYMLKYDSSHGLFKGEVAIDGNDLVINGKKVRFYGERDPAAIPWKETSAEYVVESTGVFTTTEKAKAHLQGGAKKVIISAPSADAPMYVMGVNEKSYDGSADVISNASCTTNCLAPLAKVIHDKFGIVEGLMTTIHSYTATQKTVDGPSAKDWRGGRGAAQNIIPSSTGAAKAVGKVIPELNGKLTGMSMRVPTANVSVVDLTARLEKGASYDAIKAAIKEAADGPLKGILGYTEDEVVSTDLNGNTNSSIFDAKAGISLNDNFVKLVSWYDNEWGYSRRVLDLISYVAKVDASK

SEQ ID NO: 58998 - protein, 268 aa, Leptolyngbya boryana
QPNAMGGREAGGLSHLLPGYRSVTNPGHRAELETFWQLPTGSISSNPGLTAWEMITGLETGNLGMLWVAATNPAVSMPDIERTKAALRQSPFTVYQECYYPTEMADYAHVLLPTTQWSEKTGVMTNSERRVTLCPQFRVAPGEARSDWEIFAEVGRRLGYRKQFAFNYAAEVYAEFVRLTRDRPCDQSGLSHTYLREMGATQWPFSSKAEPTQQKVEKAKRLYTDLKFHTPDGRARFSLVYSRGLAEPPDDNYPFVLTTGRLYGHWHT

SEQ ID NO: 58999 - protein, 251 aa, Avena strigosa
  misc_feature (51)..(51): Xaa can be any naturally occurring amino acid
LLDSMKASSPRHEDWIEKHPSALEWFEAVLAAAKGKQVVMFLDYDGTLSPXVEDPESAVMTEDMRDAVRAVAQHFPTAIVSGRCRDKVFNFVKLEELYYAGSHGMDIKGPVLCQPAIEFLPVIQEVYQTLTAKMQSIPGATVENNKFCLSVHFRCVAEEEWDGLGEEVRAVLDGYPDLCLTKGRKVLEIRPSIKWDKGNALEFLLESLGYAGRGDVFPIYIGDDRTDEDAFKVLRNMGQGIGILVTKFPKE

SEQ ID NO: 59000 - protein, 259 aa, uncultured marine bacterium
QPNAMGGREVGGMANLLAAHRNLASADDRQEVADYWGVDKISDKPGLTATEMFKALESGEMKAVWIVCTNPLVSLPDARQAERALKNAKFVVVQDISSKSDTADYADLVLPAAGWTEKEGTMTNSDRRISYLPQINEAPGEAIPDTDILLKFAKAMGWEGFDYDSTEAVFNEHRELTRGTNIDITGLSYDYLKTKGTAQWPFVEGATEGTKRLFEDKVCWTPNQRAQIHTSLAANQSEKLTPDHPLVLTTGRIRDQWHT

SEQ ID NO: 59001 - protein, 241 aa, Pennisetum glaucum
  misc_feature (143)..(143): Xaa can be any naturally occurring amino acid
QIVMFLDYDGTLSPIVADPDAAYMSDAMRSAVRDVAKHFPTAIVSGRCRDKVRNFVGLSELYYAGSHGMDIKGPSSNPESVLCQPASEFLPVIDEVYKLLVEKTKSTPGAKVENNKFCLSVHFRCVDEKRWNALAEQVKAVIXDYPKLKLTQGRKVLEIRPSIMWDKGKALEFLLESLGFANCSDVLPVYIGDDRTDEDAFKVLRKRGQGLGILVSKCPKETNASYSLQDPGEVMEFLRKL

SEQ ID NO: 59002 - protein, 369 aa, Candida albicans SC5314
MFAQLINKGFTAPPPVATTGSPTSSSWEITTTTNEKSSSTTSLSTVYIPFSTPSSESHIPSEPELTQEHKDKYLHVLNHFQQSDLKIAISEETHKHKQKTKELTIGEKSWITRECILRYLRATKWHESEAIDRIELTLSWRREFGISEPFDNENKVNGELVSEENETGKEVILGYDNDSRPCLYLKPGRQNTKTSERQVQHLVYMLERVIDYMPAGQDSLALLIDFKAHPVGTQSGKIPPVGIGRQVLHILQTHYPERLGKALLTNIPWLGWTFLKIIHPFIDPLTREKLVFDQPFINYVPKEQLDKDFEGLVNFEYDHKKYWDVMIKISQDKKHQYFERFEKFGGIVGLSEVDLRGNNEELIHPVGSI

SEQ ID NO: 59003 - protein, 952 aa, Ustilago maydis 521
MVKEVSSAVEFDAELNAAGSKLVVVDFHATWCGPCKVIAPIFQRLASQYTSVVFLKVDVDRVQPVAQRYSVCAMPTFLFLKNKSVVDTLQGADPNRLTALVKQHSSGASLAFSGSGQTLSGGSSSSSSSFGARVAGITDGHSSLLNTVEPKRSSALNEKPNHRLQDILGGPTGGKWLESDADEQLLIHFTFKQQVKLSGILLRTLPSQLAHAPKEIKIFANRPGLSFDDATADKGDQEAELSEDFVRGGENGGGGKALSLRFVKFQKVDSLTIAVLTNQSDAETTRIDAIDLYGVADQTTDMSELQKIAAEGGDRDFDFRTASKTGLKGGSSSRSARTGFHGPRSSSIPDMSTPAEPPLRPARSHSTSSLNSALPRYRRTTSSTSVPPMQHVDEEDGNDYADDGNYSRHSQPQTAFVPQAPPSLSEEEQAEFEAAQKAASETLGGWHYAPLAVALAPPLGSLLGGHSDAWSDAILLILASFWLYQFLRVPWEIYYASRTRSILTHDQDQDEIEHAEQVTLDGSPSSAPESSETGVQKEVRRAAAAELRRSELLSLVFCMLSPIMGAYMLHWMRETMTDGNKYLNTFNIRLFTLAAGIKPWSHAMSLVRRRMLHLQEEVHYPSSKVEKMNQRLRRLEADLSSLRKLYATKTELRLLREHDAELGRALRRSERKEEHLRLSAEEKFSIVEGRLEDLLREVAINAELIEEERRERERAASLRISLFEAIKYLLGSGLTIRRASPKHYLHDMPRSLPSTASLGIGAQSAEADLNMEAHTPGAPLPASVPIVSPTRPPRTIASATPDRPSSSSRGLASIQSEQPAAANVVNRPDHPKVGAVVERSRSRNNAHHISDPWWERGAAFYLFLPLNVSSAAVRFAGEKVKHILEDSENEAARNQRKTLQYQKHLADQQLQQHQRKISQKQYQHQPMLSPTRNRADASTIKIASASANPRTR

SEQ ID NO: 59004 - protein, 262 aa, Trichodesmium erythraeum IMS101
QPNAMGGREAGGLAHLLPGYRMVKNSQHRAEVEKLWELTPGKISDVPGRSAWEMIMALERKEIGCLWIAATNPAVSMPDLKRTKAALLRSPFTIYQDAYNPTETAEYAHLLLPAAQWGEKTGTMTNSERVVTLCPAFREPHREAKADWEILAEVGRRLGFTNHFNFADSEAVRAEFLELTRDRPCDMTGITYQRLQEKGPTQWPCPDSSGVSQERLYTDFRFNTPDGRARFAAYYSQGLAEPPNPDYPFILTTGRLYGHWHT

SEQ ID NO: 59005 - protein, 1429 aa, Colwellia psychrerythraea 34H
MFSQKSVLRVIVLASVSMVLVACGGSESTEPGEVLLSCDVPMVSDAAGTSCVAPEPIECPVPTVPDALNESCVVGIDPKAPEPIIFAGENQALLFYNRADGEYSDYKMHNWNSAECDAYAADSLAPSWDNGLAHTGVDPVYGAYWLLNLKDDHNECGHFIIHKGTDDAGKEFGGGDFKMPLFQDDETYQRMNFTFSGVASIFEYPVVTLGKQALAISGFSAHWIDSNTFTWNVNFDLVTSVKLHHSATAGIGADEANEDVITGTVVELSEVDLTDEQKAAAPLVADWPAFSGNWSIEEAKAIAKNQLVLVGYNAEGLAVAATNVQADLVLDDLYTKGEMDANEATLGVVYDNGTVKVSVWSPTAQQLKLNVYNADKEMVSSHDMTEDSMTGVWSYTGDASLDRQFYRFALTLYHPENKAIEEIESTDPYSLSLSTNGEYSQFVNLSDEDLQPEGWDGHAVSTIENYEDAVIYEGHIRDFSAQDESTSVENRGKFLAFTEINSAPMQHLQKLVANGLTHFHMLPANDIATIDEDADKIIDLDSTVLALCKVNFKAPPCYQNLDDQTLRAVFESYSPYSNEAVKLTEAMRDTDSFNWGYDPKHFNVPDGIYASNPDGVSRIKEMRAMIKSLHDIGLRVVLDVVYNHTNSAGLWDNSVLDKFVPGYYHSRDVTTGAVQNSTCCSDTALEHRMMDKLMVDSLKQWTEQYQFDGFRFDIMSQGSKEQMLAARDAIQAIDPDNHFYGEGWYKDSRGFERADQENMAGTEIATYNDRIRDGIRNATLFNNESDSDYPFEQQDIVKFGMAGTQTDYVLKTFKGTDVVGSSAGMYAKDPADIINYVSKHDNETLWDILQFKLSPEMNNSERVRAQNISQSIVLLSQGIPFLQMGGDFLRSKSLDRNTYDAGDWYNLVDFTFELNNWNKGLPLDNGGRDYDDIVSLASSSSSTVSMTDILFASNVFNEFLSIRTSSPLFRLTTATDIINRVGFHNIGKNQTQGLIVMSIDDGSTLTDIDPNYDALVVVVNGTNSEQTHTIASASNFTLHPLLAGSVDGTVASATFEQGTDEGSFTVPPLTTAVFVKVQGESQASGLSAYVTAGAPDVVPYGDTVAYVRGEMNGWNPDDAFTYIGDGVYQAKITLAAGSYGFKVADFDWSSNINLGAPGSGGEVLEDQTFNLLPGSNDNLSITVAIDGTYFFTLDASNTDAPTLLVENEEPFVGTPIFIRGDMNGWGEDNELIYIGNGKYQATITISVSTPSFKIASADWSTVNMGAPADDMEITEGENQLLLSGSGDNFSMNFTVDGDYTFVFDASDLAEATLSIYSAEIFGATPVFIRGDMNGWGEVDQLSYAGASSYSVELNLTAGDYGFKIASGDWSTFNLGAPADTSVVALDSPLTLLQNSQDNLSVTIVDDGVYIVTVTGPDPTTPTINISKKL

SEQ ID NO: 59006 - protein, 260 aa, Vibrio diazotrophicus
QPNAMGGREVGGLANQLAVHRGFDTESVRLVKEYWQSPSIAAKPGLKAVELFEAVEAGKIKVLWIMATNPVVSLPNSDQVRRALKGCDFVVVSDITEQSDVAEYADLVLPAAGWGEKQGMVTNSERRMSRQRAFLPAPGEAKPDWWAVTQVGKKLRTKLNCESGFEFDSEAAVFREFAGLSAINTNSNYLFDLSKFASISDEEYANWQPTQWPLEKEAPYHDGVFSTPSGKAQFVAVTAPSTVMNGWWLNTGRLRDQWHT

SEQ ID NO: 59007 - protein, 130 aa, Oryza sativa (japonica cultivar-group)
MAALPRRRRAGCRYPRIQAVDLDQNTIVAISVGVVSVAIGIGIPVFYETQIDNAAKRDNTQPCFPCSGSGAQVCRFCTGKGTVTVVIGGGETEVSNCVNCDGVGSLTCTTCQGSGIQPRYLDRREFKDDD

SEQ ID NO: 59008 - protein, 343 aa, Cytophaga hutchinsonii ATCC 33406
MSDQSMSVTLLAIESSCDETAAAVIQDGNILCNIVASQRIHEKYGGIVPELASRAHQQHIIPVVAQALLEANIQKSDLNAVACTSGPGLLGALLVGVSFSKAFASALHIPVIKVNHMKAHILAHFIGDVKPSFPFICMTVSGGHTQLVIVRNYLEMEVVGETQDDAVGEAFDKTAKLMGLPYPGGPLIDSYAKQGNPLAFPFPTVDMPGYNYSFSGIKTAFMYFLKKNTAVDPDFIQKNLPDICASVQHALIDVLMRKLKRLVVDTGINRVAIAGGVSANSGLRKAMEQKREQEGWDVYIPAFEYCTDNAAMIAVAGYHQYLENDFAGWDLSPEPRLRIGGGL

SEQ ID NO: 59009 - protein, 801 aa, Staphylococcus aureus subsp. aureus Mu50
MAKQKLVMIGNGMAGIRTIEEILERANDLYDITVIGKEPYPNYNRIMLSNILQNKMTVEETIMNPYEWYEEHGIELITNDPVIEVDRANQSVTTANGIEVSYDKLIFATGSKAFVIPVPGSTLPSVIGWRTIDDTEQMMNIAKTKKKAIVIGGGLLGLECARGLLDQGMEVTVLHLAEWLMEMQLDRKAGNMLKADLEKQGMKFEMQANTTEILGEDDVEGVKLADGREIPADLVVMAVGIRPYTEVAKESGLDVNRGIVVNDVMQTSDSNVYAVGECAEHNGKVYGLVAPLYEQGKVLADHLTNKETNGYKGSTTFTSLKVSGCDLYSAGQIVENAEIKGIEIFNSVDNNYKKIFLKDGNVVGAVLYGDIDDGSRFYNMMKKGESTEDYTLVSLLTKGGEEASLSIADMADDETICGCNGVDKGTIVNAITENGFTTVEEVTAKTKAGNSCGKCKPQIAQILQHTLGDDFVAAKPAAICGCTDLTRDQIVTQIRAKGLKTSKEVRHVLNFKNKGGCPKCRPAINYYLNMVYPHDHEDERESRFANERYHANIQNDGTFSVIPQMRGGVTDADQLIRLGEVAKKYHVPLVKVTGSQRVGLYGVKKEELPNIWEDLGMRSASAYGKKTRSVKSCVGKEFCRFGTQYTTRLGIRLEKTFEYIDTPHKFKMGVSGCPRSCVESGVKDFGIISVENGFQIYIGGNGGTEVEKAEFLTTVETEDEVIKLCGALMQYYRETGIYAERTAPWLRRLGFENVKEVLLDPERQNELFERIMDAKKAVEAEPWEAITSNAQARKIFEVEKV

SEQ ID NO: 59010 - protein, 267 aa, uncultured marine bacterium
QPNAMGGREVGGLANQLAAHMDFSEQDIETVKTYWNSPNIAKNPGLKAVDMFNAIATGQIKAIWIMPTNPLVSMPEVNQVRKALEQCELVIVTDCVKQTDTTELADILLPALAWGEKDGTVTNSERRISRQRAFLPSPGEAKADWWIINEVAKRMGFNDSFNYQSPDAIWREHAALTAANNDLQRDLDLSGLKDLSKLEYNRLQPVQGPCQDNSATNKNHMFEDRRFFHPDGKARFIPVKRCDSFPKTSLEYPLVLNSGRIRDQWHT

SEQ ID NO: 59011 - protein, 517 aa, Vibrio parahaemolyticus RIMD 2210633
MTKNIHDQRILILDFGSQYTQLVARRVREIGVYCELWSWDVEEADIREFNPDGIILSGGPESVTEENSPRAPQYVFDSGVPVLGVCYGMQTMAEQLGGKVAGSNEREFGYAQVKVSGESAIFKDLEATQDVWMSHGDKVVEIPADFVKVGETDTCPYAAMANEEKKYYGVQFHPEVTHTKGGLQMLENFVLGVCGCERLWTSESIIEDAVARIKEQVGDDEVILGLSGGVDSSVVAMLVHRAIGDKLTCVFVDNGLLRLNEGQQVMDMFGDKFGLNIIKVDAEERFLEALKGKSDPEEKRKTIGHVFVDVFDEESKKLKNAKWLAQGTIYPDVIESAASKTGKAHVIKSHHNVGGLPDDMEMGLVEPLRELFKDEVRKIGLELGLPYNMLYRHPFPGPGLGVRVLGEIKKEYCDLLRRADAIFIEELHAADLYDKVSQAFTVFLPVRSVGVMGDGRKYDWVVSLRAVETIDFMTAHWAHLPYDFLGKVSNRIINEVEGISRVVYDISGKPPATIEWE

SEQ ID NO: 59012 - protein, 144 aa, Hyphomonas neptunium ATCC 15444
MIIEQILNDKGREVITLRADDTLREAARLLDERRIGAVVTLDADGEIVGVLSERDIVRQFARQGEGALDMPVGNAMTRAVITISADAEVDEALQLMTDRRIRHLPVVRNSRLTGFVSIGDLVKWKIAETQAEAEAMKSYLSSQF

SEQ ID NO: 59013 - protein, 267 aa, Bacillus thuringiensis serovar konkukian str. 97-27
MWNYEAEEAKAVIVIVHGAMEYHGRYEAVAEMWNHIGYHVVMGDLPSHGTTSRNRGHIDSFDEYIEEVKLWVKEARKYRLPIFLFGHSMGGLIVIRMMQETKREDVDGIILSSPCLGVLAGPSAPLQAASKILNIIAPKLQFATNLTVEMSTRNHEVRDAMENDSLFLRKVSVRWYSELIKSIEMAHKKINDFPDVPLLLMQACEDKLVDKTRVRTWFDNVKISDKAFKEWPNCYHELLNEYERDEILNYIQSFTEIRINNIIETNK

SEQ ID NO: 59014 - protein, 293 aa, Triticum aestivum
NKFVQKSRLVPVRNSRDIVDPRVRPRGRVGEDNLHGKRSKPALPWEKRYRAAVGVAEALSYVHSGCSRPVIHRDVKSSNILLTDDFEPQLSDFGLAIWAPSSPSSLTHSDVVGTFGYLAPEYFMYGKVTDKVDVYAFGVVLLELLTGRRPITGDGSPKGHHQSLVMWATPILNGGDISDLLDPSLDVKHDEVEVRRMAVAASLCLGRSARLRPPISQILSILRGEEDATSLAASEPDCVVDDETYPAANVRSHLGLALLDVEDAESISSTEHTNLSPLEEYLRERCSRSSSFD

SEQ ID NO: 59015 - protein, 244 aa, Staphylococcus aureus subsp. aureus COL
MTKSALVTGASRGIGRSIALQLAEEGYNVAVNYAGSKEKAEAVVEEIKAKGVDSFAIQANVADADEVKAMIKEVVSQFGSLDVLVNNAGITRDNLLMRMKEQEWDDVIDTNLKGVFNCIQKATPQMLRQRSGAIINLSSVVGAVGNPGQANYVATKAGVIGLTKSAARELASRGITVNAVAPGFIVSDMTDALSDELKEQMLTQIPLARFGQDTDIANTVAFLASDKAKYITGQTIHVNGGMYM

SEQ ID NO: 59016 - protein, 873 aa, Nocardia farcinica IFM 10152
MLKHLARAGVLSARGAAEYSLAALRDRDPASRDRRRAEAVLDFLVRMGPIYIKMGQIAATRSDLFGPDWVSTLRVLQDQTPHMTAAQSRRAVERELGRPLTQVFRRFDAEPVASASVAQVHVAELLDGRKVAVKLVKDGVPEQIEESLKSIATLLRLLNRATPRLRELDVATRFDEIARLLRPQADMTHEAAQQRRIHANFAGHPYVTVPAVLDELVTSRMLVMQFMDGIPGKRVEEVGFPRDQLARRLQDVIYTMLYMHGVCHGDPHPGNVMFGPTGELILLDYGVTVELTEDEKWGLSSFYYACTRKEWHNAIDRFTRYFVLADEKLHRNRAAYDAEMAEVLRYHFDISSSQWSTISYFNDVSAVLRKYDSRYTTNFTKVELVFLSCEGFASQIDPDIDIWANARRFTDRYSPYMSAEVEARFAAGFAEQMPTSLRLRDRAQATLVAPTHIDRYFFPSGFPVFVESAAGGRVRDFDGNDYLDLSGGYGPHLLGYGHPAITEAITTGVRRGLVNGIGNPGEIELAEQLVRAFPAADKAVLCNSGTEAILFAIRMARGYRRRATVAKFEGHYHGFSDQGMVSSWFRFSGDRHRPDPVAGSQGVDPATVANTVVMQYGDLDGLARIREHADELACVILEPMPTSVVALNVEFLTALRGLCTELDIPLIFDEVVSGFRVAYGGVQVLADVHPDLTCLGKVIGGGLPCGAVVGRAELIDTAKSSQDPFYDYENKVFAGGTLSGNSLTCAAGLAVLRHLDAHREIYDELESNTQRLAGMLREATAQREIACRINASRSIFSLNFSHRAAGLYRDRMAGSNFKATIALAYYMRKHQVYLPELHSFLISAAHTTEDLDQIAHAFDKSLDEMLADNLFVL

SEQ ID NO: 59017 - protein, 222 aa, Zea mays
METMSALARTAPPLAGTIRRPSCALRPTASLSFAAASTTPRGRLGLGLSTAPAGSGRAARARAVPRRIVASSEVEQSYIMIKPDGVQRGLVGEIISRFEKKGFLLKGLKLFQCPKDLAQEHYKDLKDKPFFPKLIDYITSGPVVCMAWEGDGVVASARKLIGATNPLQAEPGTIRGDLAVQTGRNVVHGSDSPDNGKREIELWFKEGEVCQWESVQAPWLIE

SEQ ID NO: 59018 - protein, 477 aa, Zea mays
  misc_feature (11)..(11): Xaa can be any naturally occurring amino acid
AMAEELGVFIXYVGGVEHAHVLLPPLETLCTVEETCVRDKAVESLCQIGAQMKENDIVDWFAHVVKLCQDDMPMVRRAAASNLGKFAATVEQSHLKTEIMSMFDDLTQDDQDSVRLLAVEGCAAPGKLLEPQDCAAHILPVIVNFSQDKSWRVRYMVANQLYELCEAVGTEPTRGDLVSAYVRLLCDNEAEVRIAAAGKVTKFCKILNPQIAIEQELSSDSSQHVRSALASVIMGMAPVLGKDATLEQLLPIFLSLLKDEFPDVRLNIISKLDQVNQVIGIDLLSQSLLPAIVELSEDRHWRVRLAIIEYIPLLASQLGVGFFDDKLGALCMQWLEDKVFSIRDAGANNLKRLTEEFGPEWAMQHIIPQVLEKINNPHYLYRMTTLQAISLLAPVMGPDITCQQLLPVVIASSKDRVPNMKFNVAKVLQSLVPILDQSVVEKTVKPCLVELSEDPDVDVRYYAHQALRACDQMVISS

SEQ ID NO: 59019 - protein, 248 aa, Sorghum bicolor
QIVMFLDYDGTLSPIVKDPDSAVMSEEMRDAVRGVAEHFPTAIVSGRCRDKVFNFVKLAELYYAGSHGMDIKGPTAQSKHTKAKAEAVLCQPASAFLPVIDEVYRTLTARTAPIPGATVENNKFCLSVHFRCVHEEKWRALEEQVRSVLKEYPDLRLTKGRKVLEIRPSIEWDKGNALQFLLESLGFADSNNVFPIYIGDDRTDEDAFKVLRSMGQGIGILVSKIPKETSASYSLREPSEVKEFLRKL

SEQ ID NO: 59020 - protein, 339 aa, Triticum aestivum
MAPELAGKMTAKAAVAAAKPATKAYVTFLAGAGDYWMGVVGLAKGLRKVGSAYPLVVAVLPDVPELHRKILVSQGCIVREIAPVYPPENHTQFAMAYYVINYSKLRIWEFVEYERMVYLDADIQVFDNIDELFDLPKGHFYAVMDCFCEKTWSHTPQYQIGYCQQCPEKVTWPAAEMGPPPALYFNAGMFVHEPSMATAKALLDTLRVTPTTPFAEQDFLNMFFREQYKPIPLVYNLVLAMLWRHPENVQLEKVKVVHYCAAGSKPWRFTGKEENMDREDIRILVRNWWDIYNDESLDFKGLPALAADADELEAAAKKPLRAALAEAGTVKYVTAPSAA

SEQ ID NO: 59021 - protein, 340 aa, Setaria viridis
  misc_feature (337)..(337): Xaa can be any naturally occurring amino acid
MTKHAGYATDEAVTAVAAPAPAGLHFSPFPPPKVAARDCKKVAALHVDRAAPGGGGGGSWFESMKASSPRRAADAEHGDWMEKHPSALTWFEPALAAAKGKQIVMFLDYDGTLSPIVEDPDRAVMSEEMRDAVRRVAEQFPTAIVSGRCRDKVFNFVKLTELYYAGSHGMDIEGPAKQSNKHVQANAEEAVHYQAGSEFLPIIEEVYRTLTAKMESIAGAKVEHNKYCLSVHFRCVQEEEWKAVEEEVRSVLKEYPDLKLTHGRKVLEIRPSIKWDKGKALEFLLKSLGYAGRSDVFPIYIGDDRTDEDAFKVLRGMGQGIGILVSKFPKETAASYXLRD

SEQ ID NO: 59022 - protein, 248 aa, Chasmanthium latifolium
QIVMFLDYDGTLSPIVRDPDSAVMTEEMRDAVRGVAEHFPTAIVSGRCRDKVFNFVKLAELYYAGSHGMDIKGPTAQSKHTKTKAEAVLCQPASEFLPVIDEVYRALTATTASIPGARVENNKFCLSVHFRCVQEEKWGALDDQVRSVLKEYPDLRLTRGRKVLEIRPSIKWDKGNALEFLLEALGFADSNNVFPIYIGDDRTDEDAFKVLRNMGQGIGILVSKIPKETYASYSLREPSEVKEFLRKL

SEQ ID NO: 59023 - protein, 268 aa, uncultured marine bacterium
QPNAMGGREVGGLANQLAVHMDIDNVQDQKDLKTFWQSPTMCEKQGLKAVDLFNAIGDGKVKAVWIMATNPVVSLPDADKVKSALSNCELVVVSDCIAETDTTAFAHIKLPATTWGEKDGTVTNSERRISRQRSFLSPPGQARHDWRIICDVAKRMGFGEQFDYQGPVDIFREYAKLSDYKNDGKRDFDISLVADISEEGYDNWTPTQWPITRRAPTGTQRMFDDGRFFTPDKKARFIPVTAALPANASDSDFPLTLNTGRSRDQWHT

SEQ ID NO: 59024 - protein, 246 aa, Eragrostis tef
QIVMFLDYDGTLSPIVKDPENAVMTEEMREAVRGVAEHFPTAIVSGRCRDKVFNFVKLAELYYAGSHGMDIKGPTAQCKHTKAEAVLWQPASDFLPVIEEVYRALTAKVEWIPGATVEDNKFCLSVHFRCVQEEKWGALDDQVRSVLKDYPGLRLTKGRKVLEIRPSIKWDKGNALEFLLESLGFADNSDVFPIYIGDDRTDEDAFKVLHNMGQGIGILVTKIPKETSASYSLREPSEVKEFLRKL

SEQ ID NO: 59025 - protein, 268 aa, uncultured marine bacterium
QPNAMGGQEVGGLANQIAAHMDIANDKHRDLVTRFWNAPNIATEDGLKAVDMFAAIERGDIRAVWIMGTNPVVSMPEANGVRQALEKCDLVVVSDLFANTDTAAVADVCLPALGWGEKEGMVTNSERRISRQRKFLTAPGEARADWRIICDVATRMGYSEAFQFSSVDEIFREHAALSAFENNGSRDFNLELAQNLSSQAYEDWQPIQWPFTATSPTGQKRMFSDGQFFTAHKKAKMLPVAAPVTPSQPDQDYPFVLNTGRIRDQWHT

SEQ ID NO: 59026 - protein, 280 aa, Colwellia psychrerythraea 34H
MQVLVVDYTAKDAAEKFVQSLHETGFAVLVNHPIKQSLVESIYKNWQEFFLSEEKHAFAFDPVKQDGYFSSEISETAKGHSKKDIKEYFHVYPWGRIPAQLNDEIFEYYRLASELAAELLDWVEEYSPADIADKYSETLSNMIKETPNTLLRILHYPPLTGNEEAGAVRAASHEDINLLTILPAANEPGLQVQRQNGEWIDVPSDFGNLIINIGDMLQETSAGYFPSTSHRVINPTGKGSDKSRISLPLFLHPRSEVVLSDKHTQASYLLERLRELGVKV

SEQ ID NO: 59027 - protein, 249 aa, Eragrostis tef
QIVMFLDYDGTLSPIVNDPDAAFMSETMRMAVRSVAKHFPTAIVSGRCRDKVFEFVKLAELYYAGSHGMDIKGPAKASSRHAKAKAKGVLFQPASEFLPMIEQVHDRLVEQTRCIPGAKVENNKFCVSVHFRNVDEKMWDELSETVKGVMREYPKLRLTQGRMVFEVRPTIKWDKGKALEFLLESLGFADCSNVLPVYIGDDRTDEDAFKVLRRRGQGVGILVSKHPKETSASYSLQEPAEVMEFLRKL

SEQ ID NO: 59028 - protein, 268 aa, uncultured marine bacterium
QPNAMGGREVGGLANQLAAHMDFTPDAIDRVQRFWQAPNMATQPGLKAVDLFNAVEQGKIKAVWIMGTNPVVSMPNADQVKRALQGCPLVIVSDCIASTDTTALAHVLLPAAGWGEKDGTVTNSERRISRQRALVECAGEARQDWRILADVATAMGYGETFAYRSNADIFREHVALSSFENDAAGFRQFNLAALKNITDTAYDSLQPVQWPLLQPEQGTQRLYADGFFSTADGKARFIAVSVRAPANAPDADWPLILNTGRVRDQWHT

SEQ ID NO: 59029 - protein, 260 aa, Cytophaga sp. AEA-2001/3
QPNAMGGRKVEGMASLLAAHRDLGNPRHREEVRQFWGGKEINGEPGLTATEMFDALESGKMKAIWITCTNPIVSLPNAKKIEKALEKANFVIVQDISHNSETTKYADLLLPAAGWLEKEGTMTNSERRISYLPKVIDAPGEALPDAEILWRFAQKMGYGGFDYNNVSEVYDEYCLMTKGTNIDISGLSHERLQKEGSFQWPVPSPEHKGTPRLFQDQKYFTANGKVHFNAPRNLYNKSEITTTDFPLVLNTGRVRDQWHT

SEQ ID NO: 59030 - protein, 416 aa, Streptococcus mutans UA159
MKTPFVSKEQLDKITAQFPTPFHLYDEKGIRETARAVNKAFAWNSGFKEFFAVKATPNPTILKILQEEGCGVDCATDVELKMADKLGFDRSAISFTSNDTQASEFVFARSINATINLDAYEHIAFLEEAAGLPETVSLRFNPGGVFSLGTDIMDHPEESKFGMTKEQLFQGYQDLKDKGVKSFGLHAFLASNTVTNDYYPTLAAQLFELAVEIKNELGISLDFINLSGGIGIDYSAADEQNDIAVIGEGVHQKFDDILVPNGLSQIKIYTELGRYMLASHGHLITKVLHLKDTYRHYVGVDASAVNLLRPAMYDAYHHITNISNPQGTVQVVDIVGSLCENNDKFAKRRELPEARVGDTLVIHDTGAHGFSMGYNYNGRLRSAEILLREDGQTQMIRRAETPEDYFATLYGFNFDR

SEQ ID NO: 59031 - protein, 415 aa, Linum usitatissimum
MGISEERVVAVIMVGGPTKGTRFRPLSLNIPKPLFPLAGQPMVHHPISACKRIPNLAQIYLVGFYEEREFAWYVSAISNELRVPVRYLREDKPHGSAGGLYNFRDLVMEDDPTHIFLLNCDVCCSFPLPEMLEAHRRYGGIGTLLVIKVSAESASQFGELVADPDTKELLHYTEKPETFVSDLINCGVYVFTPEIFTAIQGVSSQLKDRANLRRVSSFEALQSATRSFPADFVRLDQDILSPLAGKKQLYTYETRDFWEQIKTPGMSLKCSSLYLAQFRFTSPHLLASGDGSKSATIVGDVYIHPSAKVHPTAKLGPNVSISANARIGPGARLISCIILDDVEVMENAVVINSIVGWKSSIGKWSRVQAEGVYNAKLGVTILGEAVTVEDEVVVVNSIVLPHKTLNVSVQEEIIL

SEQ ID NO: 59032 - protein, 183 aa, Candida albicans SC5314
MRDSRTKFSFLDILRILGGILFLNAFLSWWFTSTSTWGYRGKWLNTDYLKFRLFNANNPLNLTISELSLYNGTDKHLPIYLAIDGIVFDVSSSPKVYGPGGPYHELTGKDAARVYVTGCFNKKDEYTYDLRGLDETEAENDIQSWQQFFFDHDKYWYVGTVQHEPITSDPPAPCEHMKFPGMH

SEQ ID NO: 59033 - protein, 259 aa, Pseudoalteromonas sp. AEA-2001/4
QPNAMGGREVEGMASLLAAHRDLGNPRHREEVRQFWGGKEINGEPGLTATEMFDALESGNEGHMDHLHQSHCEFAQCQKIEKALEKANFVIVQDISHNSETTKYADLLLPAAGWLEKEGTMTNSERRISYLPKVIDAPGEALPDAEILWRFAQMGYGGFDYNNVSEVYDEYCLMTKGTNIDISGLSHERLQKEGSFQWPVPSPEHKGTPRLFQDQKYFTANWEKYISIAPRNLYTNQKSQQPDFHWCFNTGRVRDQWHT

SEQ ID NO: 59034 - protein, 447 aa, Paenibacillus polymyxa
TIFQFPQDFMWGTATAAYQIEGAYQEDGRGLSIWDTFAHTPGKVFNGDNGNVACDSYHRYEEDIRLMKELGIRTYRFSVSWPRIFPNGDGEVNQKGLDYYHRVVDLLNDNGIEPFCTLYHWDLPQALQDAGGWGNRRTIQAFVQFAETMFREFHGKIQHWLTFNEPWCIAFLSNMLGVHAPGLTNLQTAIDVGHHLLVAHGLSVRRFRELGTSGQIGIAPNVSWAVPYSTSEEDKAACARTISLHSDWFLQPIYQGSYPQFLVDWFAEQGATVPIQDGDMDIIGEPIDMIGINYYSMSVNRFNPEAGFLQSEEINMGLPVTDIGWPVESRGLYEVLHYLQKYGNIDIYITENGACINDEVVNGKVQDDRRISYMQQHLVQVHRTIHDGLHVKGYMAWSLLDNFEWAEGYNMRFGMIHVDFRTQVRTPKESYYWYRNVVSNNWLETRR

SEQ ID NO: 59035 - protein, 610 aa, Hyphomonas neptunium ATCC 15444
MTTHLEKMRNIAIIAHVDHGKTTLVDELLKQSGTFRANEKTAERMMDSNDLEKERGITILAKTTSVEWNGYRINIVDTPGHADFGGEVERILDMVDGVIVLVDSAEGPMPQTKFVVSKALKLGLRPIVAINKIDKAERRVDEVLNEVFDLFANLDATDEQLDFPVLYGSGKMGWMSTQYEEVRPNMDELFQLVVDHVPTPKVAEGPFRFLATTISADPFLGRILTGRILSGSIKPNQSIKVLARDGQLVEQGRISKVLAFRGLERVPVDEASAGDIVSLAGMTKANVADTFCDPSVTEPLAAQPIDPPTISMTFRVNDSPLAGTEGTKVTSRLIWDRLLKEAEGNVALKVDRATDAEAFTVSGRGELQLSVLIETMRREGFELGVARPQVLMQEGPNGEKLEPIEEVIIDVDDDHSGIVVQKMNERKAEMLDMRPSGVGRTRLVFHAPTRGLIGYQGELLSDTRGTAIMNRIFHEYLPHKGKIQGRHTGVLIAMEQGEAVAFALWNLEDRGPMMIHPGDKVYGGMIVGEHNRDNDLEVNVLKGKKLTNMRASGTDEAVRLTPPLMMTLEKSLAYIADDELVEVTPKNIRLRKIWLDPNDRKRRSKQTADA

SEQ ID NO: 59036 - protein, 542 aa, Oceanospirillum sp. MED92
MSTTHNPYALGLDQNQANFAALTPLSFVERAAFVYPEHTATVHGDVRRNWAETYTRCRQLGSALQKRGIGQGDTVSVIAPNLPEVFESHFGVPMAGAVLNAVNIRLDAEAIAFILQHAESKVVIVEREFSDVVQKALRIAGTSPLVIDIDDPTYEGGELIGSMDYEAFIAEGDPEFAWQPPADEWDAITLNYTSGTTGNPKGVVYHHRGAYLNAMSNIVSWDMGRHPNYLWTLPMFHCNGWCFPWSIAAAAGTSVSLRHVRDQDIYDLIRKEKVTHFCGAPIVLNMLNNAPDEMKAGIEHEIKVMTAGAAPPAAVIQGMEEMGIEVTHVYGLTETYGPSVVCAWHDKWDDNSLEDKARLKSRQGVKAPMLEGLMVANPETLEPVPQDGETMGEIFMRGNLVMKGYLKNPSTTDESFEGGWFHSGDLAVWHEDGYIEIKDRSKDIIISGGENISSIEVEDVLYRHPAVMEAAVVAKSDEKWGEVPCAFIKTKEGVEVTAEEIKEFCRNNMARFKAPKAIVFGELPKTSTGKIQKFVLREKAES

SEQ ID NO: 59037 - protein, 216 aa, Solibacter usitatus Ellin6076
MIALLFDMDGVIVDSNPMHRQAWEIFNRRYGVETTMAMHERMYGKRNDEIVRDFFGDALSDEEVAGRGFAKETLYREMVAGRVEEMLVPGLRDFLERHRDLPMGLASNAEPQNVALFLDGAGLRPYFGAVVDGHQVARPKPFPDIYLRAANILNTEPEDCIVFEDSHSGVAAGLAAGMRVIGLRTTFVNLPGTVLTVDNFLSGNLETWLQTLVRSA

SEQ ID NO: 59038 - protein, 1018 aa, uncultured bacterium 314
MATEISVPDIGDFESIEIIEVLVKPGDVINKNDPIVTLESDKSSVEVPSPLAGKISSLKVKIGDKVSKGSVLVLIEDAETKSEQKSKEQKKEETKPIKQKKEDILPETEKIIKQAEQTIVQKPKTESPKKIYARPNGSDIDPIETKEWLDSLDAVISKDGSDRAHYLLKKLIDETYKEGSHRPLTRITPYINTIPPESEIKSPGDQNIERRIRSLIRWNAAAMVVKANKKNPELGGHIGTFASAATLYDVGMNHFWRAKNNKFRGDLIYFQGHSAPGMYARAFLEGRLTEKQLNNFRQEVDGEGLSSYPHPWLMPKFWQFPIVSMGLGSIMSIYQARFTKYLINRGLLKDEDRKIWTFLGDGEMDEPESLGAIGLASREKLDNLIFVINCNLQRLDGPVRGNGKIIQELEGIFRGAGWNVIKVIWGSYWDPLLAKDKSGLLIKRMNECVDGEYQAFKAKGGAYVRENFFGKYSKLKELVSTMTDGDIWKLNRGGHDPHKVYAAYDAAMKTKGQPTVILAKTIKGYGMGKSGESINITHQQKKLGEEDLLYYRDRFDIPLTDKQVKNVEFYKPGEKSEEIKYLKERRMMLGGNIPERTSYAKPIKKPSKDIFKNMLKSSGEHKMSTTMALVRMLTSLLRDQNIASKLVPIIPDEARTFGMEGFFQKIGIYAHEGQKYEPVDSEQLSFYREDKKGQVLEEGITEAGAMCSWIAAGTSYTNHDLEMIPIYLFYSMFGFQRIMDFAWAAGDAQTRGFLIGATSGKTTLAGEGLQHQDGHSHLLASTIPNCISYDPTFSYELAIILQEGLRRMHDKQENIFYYLTVMNENYQHPEMPKDCEKGILKGMYLFKEFNNKGKTKIQLLGCGAILREIIAAAEILSKDYNIDSDVWSVTSFNELRNDGMKIERKNLLNPGKKPEKSYIEKCLGNKEGLIVAASDYIRTYADQIRPYISRSFYSFGTDGYGRSDGRKNLRKFFEVDKEHIVTYALSALAKEQLISSKYAEEAMKKYKIAKDKPIPTVL

SEQ ID NO: 59039 - protein, 247 aa, Hordeum vulgare
QIVMFLDYDGTLSPIVKDPDSAVMTEEMRDAVRGVAQHFPTAIVSGRCRDKVFNFVKLEELYYAGSHGMGIKGPAKVSNRKAKADEILCQPATEFLPVIQEVYKTLTAKMKSIHGAMVENNKFCLSVHFRNVEEDKWDTLAREVRAVLDGYKELCLTKGRKVLEIRPSIKWDKGNALELLLESLGYEGRSDVFPIYIGDDRTDEDAFKVLRNNGQGIGILVTKSPKETSASYSLREPAEVKEFLRKL

SEQ ID NO: 59040 - protein, 142 aa, Brassica napus
  misc_feature (50)..(50): Xaa can be any naturally occurring amino acid
NDFKSQENENAQVVSRGNSNKYNPQEMNQRGAGLKELLPPTNNEKPKHKXRRKPGSSGNVASSEEPVKHSSRHSRSKHGSMDSSSSDQEPSVRRRRSGEGSTNPFPDGSAPPRKGKPRKHKGSIGGEGSVRRSSKGKPETES

SEQ ID NO: 59041 - protein, 308 aa, Nicotiana sylvestris
TFADDIKALRLITAIKTPYLPDGRFDLEAYDTLVNLQIENGAEGVIVGGTTGEGQLMSWDEHIMLIGHTVNCFGGSIKVIGNTGSISTREAIHATEQGFAVGMHAALHINPYYGKTSLEGLISHFESVLPMGPTIIYNVPSRTGQDIPPRVIQTMAKSPNLAGVKECVGNDRVEQYTSNGIVVWSGNDDECHVSRWDYGATGVISVTSNLVPGLMRELMFGGKNLALNSKLMPLVEWLFHEPNPIALNTAFAQLGVVRPVFRLPYVPLTKAKREEFVKIVKDIGRENFIGERDVQVLDDNDFILVGRY

SEQ ID NO: 59042 - protein, 496 aa, Burkholderia thailandensis E264
MDKTTLAYWQDKAASLAIEGRAFIDGAYRDAHGGNTFDCVSPIDGRVLAKVADCGAADVDAAVAAARRAFDEQVWAGLNPRKRKAILLRWAALMRAHLDELSLLETLDAGKPIGDTTTVDVQGAAYCVEWFAEAIDKVGGEVVPADHHLVGLVTREPLGVVAAVVPWNFPILMASWKFGPALAAGNSVVLKPSEKSPLTAIKVAQLAHEAGIPAGVFNVVPGGGEPGKLLALHRDVDCLAFTGSTGVGKLIMQYAGQSNLKRVWLELGGKSPNIVLPDCPDLDRAAKAAAGAIFYNMGEMCTAGSRLLVHRDIKDAFLEKLVAAARAYKPGNPLDPNVSMGAIVDALQLERVLGYIEAGRAEAKLLLGGARVNAASGGFYIEPTVFDTAPDTKIAREEIFGPVLSVITFDSVDEAVRIANDSEYGLGAAVWTANLTTAHEVARRLRAGTVWVNCYDEGGDMNFPFGGYKQSGNGRDKSLHALEKYTELKSTLVRLR

SEQ ID NO: 59043 - protein, 352 aa, Arabidopsis thaliana
MGELDEAFIQAPEHRPNTHLTNSGDFIFSDEIPTIDLSSLEDTHHDKTAIAKEIAEACKRWGFFQVINHGLPSALRHRVEKTAAEFFNLTTEEKRKVKRDEVNPMGYHDEEHTKNVRDWKEIFDFFLQDSTIVPASPEPEDTELRKLTNQWPQNPSHFREVCQEYAREVEKLAFRLLELVSISLGLPGDRLTGFFNEQTSFLRFNHYPPCPNPELALGVGRHKDGGALTVLAQDSVGGLQVSRRSDGQWIPVKPISDALIINMGNCIQVWTNDEYWSAEHRVVVNTSKERFSIPFFFFPSHEANIEPLEELISEENPPCYKKYNWGKFFVSRNRSDFKKLEVENIQIDHFKA

SEQ ID NO: 59044 - protein, 271 aa, Marinobacter sp. AEA-2001/5
QPNAMGGREVGGLANTLAAHMDYDSPGARSRVADFWGTGTVADGPGLKAVDMFEAVHRGDIRVIWIMGTNPAVSLPDSARVREALARCPTVIVSDCVAHTDTTDLADILLPAAGWGEKDGTVTNSERCISRQRCFLPLPAEVKPDWWIMSSVAGKLGFGEAFNYKRPADIFREHAALSAHENNGERLFNLAGLANLSDAGYEALIPVQWPVMEGAGMEAEGSTRLVFRWPFCHRQPACPLCRHQHPIARQRTSDDYPMVVNTLRIRDQWHT

SEQ ID NO: 59045 - protein, 267 aa, Pseudoalteromonas sp. AEA-2001/6
QPNAMGGREVGGLANQLAAHLDIENEAHQSLVQRFWLAPTIAKKAGSNAIDMFDEIAAGKIKAVWIMATNPMVSLPNNTAIKKALETCELVVVSDCIAKSDTLKFADVAFPSTGWGEKNGTVTNSERRISRQRPLVAPYSGAKNDWQIMCEVAKKMGFEGFDFTDPSGIFEEWAQLTDFENNGSRVLNLSGLVGLTKSQYDNLKPIMWPVVKNQPYKNGQVFTDNQFSTADKKARFIPITPQLPIQQTSSDYPFVMNSGRIRDQWHT

SEQ ID NO: 59046 - protein, 257 aa, Vibrio sp. AEA-2001/8
QPNAMGGREVGGLANQLAVHRGFTSEDISAVAQFWQAPNVATQPGLKAVDLFSAAERGEIKVLWIMATNPAVSMPDNQQVRRALEKCDFVIVSDITADTDTARYADLLLPASGWGEKHGMVTNSERRLSRQRQFLPAPGETRPDWWQIARVGSALCDYLGVADAFDYSTPAQIFREFAAMTGLNSGTPLKLDLSQFAHLSDEAYDNWLPWQWGGNKPFGDHHFSTDTGKARFAVTVPCVRRSDLWLNTGCQRDQWHT

SEQ ID NO: 59047 - protein, 271 aa, Zea mays
  misc_feature (28)..(28): Xaa can be any naturally occurring amino acid
MVKLAFGSVGDSFSATSIKGLALFVGVXYVAEFIATLLFVFAGVGSAIAYVNNNPLSMFHTHAGQLTNGGALDPAGLVAIAIAHALALFVGVSVAANISGGHLNPAVTFGLAVGGHITILTGVFYWVAQLLGATVACLLLGFVTHGKAIPTHAVAAGISELEGVVFEVVITFALVYTVYATAADPKKGSLGTIAPIAIGFIVGANILAAGPFSGGSMNPARSFGPAVAAGNFAGNWVYWVGPLVGGGLAGLVYGDVFIGGSYQQVADQDYA

SEQ ID NO: 59048 - protein, 550 aa, Pseudomonas mosselii
MYVYDEYDQRIIEDRVKQFRDQTRRYLAGELSEEEFRPLRLQNGLYIQRFAPMLRVAVPYGQLNARQTRMLAKIARDYDKGYAHISTRQNVQYNWPALEDIPEILAELATVQMHAIQTSGNCLRNVTTDQFAGVAADELVDPRPWCEIVRQWTTFHPEFAYLPRKFKIAVNGSSDDRAAIEVHDIGLEPVRNAAGELGFRVLVGGGLGRTPVIGSFINEFLPWQDLLSYLDAILRVYNRYGRRDNKYKARIKILVKALTPEVFAEKVEAEMAHLRGGSTTLTEDEVQRVARHFVDPEYLALDNVDYAPLDAEHPGFARWRSRNTRAHKKPGYVAVTLSLKPTGVAPGDLTDKQLDAVADFAERYSFGYLRTSHEQNIILADVEQRQLHALWLELREQGFATPNIGLLTDIICCPGGDFCSLANAKSIPTAESIQRRFDDLDYLFDIGELDLNISGCMNACGHHHVGHIGILGVDKKGEEFYQVSLGGNAARDASLGKILGPSFAQDDMADVIEKLINVYVEQRTEDERFIDTYQRIGIDPFKERVYAANH

SEQ ID NO: 59049 - protein, 161 aa, Hyphomonas neptunium ATCC 15444
MSLAQTLRGALLTDFMGAAWIAVREMFRRKATVNYPFEKNPLSPRFRGEHVLRRYPSGEERCIACKLCEAICPAQAITIEAEPREDGARRTTRYDIDMVKCIYCGFCQEACPVDAIVEGPNFEFATETREELFYDKERLLANGDRWERLIAKNLELDAPYR

SEQ ID NO: 59050 - protein, 562 aa, Oceanospirillum sp. MED92
MSKLPSYTSGPSTQPLIGMTIGDKFDEIANKYPDNDALIVRHQGLRYTYAELQQRVNEAARAFLAIGVKRGDRVGMWSPNCAEWTITQFATAKVGAILVNVNPAYRLHELEYAMNQSEAKFLVTADTFKSSNYTQMLNELAPELKDAEEGELNSAKLPNLKGIINLAEEKHAGMWRWADFVEMAEKIDMSQLERIQSELQFDDPINIQYTSGTTGFPKGAALSHHNILNNGFFVAESMNFTEKDRLVIPVPLYHCFGMVMGNLGCITHGATMIYPDDAFEPKSVLEAVAEERATALYGVPTMFIAEMDHPDFDQYDVSSLRTGIMAGAICPEEVMKAVNSKLHMKEVQIAYGMTETSPVSTQTAADDPFEKQVTTVGRTQPHLETKIVDPASGNVVARGEVGELCTRGYSVMLKYWNNPEATAGAIDNGGWMHTGDLATMDEEGYIQIVGRIKDMVIRGGENVYPKEIEEFLYTHPSISDVQVTGVPDKKYGEELVAWVKLAPGADEVTEEELKAFCKGKITHFKIPRYFKFTDDFPMTVTGKIQKFKMREISIEELGLDND

SEQ ID NO: 59051 - protein, 217 aa, Medicago sativa
MAGYRADDDYDYLFKVVLIGDSGVGKSNLLSRFTKNEFNLESKSTIGVEFATRTLNVDSKVIKAQIWDTAGQERYRAITSAYYRGAVGALLVYDVTRHGTFENVRQMAERTAKPHRFQHCCVLVGNKADLRHLVAVSTEDGKSYAEKESLYFMETSALEATNVENSFAEVLTQIYRILSKKAVEGAENGNASVPAKGEKIDLKNDVSALKRVGCCSS

SEQ ID NO: 59052 - protein, 349 aa, Arabidopsis thaliana
MEDLDPTYIQAPEHRSDSNFIPNQPEEIPVIDLSRLDDPEDVQNVISEIGDACEKWGFFQVLNHGVPSDARQRVEKTVKMFFDLPMEEKIKVKRDDVNPVGYHDGEHTKNVKDWKEVFDIYFKDPMVIPSTTDPEDEGLRLVYNKWPQSPSDFREACEVYARHAEKLAFKLLELISLSLGLPKERFHDYFKEQMSFFRINRYPPCPRPDLALGVGHHKDADVISLLAQDDVGGLQVSRRSDGVWFPIRPVPNALVINIGNCMEIWTNDKYWSAEHRVVVNTTRERYSIPFFLLPSHDVEVKPLEELVSPENPPKYKGYKWGKFYVSRNRSDFRKLEIENIQIDDFKVKT

SEQ ID NO: 59053 - protein, 740 aa, Azoarcus anaerobius
MPRITNLDYAEPWIELASTPQDWKKLGKTELLRVLYYHHLVRAFEEAVLNLEKLGLVHGPAHSSIGQEGGAVGSVMLLNSSDMITGAHRGHHQFLVKGMQHIDSPSYDPRAAPLPEEVQTFLYRTLAEILGLSDGFCKGRGGSMHLRWVEAGAMGTNAIVGGGVPIANGLAWAQKRRNKGEVTFTFFGDGGMNIGAVPESMNLAALWNLPICFFIENNGYAVSTTLEEETRETRLSSRGGAYAIPAWRVDGMDPVAVRLASEAAIERMRAGKGPTIIEAVLYRYFHHGGSVAGSAFGYRKKDEESSWIAKDPLDRTVREMINLQWLTADENTAIRRHCESAMQGIVERLVEGEGSKRRIRAELWPKPEFRDQGLRGDLSEFKDARFEELETASGPVGDVKFVDAVARVMGRRMETDERVFCMGEDIHRLKGGTNGATKGLAERFPDRIIPAPIAEQGFVGLAGGVAQDGQYRPVVELMYSDFALVAADQLFNQIGKARHMFGGDSAVPLVLRTKCAIGTGYGSQHSMDPAGMYAMWPGWRIVAPSTPFDYVGLMNSALKCEDPVLVIEHTDLYNTTDQGPLEDLDYCIELGKAKVVRKGSAFTVLTYLAMTPLALKVADEMGLDVEIIDLRSLDRAGIDWATIGESIRKTNNVVVLEQGPLTVSYGAMLTDEIQRRFFDYLDQPVQRIHGGESSPSVSKVLERAAFVGAEEIRAGFTRMMADMGQPLPATPSPAGNSITA

SEQ ID NO: 59054 - protein, 356 aa, Alkaliphilus metalliredigenes QYMF
MKKNLLKIVGLVFICMIGYFYWIEYIQPVHFNDVRVKTALLERLGHTADKELSRSELKRLEGHLDLSNRRITDLEGIQYCQNIEYIDLSNNQIENVAPLFELTNLQEVSLRATRIENITGIKNFKNVTRLDLSTNKIGDINEISYLEKIDTLDISRNNISDLSPLISLKNLKVLYGFGNEITDLSPLSTLTRLEVLVLSDNRITDVSPLINLTRLKSLSLSSNEIEDISAFQNLRNLEEINISDNLISSISLIENTGSLKRLRIRNNPITDFEQPIYMIENTDTKMVGLILTTLLREKGISYEENENAVILKDYDNKQISYKKSFDSVEVNLKEITDLSFYEALNRELWLRVIKSN

SEQ ID NO: 59055 - protein, 421 aa, Azoarcus anaerobius
MPSVSTSMTEGTLARWLKKDGETVAKGEVIAEIETDKAILEVEAEAEGIFKAFVADGATVKVGEPMGALLAPGETLGGTISAAQSAAAPTAAAVGGETAVAVAVAAPAAAPSTGHAPAAHDGTRIFASPLARSLALLHGLDLVNISGSGPQGRIVKRDIEAAMSAQRPASGAVAAPVAEAPVKAPQPAAPQAAGAGYELIPHSSMRRVIAQRLSESKQQVPHFYLTVDCRLDKLLALRQQVNGSLPDVKVSVNDFIVKAVAAAMKRVPATNASWSDEGVRRYRDIDISVAVATPNGLITPVVRQADAKSVGTISAEVKDLAERARQGKLKPDEYQGGGFTISNLGMYGVRDFAAIINPPQACILAVGTAEKRPVIEDGAIVPATVMTCTLSVDHRVVDGAVGAEFLAAFKALLETPLGLLV

SEQ ID NO: 59056 - protein, 465 aa, Azoarcus anaerobius
MAQEKFDLTVIGGGPGGYVAAIRAAQLGLRTALIEREHLGGICLNWGCIPTKALLRSAEIFDHFKHAGDFGLEVQGASFDLQKIVARSRGVAAQLNAGVKHLLKKNKVQVFEGSGRLAGSGTIRLEQKDGVSEIQSTHIILATGARARAMAPVEPDGRLVWSYKEAMTPERMPKSLLIVGSGAIGIEFASFYRSLGAEVTVVEVRDRVLPVEDAEVSAFAHKAFERQGMKLLTSSSVVSLQKQADSVIAVIDTKGTTTEIRADRVIAAVGIVGNVENLGLEGTGVQVENTHIVTDAWCQTGEPGVYAIGDVAGAPWLAHKASHEGILCVERIAGVDGIHPLDKTRIPGCTYSRPQIASIGLTEAQAKERGYELKVGRFPFMGNGKAIALGEPEGFIKTVFDAKTGELLGAHMVGAEVTELIQGFSIGKTLETTEAELMHTVFPHPTLSEMLHEATLAAYGRAIHT

SEQ ID NO: 59057 - protein, 367 aa, Geobacillus stearothermophilus
MELFKYMETYDYEQVLFCQDKESGLKAIIAIHDTTLGPALGGTRMWMYNSEEEALEDALRLARGMTYKNAAAGLNLGGGKTVIIGDPRKDKNEAMFRAFGRFIQGLNGRYITAEDVGTTVADMDIIYQETDYVTGISPEFGSSGNPSPATAYGVYRGMKAAAKEAFGSDSLEGKVVAVQGVGNVAYHLCRHLHEEGAKLIVTDINKEVVARAVEEFGAKAVDPNDIYGVECDIFAPCALGGIINDQTIPQLKAKVIAGSADNQLKEPRHGDIIHEMGIVYAPDYVINAGGVINVADELYGYNRERAMKKIEQIYDNIEKVFAIAKRDNIPTYVAADRMAEERIETMRKARSPFLQNGHHILSRRRAR

SEQ ID NO: 59058 - protein, 604 aa, Zymomonas mobilis subsp. mobilis ZM4
MADISDQNIPGHVTTGPIRGSRKIYVEGKNGVRVAMREIDLEPSANEQPVRVYDCSGPYTDPNIKIDIAAGLKPLRREWILARGDVESYEGREIKPEDNGQLGPDRSGGVPPFPNVNHHPLRAKAGANVTQMHYAKKGIVTSEMEYIAIRENCGRAQMKEAMIRDGESFGANIPDFITPEFVRDEIAEGRAVIAANINHPEAEPMIIGRNFLVKINANIGNSAVASDVAAEVEKMVWAIRWGADTVMDLSTGRNIHDTREWILRNSPVPIGTVPIYQALEKVNGIAENLTWEVFRDTLIEQAEQGVDYFTIHAGVRLAYIPLTANRITGIVSRGGSIMAKWCLAHHQENFLYTHFEDICEILKRYDIAFSLGDGLRPGCIADANDRAQFAELETLGELTKIAWKHDVQVMIEGPGHVPMHKIKPNMDKELVACHEAPFYTLGPLTTDIAPGYDHITSAIGAAMIGWYGTAMLCYVTPKEHLGLPDRDDVKVGVVTYKLAAHAADLAKGHPTAHFRDNALSRARFEFRWKDQFNLSLDPDTAESFHDQTLPAEGAKAAHFCSMCGPKFCSMKITQEVREFAAQGMEEMSDQFKEKGGEIYLPAAE

SEQ ID NO: 59059 - protein, 257 aa, Brevundimonas aurantiaca
MLRDLLITTLALSLIIGLRYLLVGAAAHGLLWAGAGRGRALNLRPPAMKRIRAEIVASLIACPIYALPAALVLELWKRGGTAIYSDPHAWPLWWLPVSLIVYLLAHDAFYYWVHRALHHPRVFGWAHAEHHRSRDPSAFASFAFDPAEAAATAWFLPALALIVPIHWGVALTLLTLMSLTAALNHAGSEVWPAAWLERAPLRWLITATHHDAHHKRFNGNYGLYFQFWDRWAGTEVSAAPSRPSPVIPPERPSAPLR

SEQ ID NO: 59060 - protein, 666 aa, Bacteroides fragilis NCTC 9343
MKMNYLAFIGVTAATAVVSCTPAKKEYASYELYPVRSGSLTEMEYSPESTKFTLWAPTADEVRLMLFDSGEGGHAYETIPMEPGEEGTWMATVRKDLMGKFYTFNVKVNDKWMGDTPGINAKAVGVNGKRAAIINLKSTDPQGWETDQRPPLKSPADAIIYEMHHRDFSVDSTSGIQHKGKFLALTEHGTMNSAKLLTGIDHLIELGVTHVHLLPSYDYASVDETKLDENKYNWGYDPQNYNVPDGSYATDPYDPAVRIREFKQMVQALHKAGIRVVLDVVYNHTYNTDGSNFERTVPGYFYRQKPDGSLANGSACGNETASNRPMMRKYMIESVLHWIREYHIDGFRFDLMGIHDIETMNEIRKAVSAVDPSIIIYGEGWAAEAPQYPGDSLAMKVNTCKMPGIAAFSDEMRDALRGPFNDNHKGAFLAGIPGEEESIKFGIVGAVSHPQVNNDSVNYSKAPWASQPTQMISYVSCHDDMCLVDRLKSSIPGITPEQLVRLDKLAQTAVLTSQGIPFIYAGEEVMRDKKGVHNSFESPDSINAIDWNRKTTHEDVFAYYKRLISIRKAHPAFRMGDAEMVRKYLEFLPVDGGNLVAFRLKDRANGDTWDNIIVALNARSVPAKLAIPEGKYTVVCRDGVIDERGLGSLYGPEVTVPAQSALIIHQ

SEQ ID NO: 59061 - protein, 551 aa, Oryza sativa (japonica cultivar-group)
MTMMTPPPIEQQQQEDEEMLVPHQELPAAAAVVADAVQPMEVVAQTEPANAAESQPPEDPQTSRFTWTIENFTRINGKKHYSEPFVVGGFKWRVLIFPKGNNVDHFSMYLDVADSVNLPYGWNRYAQFSLAVVNQIHPKYTIRKDTQHQFNARESDWGFTSFMPLSDLYDPSRGYLVNDTVVVEAEVAVRRMVDYWTYDSKKETGYVGLKNQGATCYMNSLLQTLYHIPYFRKAVYHMPTTENDMPSGSIPLALQSLFYKLQYSDNSVATKELTKSFGWDTYDSFMQHDVQELNRVLCEKLEDKMKETVVEGTIEQLFEGHHINYIECINVDYKSNRKESFYDLQLDVKGCSDVYASFDKYVEVERLEGDNKYHAEQYGLQDAKKGVLFLDFPPVLQLQLKRFEYDYMRDTMVKINDRYEFPLQLDLDRDDGKYLAPDADRSIRNLYTLHSVLVHSGGVHGGHYYAFIRPTLSDQWYKFDDERVTKEDTKKALEEQYGGEEELPQINPGFNNTPFKFTKYSNAYMLVYIRESDKDKIMCNVDEKDIAEHLR

SEQ ID NO: 59062 - protein, 529 aa, Rhizobium etli
MRANQHTFFACSAPPCPNGKLHLGHIGGVYLLADVFVRYHRMVGNAAYHVTGADEHGTYTLVKARKLGRPVDDVAHMHIEEILQCLRSVDIEPDVFVRTSSEDHKDRSLAIYDQLRASGYVELRDGEQLYCGTCEEFAADSLAVGECPACNAPTDSNLCEDCGSALQHNLLRNPIHTTCGQSLILRPIRQVHFELEKFAPGLDHAIEASGWPESIKRKELDWLRSKLMALPMSRHFDRGVTLNSPVEVAGQTLMTWFEGLWCYETGIERLCKQNGADLDDTMRNASTRLVFFMGQDNRFYYTIGVTASLFSRGYAIPYNHAIQDFYKLEGAKFSTSRDHAVWADEVAADIDTNVLRYYLASIAKPFGANDNDFLIEGLLQTAARIRAFETALRKYAGCNETLTADKLTVEQNHNVKRYSEAVQDLRVWDAMDAIDAFFDVASFSRADTSVSAAEVSVFLSLLNPVTPMLAARYGAFFFGAGWRPGLDGGTIRPSTGLRKPVDFPLFSDPIPEAFIEAYERRFRQVRPNS

SEQ ID NO: 59063 - protein, 151 aa, Thermus thermophilus HB27
MELLANAVFWTAVLANLTAQTLKLLLYYFLEGRFQWHRFLDTGGMPSTHSATVSALAVSVGLREGFDTSLFAVAAVFALIVMYDAAGIRRAAGLHAQLLNQLMEELGQVIRLGPQRGPLKELLGHTYLEVAVGALIGGLVALGAYRLFPAA

SEQ ID NO: 59064 - protein, 407 aa, Triticum aestivum
  misc_feature (142)..(142): Xaa can be any naturally occurring amino acid
  misc_feature (181)..(181): Xaa can be any naturally occurring amino acid
MLRRRGRLLIQTLTTPSATTASPIHRLISSAARPQVHARSCILSSPRRLLSGATASGISPTTGFAVEDYLVSTCGLTRPQALKASPKLAHLRSAANPDAVLAFLASRGLSGADVAALVAKDPKFLCTRVDKGLSPIVAGLSXLGLSDPDMARLLSLAPDRFRCRSIVPNIHYCLCIFGSYXNLLSAVKRNFYILTSNLETVIKPNVAVLREFGLGPCDIARLCVAQSWLLTSSAERVRATAVCVQGLGVPRGSGMFRHALGAVAFVSEEKIAAKVEHLKKTFRWADAEVGIAVCKAPQVLHRSKESLQRRSEFLISDLGLEPAYIARRSVMLLYSLEGRLRPRSYVVKFLKANGLLDPDRDLYTAVTLSEKVFMEKFICPHKEAAPHLAEDYAAACRGELMANFRFT

SEQ ID NO: 59065 - protein, 323 aa, Xylella fastidiosa 9a5c
MTFQKNVPHTQPAKLATTPGPPGTAATPSLMSEDDDHRTITESQEKRRSWLERLSAAFSGDPHTLDDLLVILRSAEHHGLIATDTLRMMEGAIAIADLTVGDVMVPRSQMVSLPVESDLQTITKQMVESGHSRFPVHGENKDEVLGILLAKDLLRGVSANHTITNVHELLRPVGMIPESKKLNVLLKEFRLSHNHMAIVVDEYGGVAGLVTIEDVLEQIVGDIDDEHDETEDQTNMIAIQADGCYIVDALTPIEDFNERFNAEFPDDDYDTIGGLVTEAIGHLPETGDELTIGRFAFRVAKANARRIHILHVTVLPPNEQNTA

SEQ ID NO: 59066 - protein, 438 aa, Mycobacterium bovis AF2122/97
MHFARHGAGIQHPVIVRGDGVTIFDDRGKSYLDALSGLFVVQVGYGRAELAEAAARQAGTLGYFPLWGYATPPAIELAERLARYAPGDLNRVFFTSGGTEAVETAWKVAKQYFKLTGKPGKHKVISRSIAYHGTTQGALAITGLPLFKAPFEPLTPGGFRVPNTNFYRAPLHTDLKEFGRWAADRIAEAIEFEGPDTVAAVFLEPVQNAGGCIPAPPGYFERVREICDRYDVLLVSDEVICAFGRIGSMFACEDLGYVPDMITCAKGLTSGYSPLGAMIASDRLFEPFNDGETMFAHGYTFGGHPVSAAVGLANLDIFEREGLSDHVKRNSPALRATLEKLYDLPIVGDIRGEGYFFGIELVKDQATKQTFTDDERARLLGQVSAALFEAGLYCRTDDRGDPVVQVAPPLISGQPEFDTIETILRSVLTDTGRKYLHL

SEQ ID NO: 59067 - protein, 486 aa, Azoarcus anaerobius
MLNLKDAALFRQQCYIDGAWQDADNGESQPVRNPSTGEVLGTTPRMGAAETRRAILAAEAAWPAWRAKTAKERAGLLRKWYDLMLAHQDDLAAILTAEQGKPFAEARGEILYGASFIEWFAEEAKRIYGDTIPEPVAGRRLVVIKQPVGVVAAITPWNFPNAMITRKVGPALAAGCTVVVKPASQTPYSALALAELAERAGIPRGVFNVVTGSARAIGGELTANPAVRKLSFTGSTEIGQELMAQCAATIKKISLELGGNAPFIVFDDADLDAAVAGAIASKFRNTGQTCVCTNRLLVQAGVYDEFARRLSDAVSRLKVADGFDPDAQQGPLIDQAAVDKVEAHIADAVSKGARVLVGGKRHARGGTFFEPTVLADVTTGMAVAREETFGPVAPLFRFETEEEAIRMANDTEFGLASYFYSRDIGRVWRVAGALEYGMVGINEGLISTEVAPFGGVKHSGLGREGSKYGIDEYLEMKYLCMGGIGG

SEQ ID NO: 59068 - protein, 976 aa, Oryza sativa (japonica cultivar-group)
QAEANRMRLLHAHMQKRAAMKERTARSLVRKQTSERKYTERVKSLILQKRNAAEKKRLALLEAEKRKAQARILHIQRAAKTVCSKRESERRQLQEQLESKLQKAKRQRAEYLKQRVSPRSSAHADYIKHAEFLSTKLARCWKRFLKSNKTTYALVQAYDALGINEMSVKSMPFENLAMLMESPTTLQTTKAVLDRFEKRLLLSQPTGSSSAENIDHLLKRLGSPKRKAPASRSRVAAKKPAKGSETSKLSRYSLRVVLCSYMILAHPGAVLSGQGEKENLLMESAENFVKEFELLVKTVLDRPGGASMQSTDAASQKKFRTQLAAFDKAWCAYLYHFVVWKLKDAKSLEQDLVRAACKLELSMMQTCKLSSDGQSHDLSHDMKAIQKQVTDDQKLLREKIQHLSGDAGIERMNSALSDTRSKFFEAKENGNPLATSVANVSTPLSINSSGQVPNPTSKPTVEGSSFTAQSLPGAASSSSSTSPMKPPTDNEQMVNEMLHEDDVSFARNSDNVSSAEKDFQAKVKATMEKAFWDLVTDSMRGDKPDYSQLINLVKEVRNSLHELASNELKEEILENIDLEILSQVLQSGSQDTRYLGQILQYSLDMVRKLSAPAKEDDMKRSHEKLLNELAASSEVNDNGISSFVIAVIKGLRFTLEEIKQLQTEVSKARIQLMQPIIKGSAGVEYLQKAFTDRYGPPANASVSLPITKQWVSATKSIVEQEWSSHLESLQALPADHAQHVVPVLRAGHGAPAPQASSSAASSSGLPECKGEKIDKLTRVGLLQLISNVEGLNMQSTPETFQINLLRLRAVQDQFQKVIVIATSMLVLHQVLMLKIAPPELQNTISELYDALVKLLDNNADASTKEIVEAMTRSLASVGSLPEEQIQDTTELATKMLLKSLQAGDIVFGKVSRAVYFAFRGVVLGGGAKGKKLAEAPLRRLGAAKLADRVVKAGEVLIKMAVISEKVHGQWYKALAL

SEQ ID NO: 59069 - protein, 502 aa, Mycobacterium bovis AF2122/97
MTTLWQPHRNDYSPIPGRGVHARRGARRPRPRGGRAERPGTGQLTRSGRRALLVGLTAASVGVLYGYDLSAIAGALLSLSEEFELTTREQELLTTTAVLGQIAGALGGGILANAIGRKKSVVLIVAGYAVFALLGATSVSVPMLVVARLLLGVTIGLSVVVVPVYVAESAPAAVRGSLVTAYQLATLSGIVVGYLVGYLLAGSHGWRAMFGLAAAPATLLLPLLWRMPDTARWYLLKGRIADARSALRRIQPEADIDAELADMAAAVDERGGGIGEMVRRPYLRATLFVIALGFLVQITGINAIIYYSPRLFAAMGFAGYFAMLALPAMVQVAGLAAVCASLFLVDRLGRRPILLSGIATMITADAVLITVFANDSDGGTGLVLGFAGVLLFIIGFNFGFGSLVWVYAAESFPSRLRSMGSSLMLTSTLTANAIVAAFSLTMLRVLGGAGVFAVFGTFAVVAFVVVYRFAPETKGRKLEEIRHFWENGGRWPAERSPAADEP

SEQ ID NO: 59070 - protein, 663 aa, Zymomonas mobilis subsp. mobilis ZM4
MSVPYRHLANAIRALSMDAIQAANSGHPGLPMGMADVATILFGRYLKFNPKDPTWPDRDRFVLSGGHGCMLLYSLLYLTGYDEPSLEDIKNFRQLGSRCAGHPENTLLSGVEATTGPLGQGIGMAAGMALAERHLKAQFGEDIVNHRVWTIAGDGCLMEGINHEVVGIAARLGLGNLNVLWDDNGITIDGDVTISRKEDVMARHRACGWHVVACDGHNTESIIKAMDEAIADPRPSLIACRTTIGYGSPGKQGTAAAHGTPLGEEEILLTREALEWTSPDFTVPHHILKKWKELGTRHLDEYHAWKERLEANKDKDEFLRITKGQLPQDFDLTDHKNNIISSAMPMATRKASEMALSVLIRQLPELVGGSADLTPSNNTKPKGMTTLSSADYGGRYIHYGIREFGMATVMNGLALHGGVIPYGGTFLAFSDYSRPAIRLSALQKTRVVYVMTHDSIGVGEDGPTHQPIEQVMSLRLIPNLRVFRPADSVETAECWELALKNIDGPSLIVLSRQNLPLLRESADENLSARGAYRLRSAVAKRRVILMATGSEVSLAVEVADLLETAGFGADVVSMPSWTLFDQQPESYRNDVLPDQPQSTILRVSIEAGTTIGWERYTGINGLRYGIDVFGASAPANDLYAHFGLTAVGITNKVLAAIAGKSAR

SEQ ID NO: 59071 - protein, 506 aa, Arabidopsis thaliana
MAGGGLALDVSSAGNIDAKITAAVVMSCIVAASCGLIFGYDIGISGGVTTMKPFLEKFFPSVLKKASEAKTNVYCVYDSQLLTAFTSSLYVAGLVASLVASRLTAAYGRRTTMILGGFTFLFGALINGLAANIAMLISGRILLGFGVGFTNQAAPVYLSEVAPPRWRGAFNIGFSCFISMGVVAANLINYGTDSHRNGWRISLGLAAVPAAIMTVGCLFISDTPSSLLARGKHDEAHTSLLKLRGVENIADVETELAELVRSSQLAIEARAELFMKTILQRRYRPHLVVAVVIPCFQQLTGITVNAFYAPVLFRSVGFGSGPALIATFILGFVNLGSLLLSTMVIDRFGRRFLFIAGGILMLLCQIAVAVLLAVTVGATGDGEMKKGYAVTVVVLLCIYAAGFGWSWGPLSWLVPSEIFPLKIRPAGQSLSVAVNFAATFALSQTFLATLCDFKYGAFLFYGGWIFTMTIFVIMFLPETKGIPVDSMYQVWEKHWYWQRFTKPTST

SEQ ID NO: 59072 - protein, 337 aa, Zymomonas mobilis subsp. mobilis ZM4
MAVKVAINGFGRIGRLAARAILSRPDSGLELVTINDLGSVEGNAFLFKRDSAHGTYPGTVTTEGNDMVIDGKKIVVTAERDPANLPHKKLGVDIVMECTGIFTNTEKASAHLTAGAKKVLISAPAKGDVDRTVVYGVNHKDLTADDKIVSNASCTTNCLAPVLHVLQQKIGIVRGLMTTVHSFTNDQRILDQIHSDLRRARTASASMIPTSTGAARAVALVIPELKGKLDGISIRVPTPDVSLVDFTFVPQRDTTAEEINSVLKAAADTGDMTGVLGYTDEPLVSRDFYSDPHSSTVDSRETAVLEGKLARVVAWYDNEWGFSNRMVDTAAQMAKTL

SEQ ID NO: 59073 - protein, 804 aa, Oryza sativa (japonica cultivar-group)
MAVAAMELPAVRAYDALGINETSVKSMPFENLATLMQSPATLQATKAVLDRFEKLLPLLSSPVINIDHLLKHLGSPKKKKTPPPAAAASASRYSLRVVLCSYMILAHPGAVLSGQGEKEKLLMDSAGSFVKEFELLVKTVLEKQSTDAAAGQKMFSAQLADFDRAWCAYLYCFVVWKLKDAKSLEDDLVRAACKLELSMMQTCKLSSDGQSHNGLSHDMKAIQKQVADDQKLLREKVHQLSGDAGIERMNSALSDTRSKFFEAKENGNPLAASVANVSTPLSIGSSGSSFTAQSLPGAASSPSSSSLMKQPTDNEQMLNEMLHEDDVSFGGNSDNVSSAEKEFQAKVKSTMEKAFWDLVTDSMKGDKPDYTQLINLVKEVRDSLHELASKELKEEILENIDLEILSQVLESGSQDTRYLGQIMHYSLDMIRKLSAPAKEDDMKRSHEKLLNELAASSEVNDNGISSFVIAVIKGLRFTLEEIKQLQSEVSKARIQLMQPIIKGSAGVEYLQKAFADRYGPPANASASLPITKQWVSATKSIVEQEWSSHLESLQALPADHAQRVVVPALRAGHGAPMAQASSSAASGSGLPECKGEKIDKLTRVGLLQLISNVEGLNMQSTPETFQINLPRLRAVQDQFQKVIVIATSILVLHQVLVSKVAAPELQNAISELYDALVKLLDSNPDASTEEIVEAMASSLATVGSLSLPEKQAQATAELATKMLLKSLQAGDVVFGKVSRTVYCAFRGVVLGGGGVKGKKLAEAPLRRLAAAKLADRVVKAGEMLINMAVISEKVHGQWYKALAL

SEQ ID NO: 59074 - protein, 397 aa, Zymomonas mobilis subsp. mobilis ZM4
MAFRTLDDIGDVKGKRVLVREDLNVPMDGDRVTDDTRLRAAIPTVNELAEKGAKVLILAHFGRPKGQPNPEMSLARIKDALAGVLGRPVHFINDIKGEAAAKAVDALNPGAVALLENTRFYAGEEKNDPALAAEVAKLGDFYVNDAFSAAHRAHVSTEGLAHKLPAFAGRAMQKELEALEAALGKPTHPVAAVVGGAKVSTKLDVLTNLVSKVDHLIIGGGMANTFLAAQGVDVGKSLCEHELKDTVKGIFAAAEKTGCKIHLPSDVVVAKEFKANPPIRTIPVSDVAADEMILDVGPKAVAALTEVLKASKTLVWNGPLGAFEIEPFDKATVALAKEAAALTKAGSLISVAGGGDTVAALNHAGVAKDFSFVSTAGGAFLEWMEGKELPGVKALEA

SEQ ID NO: 59075 - protein, 320 aa, Moorella thermoacetica ATCC 39073
MNLAETRRVLAEAVAATDPRLQELLDYALEGGKGLRPTLVFLCARFGIYDALEAGRVAAAIELVHLASLVHDDILDGAAVRRNRPALYRAYGTVPAVLTGDYLFATAFGLLAKGKKAVLYTVTEAIRSMCSGEIGQLKGGLAGPEAYFTYIGQKTAALISAACRCGAILGRVKRNQQECLAQFGWHLGLAYQIVDDCLDLFGSPERMGKPCRQDLARGLLTLPVLRFLAVTPDAACWRERLARGLEAAEMEELVEAARGLGCDTYTAAVAADEVTRALTALDRLPVNPVQDELALLAARTLAPLEDPDCPAAYPGMTAAG

SEQ ID NO: 59076 - protein, 416 aa, Bordetella bronchiseptica RB50
MQHAPVIQQDAPGLVVVGAGCAGVEAAFAARNAGWQGPITLLGEESAEPYHRPPLSKAFLQGTAGIDSLGLKQAALYERAAIARIGATRVTRIDRAARRLHCADGRTLPYGKLVLACGGRARRLDEALAEGGGHVHYLRTLDDARGLRARLEHSRRVVIVGAGYVGLEVASACRALGLAVTVLEAAPRVLARVTAPVVSAFYEATHRGQGVDLLLDTGVAALEPAGDGGVAAVHTSDGQRIPTDLVIAGIGLAPNVELAREAGLAVGDGIVVDAMLRTEDPDILAIGDCALAYNPRYGRAMRIESVPNALEHARQAAATVCGKPRELDPLPWFWSDQYGLKLKMAGVAHGHDQVVVRGDPRQGAFSVFYLKSGQLLAVDTVNRPGEFMAARKLIFSTIGQADRLADETRELKHWLA

SEQ ID NO: 59077 - protein, 301 aa, Bordetella bronchiseptica RB50
MIDATSLRGILTALPTPVDAQGVVDTRAARLLVEYQLRHGIDGLVPIGGTGEYGSLARAERCRMVEATAQAAQGKVPVVAGVLDTGYFDALQSGRELAAAGADALMVVTPYYTNPTQAGLLDYFLRYADESPVPLIIYEIPYRTRIALAPEVLHQLSSHERIIGMKACNTDMYHFLRVVAGVSDTFSVLSGEDTLLPLHLLGGARGGIVVTATMLPAAWLQLFQLATSGRGAEALALHRELMPVMDLAFAETNPGPLKAVWDLIGIEAPDVLAPLREAAPELQAALRACMASMVQRFGQVA

SEQ ID NO: 59078 - protein, 419 aa, Bacteroides fragilis NCTC 9343
MQTIDNFNFAGKKAFVRVDFNVPLDENFNITDDTRIRAALPTLKKILADGGSIIIGSHLGRPKGVADKFSLKHIVKHVSELLGVEVQFANDCMGEEAAVKAAALQPGEVLLLENLRFYAEEEGKPRGLAEDATDEEKAAAKKAVKESQKEFTKKLASYADCYVNDAFGTAHRAHASTALIAKYFDTNNKMFGYLMEKEVKAVDKILNDIKRPFTAIMGGSKVSSKIEIIENLLNKVDNLIITGGMTYTFTKAMGGQIGLSICEDDKLDLARELMQKAKDKGVNLVLAVDAKIADAFSNDANTKFCPVNEIPDGWEGLDIGPKSEEIFAEVIKNSKTILWNGPTGVFEFENFTHGSRSVGEAIVEATKNGAFSLVGGGDSVACVNKFGLANGVSYVSTGGGALLEAIEGKVLPGIAAIQE

SEQ ID NO: 59079 - protein, 446 aa, Shewanella sp. MR-7
MADSPYNTTHEHPSLEHYWMPFTANRQFKASPRLLAQAEGMYYTDINGNKVLDSTAGLWCCNAGHGRREISEAVSKQIREMDYAPSFQMGHPLAFELAERLTELSPEGLNKVFFTNSGSESVDTALKMALCYHRANGQASRTRFIGRELGYHGVGFGGISVGGLSNNRKAFSGQLLQGVDHLPHTLDIQNSAFSRGLPSLGAEKAEVLEQLVTLHGAENIAAVIIEPMSGSAGVILPPQGYLKRLREITQKYGILLIFDEVITAFGRVGAAFASQRWGVIPDIITTAKAINNGSIPMGAVFVQDFIHDTCMQGPTELIEFFHGYTYSGHPVAAAAALATLSIYENEQLFERSFELERYFEDAVHSLKGLPNVIDIRNTGLVAGFQLAPNSQGVGKRGYSVFEHCFHQGTLVRATGDIIAISPPLIVEKHQIDQIVNSLSDGIRAVG

SEQ ID NO: 59080 - protein, 726 aa, Medicago truncatula
MAVSTIALYASPPSSVCSTPHQINYDFELGSRSSSPASTAASTSGKSVMGGLSCLFSSPTVVKHVPFTSSFSGGGGGDEDELKELSSSFSYSFSPTKFGGSWKRDHSPVSVFQCPVSCSSSIGAGTGTVRSGRGSTGGGFLDGFVRSALGSSCLDYDSTGVRLRGGGGEFDGVGGDSGIVDELTFNLDDTFVEGCVGIEIEPYAKKLLMNAQLRHKIFCEEFVIKAFCEAEKAHRGQMRASGDPYLQHCLETAVLLALIGANSTVVAAGLLHDTVDDAFLTYDYIYGMFGAGVADLVEGVSKLSHLSKLARDNNTASKSVEADRLHTMFLAMADARAVLIKLADRLHNMMTLDALPVAKQQRFAKETLEIFAPLANRLGIANWKDQLENLCFKHLNPVQHKELSSKLVESYDDAMIASAIERLEQALKDEGISYHVISGRHKSLYSVYCKILKKKLTIDDIHDIYGLRLIVDKEEDCYKALKVVHRLWSEVHGKLKDYIRFPKFNGYQSLHTVVMGEGKVPLEVQVRTKDMHLQAEFGFAAHWRYKEDHCQLSSYVLQMVEWARWVVTWQCEAMSKDSTSVGYVDSIKPPCKFPSHADNCPYSYKPDCAQDGPVFVIMIENDKMSVQEFCANSTVLDLLERVGRASCRLTTYRFPLKEELRPRLNHKPVSDPNCKLKMGDVIELTPAIPDKYLTEYREEIQRMYDRGLTVSSMGSTATASSMVGTS

SEQ ID NO: 59081 - protein, 482 aa, Zea mays
  misc_feature (358)..(358): Xaa can be any naturally occurring amino acid
  misc_feature (391)..(391): Xaa can be any naturally occurring amino acid
MATSVPEGLLGEPSSPWKVQQLLPLCAVLAVVVAWCAARAAEWAWLKPRRLERALRAQGIRGTAYSPLAGDAPLSDRLAREARSRPPLPPGCHAIVPRAMPLVHHAMNEHGKTSVTWFGPTPRVIITEPELVRQVLSNKFGHFEKAGFGQLTRLLHYGVSTHEGSKWAKHRGIINPAFHFEKLKRMLPAFASCCADLVSTWERLVVAADGEPCEVDIWPDMQRLTGDVISRVAFGSSYLEGRRIFELQEEQVHLAMLVAGKIHIPGYMMLPTRVNRRMKRIAAEIEGILRRMIATRESSLRAGKATSDDLLGLLLESNMEQLRGEGGGGGGGTSSGGMSTDDIIGECKLCSTSPAWRXVTMVLYEVLRLYTPLPALHRRTYKPMELGGVRXPDADEFRPERFAEGVARASSAGDAPPSFFPFGWGPRTCVGQTFALLEAKIGLAMILGSFTFELSPSYSHAPFPVVLLKPEHGAQVKLRKLP

SEQ ID NO: 59082 - protein, 261 aa, Xylella fastidiosa 9a5c
MRTMTQSRWRLDGRTALITGASTGIGLAVARELLGLGADVLLVARNADLLGRVRDELAEEFPERELHGLAADVADDVDRRAILDWVEDCSNGLHVLINNAGGNVTRAALEYTEDEWREIFEINLFSAFELCRYTQPLLACHASTAIVNIGSVSGLTHVRSGVPYGMSKAALHQMTRNLAVEWAEDGIRVNAVAPWYIRTRRTSEPLSDVYYYEQVIERTPMRRIGEPEEVAAAVAFLCLPASSYVTGECIAVDGGFMRYGF

SEQ ID NO: 59083 - protein, 1378 aa, Rhodococcus sp. RHA1
MQQQKAGTSTVKTACSYCGVGCGMVLEVGIDPETSARRVLKASGDKDHPTNFGRLCTKGATSAEMLVAGGRMETGYVRDERGEAPTSIDVGAAISETARRLKAQLDEHGPDALSFYVSGQMSIEAQYLITKLAKGFVGTNQIESNSRLCMASAGTGYKQSLGADGPPGSYQDFDKADVFFVIGANMADCHPILFLRMMDRVKAGAKLIVVDPRRNATADKSNLFMQIAPGTDLALLNGLLHLLVKNGHTDPEFIAEFTEGWEVMPEFLEEYTPEKVAEITGIPESEIRRAAQWIGEAENWMSCWTMGLNQSTHGTWNTNAICNLHLATGAICRPGSGPFSLTGQPNAMGGREMGYMGPGLPGQRSVLAADDRAFIEDLWELPEGSIRTEVGTGTVDMFERMVAGEIKACWIICTNPVATVANRRTVIEGLEAAELVITQDVFLDTETNGYADILLPGALWAESDSVMINSERNLTLLQQAVDPAGQALPDWQIIARVACEMGYADAFTYDSSEDVFEEIKRTWNPRTGYDLRGITYDRLRETPVQWPSPPGNRTDRNPLRYVNDGVSQNLLSAPDGSLPRLAFATATGKAAFFPRPHMLPAEMPDDDYPFVLNTGRLQHQWHTMTKTGKVAKLNKLHSGPFVEINPADAQKLSITDGDKVEVASRRGRAVLPAVVSDRVLAGGCFAPFHWNDSFGEYLSINAVTNDAVDPTSFQPEFKACAVSLTRVAPVSAPEVPETGGALTLAQGSPAAEMSRILGLDDSASPTFDEHERMYLAGLLSGLQSTAIQGVPVLPRSAPISGSKRVWLDGLMAGLFSRSDVPQSVVVPDANAESVQHPVVVVWASQTGNAEEFAAECAEQLEAAGHGTRLTSMDDYDVAGLADVRDLLIITSTFGDGDAPDNGSSFWSALSSDEAPKLSQTRYAVLAFGDSNYDDFCGHGKRIDARLEQLEAKRLTERVDCEPDYEEQARQWLTQVQKLVRERAAADGATVVASTPAPARPAAKKAATFTRKTPLITRLTKNIPLSAAGSSKDVRQFGFEVSDPEFTYEAGDALGVWPTNSDAVVDEWLKVTRSIPDTPVKLPDLPEMTLREALRTKLEITKVTPELLRFVQSRTQDTELARLLRPQNKIALQQWLWGRQSMDVLAEYGVDADADEWLSVLKRLQPRLYSISSSPKVDPGEVQLTVSAVRYNHEGKNRAGVCSTFLADHCDEADVPIFVQKSAHFRPPQAADAPMIMVGPGTGIAPFRGFLHERRELGHTGKNWMFFGEQHEATDFYYREEMEAMHRDGFLTHLDAAFSRDQRQKIYVQDRIREHGAKLWGWMQEGASLYVCGDASRMAKDVDETVREVVRTHGRLDEEDTELYMKQLATDKRYVRDVY

SEQ ID NO: 59084 - protein, 888 aa, Erythrobacter sp. NAP1
MTTTVYPFGGAAAHDDPRQRDKTITGGKGANLAEMASIGLPVPPGFTITTEESVRYLQGGEEFRDELRGEVTNALAHIEASVGKTFGNAADPLLVSVRSGARVSMPGMMDTVLNLGLNDDTVEGLAKTSEDERFAWDSYRRFIQMYSDVVLGLDHGLFEEALEIVKEDNGFYNDTELSADDWRGIVGQFKGIVDEELGKPFPQDVNEQLWGAIRAVFDSWDSDRAKVYRRLNDIPADWGTAVNVQAMVFGNMGETSATGVAFTRDPATGERAYYGEYLINAQGEDVVAGIRTPQYLTKAAREAAGAKPLSMEEAMPDAYGELARVFDLLEGHYKDMQDIEFTVERGKLWMLQTRSGKRTAKAALKMAVDMEGEGLIDREEAVRRVDPMALDQLLHPTLDPEAPRDVLVTGLPASPGAAAGKIVLDADTAEQWANRGDKVILVRVETSPEDIHGMHAAQGILTARGGMTSHAAVVARGMGRPCVSGASGVSIDRKSRTLRIGNSEMKEGDEITLDGANGQVMMGIVPTVEPELAGDFGTLMEWADALRRMKVRTNAETPADCAMARQFGAEGIGLCRTEHMFFDASRISAVRQMILAEDERGRRKALDLLLPEQRADFTSIFEAMAGLPCTIRLLDPPLHEFLPTQDAEFEELADATGLGVDHLKRRAGELHEFNPMLGHRGCRLGITYPEIYEMQARAIFEAACDVAASSGEAPIPEVMIPLVATKRELQLLRALVDKVAAEVFEEKGASVEYLVGTMIELPRAALMAGEIAEEGAFFSFGTNDLTQTTLGVSRDDSARFLAPYVEKGIFPRDPFVSLDIDGVGQLVELAAERGRATRADIKLGICGEHGGDPASIAFCEKVGLDYVSASPYRVPIARLAAAQAALKA

SEQ ID NO: 59085 - protein, 473 aa, Burkholderia thailandensis E264
MAHRNDSLLTSAQQDARHLLHPWADLTALGRETPTVIVDAQGTRVTDAEGRTYLDAIGGMWCVTVGYGRREIADAIRDQALRMPFYTPFGAMTNAPAAALGARLAERAPGDLKRVHLTTCGSTAVESALRFAHYYFGATGRPHKRHIVTRGDAYHGSTYLAASVSGKAWDRTCFHYDSTIVHHLSSPNPYRRPAGMSVAAFCASLVDEFDALIAKLGADRIACFIAEPILASGGVIVPPPGYLAAMRERCRRHDILYISDEVVTGFGRVGHFFASQAHFGIEPDMIVVAKGLTSGYQPLGAVLISERLVEAVSGERAYGNGVFTNGFTYSGHPVACAAALANIELMERERICEHVRDVGPYFIRRLDALRRFPIVGDVRGDHLMACIECTSGAGATGALPTPADIAIAQRVDRHCEEMGLLVRPYESMCILSPPLTVTRADIDEICEILAAALERTQRELAERAPVREENETC

SEQ ID NO: 59086 - protein, 143 aa, Erythrobacter sp. NAP1
MGTFQLSRRRFLPDPDALSTQQIEQGSRFAPKFDASGLLASVVIDSRTKEVLVIAFMNADALQKTRETGKVHFWSRSRSSLWMKGETSGNVLSVDEIRVDCDQDALVIYATPAGPTCHTGETSCFYRKLDLSAPDGSALSRLA

SEQ ID NO: 59087 - protein, 220 aa, Triticum aestivum
MDAMAAVARTGPSLAAAGHRSSATFRPSASLSFASASSRNRGRVGLSTAGWNQRATRVARATPNRIVASSEVEQTYIMIKPDGVQRGLVGEIISRFEKKGFLLKGLKLFQCPKDLAQEHYKDLKERPFFPNLIDYITSGPVVCMAWEGDGVVASARKLIGATNPLQAEPGTIRGDLAVQTGRNVVHGSDSPDNGKREIGLWFKEGELAQWESVQTPWLIE

SEQ ID NO: 59088 - protein, 558 aa, Arabidopsis thaliana
MASLVSGDKEAQISGDPGSKRGGWITFPFMLATLLGLSVTSFGWVMNLIVFLIEEFNIKSIAAAQISNVANGCLSVLPVVAAILADSFFGNIPVIAASSFISLLGIVLLTLIASLDYLRPRPCEAGSVLCTPPSKLHLGILYTALALVTTGAGGTRFTMASAGANQYEKPKEQGSFFNWYFLTLYAGAITGATAIVYIQDNASWKLGFGLCAAANLISFIVFVSGKRYYKHDKPMGSPFTSLIRVVVSATVKRKAVISCNEEDYHHYGLEKEVKTSAAMPSKSFRFLNRAALMTKDDLNQKEGSVNNIWRLCSVQEVEDFKAILRVFPLWLSIIFVSTPMVMQTSLIVLQALVTDRGLGPNFKVPAGSLQVIIIITACIVIIMNNWLVFPMYKKLTHKLLTPLQKVGIGQVLTILSMALSAVVEAKRLKTVENGHPMSVLWLFPPLVIVGIGEAFQFPANIELFYGEFPESLRNTATSLTSVVIGISFYLSTALIDLIQRTTAWLPNDINHGRVDNVYWLLVIGGILNFGYFLVCSWVYKYRNLKDNDQEQDPKDGTM

SEQ ID NO: 59089 - protein, 182 aa, Rhodococcus opacus
ALLHDTVEDTGYSLEQLTDEFGEEVAHLVDGVTKLDKVVLGNAAEGETIRKMIIAMARDPRVLVIKVADRLHNMRTMRFLPPEKQARKARETLEVIAPLAHRLGMATVKWELEDLSFAILHPKKYDEIVRLVADRAPSRDTYLAKVRAEINATLTASRINAVVEGRPKHYWSIYQKMIVKGR

SEQ ID NO: 59090 - protein, 808 aa, Arabidopsis thaliana
MRSRNPKASSQPLDPTSSLHTDAISPSQLSLDQISLAISLTDSLSLDCDVLSNRRLLGHLTFTVSPSSPFTQPCRSNFTIPHSFVSFSLDHNSTSPRFIFIFIYSTLPELLAVLASPSLTAHHLSFTRPLHASPQHLRQSFSPFTVLPSPPYSSLLDLTPFTHRKLDSATKELASPSSPPLNHSTSSLPSLIKTATMFSPFAVYLTKLPLQSTKQALPPFTQPRRYRLSFTFTRPQNRKTRIHNFNVLDRFNRPCTRPEINMSYYSGESSMDADYNVDEGESCERAPLPAIYRSLEGLFGFPSEKGTKPKFEREELKDLWLTIGNDMALNSMRSKSNQIRSPGIQYYQRSVANGKKFLKGDLNDAPPVMLLLIHLCGYRKWAHTNGKKRARRALCGEPPLDMPSRRYDASEPSRHRPEPVQHRPEPIGVHDFSSPEAYVTAVLAAAEEERSSIIRAVLAATKEQRSSNPTGKLRHNREILRWHGSNHRQLLTTNSVPFSTELCLYLYPSKKNLRIQVIWRICNKVCCFLIEYNPNAKVVGLRSNASTNCWEKGKKGKKGKKVKKPKRNWSSTEDVVLISGWLNTSKDPVVGNEQKGAAFWERIAAYYNSSPKLKGVEKRGHICCKQRWSKVNDVVNKFVGSYLAASKQQTSGQNDDDVVSLAHQIFSKDYGCKFTCEHAWRELRYDQKWIAQSTHGKAKRRKCEDDSEPVGLEDKEARPIGVKAAKAAAKAKGKGKLSPDEGEETNALKEIKSIWEIKEKDHAAKEKLIIIKEKKNRTKLLERLLGKTEPLSDIEIELKNKLINELLA

SEQ ID NO: 59091 - protein, 85 aa, Triticum aestivum
MALGDDSPASYIRMVHHLIEKCMTFRMSMEECMEALSKRADVQPVVTSTVWKELEKENKEFFDSYNKQLRSEGRSSSNSSSDSSS

SEQ ID NO: 59092 - protein, 429 aa, Shewanella sp. MR-7
MATKRIVIVGGGAAGLALASKLGRKMGGSDVVDVCLIDKSPIHIWKPKLHEVAVGVIDQSIEGLLYRDHGLKNGYRYIRGEIEQCDPDAKTIQLAAVYSDSGELLLEPRQIEYDYLVLALGGVSNSFNTLGAEQHCIFLDSLDNANLFHQKLLDALLQLNETQEKVSIGIVGAGATGVELAAELHHVIESVKEYGYLNISKHHLDVHLIEASPKILPQLPERVSARAQAVLDKIGIRLHIGVQVKEVTRDGFITQDGDVIEAGLKVWAAGVKGPKAFQNFSKLPITPRNQVEVDACMRVKGHQDIYALGDCALLILESGQPVPPRAQAAAQMADTLYENIVNRLQGKAEKPFVYKDYGSLVSLSRFSAVGNLMGNLRSGTFFVEGHIARIMYISLYQRHLASLYGWFSAIIYRIAQKLLKWQRPKLKLH

SEQ ID NO: 59093 - protein, 389 aa, Brassica napus
  misc_feature (41)..(41): Xaa can be any naturally occurring amino acid
MNRGALESSPVQQLMVAGNPNWWNVSGSTRPPPPLMGHQQXPLPPQMTPNNNYLRPRMMMTSSSPSLLDNPSLSSWLESNDLPPESWSLSQLLLGGLMMGEEERLEIMNHHSHHDEQHHHSFQGKMRLENWEEQVLRHQQASMGVVDIKQESNINNNNGYLISSPNSPPNKSCVTTTTTTSLNSNDNTNNNNNMLGFSSNHNGLNLSEIRHTPPDRSSECNSLDIGGSTNKKPRLQPSPSSQSTLKVRKEKLGGRIAVLHQLVSPFGKTDTASVLSEAIGYIRFLQNQIEALSHPYFGTTASGNMRNQHLQGDRSCLFPEDPGQLVTDQCVKRRGVSSSSSENQNAKEEPKKDLRSRGLCLVPISYTLQVGSDNGADYWAPTLGSASFH

SEQ ID NO: 59094 - protein, 231 aa, Lycopodium annotinum
MGRGKIEIKRIENATSRQVTFSKRRGGLLKKAHELSVLCDAQVALIIFSSTGKLFEYASPSMKEILDRYGKYPEGVQTGTVTDPNNDVMLQYLNREVIRMKQQIERTHQTQRHMMGEDLAILPLKDLQQLEEQLDIGLRRIRARKDQLLVEQLEELHRKERHWLEENEALRRKLAGGQALSGPVPSPLSIVNPLETREPPSLGTVSLPFSVQFNQQNMQDTPNLQTSLQLG

SEQ ID NO: 59095 - protein, 242 aa, Pseudomonas aeruginosa UCBPP-PA14
MPDRMRGVKSDSPEQESADDALKRIVDGFQHFRREVFPEQQALFKKLANSQRPRAMFITCADSRIVPELITQSSPGDLFVTRNVGNVVPPYGQMNGGVSTAIEYAVLALGVHHIIVCGHSDCGAMRAVLDPQTLERMPTVKAWLRHAEVARTVVADNCDCGASHDTLGVLTEENVVAQLDHLRTHPSVASRLASGQLFIHGWVYDIESAQIRAYDAKQGRFLPLDGEHPVPMATPAPRYLNS

SEQ ID NO: 59096 - protein, 577 aa, Zea mays
SAAATQSHTLTHTHQLGAEMQQRRKSVFASAPFAMKQAALGAGVAARKNGAPLSLAAVVFALFVFATFLYNEDIKSITDFQFSSGAIRAKSPDLHLLQEAEAAAHAAVNTLAKRGEEVIVRVLEVEAPPVVNTSSVLAAAAKANAKAKANAVDVGQEKERDVTLPTVTGGRGGADEARRRADEEVAEKAASAKAAAATAALRGVVSVPQTCDLYRGSWVYDEVSAPVYKEGECEFLTEQVTCMRNGRRDDSYQKWRWQPAGCDLPRFDARLLLERLRNKRLMFVGDSLNRNQWESMVCLVQSVIPDRGQKTLTKFVNGGSSNVFYAHEYNATVEFYWAPFLVESNSDNPKVHSVPDRVIQWHAIAKHARNWIGVDYLVFNTYIWWLNTLDIKVLKQGSSFDDQGGSTEYVEVDRPVAYKEVLTTWAKWVDRNIDPNRTTVFFMGMSPNHITPEAWGNKGGIKCAMETLPIASNRSAALDVGTDWRLYAGAREVLPTLRRVPVHFVDITALSELRKDAHTSVHTLRQGKLLTPEQQADPKTYADCIHWCLPGLPDTWNQFLYARIASSPWPNDAQAQQ

SEQ ID NO: 59097 - protein, 521 aa, Juglans regia
MPAVSGVPAGGVPGKAYPGNLTPYVTVTCIVAAMGGLIFGYDIGISGGVTSMDPFLKKFFPSVYRKKNEDKSTNQYCQYDSETLTMFTSSLYLAALLSSIVASTVTRKFGRKLSMLFGGVLFCAGAILNGFAKAVWMLIVGRILLGFGIGFANQSVPLYLSEMAPYKYRGALNIGFQLSITIGILVANVLNYFFAKIEGGWGWRLSLGGAMVPALIITVGSLVLPDTPNSMIERGQHDEAKEKLKRIRGVDDVEEEFCDLVAASEASQLVENPWRNLLQRKYRPHLSMAILIPFFQQLTGINVIMFYAPVLFNTIGFGSDASLMSAVITGIVNVGATMVSIYGVDKWGRRFLFLEGGTQMLICQAIVTAAIGAKFGVDGNPGDLPKWYAIVVVLFICIYVAGFAWSWGPLGWLVPSEIFPLEIRSAAQSVNVCVNMIFTFVVAQAFLAMLCHMKFGLFLFFAFFVMVMTVFVYFFLPETKGIPIEEMNRVWKTHWYWSRFVSDDDNPKVEMGKGGRAIKNV

SEQ ID NO: 59098 - protein, 508 aa, Juglans regia
MPAVSGVPAGGVPGKAYPGNLTPYVTVTCIVAAMGGLIFGYDIGISGGVTSMDPFLKKFFPSVYRKKNEDKSTNQYCQYDSETLTMFTSSLYLAALLSSIVASTVTRKFGRKLSMLFGGVLFCAGAILNGFAKAVWMLIVGRILLGFGIGFANQSVPLYLSEMAPYKYRGALNIGFQLSITIGILVANVLNYFFAKIEGGWGWRLSLGGAMVPALIITVGSLVLPDTPNSMIERGQHDEAKEKLKRIRGVDDVEEEFCDLVAASEASQLVENPWRNLLQRKYRPHLSMAILIPFFQQLTGINVIMFYAPVLFNTIGFGSDASLMSAVITGIVNVGATMVSIYGVDRWGRRFLFLEGGAQMLICQAVVTAAIGAKFGVDGNPGDLPKWYAIVVVLFICIYVAGFAWSWGPLGWLVPSVNVCVNMIFTFVVAQAFLAMLCHMKFGLFLFFAFFVMVMTVFVYFFLPETKGIPIEEMNRVWKTHWYWSRFVSDDNNPKVEMGKGGRAIKNV

SEQ ID NO: 59099 - protein, 440 aa, Alkaliphilus metalliredigenes QYMF
MDKRSIMKYERSQKLFEASQEVIPGGVNSPVRAFSSVGMNPPFIKRGKGAYIYDEDGNKYIDYVGSWGPLILGHCHPEVVENLKAVLETGTSFGAPTEIELKIAELITGAIPSVEMIRMVNSGTEATMTALRLARGYTGRNKIVKFNGNYHGHSDGLLIKAGSGALTHGVPNSPGVTPDVAKNTITAKYNDIEGIMEIFKQQGEEIAAVIIEPIAGNMGVVPMTNKFAHALRKITEDYGALLIFDEVMTGFRVSFGGAQSLYQIKPDLTCFGKIIGGGLPVGAFGGKREIMEHLSPVGPVYQAGTLSGNPLAMTAGYTTLSILHNNSGIYEELEKKAQKLEKGFKKIVKELQIDASFNRVGSMLCMFFTKEKVSDLETASTSNTEIYSQYFRAMLSRGVYLAPTQFETMFISDAHGDVEINRTIEAAYEGLKEIRNNPSI

SEQ ID NO: 59100 - protein, 121 aa, Marinobacter sp. ELB17
MSETLFTKIINREIPADIVYEDDTTLAFRDINPQAPVHLLIIPKKHIATINDITEDDRELVGNLYYVAAKLAKEMGFADDGYRTVMNCGENSGQTVFHIHLHLLAGKPMGWPPYSDKMKQG

SEQ ID NO: 59101 - protein, 495 aa, Oryza sativa
MADHQPAASSPKRKKKHSKKPEDSNATVDDSLAAAASPSPKKKEKHSKKKREAIDATMAAASPKKKEKKHSKKQEDTNVPEKKREVVHVTVDASLTGAAAAGAAPVVAYFPTGYDPLAAGGGRKGREAPRTRLFRHTKHPSRIELVVGAATGGGGGPDFVGRSYAGEAVLPQLTGYALGVLDKASGTLKVVPIAANKILRLDPHLEVQKLAHSQHSGAVGEAVSSAGDADLKVQDITKAFGTQKDKAKDIKWQSLNEQRNDPSAFMDLDLGNADTSVGANESQEPTVRNIPPYDPAADTSERAYLFDEIIPKSIRPHLVDIIGHFESGEISSKGYGSFVSNRVNKLQELQGEDKERLAWILSYITHLLSLLARNSSMSKRHRKENQATSGPVIPQYVYRKMVLMFTEPGSSALSTEKHELLINYILVLTLYADDFRSDPKDICEDLKMTRQMIKPYYDQLGCKSSSAGAFKSSVMTLPAPLKFPKEATRRKRRRF

SEQ ID NO: 59102 - protein, 238 aa, Phaseolus vulgaris
LVLDGVIQLTERDECAYQEMITHLPLCSIPNPKKVLVIGGGDGGVLREIARHSSVEKIDICEIDGMVVDVSKQYFPDVAVGYEDPRVTLTVGDGVAFLKNVPEGTYDAVIVDSSDPIGPAQELFEKPFFGSVAKALRPGGVVCTQAESIWLHMDIIEDIVSNCRHIFKGSVNYAWTTVPTYPSGMIGFMLCSTEGPPVDFKHPVNPIDENECQKSARPLKFYNSEIHTAAFCLPSFAK

SEQ ID NO: 59103 - protein, 1087 aa, Campylobacter lari RM2100
MPKRTDIENILLIGSGPIVIGQACEFDYSGTQAAKTLKELGYRVVLINSNPATIMTDPEFADATYIEPITKESILSIIKKEKIDAILPTMGGQVALNVAMEVYESGELGDVKFLGANPQAIKKGEDRQIFKESMKKIGMDLPKSMYAYNYEEALKAVEEIGFPLMIRASFTLGGAGSGVVYNMDEFAELANTALALSPIHEILIEESLLGWKEYEMEVIRDKNDNCIIVCSIENVDPMGVHTGDSITIAPALTLTDKEYQAMRNASFAILREIGVDTGGSNVQFAINPTNGRMIVIEMNPRVSRSSALASKATGYPIAKIATLLAVGFSLDEIKNDITGTPASFEPVIDYIVTKIPRFTFEKFPNASTELGTSMKSVGEVMAIGRTFKESIQKALCSLERNLSGFDVIECDKNELIAKIRHANEKRLLYIAQAFREGFSTQELFELCKIDPWFLNQIKEIVEFENQIDMDILSNKQLLRKAKTLGFSDKKIASLINQKDNLELSQNDIYYARIKHKIIAQYSEVDTCAGEFEALTPYLYSSINTNEATQIKESKDKKDKKVMIIGGGPNRIGQGIEFDYACVHASFALKDMGVKTIMYNCNPETVSTDYDTSDILYFEPIDFEHLRAVIDRERPDGVIVHFGGQTPLKFAKRLSAFGAKIIGTSARVIDLAEDRKKFAKFIEDLGINQPKNGTAISVEEAIIKANEIGYPVLVRPSYVLGGRAMRVVHDESELRLYMQEAVDVSDKSPVLIDQFLDNATELDVDAISDGKDVYVAGIMEHIEEAGIHSGDSACSLPAINIDETMLEMIEQKTKDIALNLGVVGLLNIQFAIHDNKLYMIEVNPRASRTVPFVSKATGIPLAKVATRVMWQGNLRESLKFYDIFKVVEEKNGILRAKKPKHISVKSVVFPFAKLSGSDLELGPEMRSTGEVMGISKDFENSYAKSQLASSNFLPESGNVFLSLREQDKKYAVDLASEYIKLGFKIIATSGTYKILQEAGLECEFVHKISEGRPNVEDKLKNSQIQLAINTSDEHSFKGDTKKIRANILRFKTPYFTNLRAAYAGAKAIKAIQNKTCLEVKSLQEYLKV

SEQ ID NO: 59104 - protein, 544 aa, Oceanospirillum sp. MED92
MENKNNNPYSLGLDKNAANYAALTPLSFIERAATVYPDRTAVIYGDLQRTWSQTYERCIRLASALRKRGVGEGDTVAVMLPNIPEMLELHFAVPMTGAVLNTQNTRLDAETIAFMLDHGEARVVITDREFSNVMERAVRMASVDPLLVDVDDPQFTGGELIGSLTYEQLLAEGDINDHWSPPEDEWQAITLNYTSGTTGNPKGVVYHHRGAHLNATSNIIGQNLPPHAVYLWTLPMFHCNGWCYPWSVTAVAGTHVCLRHLLPEKVFELIQACGVTHFCGAPVVLNMLLNAPEESKMLVDHPVTVTTGGAAPPAAIIEGMEKIGIKVVHAYGLTESYGPSVFCAHQDEWDQMVLEDKAAKMARQGVRAPALEQLMVGDPETMAPVPRDGKTMGEVFMRGNNVMKGYLKNPSASDAAFSGGWFHSGDLAVWHEDGYIEVKDRSKDVIISGGENISTIEVEDMLYRHPAILEAAVVAKPDEHWGEVPCAFVTLKDGQSATEAEIIEFTRSNMAHFKCPKKVVFAPLPKTSTGKVQKFALRAMLKDI

SEQ ID NO: 59105 - protein, 999 aa, Oryza sativa
MEGSPSKSRGVTGPAHTDDGDWFSDVPDDIILNIMSFLTTRQAVQTCVLSRRWRNLWRSVPCINSDIDEFTRDSDSEGYYDEKTELAFIMFMERVMELRDPAALISTFQFRCKFELDEGFDDISDPEDINAWISHAVQKQARVLDIVVLCDKLYLDHSEFASRYLTRIEFTSVVLMEGFFKQLEMGCPAWESLFLDECAVNDVEISSQTLKVLTIKNTLFSSDKTTISTPSVTYLKLWRPVDSCVFNDMPLLVTSLLVLYHVQDSGDFFQNLRSLSAAKSLEFNYIGKELTMENNLQLYPKFNNLVRLTLGQWCLDANFYGLMVFLQTSPKLEKLTLKIEKEKTQRIIGKIEDRSFTCEHLTRVEIVCSEDDPLVKDVVTFFVNSGLTSAQVVGVVRARVAKAAGAWWGHTHLLEDDAAVVRAGDDGVFVRGSVHEGVTAVAPVVGGRRRGTGGGRGGGGGKGRGRSHRKRICLITFCSLSDLPRNHRKKGFLFGLLFTSGDQRLSFSRAARLQQQQEEEERCGGGSSHALHLFDETPARAVSSFYARDLFDETPLRACSAAMEGSPSKRRGVTAPAHTDDGDWFSDVPDDVILNIMSFLTTRQAVQTCVLSRRWLNLWRSVPCINADVGEFQRSDTEWEEYDQERESAFKMFMDRVLELRNPAAPIRTFRFRCCRLDGFEGTSDEADMNRWITHAMQKQPWVLDILVLYDALKLDHSAFTCRYLTRIKFINVLMMPGFFQQLEMGCPVLENLFLDESIVADVEISSRTLKVLTIKSTQFSYKFRTTISTPSVTYLKLWRPVNGIYVFNDMPLLVTSILVLYDVQDSSDFCQNLRSLSAAKRLEFDYFGRKLTMENNLQLYPKFNNLVSLTLGQWCLDANFYGLVVFLQNAPKLEKLTLELEKNTPERIIGKLEDRSFTCEHLTRVEVVCSEVSTHATCSTKRLWACACAHGLTAMAPAHADGKDWFSALPDDIVLHIMTFLTTRQAVRTCVLSRWRNL

SEQ ID NO: 59106 - protein, 165 aa, Euphorbia esula
MSADIEYRCFVGGLAWATTDQSLQEAFSPYGEILDSKIINDRETGRSRGFGFVTFNNEKSMRDAIQGMNSQELDGRNTTVNEAQSRGNGRSGGGGGYSRGGGGGGYGSGGGRRERGYGGGGGGYNSISTGGSGGYGGGRDQGYGSGGGGSRYSTGGGESDGNWRN

SEQ ID NO: 59107 - protein, 412 aa, Thermus thermophilus HB27
MEYTTLAVLAGLPEDPHGAVGLPIYAVAAYGFKTLEEGQERFATGEGYVYARQKDPTAKALEERLKALEGALEAVVLASGQAATFAALLALLRPGDEVVAAKGLFGQTIGLFGQVLSLMGVTVRYVDPEPEAVREALSAKTRAVFVETVANPALLVPDLEALATLAEEAGVALVVDNTFGAAGALCRPLAWGAHVVVESLTKWASGHGSVLGGAVLSRETELWRNYPQFLQPDLKGQIPWEALRARCFPERVRTLGLSLCGMALSPFNAYLLFQGLETVALRVARMSETARFLAERLQGHPKVKALRYPGLPEDPAHRNARKYLASGGPILTLDLGDLERASRFLEAIRLLKAANLGDARTLLVHPWTTTHSRLKEEARLQAGVTPGLVRVSVGLEDPLDLLALFEEALEAV

SEQ ID NO: 59108 - protein, 678 aa, Arabidopsis thaliana
ILCFFFFILSFRVISVSAQQTCDNTAGSFKPNSTYDNNRRLLLSTFASNVTAQNGYFNGSFGLGTDRVYAMGMCAPGAEPDVCSNCIKNTAEGLLQICLNQTDGFSWSGEETLCLVRYSNKSFSGLLGLEPSNDFFNVNEIRKEDQKEFDSVFDELMFRTIQGASSSVRNNSNSLSLSGKYYAKDVAPEPVYGNISVVMQCTPDVSSKDCNLCLERSLDFYKKWYNGKRGTIILRPSCFFRWELYTFFGAFDSINARHPPPPPRPLSPPPLKTPSVTNQTNITKKNDSRISGGTIAAIVVVVVVTIILIVVGLVICKRRKQKQEIELPIVLNEAESVQFDLKTIEAATGNFSEHNKLGAGGFGEVYKGMLLNGTEIAVKRLSKTSGQGEIEFKNEVVVVAKLQHINLVRLLGFSLQGEEKLLVYEFVPNKSLDYFLFDPNKRNQLDWTVRRNIIGGITRGILYLHQDSRLKIIHRDLKASNILLDADMNPKIADFGMARIFGVDQTVANTARVVGTFGYMSPEYVTHGQFSMKSDVYSFGVLILEIISGKKNSSFYQMDGLVNNLVTYVWKLWENKTMHELIDPFIKEDCKSDEVIRYVHIGLLCVQENPADRPTMSTIHQVLTTSSITLPVPQPPGFFFRNGPGSNPSSQGMVPGQSSSKSFTSSVDEATITQVNPR

SEQ ID NO: 59109 - protein, 398 aa, Rhodococcus sp. T104
MSFLIVGASVAGTRTAIALRQRGFAGHIVLLESEEHWPYDKPPLSKDLLAEGPVPDVPRLLTPELAAEFDLDVRLGMCATGLDPARQVLVTHTGEEFSYERLVIATGARARALPVPSGLAGVHTLRTLDDATALREALVGRPRVAVVGAGFIGAEFASAARGRGLDVTLIEALEIPMSHVFGDEVGREISSIHTLHGAGLVTGARVEGFLGREQVEGVVLADGTEVPADLVVVGVGAVPNTHWLADSGLPIDGGVHCSDRFEVDGFPSIFAIGDLALRRHPLLGVSARIEHWTSAGEQADAVAAIVTGAEPAAAQLPYVWSDQYGARIQIVGMPSLGELAHREGSIAEGRFRAVYTDVDDKPIAQVSVNDAQAVAAFRKNHRRDGSLEDLVGQQRPAR

SEQ ID NO: 59110 - protein, 231 aa, Oryza sativa (japonica cultivar-group)
MEGGRGVTRVLLVDDSPVDRRVVQLLLSSSACAGSFHVIAVDSAKKAMEFLGLKEEGKEQAIDMVLTDYCMPEMTGYELLKAIKALSPLKPIPVIVMSSENEPQRISRCMNAGAEDFIVKPLQSKDVQRLRNCSPANTQCCDAGSDGKPPLLLLPSDHVVVDATAASPPPPPSRRRAHFAGVAMVLHSSSVELSHYFPFLFKFILLVYAILCLGELLHRWSNGCFLNLWCA

SEQ ID NO: 59111 - protein, 337 aa, Gibberella zeae PH-1
MAALNVDTLDMSLFFGTPDQKKDFCDSLLRLLKKRGGVKLVNHSIPSEDIHELFAQTKRFFELPLETKMIAKHPPQANPNRGYSFVGQENVANISGYEKGLGPQTTRDIKETVDFGSATDELVDNIWVPEDKLPGFRKFMEGFYEKAFKTEMQLLEALAIALGVSADHLKSIHNRAENEFRILHYPAVPASELADGTATRIAEHTDFGTITMLFQDSVGGLQVEDQENLGHFNNVESAAPTDIILNIGDSLQRLTNDTFKAACHRVTYPPSIKASDGEQVIPERYSIAYFAKPNRSASLFPLKEFIEEGMPCKYEDVTAWEWNNRRIEKLFSSDAKA

SEQ ID NO: 59112 - protein, 199 aa, Brassica napus
  misc_feature (164)..(164): Xaa can be any naturally occurring amino acid
  misc_feature (173)..(173): Xaa can be any naturally occurring amino acid
  misc_feature (180)..(180): Xaa can be any naturally occurring amino acid
  misc_feature (187)..(187): Xaa can be any naturally occurring amino acid
MAEEKKVAPIGIWTAVKPFVNGGASGMLATCAIQPIDMIKVRIQLGQGSAASVTTTMLKNEGIGAFYKGLSAGLLRQATYTTARLGSFKMLTAKASEANDGKPLPLYQKALCGLTAGAIGACVGSPADLALIRMQADNTLPLAQRRNYTNAFHALYRISADEGXLALWKGCGXTVVRAMXLNMGMLXSYDQSAEYMRDI

SEQ ID NO: 59113 - protein, 297 aa, Enterococcus faecalis V583
MTEPNLKDPRKLFYSDGFPQQDQETPALQDKMVPKPDCGEDSYVGNHKLENRRVLITGGDSGIGRAAAIAFAREGADIALHFFPGEEKDAEEVAHYIREAGRKVVLLPADLRDKQAPEELVAQAHEALGGLDTLVLNAAQQISCAAIEELPMEQVIDTFHVNIIAMFGIVKAAVPHLPAGSSIVTTTSVQAFNPSEHLLDYAATKASIANFTVGLAKQLAPKGIRVNGVAPGPIWTPLQLDHGQPIEELPEFGQHSLLERAGQPAELAPVYVFLASNDASYVTAQVYGVTGGEAINL

SEQ ID NO: 59114 - protein, 327 aa, Arabidopsis thaliana
  misc_feature (78)..(78): Xaa can be any naturally occurring amino acid
  misc_feature (91)..(91): Xaa can be any naturally occurring amino acid
MVLFWNIALLFSYFQLLKKSIFAPKSSSSSSCSKFNHSHTPVCVITGATSGLGKATAFALSRKGFYVVLAESFLLILXVGRSSHLLSKVFXTLSDIKRQNEDAKLKAFEVDMSSFQLVLKFRSSLEQWLFESDLHSSVQLLVNNAGILATSSRPTVEGFDRMIATNYVGAFSLTKLLLPLLRNSPVPSRVVNVTSFTHRSAFTGRFDMDSVTGVNFSRSKQYPCARIYEYSKSVDPGAVKTNIMHELPSYIQVIAFCGLKILGLMQSPEDAAESVIDAALAPPEISGKYFFGGRTIESSTLSSDPKMAKELWDTSCLIFNELQQTHT

SEQ ID NO: 59115 - protein, 1320 aa, Cryptococcus neoformans var. neoformans JEC21
MAFSRFGASKYRNAVPSIPHREEWYRSALPPASATSTTSSAASTFSSEIKTNREWIVTATQAGDLSYRPYHGDSTSLKVGSGGGVGDWDLSRLEDGLLVVGGLDGAVSAYQLPSASATRDLSHVSTIPQSSSPVTNLILHPTTPNILLVSTIAAPASIYDLSTTQSPSIILDAKEPKGMWSIAWNSDGRLVAGVGKSGMAYIWDPRSGKEPKVSKLLPIQPLKPARIRWIGEDIFLTSFSKTRNRQYSLLSGSSLSTTFTQSLDTNPGVLLPLVDEERKIIYVAGRGDMTLRQIELSGPQGYQETLHPLQFPLASASLAAVHPAKLDVMKAEISRILVPIIDKDGDSLLPVSIKVPRRQLIDFHEDLYPDLAGFVPEQTASDWLKGEDKSPLPISLDPSRRGAWESQVENLLKEKTAATPSKKPTDKPAQATVSEAQSSEPGSVPLTLNASAVPSGTSTQESKPKPSTTVPTPSQMSSQKVPSDSEPAPITEPKPEPTARPNLPSLLDDEDYSSTSYKVRIIADYLADQVAKHKRKGNKGPLMVGLQGPQGCDLYKTHDALKSVAQQHPDNALLAGRGPPGTHDIALAVETIKKVNSINDSAGSTVDLPVFDKSLCGGEGDRSVDKVVISGPLDVFILEGWSMGFAPLSESELKQVYDQPKPASSSTSKTYFPDHSLSSLLTLNGYLADFASSIYPSFTSFIQIEPESYDYVFNWRLQQEHNMKAKNGGKGMNDEQVQKFVERYMPGYELWKDGIWSRGAPWIGQGLKLKFGENRELLEMGVPPSQAPATSTSTQANNSSTSSAEMAPEKIVQATSAKVPKPATTAAPVAAAQAQPQASAKPNYTAPQAAPLTERFNPHWSRKFLAAKSPLIPTYDSLPSISSLHQDSQILKVTSHLAFFPIQGTGGRLCVHPLKKKGRVAVGGEGYLTNGVEIVDFDAELGDGKRVAVAGEDGAVRVWKIDEDGVQGVGPQPGQVLHGKNIDKFTQILFHPTARDLLVGVTNDYGQAHIRFWDLSKGEEVKVIDLPAPSVYRLAFSPAGDKVAVGTKDGRLVVFNPRDPETVSSGKAHDSPRSFQISWIDDNHIVSVGFSRGSQRRILLYRLPTSVGGEITTLSSITIDVSPSVLFPVYDADTSILYVWGKGERVIQAYEVHPEDDREPIAKLPGFTGDSPQIATVFMPKRMVDMKKVEVAKALRLTAKTLEEVSFTIPRNKPDFFQDDIYVPTKNVEITSLTASEWLDGKDVAQEIIDLKPEGMTLLSLAPKADTTARKKFVPAKNIMSEEEKKKKEMDALFAKAKMDESSSDEEEIRAGLDPPDDDW

SEQ ID NO: 59116 - protein, 738 aa, Legionella pneumophila str. Paris
MQQEDQAQIPQNSRSFSRNTARCFDTFMDTVDFLGRIGWPVIDLAFRIWIAQQLLVSAILLSNHWDTAVYLAKNEYPVPWLSPEWEALLGILAQFVGGISLLLGLFTRCGAAVIIGFAVMTQVYYQPIDLNLLWIALMLGYVLRGPGPLSLDNLFEHGFSRSPLPFAMLIVTFVDRTREFFSSLYLFSLRMWLMISLLLINQHIQLISSDALPLLMPWLPLNSASIVFNNVSLFMAIFLGLGLATRVVAIFGLIVVLLSFTPGVTGFYLYWMVLMAILFISGPGILSLDHLIFHALKKHYPQLSGKPAFSLDGLPRVVIIGAGFGGIACAKALRHMPVKITLIDRHNYHLFQPFLYQIATGSLSPADIAISIRSIFLEQFNAEILLGNVTGINKEERLVIADNFTIPYDYLVIATGATHSYFGKDSWAPYAPGLKTINDGTSVRSRIIKSFELAEIAESDEERKQFLNFVIVGAGPTGVELAGAIAELARFGIVKEFRHFDPASANIILVQAAPRILPTFSEQISQKAQRYLESMGVKVLVNSMVEQIDSDGVIINKERIYSKSVFWAAGVAASPASKWLQLEADPAGRVKVNDDLTVAGYSNIFAIGDTAASNAWNGKPVPGIAPAAKQGGAYVAKVISKRIYNNNSRYKPFKYIHYGSLATVGRKAAVAEFDRFKISGELAWWFWGGVHVFFLVGSRNRLSVILNWFWSYYTFRANNLLITDDSLNKKNKSGTSEV

SEQ ID NO: 59117 - protein, 199 aa, Triticum aestivum
AAFMSKDKAAERTLGDIILQKIMEKDAEVATEGRPRVKLDNSIIELYKEVGKFLSRYTSGKIPKAFKRIPSLECWADVVQLTEPENWSPNAVYQATRLFSSNMNTKNAERFYEAILLPRVRNDIRKNKRLHFALYQSLKKALYKPAAFNKGILLPLCRERNCTLREAVIIGSIIQKVSIPFLHASVALVKLAEMEYCGT

SEQ ID NO: 59118 - protein, 110 aa, Glycine max
  misc_feature (41)..(41): Xaa can be any naturally occurring amino acid
  misc_feature (80)..(80): Xaa can be any naturally occurring amino acid
  misc_feature (105)..(105): Xaa can be any naturally occurring amino acid
RTTCLIVSWKNHRKEELLFMSSKAIWKQHKPIREGISTCLXTRNRMWSLDRDPSPLPPLDNQSFVELILKSTKVDLKTPXSFEFRLRISLNADNLIWIPQVRNTXNKAFS

SEQ ID NO: 59119 - protein, 354 aa, Zea mays
  misc_feature (68)..(68): Xaa can be any naturally occurring amino acid
  misc_feature (149)..(149): Xaa can be any naturally occurring amino acid
ITGRPTRLSLILPDNAIYFNSIREIYDAWVIYNFLSLCLAWVGGPGAVVVSLSGRTLKPSWILMTCCXPAIPLDGRFIRRCKQGCLQFVILKPILVVITFILYAKGKYEDGNFSVNQSYLYITIIYTISYSMALYALALFYAACRDLLXPYNPVPKFIMIKSVVFLTYWQGVLVFLAAKSGFIKNAEKAAYLQNFVLCVEMLIAAIGHRFSFSYKEYAGSNARPFGGFRGSLLHAMKFNDFYHDTVHQFAPTYHEYVLYSNEGEDEPTKYSPSTMVPTGEHIVELAEVTVVNSKAPGMSRFLMYEPDQAETMPSQVMEANRTASAEPYDLSSFLNVELSDHPDEVPAIPDAREQ

SEQ ID NO: 59120 - protein, 221 aa, Burkholderia thailandensis E264
MTALTLLFDLDGTLVDTDALHLNAYNALLARWNRSIDIDYYKTHVMGFSDDLIFGRLFPGMPAAQYTELAAEKERMFRAQLGAKLTPTAGTADLLGYAERVGAKTAVVTNAPRENATMMLKALALEERFETLVIGGELEHGKPHPLPYLTALEWLGAKAQDAVAFEDSASGVRSASSAGIFTFGMLTALGEERLREAGAKAVIRDFGDRELWELLECAPSR

SEQ ID NO: 59121 - protein, 754 aa, Zea mays
MGGVGAGSLALLRLLLLLLLRAEASALHGTKPSTLPFTVPVATILPSPALSPSKAPEARSFGPRISPSHPPSALPPGSPGVDARHHSHKHPHHRESNQGPSPSSAPTPEGCSSYICTEPLTATPIGSPCGCVEPISVIVDLDLAPYLLFMSIAELEVEVAAGTFLKQSQVKIMAAVASIQDDQKTRVTIYLVPLREQFDTYTASLISDRFMEKKVQINSSIFGDYKVINISYHGLQSPPSSLPGGSDPSGTEEYPITAEVPDQKKKHNKSDILVIVVVLGSSLGLLMTCAVLLILLVRWKKLGRLHEAMTPATIPAVNRRYGTRPTLSTSMVSSASASVFSTVATCTTSVKTFSLAQLQKATDGFDSRRVLGQGGFGRVYHGTIEDGNEIAVKLLTREDRSGDREFIAEVEMLSRLHHRNLVKLIGICIERSKRCLVYELIRNGSVESHLHGADKAKGKLNWDVRMKIALGAARGLAYLHEDSNPHVIHRDFKASNILLEEDFTPKVTDFGLAREASNATQPISTRVMGTFGYVAPEYAMTGHLLVKSDVYSYGVVLLELISGRKPVNISESKDPENLVTWARPLLSHKEGLEKLIDPSLDGNFNFDNVAKVASIASMCVHTDPSQRPFMGEVVQALKLIYNDPDEACDDSYSPRNSSDQDGDYEGDLVFESGSWGFGASGCLDYRNSLPFVTMDYSSGRIEGPHDPRAALSAGSHAQSPVLQNRSGPLRVKKKLASFYRSRGSISEHGHLPRH

SEQ ID NO: 59122 - protein, 393 aa, Geobacillus stearothermophilus
MKLAKRVASLTPSATLAITEKAKELKAAGHDVIGLGAGEPDFNTPQHILDAAIKAMNEGHTKYTPSGGLPALKEEIIKKFARDQGLDYEPAEVIVCVGAKHALYTLFQVLLDEGDEVIIPTPYWVSYPEQVKLAGGVPVYVEGLEQNHFKITPEQLKQAITPRTKAVIINSPSNPTGMIYTAEELKALGEVCLAHGVLIVSDEIYEKLTYGGAKHVSIAELSPELKAQTVIINGVSKSHSMTGWRIGYAAGPKDIIKAMTDLASHSTSNPTSIAQYAAIAAYSGPQEPVEQMRQAFEQRLNIIYDKLVQIPGFTCVKPQGAFYLFPNAREAAAMAGCRTVDEFVAALLEEAKVALVPGSGFGAPDNVRLSYATSLDALETAVERIHRFMEARA

SEQ ID NO: 59123 - protein, 318 aa, Shewanella sp. MR-7
MANTLEQLKSYTTIVADTGDIEAIKRYQPEDATTNPSLILKAAQIPEYSALIDNAIAWAKLQSADIEQQIDDASDKLAVNIGVEILKLVPGRISTEVDARLSFDKEKSIAKAHKLVRLYQEAGVDKSRILIKLASTWEGICAAKELEQEGINCNLTLLFSFAQARACAEAGVYLISPFVGRILDWYKKDTGKDYDAVNDPGVVSVTEIYNYYKQHGYNTVVMGASFRNIGEIIELAGCDRLTIGPSLLEELANSQVAIQPKLIPASTTVAAGEPLTEAQFRWDFNQDPMAVDKLAEGIRNFAIDQGKLEVMLKAKLAN

SEQ ID NO: 59124 - protein, 545 aa, Shewanella sp. MR-7
MTILTQSTTWQALAAHSHQIPHMRELFAGDPARFSNMSLSTCGLFLDYSKNRATPETLNLLQTLAQEAKLDAKIKAMFAGDIINTTEKRAVLHTALRSTAEQSIVAEGQDIVPEVQQTLNKMQQFVTSVTSGQWKGFTGKAITDIVSIGIGGSFLGPKIVSQALRPYWITGLNCHFVANVDGTSISEKLKLLDPETTLFIMSSKSFGTQETLTNTLTAKAWFLAKGGSQSDVAKHFVAVTSNVAKATDFGIDADNIFPMWDWVGGRYSLWSAIGLPIALLIGMDNFRSLLKGAHQMDTHFANAPLAENMPVIMGLFSLWYGNFFNAQSHVVLTYDHYLRGLPAYFQQLDMESNGKSVTLNGTHVDYSTGPVIWGGEGTNGQHAYHQLLHQGNALIPADFIMPLQSHNPIGEHHDQLASNCFGQTQALMQGRTLDEALAELSKSSLSDEEKLLIAKHKVMPGNKPSNTLLMDKLTPETLGALIALYEHRTFVQGAIWDINSFDQWGVELGKSLGNDVLARIGAEQDATALDASSNGLINLYRQGKI

SEQ ID NO: 59125 - protein, 221 aa, Pseudomonas aeruginosa
MKKIKLVMVGNGMAGVRTLEELLKLNSDFYDITVFGAEPHPNYNRILLSPVLAGEQTFEEIVLNDLNWYAENGIKLLLDRKVVQIDRLRRRVVAADGSEAEYDRLLLATGSLPFILPIPGNRLQGVIGYRDIADTQAMIDCARTHSHAVVIGGGLLGLEAANGLKQRGMDVTVVHLSDWLLERQLDRTAGKLLQGALEARGIRFRLNTQTQELMDNGSGRV

SEQ ID NO: 59126 - protein, 594 aa, Solibacter usitatus Ellin6076
MATSTEQALSQREQLENEHLKTVREEIEIFRTKAMSVLAGEITDAEFRPFRLKHGIYGQRQPGVQMVRCKIPSGLLTADQVGQLARIADEFGGGRGHLTTRQNIQYHFVPLAQVPDLMHLLADVGLTNREACYNTVRNVTACPWAGIAQDEVFDVRPYAQRLAYAFLRKDLTGNLPRKFKFAFDGCRHEDCIQGAINDVGLRAVVRDGKRGFRMVIGGGLGPLPTEAQLLEEFVPEEQLLHKCEAIVRVFNQYGNRKNKNTARMKFVMRNRGLEWMREQIELAYQDILLNGGIAWPAIVPEGFGGYESNPQPLGNGALLPVVNHSTSGDAAYDRWLETNVREQKQTGYAAVTVTVDQGNLTGDQLRGLAKLAGTAGDGLLRTAINQNVVLGFIPLSRLPQVYQALGDLNLAGAGAGQIEDVLTCPGAYTCNLGITKTMNLGAALQETVRQFDDPEVRRLTIKASGCPNACGHHWIGDFGFYGNARKLEGREIPYYQMLLGGGYDDQGIMRFGLAIQSLPARLAPEAVRRVIQHFQANRLRGERFRDYVLRFKIETFRELTADLAKPADLFPEIYQDWGDSEAYSLKLGRGECAV

SEQ ID NO: 59127 - protein, 469 aa, Streptococcus pyogenes MGAS10394
MAFEIIMPKLGVDMQEGEIIEWKKQEGDTINEGDILLEIMSDKTNMELEAEDSGVLLKIVRPAGDTVPVTEVIGYIGAEGESVDTIASSEKTTEIPVPASADAGPTVAPKENVASPAPQVAATAIPQGNGGKVRATPAARKAAAEMGIDLGQVPGTGPKGRVHKEDVENFKGAQPKASPLARKIAADKGIDLATVSGTGFNGKVMKEDIIAILEAAKPAEAKAPAAKEEKVVDLPEGVEHKPMSAMRKAISKGMTNSYLTAPTFTLNYDIDMTEMIALRKKLIDPIMAKTGLKVSFTDLIGMAVVKTLMKPEHEYMNASLINDANDIELHRFVNLGIAVGLDDGLIVPVIHGADKMSLSDFVLASKDVIKKAQTGKLKAAEMSGSTFSITNLGMFGTKTFNPIINQPNSAILGVGATIPTPTVVDGEIVARPIMAMCLTIDHRLVDGMNGAKFMVDLKKLMENPFELLI

SEQ ID NO: 59128 - protein, 475 aa, Pseudomonas aeruginosa UCBPP-PA14
MSKVVLASQLPNKRNASLAPGLKQRHVTMLSIAGVIGAGLFVGSGHAIAAAGPAALLAYLIAGTLVVLVMRMLGEMAVASPDTGSFSTYADRSIGRWAGFTIGWLYWWFWVLVIPLEAIAAAAILNAWFPAIDTWIFALAVTFLLTVTNLFSVARYGEFEFWFALLKVIAIIAFIVLGAVAIVGGLPEREVSGLSSLMASHGGFVPNGYGAVLGALLTTMFSFMGTEIVTIAAAESKDPAKQITRATNSVIWRIGLFYLVSIFIVISIVPWNDPLLIQVGSYQRALELLDIPHAKLIVDLVVLVAVASCLNSAIYTSSRMVFSLAKRGDAPSVLKLTNTAHVPRPAVLASTAVGFLTTIVNYFAPEKVFTFLLASSGAVALLVYLVIAVAQLRMRKQLQVSGQPIEFRMWLYPWLTWAVILFIVAALSIMLIMPEHRHEVFATALLTIFTVCLGLLNARRKPRLGEDYAGKTARV

SEQ ID NO: 59129 - protein, 624 aa, Streptococcus pyogenes MGAS10394
MFRKVLVVLTWVRQRNQRFLTYRKNSIAFSLLLVSYIMAVEIIMPKLGVDMQEGEIIEWKKQEGDTVNEGDILLEIMSDKTNMELEAEDSGVLLKITRQAGETVPVTEVIGYIGAEGESVEVSSPAASDVNVARTTEDLEAAGLEVPKAPAQAASAAPKAALADDEYDIIVVGGGPAGYYAAIRGAQLGGKIAIVEKSEFGGTCLNVGCIPTKTYLKNAEILDGIKIAAGRGINLASTNYTIDMDKTVDFKNTVVKTLTGGVQGLLKANKVTIFNGLGQVNPDKTVNIGSQTIKGRNVILATGSKVSRINIPGIDSKLVLTSDDILDLREMPKSLAVMGGGVVGIELGLVWASYGVDVTVIEMADRIIPAMDKEVSLELQKILSKKGMKIKTSVGVSEIVEANNQLTLKLNNGEEVVAEKALLSIGRVPQMNGLENLNLEMDRNRIKVNDYQETSIPGIYAPGDVNGTKMLAHAAYRMGEVAAENAIHGNTTRKANLKYTPAAVYTHPEVAMVGLTEEQAREQYGDVLIGKNSFTGNGRAIASNEAHGFVKVIADAKYHEILGVHIIGPAAAEMINEAATIMESELTVDELLLSIHGHPTFSEVMYEAFADVLGEAIHNPPKRK

SEQ ID NO: 59130 - protein, 136 aa, Salmonella enterica subsp. enterica serovar Dublin
MKRHILATVIASLVAAPAMALAAGNNILSVHILDQQTGKPAPGVEVVLEQKKDNGWTQLNTGHTDQDGRIKALWPEKAAAPGDYRVIFKTGQYFESKKLDTFFPEIPVEFHISKTNEHYHVPLLLSQYGYSTYRGS

SEQ ID NO: 59131 - protein, 372 aa, Arabidopsis thaliana
MEKSRVKWRHTREKAQLTGKSAEPIPPPPVTITILVIIISQKKNVLMNDSQFRYQSNTSLNQLHLLGTMRAGCTIDPVNYFANDNLAPMMRLNSTRGRETENNNIMQRQQKLQISLNYNYNNNNTVVQDEVPKQNLVSTGLRLSYDDDERNSSVTSANGSITTPVYQSLGDNIRLDLNRQNDELDQFIKFRADQMAKGVRDIKQRHVTSFVTALEKDVSKKLQEKDHEIESMNKKNRELVDKIKQVAVEAQNWHYKAKYNESVVNALKVNLQQVMSHGNDNNAVGGGVADHHQMKEGFGDSEIDDEAASYNYLNIPGMPSTGMRCKLCNVKNVSVLLVPCRHLSLCKDCDVFTGVCPVCQSLKTSSVQVFFF

SEQ ID NO: 59132 - protein, 448 aa, Pseudomonas aeruginosa UCBPP-PA14
MNQPLNVAPPVSSELNLRAHWMPFSANRNFQKDPRIIVAAEGSWLTDDKGRKVYDSLSGLWTCGAGHSRKEIQEAVARQLGTLDYSPGFQYGHPLSFQLAEKIAGLLPGELNHVFFTGSGSECADTSIKMARAYWRLKGQPQKTKLIGRARGYHGVNVAGTSLGGIGGNRKMFGQLMDVDHLPHTLQPGMAFTRGMAQTGGVELANELLKLIELHDASNIAAVIVEPMSGSAGVLVPPVGYLQRLREICDQHNILLIFDEVITAFGRLGTYSGAEYFGVTPDLMNVAKQVTNGAVPMGAVIASSEIYDTFMNQALPEHAVEFSHGYTYSAHPVACAAGLAALDILARDNLVQQSAELAPHFEKVLHGLQGAKNVIDIRNCGLAGAIQIAPRDGDPTVRPFEAGMKLWQQGFYVRFGGDTLQFGPTFNARPEELDRLFDAVGEALNGIA

SEQ ID NO: 59133 - protein, 293 aa, Bdellovibrio bacteriovorus HD100
MKNFKGTFTALVTPFKNGKIDFASLDKLLKQQLAGGVDGFVVNGTTGESPVLTSSEKAELFKHIRNVCGDKVVLIMGTGSNNTAQTIEDSRKAEEMGADAILVVVPYYNKPPQRGLYEHFKAVASSVKIPTILYNVPGRTITSLETGTIRDLAKVKGVVGIKEATGKIDLASEIIKACGSEFVMLSGDDGTYVEFLGVGGHGVISVASHVIPAQMVQWKKWVSEGALDKARADIAKYNDLINLLFVEANPIPVKKALQLMGILESAELRLPLVELGAENTAKLQAEMKKVGVL

SEQ ID NO: 59134 - protein, 350 aa, Mycobacterium bovis AF2122/97
MGGVLTLDAAFLGSVPADLGKALLERARADCGPVLHRAIESMREPLATMAGYHLGWWNADRSTAAGSSGKYFRAALVYAAAAACGGDVGDATPVSAAVELVHNFTLLHDDVMDGDATRRGRPTVWSVWGVGGAILLGDALHATAVRILTGLTDECVAVRAIRRLQMSCLDLCIGQFEDCLLEGQPEVTVDDYLRMAAGKTAALTGCCCALGALVANADDATIAALERFGHELGLAFQCVDDLIGIWGDPGVTGKPVGNDLARRKATLPVVAALNSRSEAATELAALYQAPAAMTASDVERATALVKVAGGGHVAQRCADERIQAAIAALPDAVRSPDLIALSQLICRREC

SEQ ID NO: 59135 - protein, 380 aa, Erythrobacter sp. NAP1
MATQTDYYSLLEVSRDADGSTIKSAYRKLAMKWHPDRNPGNAEAEAKFKACNEAYECLKDPQKRAAYDRFGHEAFTQGMNGGGGPGGGHGPDGFADIGDIFETIFGSAFGGGGMGAQRQRQRRGADLRYDMQVTLDEAFHGKSTEIEIEVSQSCDTCDGSGAAPGTSERTCNLCHGQGSVRAKQGLFVVERPCPTCGGRGQVIEDPCGDCRGEGRVDKAQALQVDIPPGVDTGTRIRLSGKGEAGQRGAPPGDLYIFVHVKEHPLFEREGTTLATRVPISFTTAALGGSVDIPDLDGSTNTVDIPVGIQSGKQLRVRGAGMPVLQGRGRGDLVVEVKVETPTKLSRKQREILEQFRDTETGEECPESRSFFSKIKEAFGG

SEQ ID NO: 59136 - protein, 1417 aa, Yarrowia lipolytica CLIB122
MGEFHINLIPTYDDAHNLTDDLQSVSSSPYSVTVPKNRLRSRSDLSEVADRSVSTGALERLVPNPNKIRVDRRVVSDTNGDSNANSGPSLTHHLSHANLNTYNNNSSTNNLQTPQKLKSSVSYSSLHRTPNNNNFDTSFQSLQSEQSFHTAPSPDGVLSSSPNETRLKFQKSRDILRQGAPSPLNLTPGNRSVNATSPHPPTPSAYLFENDSSHKNQEQPSKQSPIQYSSPHPIGNAISWKADEPNNWTLDRVLMFLDLYQFGPDWAQTFTERNIVEGRFLELVSYQKLKALGHLSLNNGEVDTSPSRFIHILRKTLNRGTSSGTIDVDALNSSQSSDGTTGRHAATSSPQAFTSPQMGSPVISQNSPVPHHSPAPSEPPPPPPPPTNSAPPPPASNSAPPPPTSTPSAVQAKAHIPNSPSTSSLTSPLVPTTSAPADKITPRPLKTNRPQRPMTAYEGLYRTMKSPVSPSGNFFRRTHHKSSSSESSILGEDGLPKEEERKSRNLFSRLRRRDRSSSKNRNSTIPPSPVDHDGAASLYSNESKDKTSSPTLTSSSGWAPPKPPKVPIPNPTYNPPPLPPRSGSQQTPTSASTHHSSLSGFSVNSQPAPSTPLDRYFTITQNDRMILVTLDNVHFVAADLKNVLSVPQATDVIAKALGLNTHDLRFRLTDVGSEASEKLDEEALSYFFSDNKVMLSNYKLLVESASPSATLAPAVAAQTSSSVTSSPGKSIYSLETPSGGTKYPATPSYLYTKTQEPPGDYFSSQPPSKPTRQPSQSSIQTASDDQDSFKVIRPPPKKEINFDNRRSSPYDTLSRNTSFVARREAPRRPESSSSVRVRSTAVNSYTPGESEKFIPRPYHGGSNRLVMRKPVSAASSPVDQQSNDPTAATTAVSAAPQPSRLNPKLSGNFTFGRSGLKFKVPNYQDKLQRRSTSSSVRVAPEQNFQENDISFDDIQFDDDDDESDDGLWSKKLTKPTEAVSSTVSSTRSSTSSSSDVWAVRPPAEVVYDNLERFFPNADLDKPIIDDVESPPTSPDKRETLDYVKPRSMIIDQSQNDRKATITPLTSKIKEEGTLEKEEKTPAAKFSRKTGTSRIKSIRVVAREASEARKRFSTSSTKSTMTNPALLRRRSTKMWGQKVVEATPNQIKKGHISTVRDQRGHLKKFVWVKGELIGVGTFGKVYLALNATTGDMMAVKQVEVRNKAAAEVGVGALHAEVGTMKNLDHFNIVQYLGFETMQDHTYNLFLEYVPGGSVGSCLRNHGRFEENIVRFLTRQILEGLAYLHGCGILHRDLKSDNLLLDLDGVCKISDFGISKKSRDIYSNDAEMSMQGTIFWMAPEVIHNVIHNEKQGYSAKVDIWSLGCVVLEMFAGRRPWSNDEAIGAMYKLGNSRLAPPIPEDTKTFVSEDAKDFLDKCFIM

SEQ ID NO: 59137 - protein, 292 aa, Oryza sativa (japonica cultivar-group)
MEQYEKVEKIGEGTYGVVYKGKHRHTNETIALKKIRLEQEDEGVPSTAIREISLLKEMQHRNIVRLQDVVHKEKCIYLVFEYLDLDLKKHMDSSPDFKNHRIVKSFLYQILRGIAYCHSHRVLHRDLKPQNLLIDRRTNSLKLADFGLARAFGIPVRTFTHEVVTLWYRAPEILLGARHYSTPVDMWSVGCIFAEMVNQKPLFPGDSEIDELFKIFSIMGTPNEETWPGVASLPDYISTFPKWPSVDLATVVPTLDSSGLDLLSKMLRLDPSKRINARAALEHEYFKDLEVA

SEQ ID NO: 59138 - protein, 98 aa, Oryza sativa
TILPGITRKSIIDVALSKGFQVEERLVSVDELLEADEVFCTGTAVVVSPVGSITYQGKRVEYAGNKGVGVVSQQLYTSLTSLQMGQAEDWLGWTVQLS

SEQ ID NO: 59139 - protein, 213 aa, Marinobacter sp. ELB17
MDSDLTQKNLSFNSARFMVSASKLNECPADIGAEVAFAGRSNAGKSSALNTITVNGKLARTSKTPGRTRLINFFSLNRENARLVDLPGYGYARVSRDMKDDWQTHLGHYLNDRRCLRGLVLVMDIRHPLTEFDQTMVQWCQHNTMPLMILATKSDKLKFGQAKTAMLGIRQKLNEFSCVQHLIMFSSSNKTGLDECRQALTQWLEAEPEAAAG

SEQ ID NO: 59140 - protein, 359 aa, Oryza sativa
  misc_feature (96)..(96): Xaa can be any naturally occurring amino acid
MSAYCGKYKDELIKNAAYIGTPGKGILAADESTGTIGKRFASINVENVEENRRSLRELLFTTPGALQHLSGVILFEETLYQKTKDGKPFVDVLKEXGGVLPGIKVDKGTVEVAGTNKETTTQGHDDLGKRCAKYYEAGARFAKWRAVLKIGPNEPSQLSIDLNAQGLARYAIICQENGLVPIVEPEILVDGSHDIERCAYVTEKVLAACYKALNEHHVLLEGSLLKPNMVTPGSESKKVSPQLIAEYTVRALQRTVPAAVPAIVFLSGGQSEEEATVNLNAMNKLSTKKPWALSFSFGRALQQSTLKAWGGKTENVVKAQKAFITRCKANSEATLGTYQGDAVLGEGASESLHVKDYKY

SEQ ID NO: 59141 - protein, 287 aa, Shewanella oneidensis MR-1
MTVTSPIVDRYAVFGHPIGHSKSPFIHGQFAALTQESLTYEAILAPIDGFEASLKSFFSSGGKGANVTVPFKEQAFALCDSLSAEAALAGAVNTLSLLADGSIRGDNTDGLGLVADLISHLGSLQHKRVLLVGAGGAARGCILPLLNAGVGQLVITNRTQTKAKDLVDIFSQLEEGIYKDKLQALSMSELTGEFELVINSTSASLAGELPPLPQSIIGSTTVCYDMMYGAMPTAFNQWALQQGAAKVIDGLGMLVGQAAKSFALWRTVEPDTAVVLKLLREKLQLDI

SEQ ID NO: 59142 - protein, 344 aa, Sulfolobus solfataricus P2
MEAVILHGGQGTRLRPLTHTGPKQLIKVAGKPVSQWVLEQIRDAGIRDVIIVLGDNAPTRVVEYYGDGSKFGVRITYVYQGKARGLADAVYKVKDVVSDKFLVYLGDNLVPYDLSKFSSFKGSASILLAKVNNPNRFGVAVIKDGRVVKLIEKPKEQISDLALVGVYGFTREIFDVIESLKPSWRGELEITDAIQGLIDRGREVNYEIIQGWWKDTGTPKDILEANAFLLDRYAESRIEGVVDNSTVDGKVIIEKGAVIKNSVVRGPTYIGRDTKIINSYIGPFTSIGDQSEITDSEIEYSVILDGVKIRGVTLMDSLIGNNSTVEKGGRWQKLIIGENSSVIL

SEQ ID NO: 59143 - protein, 358 aa, Arabidopsis thaliana
MGINFEDQTTLFNFVVREGNGVKGMIDSGLSSVPRPFVQPLSERIPTQKALTCEATQPIDLSNLDGPQHKEVAKQIVEAAETLGFFQVVNHGVSVELLELLKSSAHEFFAQAPEEKSMYLKEVSPSKLVKYGTSFVPDKEKAIEWKDYVSMLYTNDSEALQHWPQPCREVALEFLNSSMEMVKNVVNILMENVGVTLEEEKMNGLMGTKMVNMNYYPTCPSPELTVGVGRHSDMGMLTVLLQDGIGGLYVKLDNGEWAEIPPVHGALVINIGDTLQILSNGKYKSAEHRVRTTNIGSRVSVPIFTAPNPSQKVGPLPEVVKRDGVARYKEFLFQDYMNNFFGQPHDGKKSLDFARAEG

SEQ ID NO: 59144 - protein, 527 aa, Zea mays
MAMAMMAMRRAVALGARHIPAAAASSFRVVSLRHMSADAGAAMEKIRAAGLLRTQGLIAGQWVDAYDGKTIEVQNPATGEVLANVSCMGSRETSDAIASAHSTFYSWSKFTASERSKALRKWYDLIISHKEELALLMTLEQGKPMKEALGEVNYGASFIEYFAEEAKRIYGDIIPPTLSDRRLLVLKQPVGVVGAITPWNFPLAMITRKVGPALACGCTVVVKPSEFTPLTALAAADLALQAGIPAGALNVVMGNAAEIGDALLQSTQVRKITFTGSTAVGKKLMAGSANTVKKVSLELGGNAPCIVFDDADIDVAVKGSLAAKFRNSGQTCVCANRILVQEGIYEKFAKAFIQAVQSLKVGNGLEESTSQGPLINEAAVQKVEKFINDATSKGANVMLGGKRHSLGMSFYEPTVVGNVSNDMLLFREEVFGPVAPLIPFKTEEEAVHMANDTNTGLAAYIFTKSIPRSWRVSESLEYGLVGVNEGIISTEVAPFGGVKQSGLGREGSKYGIDEYLELKYICMGNLG

SEQ ID NO: 59145 - protein, 416 aa, Arabidopsis thaliana
MTTMSNLPAEVLEEILSRTPVTSLRTMRSTCKKWNNLSKKKIIPEAARKQQGLMLIKKKICSLSFSLHEIHKDDYVVPCINQVDIPRNIEVEKIFHCDGILLCVIEDNCSLLVWNPYLGQTRRIEVSSDADMNDRYALGYDNNNSSHKILRIKKDFKNSDGLGYEIYRFASNSWSLLDEEVMKPEWDVWSVQRSSVSLKGNTYFLLQGNDYDDQEDEEEEDDEEYEDDDDVLPKDNFLLCFDYTTERFGPRLLLPFNPHVEETVALSCIGEERLVMLYQSFKTYKGIEIWVTDKIDPKAVSWSKFLKVDITPLTGFPVDFYADSFVIDEEKKVAAVFDIHCSYQKAHIIGEDGYLKCVNMGRASDVGNGQPLVFSSYVPSLVKVPVKQPKGKRKGRSSETKSNKNKKGRKIKIIGG

SEQ ID NO: 59146 - protein, 514 aa, Shewanella oneidensis MR-1
MTTTKRPIALLILDGWGYRENTHMNAVYHANTPVLDRLNAQYAHGLISGSGLDVGLPDGQMGNSEVGHINLGSGRIVYQELTRISKAIADHEFEQNPALCDAVDAAVKTGGAVHIMGLLSPGGVHSHEEHIEAMCRMAVARGATKVYLHAFLDGRDTPPRSAKSSLSHFDDLFTTLGHGRIASIIGRYFAMDRDNRWDRVSQAYDLITQGKSKFQYDNAVTALEAAYSRDENDEFVSSSAITDANGQVATLQDGDALIFMNFRADRARQITRSFINPEFDGFARAVTPKVNFVTLTEYAADIKAPIAYPSDNLVNTLGEVLQNRGRTQLRISETEKYAHVTFFFNGGKEEPFNGEDRILINSPKVATYDLQPEMSSTELTDKLVAAIESTKYDVIICNYPNGDMVGHTGNFDAAVKACEAVDACIGRVVEALAKVGGECIITADHGNAEQMTDETTGQAHTAHTSELVPFVFVGRDATIDKGGKLSDVAPTILHLMGESIPAEMTGKPLIHVKE

SEQ ID NO: 59147 - protein, 1070 aa, Alkaliphilus metalliredigenes QYMF
MPRDHSIRKVLVIGSGPITIGQAAEFDYAGTQACQALKEEGVEVVLVNSNPATIMTDREMADKIYIEPLKVEIIEKIIEKERPDSLIAGMGGQTGLNLAVELHDQGILNKYGVRVIGTSIESIKKGEDRELFKNLMEKIQQPSIESEIITKLEDGLSFAEEIGYPVIVRPAYTLGGAGGGIADDPEALKTILTAGLHLSPVGQVLLERSIKGWKEIEYEVMRDGSGNCITVCNMENIDPVGVHTGDSIVVAPSQTLSDKEYQMLRSASIDIINAIGIEGGCNVQFALDPHSFAYVVIEINPRVSRSSALASKVTGYPIAKVAAKIALGFGLDEIKNAVTKKTYACFEPTLDYVVVKIPKWPFDKFHGANRSLGTKMMATGEVMAIANNFEAAFLKGIRSLEIGQYSLVHQASRNRTIDELKARVQIPDDERIFDLAEMLRRNYRVDKVSEITGMDPFFVEKIKGIVEEEEKLRKTRVEHVTEEWLRELKKRGFSDKGMGDLIGCSPQKIYELRSQFDIHPVYKMVDTCGGEFEAVSPYYYSTYDQEDEVVVSERKKVMVIGSGPIRIGQGIEFDYCCVHSVLALRKAGIETIMVNNNPETVSTDFDISDKLYFEPLTEEDVLNIVEKEKPNGVILQFGGQTAIKLAKFFREMNIPILGTQPEQIDVAEDREKFEALMEELNIDRPKGKAVWSLEEGLVVAETLGYPVLVRPSYVLGGQGMEITYEEKELIRYLGDSFERDKKTPVLIDRYLIGTEIEVDALCDGEEILIPGIMEHLERAGIHSGDSISMYPSQNVSEEIKEKIIDYTKRIALALRVQGMINIQFIEYENELYIIEVNPRSSRTVPYISKVAEVPIIALATRVMLGEKIIDMGYGTGLYKESEMVGVKVPVFSTEKLPLVEVSLGPEMRSTGEVLGVGRDWVEALYKGCLAAKIPLLKQDGRVLVTIKDQDKEEFLPLAKKFAEKNYEFIATAGTAKFLRKHGMEAREVNKIGEDQPNILDVIRQGEVDLVVNTPTKGNDTNRDGFKIRRAAVESSVGVVTSLDTVAALLTVLESEVSMENIEVINLGVKS

SEQ ID NO: 59148 - protein, 487 aa, Burkholderia thailandensis E264
MGIKHWIGGREVDSRETFTTFNPATGEPIAEVASGGAQEIDAAVRAAKDAFPKWANTPAKERAKLMRKLGELIERNVPALADLETQDTGLPISQTKKQLIPRASENFHFFAEVCTQMNGRSYPVDDQMLNYTLYQPVGVCALVSPWNVPFMTATWKTAPCLALGNTAVLKMSELSPLTADQLGRLALEAGIPAGVLNVVQGYGATAGDALVRHPDVRAVSFTGGTVTGKRIMERAGLKKYSMELGGKSPVLIFDDADFDRALDASLFTIFSINGERCTAGSRIFVQRTIYDKFVAEFARRANNLIVGDPADESTQVGSMITRAHWEKVTGYIRLGIEEGARLVAGGPDKPANLPAHLANGNFVRPTAFADVDNRMRIAQEEIFGPVACLIPFDGEEDGLRLANDTSYGLASYLWTQDVRRAHRLARGIEAGMVFVNSHNVRDLRQPFGGVKESGTGREGGEYSFEVFAEIKNVCISMGGHHIPRWGV

SEQ ID NO: 59149 - protein, 320 aa, Pseudomonas aeruginosa UCBPP-PA14
MDRLPIIDIAPLYGADRGAWNDVARRIDQACREWGFFYIAGHPLPAARFEALLAAAREFFALPVEEKLKIDITRSRNHRGYGAIATEQLDPALPSDFKETFDMALHLPAEHPDVRAGKSFYGPNRHPDLPGWEALLEGHYVDMLALARTVLRALAIALGIEEDFFDRRFEQPVSVFRLIHYPPAAARQSADQPGAGAHTDYGCVTLLYQDAAGGLQVQNRQGEWIDAPPIDGTFVVNIGDMMARWSNDRYRSTPHRVISPRGVHRYSMPFFAEPHMDTEIRCLPGCFDADNPPKYPPTTCGEWLTSRFAQTYAYRRGETA

SEQ ID NO: 59150 - protein, 90 aa, Medicago sativa
YYEAGARFAKWRAVLKIGPNEPSPLSIHENAYGLARYAVICQENGLVPIVEPEILVDGSHDIAKCADVTERVLAACYKALSDHHVLLEGT

SEQ ID NO: 59151 - protein, 505 aa, Synechococcus sp. WH 8102
MAGSHFFLELEPPEECLHHAPHVVIVGGGFAGVHACKALANADVRITLIDKRNFNLFQPLLCQVSTGLVSRGDIATPLRELVGKQHNVQVLLGEVTNVYPEGKQIVFNGKAYSYDHLVLATGSGSTFFGHDEWRTFAPPMKILEHAEEIRRRLLMAMEQAEQTPDPEARQFLQTVVIVGAGPSGCEMAGAVSELMRWALNNAFKQLDPNKTQIVLVDPGDRVLRAMPEMLSSAALKSLEADGIEFLPKGRVQTMRPGEVIVGTPDGDVRLQAATVIWTAGVRASSLGKKLAEATGCEVDRGGRVIVQHDFSIADHPEIRVAGDLSSYSHTSNGKPLPGMAAPAKQAGTFIGKDIAAIVADRPRPTFSYFDFGSMAVLDRASAVADLRGLHFADGIGWILWAFVHLVLIPDWENRISLSIKWIFALLTQQRAAILLTGMPSQHMALDAVDAHFPMKAGEGVSIAEPDAAIKADMNYDSHQITGHPQPQELIDTRVDSAADSAAAIR

SEQ ID NO: 59152 - protein, 463 aa, Erythrobacter sp. NAP1
MAIELKMPALSPTMEEGTLARWLVKVGDEIASGDIMAEIETDKATMEFEAVDEGTLAAILVEEGTENVAVGTVIAMLAEEGEDVSDVSAPSGDAAPAPTPAPAPAPKSAPASSEGVKASPLAKRIAANEGVDLASVEGSGPKGRIVKADVEAAAGGSSSQPRSGDRVIASPLAKKMAGEQGIDLGDVSGTGPGGRIIKADIDNYEPTPAASPAPAPAASEEKTAKPAPQAPEHGAPFEEEKLSNVRKVIARRLTESKQTVPHYYLTMDIVLDPLLKLRKELNASLEPDGVKLSVNDLLIKALARALIRVPQCNVSYHGDTMRKYSRADISVAVAAPSGLITPVITEADTKGLAQISKEMKELAGKARDGKLQPHEYQGGTASLSNLGMFGIKQFDAVINPPQGMILAVGAGQQVPYVIDGEIKPATVLHASGSFDHRAIDGAEGAQLMEAIKQLVENPMGLLV

SEQ ID NO: 59153 - protein, 471 aa, Moorella thermoacetica ATCC 39073
MAIKFGTDGWRAVIADEFTFANVRLVTQATANYLLREAGSGKIIIGYDNRFLAPEFARAVAEVLTASGFTVYLPSRAVPTPVTAWAIKHYQAMGALMLTASHNPPEYCGLKFIPEYAGPAVPAITSAIEKEIAAVINGGEVKTLNLDEARGRGLVRELEPEADYREYLHGLIDVEALRKAGLKVVVDPLYGAGIGYLEDFLRGAGCQVQAIHNYRDPLFGGDLPDPSARGLEELSRRVRETGAHLGLALDGDADRFGVVDGDGTYLTANQVLYLVLAHLIMDRHYRGPVARTVATTHNLDRLARAHDLEIIETPVGFKYIGEALREKGCILGGEESGGLSIRGHIPEKDGILATALVAELRAVRGRSLGEILADLHSSYGHLVNQRLDIKVDPATKERVLQELPDFAPAKVAGIPVTGRLTVDGVKLTLADGSWVLLRPSGTEPLLRLYAEAPDAGRLRLLQKEITTALRI

SEQ ID NO: 59154 - protein, 276 aa, Synechococcus sp. WH 8102
MRIRPLLAVVLALCLAFFTTACSGDSEAVQRGASNVTYDDIHNTGKANDCPTIGDSARGSIALSVGGSYELRDVCMHPVQVYAKEEPKNVRQQAEFVEGKILTRYTSSLDEVYGDLKVTESGLEFQEKGGIDFQPITVLVPGGEEFPFTFSSKSLKATADGDALTTSTDFEGTYRTPSYRTSNFIDPKGRALTTGVQYAQGLVALGGDDEQLEKDNNKRYIDGVGTMSLSITKVDPETGEFAGVFSAIQPSDSDMGGREVVDIKITGELYGRLEEA

SEQ ID NO: 59155 - protein, 401 aa, Campylobacter lari RM2100
MDYLKLAKQYNTPFYIYDFDKIKERFLLLKEAFKARKSQIFYAVKANSNLSVLKLLVSLDSGFDCVSAGEIYRALKAGAKNYKIIFSGVGKSADELKYALEQNILYVNLESYEEMLLLEQIAKESQKIARISIRVNPNVDAKTHPYISTGLHENKFGVDIESAKKMYIYAKNSQFLDPVSVHFHIGSQILDISSIHEASVIVAKLVKELLVLKINIKFFDIGGGLGVCYKDEQEPNLYDYAQGILASLQGLDVCIGMEPGRFLVANAGEFITKVLYEKFNDKKRFVIVDGAMNDLLRPSLYSAYHEVKLLSENKEESLCDIVGGVCESGDFLAKDRKLAKTKAGDLIIVKSAGAYGFSMSSNYNTRNRVCELACENGMVRMIRKRESYEDQIALELDFLKD

SEQ ID NO: 59156 - protein, 490 aa, Oryza sativa (japonica cultivar-group)
MAGRKENPVLTACQAPSGRITRAQAAANRGRFGFAPSVSLPARTERKQTAKGKTKRGALDEITSASTATSAPQPKRRTVLKDVTNIGCANSSKNCTTTSKLQQKSKPTQRVKQIPSKKQCAKKVPKLPPPAVAGTSFVIDSKSSEETQKVELLAKAEEPTNLFENEGLLSLQNIERNRDSNCHEAFFEARNAMDKHELADSKPGDSSGLGFIDIDNDNGNPQMCASYASEIYTNLMASELIRRPRSNYMEALQRDITKGMRGILIDWLVEVSEEYKLVPDTLYLTINLIDRFLSQHYIERQKLQLLGITSMLIASKYEEICAPRVEEFCFITDNTYTKAEVLKMEGLVLNDMGFHLSVPTTKTFLRRFLRAAQASRNVPSITLGYLANYLAELTLIDYSFLKFLPSVVAASAVFLARWTLDQSDIPWNHTLEHYTSYKSSDIQICVCALRELQHNTSNCPLNAIREKYRQQKFECVANLTSPELGQSLFS

SEQ ID NO: 59157 - protein, 191 aa, Deinococcus radiodurans R1
MAHLGHGTAGRFAEREHERRLACTPGCGGYWVGGYRAGGQRFVSQSTAILTSGMERTFAMIKPDGVRRGLTPEILARIHNKGYRVVGLKQMMMPRETAEQHYGEHRERPFFGELVDFITGGPVVAIALEGENAIAGWRAMMGATNPANAAPGTIRADFATSTGENVTHGSDSPESAERELALFFGDGELLS

SEQ ID NO: 59158 - protein, 301 aa, Medicago truncatula
MGDEKKPKPVAIGVWPTIKPFVNGGASGMLATCVIQPIDMIKVRIQLGQGSAASVTSTMLKNEGVGAFYKGLSAGLLRQATYTTARLGTFRILTNKAIEANDGKPLPLYQKALCGLTAGAIGATVGSPADLALIRMQADATLPLAQRRNYTNAFQALYRIGADEGILSLWKGAGPTVVRAMALNMGMLASYDQSVEFFKDTVGLGEMTTVVGASSVSGFFAAACSLPFDYVKTQIQKMQPDAEGKYPYTGSLDCAVKTFKAGGPFKFYTGFPVYCVRIAPHVMMTWIFLNQLQKLEKSYGL

SEQ ID NO: 59159 - protein, 610 aa, Streptococcus pyogenes MGAS10394
MNSQDLKKRQEKIRNFSIIAHIDHGKSTLADRILEKTETVSSREMQAQLLDSMDLERERGITIKLNAIELNYTAKDGETYIFHLIDTPGHVDFTYEVSRSLAACEGAILVVDAAQGIEAQTLANVYLALDNDLEILPVINKIDLPAADPERVRHEVEDVIGLDASEAVLASAKAGIGIEEILEQIVEKVPAPTGDVDAPLQALIFDSVYDAYRGVILQVRIVNGIVKPGDKIQMMSNGKTFDVTEVGIFTPKAVGRDFLATGDVGYVAASIKTVADTRVGDTVTLANNPAKEALHGYKQMNPMVFAGIYPIESNKYNDLREALEKLQLNDASLQFEPETSQALGFGFRCGFLGLLHMDVIQERLEREFNIDLIMTAPSVVYHVHTTDEDMIEVSNPSEFPAPTRVAFIEEPYVKAQIMVPQEFVGAVMELSQRKRGDFVTMDYIDDNRVNVIYQIPLAEIVFDFFDKLKSSTRGYASFDYDMSEYRRSQLVKMDILLNGDKVDALSFIVHKEFAYERGKIIVEKLKKIIPRQQFEVPIQAAIGQKIVARSDIKALRKNVLAKCYGGDVSRKRKLLEKQKAGKKRMKAIGSVEVPQEAFLSVLSMDEDAKK

SEQ ID NO: 59160 - protein, 242 aa, Triticum aestivum
MRKAYRDSLKVLEADIQHANTLATEFPREYDGACLQMRLSFSPAAHIFLFLVQWTDCSLAGALGLMRILIYKVYVDGTTTMSTHERKASIKEFYAVIFPSLLQLQRGITDMEDKKQKAVCMERYRRRDEDETSSLSDVDAEREEECGICMEMNSKVVLPNCTHAMCLRCYQDWNSRSQSCPFCRDNLKKTDPGDLWIYVEDDDVVDMETVSRENLRRLFMYINKLPLIVPDVIFSVYDSHIK

SEQ ID NO: 59161 - protein, 614 aa, Arabidopsis thaliana
MGTPETSREPCPDRILDDIGGAFGMGAVGGSAFHFIKGTYNSPKGSRFVGGTQSVSMNAPRTGGSFAVWGGLFSTFDCTMVYLRQKEDPWNSIIAGAATGGFLSMRQGAGAASRSAIFGGVLLALIEGAGIMLNKVLAQPQNMMMEDPGMQGMPGMQGMQGMPGMPGMQGMPGMQGMQMGQMQSQAQIRSESQNQNTASSSSSSSWFGGLFDKKKEEVQPGSESKTEVLESFDAPPVPSFEFNPSTQLKHSNYIVVTASTSKLQKKINQSGFLGVFSLFAIMESLGKLQLHQQPNHLSFTHFSSSFPKKPSSFSLRSLPRSTSSFKCISIKASSSKSQDSKLSILKSTCVSFTAAAALFLVNLQLKPSPAIAAPVAATPLMESLKQSNGNVSFEEEERSLEEYLASHPDDVEALRSLMEVRIKSRKLLEAIELIDRLIELEPEEKEWPMLKANIFSYSGDLESAKTGFEEILVKDPLRVEAYHGLVMAYSDSGDDLNAVEQRIEEAMVRCKKEKNRKDLRDFKLLVAQIRVIEGKHNEALKLYEELVKEEPRDFRPYLCQGIIYTVLKKENEAEKQFEKFRRLVPKNHPYREYFMDNMVASKLFAEKVQREMAE

SEQ ID NO: 59162 - protein, 686 aa, Oryza sativa
MPSPPLDPHHVARPARANNRTNSKAFSFRKWHHGTQVLGSFITKLANYLPPSVPSYASTKMLYEALSQSPLTKCCIKERSLKRLAAILYGCGALIYTMYITPNLKKSKKFHPDVACTRNQHNSGKAYQDGVNEAVKRHGKRLEWIGRRRRGGGGDGRIYHETGLADLAIAEQADLEAASLTSGALRSAAAPPSSLGSRDRTAPLAMRCGGVEETGVGVWGVGAATAARRRGIAVMGWTTKEREKAAASRGSWSVGRRRWRRGKWRRGLGGVGRRTEEAWIPLQAGQGGRRWQGAMATVVGGRAMRDGVWAEWAADAEKKEWGRRRSIRATTMCLKSSFHGFQQQAHWLHSTPVSFQGFRPPENWVYSPNQITGSASSHGSESASQCPARYEENNVVDIEESSDNSQEAGRRGTRVNWTEEENIRLLSSWLNNSVDPINGNDKKAEYYWKAVAVEFNSNTSRSNRKRTVVQCKTHWGGVKKEIGKFCGAYSRARSTFSSGYSDDMIMEKAHIMFKSENNEKPFTLEYMWRELKDQPKWRRVLEEDSKNKRTKISESGAYTSSSNQDTEEENRRKKENRRKKKRPEGQKKAKAKLKGRGKNVAPSPLGDQPCQDFVLYNEAIKVKAEAMLKSAEATSKSAEAKKEYTRMEKYQTYLKLLDKDTSNFSDAKLKRHEAVLEKLATELAEE

SEQ ID NO: 59163 - protein, 221 aa, Brassica napus
RADAAFSEACALDGSLSSGTTALAAILTGRSLVVANAGDCRAVLSRQGKAIEMSKDHKPMSCKERRRIEASGGYIYDGYLSGQLNVARAIGDFHMEGMKRKKDGSNGGPLIADPELMTTKLTEEDEFLIMGCDGVWDVFMSQNAVDFARRRLQEHNDPVMCSKELVEEALKRKSGDNVTAVVVCLQPQPPPNLVAPRLRVQRSFSAEGLKDLQSYLDDFGC

SEQ ID NO: 59164 - protein, 837 aa, Dechloromonas aromatica RCB
MKLNRRDFIKANAAAAAISAAGLSVPGAAVAQGKDEIRWDKAACRFCGTGCGVLVGTQDGRVVATQGDPDAPVNRGLNCIKGYFLSKIMYGADRLKTPMLRMKDGKYDKNGEFTPISWTKAFDIMEEKAKATMKAKGPNGLAMFGSGQWTIWEGYAASKLMKAGFRTNNLDPNARHCMASAVAGFMRTFGIDEPMGCYDDIEHADAFVLWGSNMAEMHPILWTRITDRKLSNKGVKVAVLSTFEHRSYELADIPMIFTPQTDLAILNYIANYIIQNGKVNQAFVDKNVNFKKSATDIGYGLRPTHALEKNATSNGYPDADGKPKGDTGKSDPITFDEFKKFVSEYTVEKVSKLSGVAEKDLKALAELYADPKVKVISFWTMGFNQHTRGTWANNLCYNIHLLTGKISEPGNSPFSLTGQPSACGTAREVGTFSHRLPADMVVTNPEHRKHTEELWGLPEGTIPDKVGYHAVAMARALKDGKVNFYWQQCNNNMQAGPNINEELYPGWRKPENFIVVSDPYPTVSAMAADLILPTAMWVEKEGAYGNAERRTQFWRQQVKAPGEARSDLWQLMEFSKRFKVEEVWPAELVAKAPKLKGKTLFDVLYANGVVNKYKLNETAAGFDNDDSKLIGFYIQKGLFEEYASFGRGHGHDLAPFDSYHQARGLRWPVVGGKETLWRFREGYDPYVKKGEGVKFYGHKDGKAVIFALPYQPPAESPDKEFDMWLSTGRVLEHWHTGTMTRRVPELYKAFPDAVVFMHPDDAKARGLQRGMEVKVASRRGEIQLRVETRGRNKPPRGLVFIPFFDAGRLVNKLTLDATCPISKETDYKKCAVKVTKV

SEQ ID NO: 59165 - protein, 142 aa, Medicago truncatula
MAFDLIFWLLICFPLNIAFLASAFYQVLMLSDLEADYINPYDASSKINYFVVPEFIGQGLLCALFLFTGHWVMFLLMLPLASYHVMLYVKRQHLLDVTEVFRVLNAEKKFRIVKLTFYLTLVMITIFRLVLIVVNYFDMDDD

SEQ ID NO: 59166 - protein, 471 aa, Erythrobacter sp. NAP1
MADTDYDVIVLGSGPGGYVAAIRASQLGLKTAIVERELLGGICLNWGCIPTKAMLRSAEVYHQMHRASEYGLKVAGEIEADLAAIVKRSRGVAKQLNQGVTHLMKKNKITVHMGEGVLTGPTSLTVKGEKGEEKLTAKHVIVATGARARDLPFAPADGKRVWTYRHAMTPPEQPTKLLVIGSGAIGIEFASFYNDIGVDVTVVEMLDRIVPVEDEEVSTFLEKSLTKQGITVMTGAGVEDLKVTDKGVTATIKDKAGKTETTEFSHCITAIGIVPNTEDIGLDGLAEMDRGFIQIDDYGRTKSAGLWAIGDCTPGPWLAHKASHEGVTAAEAIAQELGNTDVHPHPLNRDAIPGCTYCHPQIASVGMTEAKAKEAGYEVKVGNFPFIGNGKAIALGEAEGFIKTVFDAKTGELLGAHMIGAEVTELIQGYTVGMTLETTEEELMQTVFPHPTLSEMMHESVLGAYGKALHI

SEQ ID NO: 59167 - protein, 115 aa, Oryza sativa (japonica cultivar-group)
MAAAAARPATSSTADAPATSGDCSSDVQDLMANCQDYVMFPADPKIDPSQACCAAVQRANMPCVCNKVIPEVEQLICMDKVVYVVAFCKKPFQPGSNCGSKSICLIRSSSRSAFN

SEQ ID NO: 59168 - protein, 323 aa, Candidatus Kuenenia stuttgartiensis
METEDIFASIEPLMDEVEARFYKELQPQNNSLADLVVHISKYKGKRLRPALTLLSGKCISDTAPQHIDLAVVVEMVHTATLVHDDIIDEAAMRRHVESMNSKWGREISILFGDYLFSRGFTILSALDSQIATLLLSQTVNTMCEGELIQLKRRYDVGLSEEDYIDIIEKKTASLCATSCRLGATFAGANHKLSEMMSNYGLKIGTAFQIIDDCLDFMGDEDEVGKSLNTDIKKGKLTLPLIRLVHQLPVSKRESTKELIFKGHLDEKKDAIVELLTEHDAVEYAFDRARSIVKQAQDVIAPLPDSQYKTALIELADYIIARKK

SEQ ID NO: 59169 - protein, 201 aa, Bacteroides fragilis YCH46
MEITNAEFVISNTDVKKCPAGTFPEYAFIGRSNVGKSSLINMLTGRKGLAMTSATPGKTMLINHFLINNSWYLVDLPGYGYARRGQKGQEQIRTIIEDYILEREQMTNLFVLIDSRLEPQKIDLEFMEWLGENGIPFAIIFTKADKLKGGRLKINISAYLRELRKQWEELPPYFITSSEERLGRTEVLNYIESINKELNSK

SEQ ID NO: 59170 - protein, 463 aa, Chlamydomonas reinhardtii
MQMQLNAKTVQGAFKAQRPRSVRGNVAVRAVAAPPKLVTKRSEEIFKEAQELLPGGVNSPVRAFRSVGGGPIVFDRVKGAYCWDVDGNKYIDYVGSWGPAICGHGNDEVNNALKAQIDKGTSFGAPCELENVLAKMVIDRVPSVEMVRFVSSGTEACLSVLRLMRAYTGREKVLKFTGCYHGHADSFLVKAGSGVITLGLPDSPGVPKSTAAATLTATYNNLDSVRELFAANKGEIAGVILEPVVGNSGFIVPTKEFLQGLREICTAEGAVLCFDEVMTGFRIAKGCAQEHFGITPDLTTMGKVIGGGMPVGAYGGKKEIMKMVAPAGPMYQAGTLSGNPMAMTAGIKTLEILGRPGAYEHLEKVTKRLIDGIMAAAKEHSHEITGGNISGMFGFFFCKGPVTCFEDALAADTAKFARFHRGMLEEGVYLAPSQFEAGFTSLAHSEADVDATIAAARRVFARI

SEQ ID NO: 59171 - protein, 525 aa, Erythrobacter sp. NAP1
MSDTENAPYYITTAINYPNGRPHIGHAYEGIAADVIARFQRLKGREVRFQTGTDEHGLKMARKAEEQGRTPRDLADEMSGYFREMDEALNIDFDRFIRTVEPEHHRASQAIWERMEAAGDLYLDRYEGWYSVRDEAYYDESELVEGEGEQKLSPQGTPVEWTVEESWFFRLSKYEKPLLDLLKTPGFLEPASRRNEMIAFVEQGLRDLSVSRTSFDWGVKVPGSDNHVMYVWVDALTNYLTGLGFPDETPEMEKFWPASLHLIGKDIVRFHTIYWPAFLMSANLPVPKKVFGHGFLLNRGQKESKSLGNVTDPLELAEQFGVDNLRYFLMREVAFGQDGSYSSEAIVTRTNAELANSFGNLAQRTLSMIAKNMDGVLEPFELAEVDTALLAAVKNACATDLPREFEQLAFSVGIEVWIKAVYACNQYVDEQAPWTLKKTDPERMKAVLQTLFCAIRDLAIAIQPIVPEKASAVLDQLGVPENERQFEQLHDRSWFDRLAKSGHVVGKPTPIFPRLELPEAAEEKS

SEQ ID NO: 59172 - protein, 481 aa, Solanum lycopersicum
MAAVNGVGLSWPSKLTKNQTPKWGFSPSHRRCNPSSSSSATIRMTASVDEKKKTFTLEKSEEAFSKAKELMPGGVNSPVRAFKSVGGQPIIIDSVKGSRMRDIDGNEYIDYVGSWGPAIIGHADDEVLAALAETMKKGTSFGAPCLLENTLAEMVISAVPSIEMVRFVNSGTEACMGVLRLARAFTCRPKIIKFEGCYHGHADPFLVKAGSGVATLGLPDSPGVPKAATIDTLTAPYNDISAVESLFEEHKGEIAAVILEPVVGNAGFIPPKLEFLAAIRKITKENDALLIFDEVMTGFRLAYGGAQEYFGITPDLTTLGKIIGGGLPVGAYGGRRDIMEMVAPAGPMYQAGTLSGNPLAMTAGIHTLKRLQGQGTYEHLDKITAELTQGILDAGKKTGHAMCGGSIRGMFGFFFADGPIYNFSDAKKSDTEKFGRFYRGMLEEGVYFAPSQFEAGFTSLAHTPEDIQRTVAAAEKVLKQI

SEQ ID NO: 59173 - protein, 585 aa, Deinococcus radiodurans R1
MALTAASISESLCSRCLHVSGPGGFPMRSNMMPVPLTIPFILERARTGFAEREIVSLLPAGKDAQGQPIAQTHRTTYGEVADRALRLGAGLQALGLQPGDRVATLAVNSFRHLEAYLGVPSAGFVLHTVNIRLHPEQVAWILNHAEDRVLLIENVFAAMIPAIRAACPKLEHVFVLGGLPQPIPGVADYDQWVMSQEPLTHYPQLDENDAAAMCYTSGTTGNPKGVLYSHRSTVLHSLASAPKDALNVGEADSVLPIVPMFHVNAWGLPYTCAMYGAKQVFSGVFTDGKSIAQLMQDEGVTSTAGVPTIWMGLLSELDRAKQAGEPYDLSGLERLIVGGSAAPESLIRAFEERHNLRLLHAWGMTETHPLGTASTLPLNMDPRSDEGYALRAKQGRPVPLVELEIVDDDSNVLPHDGAAMGRLLCRGPWIADSYFKGEGASSFLTLDGNLWFDTGDIATLDERGYMHIQDRSKDLIKSGGEWIGSVELENAIMAHPAVAQCAVIAMDDPKWDERPLAVVVLRPGQAATHEELTEFIAPKFAKWWLPDATVFTDALPIGATGKFLKRELREEYRGYRQQNFPQRQD

SEQ ID NO: 59174 - protein, 194 aa, Medicago truncatula
MNKGVAAAADKGLPFWHDKALNAVKVVALYFSYRPTVEFFKDTIGLELTDTALCAIFVSIIYAAACSLPVEYVMIQIQNMQPDAEGKYPYTGFLDCAVKTYKAGGILKFYTGFPLYCVRISIGVMHPSPVLDPIVPSTNPKDSQLSLRFLCGVIQGIEIWNLGFGISGKLNLEAKRNGVLIGVGDEEEKTEGEE

SEQ ID NO: 59175 - protein, 422 aa, Enterococcus faecalis V583
MSNENIVLARNTERAPKHHLAAQTVAFSHYNHLSAQLPIEPTSGQLVEGGIRAQATQCLKNIQAVVESINHVMSDIVRMTIFVKDMRDAAAVEEVYAAFFTHYYPAKTVVAVADLPLGASVQMEALVSNGEGTIPNAPQAGDLIKLTNQTVQAPIDALASQTVAFSHYNNLSAQLPIDPQTGRVVAGCVKTQTKQCLKNIKAILTSIDVPFDDIVKINIYLKDLSKLEAVNQVHAAFFPDSGIARTVNYMPARTVIAVADLPMGAAVQVEAVVSHGDGTPPQAIEDRHGLIIEANNTEHAPKCPFSTQTVAFSHYNHLSAQLPLDPKTNALVAGGIKEQTTQCLENIKAIIESVDHSLADLVKVNIFVKEIEELAAVDDVYQTYFPEGTPARRVIGVTDLPKGAQIQIEAIAGNAEGTPPIG

SEQ ID NO: 59176 - protein, 677 aa, Candida glabrata CBS 138
MERVRLDRKSSNDSNHSLGGESTSRSGGSGIGVAPTSGNNGTVKRASSMSSNYSNINASLHARVKAFQEQRGLHRSSSLGKGDSEENIGNVGTSINPSPSLGSMKDEPVPAIQKIVNKPLPPLPGQNSSSLTPSQETINMISNASQQAPDGPLNNISPVPGFKEAMGGNVRRNDGQNLYGSTSPAVTASAPNMPAFNPNRKAPRPPQIPHNTVIPAKPMQSLSSRRGLKLPPGGMKLKLPSKGDAPASMPSTVPAASSVKPVVHQEFAATPSNKNHIKNNNGSTEGKRSNPGSLVNAVQTTSISSANDQQDTEGTEPKSNSNGTGLFANFSRYVDIKSGSLNFAGKLSLSSRGIDFSNGSSSRITLDELQFIEELGHGNYGTVSKVLHKPNNVLMAMKEVRLELDESKFRQILMELEVLHKCNSPFIVDFYGAFFIEGAVYMCMEYMDGGSLDKIYDENPEMGGIDEPQLAFITNAVIQGLRELKEVHNVIHRDVKPTNILCSAKQGTVKLCDFGVSGNLVASLAKTNIGCQSYMAPERIKSLNPDRGTYTVQSDIWSLGLSILEMALGRYPYPPETFDNIFSQLSAIVDGPPPKLPADKFSDEAQDFVSLCLQKIPDRRPNYSNLYEHPWLAKYRSIDVQMGPYITKRLEIRKRILAEKGEDGLHRTVPALHKGGL

SEQ ID NO: 59177 - protein, 125 aa, Deinococcus radiodurans R1
MKDIVQTADAPAAIGPYSQAVTFGNLVVTSGQIPLTAQGELVTGGIAEQTEQVIQNLRAVLAAAGTDLDRVVKTTVFLADMNEFTAMNAVYEQHFTAPYPARSTVQVARLPRDVRVEIEVLAERH

SEQ ID NO: 59178 - protein, 977 aa, Aspergillus nidulans FGSC A4
MSKAVVKTTFEASRTLRPIYTGGSTALDASGRLLVACVNEDALVVDLETGNQLATLDGDGEVITSLAITPSASHVILCSRSMSMRIYSLSQYEDTTPTLETKLVRSLKPHTAPVVTTATDSTGTLLATGAADGSIKVWDIRGGYITHSFHGHGGVISALCFFQPPTAEHDGKLSSKKKPKRKTGMAGDDDDNEMMDLDSASNSNGAFRLASGSEEGKVRVWDLNKKKSIASLDSHVSVVRSLSYSLTENALLSAGRDKTVIVWDMRTFKTRRIIPVLESAEAASFVAEGGLCLVGGEYGRLRVWDCNRGGEVTGDQEAAPEFEAIIAIHYTPGMSFAMTVHADQTLRLHSLEPLSNLKPGTTIDPLPVVRRISGNDDDIIDLAYVGPDRSMLALATNTESIRIVSVGPSDYRPSTDGQEYFGADIAHLDGHDDIIICIDVDWSGHWLATGAKDNTARLWRLDPQNSSYTCFALLTGHAESLGAISFPRDSPPPDTPAYKAPVNHPPPFVITGSQDRTVKRWNVGKLGPTIGNKPHTPKALFTRKAHDKDINALDVSPSSALFASASQDRTVKIWSADDGSVVGVLRGHKRGVWSARFSPKGTPILSADAKSSTNRGMIVTGSGDKTVKLWSLSDYSCLLTFEGHTNSVLKVLWLPPPDMSSKTEDEEDEDAAASKPNSIQLRPLVASAAADGLVKIWSPYTGELETTLDNHTDRVWALASPTPSGTRDDVNSSATKSTSPYAIASGSADSTVTFWTDTTSATYTAAVNANSARIEQDQQLQNYIVAGAYREAITLALQLNHPARLLSLFSAAIDAADDPHNTDNQGEDRANSFTGNPSIDEVLQTLDPANLYVLVLRLRDWNTNARHSKVAQRILFALFRSYPASTFVELASSSIAKRNGDGRAAAAMKDILQALASYTERHYRRVEELEDESYLVEWVLGEMDGGIGLSALGAPTQGINEIEDKAEHGKDVVMLGA

SEQ ID NO: 59179 - protein, 397 aa, Oryza sativa
  misc_feature (26)..(26): Xaa can be any naturally occurring amino acid
MATFSGTDRLRDLHAFDDTKAGVKGXLVDAGVTTVPYFFRHHPDPLPVAAPSEAAAAIPLIDLAKADVDRGHVVSQVRSAAESVGLFQVVNHGVAGELMDAMLAAARRFNEEPLEAKVPYYTRDVASKVRFSSNFDLFRSPAANWRDTMYVEMFPEVPSPEEIPPPCRGVAEEFAAAVWRLGERVTELLSEALGLPPGYLAEHAGCMDGMSMVAQYYPPCPEPEKTMGTTRHSDPSFLTVLLQDESGGLQAVLPRPPEERWVDVPPVAGALVVNVGDLLQLVSNGRLRSMEHRVLPTAASAARARVAVACFFRLEYSASLTRPRSYGPIVDSGEGGARRAAAVYRSTTPRDFLAYFNGKGLDGRSALEHFRIPEAAAASSAVDVVSSSTTAAASIPR

SEQ ID NO: 59180 - protein, 458 aa, Shigella flexneri 2a str. 2457T
MKNASTVSEDTASNQEPTLHRGLHNRHIQLIALGGAIGTGLFLGIGPAIQMAGPAVLLGYGVAGIIAFLIMRQLGEMVVEEPVSGSFAHFAYKYWGPFAGFLSGWNYWVMFVLVGMAELTAAGIYMQYWFPDVPTWIWAAAFFIIINAVNLVNVRLYGETEFWFALIKVLAIIGMIGFGLWLLFSGYGGEKASIDNLWRYGGFFATGWNGLILSLAVIMFSFGGLELIGITAAEARDPEKSIPKAVNQVVYRILLFYIGSLVVLLALYPWVEVKSNSSPFVMIFHNLDSNVVASALNFVILVASLSVYNSGVYSNSRMLFGLSVQGNAPKFLTRVSRRGVPINSLMLSGAITSLVVLINYLLPQKAFGLLMALVVATLLLNWIMICLAHLRFRAAMRRQGRETQFKALLYPFGNYLCIAFLGMILLLMCTMDDMRLSAILLPVWIVFLFVAFKTLRRK

SEQ ID NO: 59181 - protein, 214 aa, Ustilago maydis
MAPAAICRKLVIVGDGACGKTSLLCVFAIGEFPQEYEPTIFENYVAEIRLDGKPVQLALWDTAGQEEYERLRPLSYSQAHVILIAFAIDTPDSLENVQVKWMEEVRQICGPSVPVLLVGCKKDLRENAIAKGKPVQGHYVKRQQAKLVAAQIGARSYHECSSLNNQGVDAVFEAATRAAMLVRNSGASSGGAISQSKTKEALHNDAGSCKCIVL

SEQ ID NO: 59182 - protein, 193 aa, Ustilago maydis
MQTIKCVVVGDGAVGKTCLLISYTTNAFPGEYIPTVFDNYSANVMVDGKPVSLGLWDTAGQEDYDRLRPLSYPQTDVFLVCFSLVSPPSFENVRTKWWPEVSHHAPNIPTILVGTKLDLREDPETIAKLRDRRMQPITYAQGNQMARDIHATKYLECSALTQKGLKGVFDEAIRSVLAPAPVQSKKKNNCLIL

SEQ ID NO: 59183 - protein, 352 aa, Gibberella zeae PH-1
MSSSYSTKQWVLANKPTGEPVLSGPDATWKLQTVTLPELQDGQILVKIQYFSNDTGLRNFMHSTVAPERFYVPTVPVGSPMRSGIIAEVVESRSDKFKVGDLCMDFHLGIWSEYAILEAENSQPLAPLPNGLSTTHFLGAFGASGLAAYTGLYYAGEAKPEHTIVISAAAGATGSMAVQIASKILKAKRVIGIAGSDEKCEWVKSIGAHECINYKSPTFLEDLKAVTPDEVDVYFDNVGGFVLDAMLTRVKRHGHIAVCGSVSVYNSDEPMALKNWFELISSRINIRGFIMLDYMDKVPAILGELIGATADGRIKLENAETVIEARIEQQPETWMKLFSGVNQGKLLTKLII

SEQ ID NO: 59184 - protein, 435 aa, Schizosaccharomyces pombe
MTTIQKIYSRSIYDSRGNPTVEVELTTELGTFRSMVPSGASTGEWEAKELRDNDKNKWGGKGVTIAVHNVNNIIGPALVKSDIKITDQRGIDEFMIKLDGTNDKSKLGANSIVGVSMAVARAAAAFLKIPLYEYIGKLAGSKTTECIPVPSFNVLNGGRHAGGDLAFQEFMIMPIKAPTFSEGLRWGSEVYHTLKALAKKKYGASAGNVGDEGGIAPDLTTAEEALDLVNEAIKEAGYDGKVKIGFDVAASELYNGKLYDLDFKSEHPKPENKLDYKKLYEKYSALIEKYPIVFIEDPFSEEDWGAFSYMSSKTKVEVIADDLTVTNVKRLSKAIELKCANALLVKINQIGSLSETIDAANMAKKAGWGLMVSHRSGETDDSFIAHLAVGLEAGQMKSGAPCRSERLAKYNELLRIEDNLGDSAIYAGTRAADYI

SEQ ID NO: 59185 - protein, 197 aa, Triticum aestivum
MAGSDLLRPDPATGLAIVIMGVSGCGKSTVAAMLADALGCGFVEADDYHSHANKEKMSRGVPLTDEDRLPWLESLRDAIRERLGRGEDVAVSCSALRLKYREVLRQGDISYKPGSYETCRVKFVCLEASAEVIAGRVERRAAEGGHFMPASLVRSQLDLLEIDAAEGITVVDATVPAHAIVQATVAQFRDELASMAC

SEQ ID NO: 59186 - protein, 756 aa, Solanum tuberosum
MAIVGGLVDVPFENKVEFDDLARFAVQDYNQKNDSSLEFKKVLNVKQQIVAGIMYYITFEATEGGNKKEYEAKILLRKWEDLKKVVGFKLVGDDSTMPGGIVNVPNPNNTKFQELARFAIQDYNKKQNAHLEFVENLNVKEQVVAGIMYYITLAATDDAGKKKIYKAKIWVKEWEDFKKVVEFKLVGDDIAKLGGITDVPFPNNPEFQDLARFAIQVYNKKENVHLEFVENLNVKQQVVAGMMYYITLAAIDAGKKKIYETKIWVKEWEDFKKVVEFKLVGDDSAKTGGIINVPNPNSPEFQDLARFAVQDYNNTQNAHLEFVENLNVKEQLVSGMMYYITLAATDAGNKKEYEAKIWVKEWEDFKKVIDFKLVGNDSAKKLGGFTEVPFPNSPEFQDLTRFAVHQYNKDQNAHLEFVENLNVKKQVVAGMLYYITFAATDGGKKKIYETKIWVKVWENFKKVVEFKLVGDDSAKLGGIINVPFPNNPEFQDLARFAVQDYNKKENAHLEFVENLNVKEQLVAGMLYYITLVAIDAGKKKIYEAKIWVKEWENFKKVIEFKLIGDDSAIIGGFTDVPFPNNPEFQDLARFAVQDYNKKENAHLEYVENLNVKEQLVAGMIYYITLVATDAGKKKIYEAKIWVKEWEDFKKVVEFKLVGDDSAKPGGIIIVPFPNSPEFQDLARFAVQDFNKKENGHLEFVENLNVKEQVVAGMMYYITLAATDARKKEIYETKILVKEWENFKEVQEFKLVGDATK

SEQ ID NO: 59187 - protein, 152 aa, Yarrowia lipolytica CLIB122
MSNTEQTFIAIKPDGVQRGLISPILHRFEQRGFKLVAIKLTNPDEKLLREHYEDLQEKPFFPSLLKYMQSGPVLATVWEGKDVVKQGRNILGATNPLQSAPGTIRFDYAIDIGRNVCHGSDSVESAKKEIGIWFKPEELASYTPANIGWIYE

SEQ ID NO: 59188 - protein, 2211 aa, Candida glabrata CBS 138
MTTPVAPITPPMETTGDRLVTLELKDGTTLQGYSFGAEKPVAGELVFQTGMVGYPESITDPSYEGQILVITYPLVGNYGVPDFNLRDEFIESLPRYFESNRIHVAGLVISHYTEDYSHYLAESSLGQWLKREGVPAVYGIDTRALTKHLRNCGSMLGRLALQEASAKLEVATSESWKSVFDVPEWVNPNVENLVAKVSLKEPKLFTPPSDNKYVEVKKGADGKTIRILAIDVGMKYNQIRCFVKRGVELLVVPWDYDFTKEDYDGLFISNGPGDPSVLNDLANRLSKALEKKKTPIFGICLGHQLLARASGASTLKLKFGNRGHNIPCTSTISGRCYITSQNHGYAVDVDTLTPGWKPLFVNANDDSNEGIYHTELPYFSVQFHPESTPGPRDTEFLFDVFINAVLEHKNSGVLKPVEFPGGKIENNRKENPRVEAKKVLVLGSGGLSIGQAGEFDYSGSQAIKALKEEGIYTILINPNIATIQTSKGLADKVYFLPVTAEFVRKVILHERPDAIYVTFGGQTALSVGIEMKDEFESLGVKVLGTPIDTIITTEDRELFANAIDEIDEKCAKSQAANSVEEALAAVKDIGFPVIVRAAYALGGLGSGFANNEQELIDLCNVAFASSPQVLVERSMKGWKEVEYEVVRDAFDNCITVCNMENFDPLGIHTGDSIVVAPSQTLSDEDYNMLRTTAVNVIRHLGVVGECNIQYALNPFSKEYCIIEVNARLSRSSALASKATGYPLAYTAAKLGLNIPLNEVKNSVTKSTCACFEPSLDYCVVKMPRWDLKKFTRVSTELSSSMKSVGEVMSIGRTFEEAIQKAIRSTEYSNLGFNATDLEIDIDYELQNPSDLRIFAIANAFDKLGYSVEKVWEMTNIDKWFLNKLYDLVKFASKVSSCGGIEGLSPTVLRQAKQLGFDDRQIASFTSSNEVAIRRLRKDYGIIPFVKQIDTVAAEFPAYTNYLYMTYNAAEHDVEFNDHGVMVLGSGVYRIGSSVEFDWCAVTAVRTLRANNIKTIMINYNPETVSTDYDEADRLYFETINLERVLDIYEAEASNGVVVSMGGQTSNNIAMSLHRENVKILGTSPDMIDSAENRYKFSRMLDQIGVDQPAWKELTSMDEAEDFAEKVGYPVLVRPSYVLSGAAMNTVYSKNDLESYLNQAVEVSRDYPVVITKYIENAKEIEMDAVARNGELVMHVVSEHVENAGVHSGDATLIVPPQDLAPETVDRIVVATAKIGKALKITGPYNIQFIAKDNEIKVIECNVRASRSFPFISKVVGVNLIELATKAIMGLPFAPYPVEKLPDDYVAVKVPQFSFPRLAGADPVLGVEMASTGEVATFGHSKHEAYLKSLLATGFKLPKKNILLSVGSYKEKIELLPSVQKLYNMGYKLFATAGTADFLTEHGLSVQYLEVLNEDEPEKKEYSLTQHLANNEIDLYINLPSANRFRRPASYVSKGYRTRRMAVDYSVPLVTNVKCAKLLVEALAQNISLNVSERDAQTSHRTVTIPGLINITTYVPNITNVVEGPAELKETTRLFLESGFSYCQIMPRASRGPVINDAASIKVATSVSNNSCHTDFAFTIAGTAHNAQQIAQSADKANALYLPLHELKNKVSTISELLSNWPSNKQVITEAKTSDLASVLLLASLQNRSIHITGVSKKEDLSLIMTVKEKDPKVTCDINVYSLFVTQEQWPEAMFLPTEEDQEFFWKNLSAIDAFSIGSVPTQLAEITGNKVEVGLGIKDALPLLLSAVEEGKLTVDDIVEKLHDNPAKIFNIPTQNSLVELDLDFSFASKKRWTPHSNTSLRGGIERVVVNDETLVLSGELVATEPKGTLKMKSELVQASVENAPAIQSTGRRMTIHDDKLMDVDSAENSIPDAPIQQKLMSSKPPRELTAPSALQNLIRGNNPFQGRHILSIKQFSRADFHALFAVAQELRAAVAREGVLDLMKGHIITTIFYEPSTRTCSSFIAAMERLGGRVVNINPNVSSVKKGETLQDTIRTLACYTDAIVMRHSEEMSVHIAAKYSPVPIINGGNGSREHPTQAFLDLFTIREEIGTVNGITVTFMGDLKHGRTVHSLCRLLMHYQIRINLVSPPELRLPESLREELNSKGQLGVESVALTPEIISKSDVLYCTRVQEERFKSTEEYERLKDFYIVDNKILSHAKQNMAVMHPLPRVNEIKEEVDYDHRAAYFREMKYGLYVRMALLAMVLGVNN

SEQ ID NO: 59189 - protein, 488 aa, Glycine max
MCSSETINIAASTQKLDVDNRIALRFYYRIADNILKQADIFRAETNIVDLYIMLLRFSSLVSETIPRHRDYRSSPQGKKEALRKKLLHSMNELEKLKPKVQQKINEFNSRRAYQPNGWEKCHSNNFMDFSPAKKQTLTSYNKKKAVIPTTGEFVYQGSRGQQFSSVRPVEENMRRLSLSLLRPKEETLSRHSILGPNGLKGQWRPPASDKGVRYPTIIDLSPVEIPSLQQPLVDGSLTKKDNSISEQHKSDLESILTQSDDCKAKHADEAPSLISFEATEIPAQIEVTRQPSPPPVLAEVQDLVPAMLPHVIEEGCKTEIPMSDSIVRAESPLQLHISTSMMESFMKLAKSNTDKNLETCGILAGLLKNRKFYITTLIIPKQEATSSSCQATNEEEIFEVQDKQSLFPLGWIHIMLPEAVAIVMAPTDSSRNHGIFRLTTPGGMSVIRQCQQRGFHPHNQPPDGGPIYDTCTDVYMNPDLKFDVIDLR

SEQ ID NO: 59190 - protein, 510 aa, Medicago truncatula
MAVVAAPKKNNSMNKKDNPNLLLGRFELGKLLGHGTFAKVHLAKNLKTGESVAIKIISKDKILKSGLVSHIKREISILRRVRHPNIVQLFEVMATKTKIYFVMEYVRGGELFNKVAKGRLKEEVARKYFQQLICAVGFCHARGVFHRDLKPENLLLDEKGNLKVSDFGLSAVSDEIKQDGLFHTFCGTPAYVAPEVLSRKGYDGAKVDIWSCGVVLFVLMAGYLPFHDPNNVMAMYKKIYKGEFRCPRWFSPELVSLLTRLLDIKPQTRISIPEIMENRWFKIGFKHIKFYVEDDVVCDLDSLDLDGEDNNNKVVKVDDHHDEVLESVSENESDSEVVNRRIRNRGSLPRPASLNAFDIISFSQGFDLSGLFEEKGDEARFVSSASVPKIISKLEEVGQMVRFNVRKKDCKVSLEGSREGAKGRLTIAAEVFELTPSLVVVEVKKKGGDKVEYDKFLNTELKPALHSLTKEESAGSSSQTTPDESLQQRAFSDSAIDKHSDSIESLNLDT

SEQ ID NO: 59191 - protein, 192 aa, Oryza sativa
DKLRAEVARDGYMEVLTFSLCSREENFDMLNRTQDVNKAVIIGNPRTYEFEVVGTSLMSCLLKTLKHNIVHPRPIKIFEVGDVVTLDGSRDVGASNNRQLAALYCNKQSGFEEIMGLVDRIVNVVRAPHIKFGQNYYVPTNEPEFFPKRQCKIVMSDGKQIGYLGIVHAEVLRKFGIPDPCTFVEIDVEALL

SEQ ID NO: 59192 - protein, 458 aa, Streptomyces coelicolor A3(2)
MRRTCVIGAGPSGLAASRVLASRGIPFDCYEAGSGIGGLWRYGNDNGMSGVYASLHANISKESMSFSSLPMPDSYPVFPHHTQVLAYLESYAETFGLHGHIGLRTEVTSVRPVEGGGWEVTRRSRGGAEAETDRYTEVVVANGHHWDPRLPDPAVPGAGVFEGSAVHAHAYRSPEPYAGQRVLVVGMGNSGCEIAAEISRSAARTFLSARAVAHVFPKMLLGRPADHWAVSRAAVLPRFLKDPGMALLLRLARGAPALYGLPEPVRRPLAAHPSTSDELLVQLARGAVTAKPGIRSFGRDSVSFTDGSRETVDAVVYATGYSLSFPFLAPAVFAAPDGRTELYLRTVPPRLPGLFFMGLAQPAGAAFPLLEPQAEWIADLIEGEVLLPTPAEMTRSIARARERHDKVYAPSYRHGIEIDICAYRRALRRELRAGRRRARRADARRPDAPRPAPVSDTV

SEQ ID NO: 59193 - protein, 587 aa, Glycine max
MDVHRRPIPSSGEHRQTQKLKTTTTTTTDSKSQSQALLPLYLTNALFFGVFFSVAYFLLHRWREKIRTATPLHAVSPAETAAIVSLVASAVYLLGFFGVASRASLDELSDDEIILKEDSRALGPCPAALADSSCLLPNKIQNQFPLSPKAIHSVTKEPQVDSPVPISSFSDEDEEIVQAVVSGSIPSYSLESRLGDTRRATAIRHEVVQRLTSRSLSGLPLEGFNYDSILGQCCEMPIGFVQIPVGVAGPLLLDGKEYTVPMATTEGCLVASTNRGCKAIHVSGGASSVLLRDGMTRAPVVRLPSAQRAAQLKFFLEDPLNFDSLAVVFNKSSRFARLQNIQCAIAGKNLYMRFRCSTGDAMGMNMVSKGVQNVLDFLQDDFPDMDVIGISGNFCSDKKAAAVNWIEGRGKSVVCEAIIKEDVVKKVLKTSVEALVELNMLKNLTGSAMAGALGGFNAHASNIVSAIYIATGQDPAQNVESSHCITMMEAINDGKDLHVSVTMPSIEVGTVGGGTQLASQSACLNLLGVKGANKESPGANSRLLATIVAGSVLAGELSLMSAIAAGQLVKSHMKYNRSSRDISTIVQ

SEQ ID NO: 59194 - protein, 447 aa, Schizosaccharomyces pombe
MSTPYEPEFQQAYKEIVGSIESSKLFEVHPELKRVLPIISIPERVLEFRVTWEDDKGNCRVNTGYRVQFNSALGPYKGGLRFHPSVNLSILKFLGFEQIFKNALTGLPMGGGKGGSDFDPKGKSDNEIRRFSQAFMRQLFRYIGPQTDVPAGDIGVTGFVVMHMFGEYKRLRNEYSGVVTGKHMLTGGSNIRPEATGYGVVYYVKHMIEHRTKGAETLKGKRVAISGSGNVAQYAALKCIQEGAIVKSISDSKGVLIAKTAEGLVPEEIHEIMALKEKRASIADSASLCKKHHYIAGARPWTNVGEIDIALPCATQNEVSGEEAAALIKQGCRYVAEGSNMGSSAEAVEVFEKSRASGEGCWLAPGKAANAGGVAVSGLEMAQNAQFSTWTHAEVDAKLAGIMQNIFEQSTDVASKYCDSGSNNIPSLVDGANIAGFLKVATAMQAV

SEQ ID NO: 59195 - protein, 311 aa, Yarrowia lipolytica CLIB122
MSLVKARYGKDNVRVLKVSRDPSNPKIQQVQELVVKCLLEGDIEVSYTKADNTPIVATDTVKNTTFIVAKQLPGTWPIELFGAVLADHFIKKYPHISSAHVDIEQYKWTKYDVNGKTSQHSFVHDGTELRTVHVDRYRDAAKNPETVTTFNIASGIKDLSVLKSTGSMFYGYHKDDFTTLKPTKDRILSTDVAATWHWISKEIDTLDKIKEIAKKGIFDSVYAQVVDTTLQRFATENSASVQATMYNMSTDILDKASLVETVDYELPNKHYFELDLSWHHRLKNTGTDAEVYVPQSNPNGLIKSSVGRSKL

SEQ ID NO: 59196 - protein, 748 aa, Shigella flexneri 2a str. 301
MLTRLREIVEKVASAPRLNEALNILVTDICLAMDTEVCSVYLADHDRRCYYLMATRGLKKPRGRTVTLAFDEGIVGLVGRLAEPINLADAQKHPSFKYIPSVKEERFRAFLGVPIIQRRQLLGVLVVQQRELRQYDESEESFLVTLATQMAAILSQSQLTALFGQYRQTRIRALPAAPGVAIAEGWQDATLPLMEQVYQASTLDPALERERLTGALEEAANEFRRYSKRFAAGAQKETAAIFDLYSHLLSDTRLRRELFAEVDKGSVAEWAVKTVIEKFAEQFAALSDNYLKERAGDLRALGQRLLFHLDDANQGPNAWPERFILVADELSATTLAELPQDRLVGVVVRDGAANSHAAIMVRALGIPTVMGADIQPSVLHRRTLIVDGYRGELLVDPEPVLLQEYQRLISEEIELSRLAEDDVNLPAQLKSGERIKVMLNAGLSPEHEEKLGSCIDGIGLYRTEIPFMLQSGFPSEEEQVAQYQGMLQMFNDKPVTLRTLDVGADKQLPYMPISEENPCLGWRGIRITLDQPEIFLIQVRAMLRANAATGNLNILLPMVTSLDEVDEARRLIERAGREVEEMIGYEIPKPRIGIMLEVPSMVFMLPHLAKRVDFISVGTNDLTQYILAVDRNNTRVANIYDSLHPAMLRALAMIAREAEIHGIDLRLCGEMAGDPMCVAILIGLGYRHLSMNGRSVARVKYLLRRIDFAEAENLAQRSLEAQLATEVRHQVAAFMERRGMGGLIRGGL

SEQ ID NO: 59197 - protein, 113 aa, Synechococcus sp. WH 8102
MADDTIFGKILRGDIPCDEVYSDDRCLAFRDIAPQAPVHVLVIPRQPIESLRSAGSGDEALLGHLLLVAARVARQEGLEDFRTVINSGAAAGQTVFHLHVHVIGGRPLDWPPG

SEQ ID NO: 59198 - protein, 213 aa, Erythrobacter sp. NAP1
MPEFAELLKGYRRFREDTYPRQKARFDETVAKGQHPKLMIIGCSDSRVDPAQIFDVDPGEIFVVRNVAALVPPFEQKPGLHGVSAAVEFAVQMLEVKQILVMGHGRCGGCKAALSGSYLEKEPGEGGFIANWIDLLSEARLPVERKHGTTGRKAELAMEFAAIRQSLANLRTFPWVADKEAVGEIKLRGAHFSIKEGVLYSLDEETGEFLPED

SEQ ID NO: 59199 - protein, 137 aa, Campylobacter lari RM2100
MEKTLSIIKPDAVKKGVIGQILTRFESNGLRIAATKKIQLSEKEAQEFYAVHKDRPFFKDLVEFMISGPVVVSVLEGKNAVLKNRELMGATNPKEAAAGTIRADFADSIDANAVHGSDSLENAKIEIEFFFSKTEIL

SEQ ID NO: 59200 - protein, 521 aa, Oryza sativa (japonica cultivar-group)
MLIMLGLGLVPAGAAAALAVALRRYYISPSRQSKRRASDSDQPILQRAEKMKAERNLDNQKTTGSLQDRAAQLQKCDEDIKLIKTACRIHETMVMQFFANYGKLSFIWFGPVPRVMIPDPELVREVFNKFDQFGKPKMIRVGKLLATGVVSYEGEKWAKHRRILNHAFHHEKIKRMLPVFANCCTEMVTRWENSISLEAASEIDVWPEFRNLTGDVISRTAFGSSYQEGRRIFQLQEELAQYLTEALQKLFIPGYWYLPTKNNRRMREIDREVRKILLEIIGNKERAITNGENSNDDMLGLLVESNTKQPELRMSTDDIIEECKLFYFAGMETTSVLLTWTLIVLSMHPEWQERAREEVLHHFGRTTTPDYDSLSRLKIVTMILYEVLRLYPPVVLLNRRTFKETNLGGIKFPADMNLILPILFIHHDPEIWGKDASEFNPGRFADGISNASKYHDASFFPFGWGPRICIGQSFALLEAKMALSMILQRFSLELSPSYIHAPYIVLTLRPQHGAQIKLKRI

SEQ ID NO: 59201 - protein, 400 aa, Glycine max
  misc_feature (326)..(326): Xaa can be any naturally occurring amino acid
PVRNPGSTHASAFLHSCNEVSLAVPSADQGQVDNSSSYTAAPPEVTGKKGGNGFNSIEIASITSASAIVSVLLALIVLFIYTRKWNPRSRVVGSMRKEVTVFTDIGVPLTFENVVRATGNFNASNCIGNGGFGATYKAEIVPGNLVAIKRLAVGRFQGVQQFHAEIKTLGRLRHPNLVTLIGYHASETEMFLIYNYLPGGNLEKFIQERSTRAVDWRILHKIALDIARALAYLHDQCVPRVLHRDVKPSNILLDDDYNAYLSDFGLARLLGTSETHATTGVAGTFGYVAPEYAMTCRVSDKADVYSYGVVLLELLSDKKALDPSFXSYGNGFNIVAWACMLLRQGQAKEFFAAGLWDTGPEDDLVEVLHLAVVCTVDSLSTRPSMKHVVRRLKQLQPPSC

SEQ ID NO: 59202 - protein, 398 aa, Wolbachia endosymbiont of Drosophila simulans
MNIPSIENCDLHNKAVLLRVDFNVPIKDGEIRDVTRILRALPTIQYLVNASAKIIIISHFGRPKARDNNLSLKNVIDTLSQLLNKKVKFIDDCVGEKVQKAVSAMDAGDIILLENLRFYEGEKENDANFARQLASLADIYVNDAFSCSHRAHASISRITEFLPSYAGFCLQDELKYLEKAVSFKAKPITAIVGGAKISTKIKVLMKLTEKVDYLVLGGAIANNFLSFSKVNIGKSFFQNGVDDLLHNIVETANKNNCKIVVPEDVLVAVNSDYSTSISRKTESILDGDIILDIGSQTLSTISSIIASSKTLLWNGPIGVFEHSAFASGTIGVMKIVSDLTHKGKLTSIIGGGDSLSAISAAGLTDKDFTYVSTGGGAFLDWLSGDEMPGVAALQKRLD

SEQ ID NO: 59203 - protein, 578 aa, Oryza sativa
AHEDQLSQRHSYIIGFECAEFTCTQHRILSLPVKVHCPLTVTRDSTPACYSFSRVLIMDPTSVPWSSMVYGLLGLALLWQVHRLLVRLWWQPRRLERALRAQGVRGTSYRFLTGDLKDYGRLSKEAWARPLPLRCHDIAPRVAPFVHRTIAEHGKACLSWFGPIPKVTIADAEIAKDVLSNKMGHFEKLKFPVLSKLLADGVANYEGEKWAKHRRILNPAFHLEKLKLMLPAFSACCEELVGRWAASLGSDGSNEIDVWPEMQSLTGDVISRTAFGSSYLEGRRIFQLQAEQQELFMGAIQKISIPGYMSLPTKNNRRMYQIKNEVESIIRDLVQKRMHAMKDGERTKDDLLGILLESSTRHADENGHSGPGMTIEEVMEECKVFYFAGMETTAILLTWTMVVLSMHPEWQHRAREEVLSLFQKNKLDYEGLSKLKTVTMILYEVLRLYPPGIGFVRQTYKEMEIGGVKYPAGVMIELPLLFIHHDPDIWGSDVNEFKPERFAEGISRASNDHGAFFPFGWGPRICMGQNFALLEAKMALCMILQRFEFELAPSYTHAPHIVLMLRPMHGAPIKLRAI

SEQ ID NO: 59204 - protein, 566 aa, Blastopirellula marina DSM 3645
MSTDQALSPVDEFKRDSNYLRGEIAQEFVDGSDHFGKSSIQLMKHFGVYQQDDRDARSANRAAGGGKSYIFMIRTRIPAGVLTSDQMLVELDLCDELGNETLRITSRQGLQHHGVMKEGLQPLAQKLKQVGLSTLGACGDVNRNVMCCPAPLFGDSVRREMQETASKLADHLAPRTGAYREIFLQDPETGEKEKIATGEVVEPLYGKQYLPRKFKMGMALPEDNCIDVYTHDLGMICVHENGQILGYNILVGGGQGRTPSADKTFPALGQRLTFVTTEQLIPVIEAIVKVQRDFGNREDRKVARMKYLIHNWGLEKFKAKVEEYYGSSLPEPHPADVHGFDDHKGWHAQGDGKWFYGLNVENGRIKDDETMQLKTAIRKICRQFNPGIRLTAHQDIIFSDINEADKEALIEILKSHQVPLTEDISNVRRWSMACVAWPTCGLSITESERALPGIIDGLEAELAKLGLAAEEFTVRMTGCPNGCARPYNSDVGLVGRAKEKYTLFLGGRLLGNRLSFIYKDMVPAGDVTPELTKVFAFFKAAREEGESFGDFCHRQGKEAIEAAVGQ

SEQ ID NO: 59205 - protein, 131 aa, Hordeum vulgare subsp. spontaneum
HGHATDKVEEYGQPVAGHGGFTDGPTGTHGAAGVGGAQLQATRDGHKTDGVLRRSGSSSSSSDDGVGGRRKKGMKEKIKEKLPGGAHKDAAGQQQQTAMAGEYAGTHGTEATGEKKGVMDKIKEKLPGGQH

SEQ ID NO: 59206 - protein, 131 aa, Hordeum vulgare subsp. spontaneum
HGHATDKVEEYGQPVAGHGGFTGGPTGTHGAAGVGGTQLQATRDDHKTDGVLRRSGSSSSSSDDGVGGRRKKGMKEKIKEKLPGGAHKDAAGQQQQTAMAGEYAGTHGTEATGEKKGVMDKIKEKLPGGQH

SEQ ID NO: 59207 - protein, 799 aa, Sulfolobus solfataricus P2
MGSFLLVEAISSEEDLILDVSQVTKDMVQLAGGKGANLGELTSIGVRVPPAFILTSKAFKYFLEYNNLFDKIRDTLSSSETSEEASEKIKQLIKNAKMPDKLSSMIYQAYDELSKKVGKEILVAVRSSATAEDIETASFAGQQDTYLNVTKDELIDRIKDVWASLYNARAMEYRKSKGIDDLSILIAVVVQKMVNSRSAGVMFTLHPVTGDEKYIMIESNWGLGESVVGGKVTPDEVLIEKSTLRIVEKKVSNKNIKIVYDKQLKKNVTITLDEKESRLMSITDEEAIELAKLALKIEEHYKRPMDIEWAIDNDLSFPENIFIVQARPETFWSSKRKENKNIAEKSAPIGGKVLVRGLAASPGIAFGKAKIILDIKDPKVHEFQKGEILVTKMTDPDWVPLMKIAGAIITDEGGMTSHAAIVSRELGIPAIVGSREATKIIRDNQEITVDAIRGIVYEGKVLQTSETVSQQAQPSIGIQGISREVLLSLYPVTATKIYMNLGEPDVIDKYLDLPFDGIGLMRIEFIVSEWVRYHPLYLIKIGNAELFVDKLAEGIAKVASAIYPRPVVVRFSDFKTNEYKKLIGGEEFEPDERNPMIGWRGVSRYVSKEYEPAFRLEAKAIRKVREEMGLKNVWVMFPFVRTTWELEKAIKIMEEEGLRRDSDFKVWIMAEVPSVVVLAEEFAKIVDGFSVGSNDLAQLTLGVDRDSELLARMGYYDERDPAVLESIRKLIKAAHKYGKTVSICGQAPSVYPAVVEYLVKAGIDSISVNPDAVINVRRQVASIEQQIILRNLNGKRKNK

SEQ ID NO: 59208 - protein, 310 aa, Streptococcus pyogenes MGAS10394
MNWLITSQPYKELNMKAATYLSTGNLQLIDKPKPVIIKPTDAIVQVVKTTICGTDLHILGGDVPACKEGTILGHEGIGIVKEVGDAVTNFKIGDKVIISCVTSCHTCYYCKRGLSSHCEDGGWILGHLINGTQAEYVHIPHADGSLYHAPDTIDDEALVMLSDILPTSYEIGVLPSHVKPGDNVCIVGAGPVGLAALLTVQFFSPANIIMVDLSQNRLEAAKTFGATHTICSGSSEEVKAIIDDITNGRGVDISMECVGYPATFDICQKIISVGGHIANVGVHGKPVDFNLDELWIKNITLNTPIQLKCY

SEQ ID NO: 59209 - protein, 219 aa, Burkholderia vietnamiensis G4
MQDIIDGFLRFQRDIFPQREALFKQLATSQSPKALFVTCSDSRVVPELLTQREPGELFVIRNAGNIVPSYGPEPGGVSATVEYAVAVLGVRDIVICGHSDCGAMGAISRCTCLDHLPAVANWLRHADAAKVINAAHEYDTPRAKLDGLVRENVIAQLANLRTHPSVALALEQGRMNLHGWVYDIESGGIDALDGATRRFVPLAESPSVVAVNARDRGQA

SEQ ID NO: 59210 - protein, 420 aa, Shigella flexneri 2a str. 301
MPHSLFSTDTDLTAENLLRLPAEFGCPVWVYDAQIIRRQIAALKQFEVVRFAQKACSNIHILRLMREQGVKVDSVSLGEIERALAAGYNPQTHPDDIVFTADVIDQATLERVSELQIPVNAGSVDTLDQLGQVSPGHRVWLRVNPGFGHGHSQKTNTGGENSKHGIWYTDLPAALDVIQRHHLQLVGIHMHIGSGVDYAHLEQVCGAMVRQVIEFGQDLQAISAGGGLSIPYQQGEEAVDTEHYYGLWNAAREQIARHLGHPVKLEIEPGRFLVAQSGVLITQVRSVKQMGSRHFVLVDAGFNDLMRPAMYGSYHHISALAADGRSLEHAPTVETVVAGPLCESGDVFTQQEGGNVETRALPEVKAGDYLVLHDTGAYGASMSSNYNSRPLLPEVLFDNGQARLIRRRQTIEELLALELL

SEQ ID NO: 59211 - protein, 468 aa, Parvularcula bermudensis HTCC2503
MAVKDVLKKIKDEDIQYVDLRFTDPKGKWQHVTFDKSMVDEELFEDGTMFDGSSIAGWKAINESDMILMPDAETAIVDPFFAQPTLSIICDILEPSTGQPYSRDPRTTAKAAEAYLKSSGIGDTAYFGPEAEFFIFEDVRISTEQNNMGFSLDSTEGPYNMAREYEGGNLGHRPRAKGGYFPVPPVDSEQDLRSEMLSYMSQMGLEPEKHHHEVAPSQHELGMKFSTLLKMADNMQIYKYVVHQVAHAFGKTATFMPKPVFGDNGSGMHVHQSIWNAGKPVFAGDRYADLSETCLHYIGGIIKHARAINAFSNASTNSYKRLVPGFEAPIMLAYSARNRSASVRIPWVSSPKGKRIETRFPDAAGNPYLTFAALLMAGLDGIENRIDPGDAMDKDLYDLSPEEQQGIPTVCASLEEAMAALDADRDFLRKGNVFSDDQIDAYIELKMEEIVRYNTTPHPVEFDMYYSV

SEQ ID NO: 59212 - protein, 151 aa, Yarrowia lipolytica CLIB122
MSARTERIDFNEGLNTLQLVPATASVGRRGKGAGFYCEVCNLTYKDSIQWIDHLNSKQHLYEIGETDGPRQSTLEDVQKRLKWLTERKRAQEKELDYDINARISARKQLIERQKKKKKDRKRQKREEKVEEGADDEMMAAMGFGGFGSTKK

SEQ ID NO: 59213 - protein, 176 aa, Triticum aestivum
  misc_feature (85)..(85): Xaa can be any naturally occurring amino acid
MAAAGDAGEKKMITLKSSDGEEFEVEEAVAMESQTIRHMIEDDCADNGIPLPNVNSKILSKVIEYCNKHVQAKPADGAAAGAGAXSLGTPPPPPPPRDLKNWDAEFVKVDQATLFDLILAANYLNIKGLLDLTCQTVADMIKGKTPEEIRKTFNIKNDFTPEEEEEIRRENQWAFE

SEQ ID NO: 59214 - protein, 379 aa, Zea mays
  misc_feature (173)..(173): Xaa can be any naturally occurring amino acid
MEAGGAGSGLNGAVQAKGTGADDGSAKRLPPCCVKARAAAPESEARCHATVVSGWFTEPRSRCGKASKVQYYNNPMWPGEANSLKVEKILYQGKSLYQEVLVFESSTYGKVLVLDGIVQLTDKDECAYQEMITHLPLCSIPSPKKVLVIGGGDGGVLREVSRHSSVESIDICXCKDFFPHLSVGFQDPRVQLHVGDAVEFLRNAPEGTYDAIIVDSSDPIGPAQELVEKPFFDTIARALRPGGVLCNQAESMWLHTHLIQDMLSICRETFKGSVRYAWTSVPTYPSGVIGFLLCAKEGPLVNFLTPINPIEKLEGATKAGREIRFYNSEMHRAAFVLPTFARRELEAYCVSTETEQAEETPAAPLKLTLASRSEIFATS

SEQ ID NO: 59215 - protein, 353 aa, Nicotiana sylvestris
MEVISTNTNGSTIFKSGAIPMNGHQNGTSKHQNGHKNGTSEEQNGTISHDNGNELLGNSNCIKPGWFSEFSALWPGEAFSLKVEKLLFQGKSDYQDVMLFESATYGKVLTLDGAIQHTENGGFPYTEMIVHLPLGSIPNPKKVLIIGGGIGFTLFEMLRYPTIEKIDIVEIDDVVVDVSRKFFPYLAANFNDPRVTLVLGDGAAFVKAAQAEYYDAIIVDSSDPIGPAKDLFERPFFEAVAKALRPGGVVCTQAESIWLHMHIIKQIIANCRQVFKGSVNYAWTTVPTYPTGVIGYMLCSTEGPEIDFKNPVNPIDKETAQVKSKLAPLKFYNSDIHKAAFILPSFARSMIES

SEQ ID NO: 59216 - protein, 451 aa, Erythrobacter sp. NAP1
MAIELKMPALSPTMEEGTLAKWLKSEGDTIEPGDIIAEIETDKATMEFEAIDEGVLAKILVAEGTENVAVGTVIAEMEGEGEEASPAPAPAAKEEPAPAPTPPPVATKPEVKATPSDPEIPEGTSFTSTTVREALRDAMAEEMRADKRVFVMGEEVAEYQGAYKVTQGLLDEFGPKRVIDTPITEYGFAGIGSGAAMGGLKPIVEFMTFNFAMQAIDHIVNSAAKTNYMSGGQMRCPIVFRGPNGAASRVAAQHSQNYGPWYASVPGLIVIAPYDSSDAKGLMKAAIRSEDPVVFLENELVYGRSFEVPDLDDHVLPIGKARIVREGKDATIVTYSIGVGLALEAAEELAGQGIDAEVIDLRTLRPLDKETVLKSLAKTNRLVVAEEGWPTCSIASEIISICMEEGFDDLDAPVLRVCNEDVPLPYAANLEKLALIDAPRIVEAVKKVCYV

SEQ ID NO: 59217 - protein, 319 aa, Nicotiana sylvestris
MEVISTNTNGSTIFKNGAIPMNGYQNGTSKHQNGHQNGTSEHRNGHQNGISEHQNGHQNGTSEHQNGHQNGTISHDNGNELQLLGSSNSIKPGWFSEFSALWPGEAFSLKVEKLLFQGKSDYQDVMLFESATYGKVLTLDGAIQHTENGGFPYTEMIVHLPLGSIPNPKKVLIIGGGIGFTLFEMLRYPTIEKIDIVEIDDVVVDVSRKFFPYLAANFSDPRVTLVLGDGAAFVKAAQAGYYDAIIVDSSDPIGPAKDLFERPFFEAVAKALRPGGVVCTQAESIWLHMHIIKQIIANCRQVFKGSVNYAWTTVPTYPT

SEQ ID NO: 59218 - protein, 2145 aa, Podospora anserina
MPRNDASSRFSSMTGSSTDSARSNITVKPLPSLPPSASSSSPFAASSNQTSNASRSASHGSRRAAPSRLKTDENGQLSRSFKDSDAQVSPTSTSPCVSPSSITSSNSIREHRMSDLADYRRDLAILDPAGGRASRTQQNNPSSGSLSQIAPWMAAAPTPASSGPLPTSFFNDSTDNLSLSSQTSPGLRNATARPSQTTTGSTESPETLYFTDERRPSIASITTTASSQGSRASGARGGIRKLQGFFGEEFPGRDSSEISLSHPIVGKEHRSHSYSHARPHRDRNYSNATDHGRDASPASRPRTPVPKPEVVPFLYQEADDIARYGEAPVRDILSGPDRERFVNDSSQQNNPPKTSGSGRSGHSIGVHLTGHHHRHNKSNEDPRSLRPTVSREDSTISVPKDRNGSSTMYGTRSRAQSPAPSTTGSYWGHKSGSTDGQTSPGQPKKSFLGRLGRRLKEKDDAPDLKKLGPASQSSLHSRPSRQELSKADGQFARGADGKYQPDVRDGIRPDLARPANGPQTFNKFSLSKKAPRSKTQDDLDEAIGPTDRQDVGTVFHLDTNLNNMDGILSKPAPLTPMNAHEIFDEVGSGKGSISYPSSNGAWNAPDSWAVLRDDDAGAQLPDTEDIGSPPRPEEKQHNYCIRVFRADGTFATLQMPLLTSVSELINQIVKKSYLQDPDKFKLVLKKHDLYKVLQSTDRPLLLQKRLLEQVGFEERDRIEDIGREDNSYLCRFLFYPFTDNSYEVMDQMEFLRSQKNNHIDLSGRSLSAIPVQLYPRANEIISLNLSRNLSLQVPRDFISVCPNLRDIKFNNNEARALPKSFGYASRLTMLDASNNRLESLESAALHNLTGLLKLNLANNKLKQLPREFEAFAVLRTLNISSNLLNNFPPFLAKLENLVDLDLSFNTIQSLPDNVGQMTSLERLVITNNELSGSLPPSFKNLRSLRELDIKYNAISNIDVISQLPKLEILSATRNNISQFSGTFERVRSIKLNWNPITKFEIKAPVPTLKALNLSNAQLASIDESFHNMSNLERLELDKNYFVSLPAHIGNLRRLEYFSIAHNSVGELPPEIGCLTELKRLDVRGNNIRKLPMELWWANKLDYLNASSNVLENFPKPASRAPHPPGETNGNTSFPTGRIGPPTGALSQTPSAEELNDPSRRPSQASSSLLSVGPSPVPGGADRKSSMVSVYGKGGRKTSVISRSTTQSSTALATPTASSRKDSSHTQRLTNTFAGSLRYLYMADNQLDDDCFDQLCMLENLRVLNLSYNDLSDMPQRSIKSWPQLVELYLSGNELASLPADDLEEYSMLQTLHINGNKFTNLPADISRAKKLTVFDCGSNSLKYNIANVPYDWNWNLNPNLRYLNLSGNRRLEIKQSSVPTAAQNREQYTDFGRLTNLRVLGLMDVTVLNSTLPDQSEDRRVRTSGSLAGYMPYGMADTLGSKNEHLSTIDLVVPRFNSNDSETLLGLFDGQALSSGGSKIAKYLQENFGHIFSQELRDLKNTENPADALRRSFLSLNKDLIAAGNTHTEDRSLMVHRGSTAPLVLSREDMNSGGVATIVYIQNQDLYVANVGDVQAMIIKSDSTHVMLTKKHDPADPNERTRIREAGGWVSRNGRLNDLLEVSRAFGYLDLMPAVQSAPNIEKHTIGEHDEMILIATREVWEYLPKDVLVDVTRSVRQDPDPMRAAQKVRDLAMAYGCSNKMTVQMLGVSNLKARRERSRQHKGQSMPVYASLQDDGGSSTGMRRARKARDGPLDSTLGRLDAEVPAPTGLIAIVFTDIKNSTQLWETYPEAMRTAIKNHNELMRRQLRTIGGFEVKTEGDAFMVSFPTATSALLWCFAVQCKLLHLDWPAELYNSVNCQPVYDRDNNLIFKGLSVRMGIHWGEPLSEPDPVTRRMDYYGPMVNKASRISACADGGQIAVSSDFIAEIQRCLEHYQEPTSTAVDLNEDSFATAIRSELRSLSGQGFEVKDMGEKKLKGLENPEFIYSLYPHALSGRIETHSKHEKEQAQDLREIRPAILSPGSELSVEPDDIWSLWRVALRLEMLCSMLEDNSKALQPPETGLLDRMRQRGGEVSEDFLVNFLDHQVSRIETCINTIYMRHLVSQSSIGSNFGALRGPMDEVLKVVAEQFQLVAEYKARYGDLRA

SEQ ID NO: 59219 - protein, 397 aa, Desulfovibrio vulgaris subsp. vulgaris str. Hildenborough
MSQSQFPRMHRLPPYVFAVVNELKMQLRRQGVDIVDLGMGNPDMPTPQHIVDKMVEASMKGNNHRYSVSRGIPNLRKAICDWYTRRFGVYLDPDTEAVVTMGAKEGLSHLSLAMLSPGDVVFAPDPTYPIHTYAPVIAGADVRRIPIGRGRDFFEDLLVATRQTWPQPKLLFLSYPHNPTTELATPEFFQKVVDFAKEHKIYVIHDFAYADLAFDGHMPPSFMQADGAKDVGVEFFSMSKSYSMAGWRVGFCVGNREMVNTLTRIKSYLDYGIFQPIQIAATVALNGPQECMTEIVDTYRKRRDVLIEGLNRSGWEVPAPKGTMFVWAQIPEPFRAMGSVEFSKLLLREAHVAVSPGLGFGAHGDDHVRFALIENEQRTKQALRGIRHLLSGKPCGE

SEQ ID NO: 59220 - protein, 430 aa, Nicotiana sylvestris
MEVISTNTNGSTIFKNGAIPMNGHQSGTSKHLNGYQNGTSKHQNGHHNGTSEHRNGHQNGISEHQNGHQNGTSEHRNGHQNGTSEHRNGHQNGISEHQNGHQNGTSEHQNGHQNGTSEQQNGTISHDNGNELLGNSNSIKLGWFSEFSALWPGEAFSLKVEKLLFQGKSDYQDVMLFESATYGKVLTLDGAIQHTENGGFPYTEMIVHLPLGSIPNPKKVLIIGGGIGFTLFEMLRYPTIEKIDIVEIDDVVVDVSRKFFPYLAANFNDPRVTLVLGDGAAFVKAAQAGYYDAIIVDSSDPIGPAKDLFERPFFEAVAKALRPGGVVCTQAESIWLHMHIIKQIIANCRQVFKGSVNYAWTTVPTYPTGVIGYMLCSTEGPEVDFKNPINPIDKETTQVKSKLAPLKFYNSDIHKAAFILPSFARSMIES

SEQ ID NO: 59221 - protein, 142 aa, Triticum aestivum
MYPQSLPQNIVKALVPQTSSQALPLLSKRTHPSELGGSAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 59222 - protein, 131 aa, Hordeum vulgare subsp. spontaneum
HGHATDKVEEYGQPVAGHGGFTGGPTGTHGAAGVGGAQLQATRDGHKTDGVLRRSGSSSSSSDDGVGGRRKKGMKEKIKEKLPGGAHKDAAGQQQQTAMAGEYAGTHGTEATGEKKGVMDKIKEKLPGGQH

SEQ ID NO: 59223 - protein, 612 aa, Glycine max
MSSSFSVRFLAPPSSCFPSSRPKTWLCAATTPTVAPATASSEVEASRLEPRVEERDGFWVLKEEYRGGISPQEKVKLEKDPMKLFMEGGIEDLAKMSLEEIESSKHTKDDIDVRLKWLGLFHRRKQHYGRFMMRLKLPNGVTTSAQTRYLASVIRKYGKDGCADVTTRQNWQIRGVVLPDVPEILKGLDEVGLTSLQSGMDNVRNPVGNPLAGIDPDEIVDTRPYNNLLSQFITANSRGNPAMSNLPRKWNVCVVGSHDLFEHPHINDLAYMPANKDGRFGFNLLVGGFFSAKRCAEAIPLDAWVSADDVIPLCKAVLEAYRDLGFRGNRQKTRMMWLIDELHGLFPLSLSVSAWQVSDKSVWQMKGIEVFRSEVEKRMPGKQLERASEEELVKKKWERRDYLGVHPQKQDGLSYVGIHIPVGRVQADDMDELARLVDKYGTGELRLTVEQNIIIPNVDSNKIDALLNEPLLKERFSPEPSLLMKTLVACTGNQFCGQAIIETKERALKVTEEVERQVAVTRPVRMHWTGCPNTCGQVQVADIGFMGCMARDENGKATEGVDIFLGGRIGSDSHLAEVYKKGVPCKNLVPIVVDILVKHFGAVQRNREEGED

SEQ ID NO: 59224 - protein, 212 aa, Schizosaccharomyces pombe
LKYPVEQSGLYCVFTAPLEGSSEAYKITVTWENYFGNLDATDYPHLFLNPILLAINCLIGIWWSFIMFRYRHDLLQVQKYISGVVALSIVCTMVSTGYFYFANSKGYTTGSKVFAFFLSLAQSARQSYFGFLLLIVSLGYSIVVPSLGSLLRKCQILAGLQFVSSCFFLSSLFISPSNKESLVILFAAPVFLITLFAMFLWIVLALNNTIRD

SEQ ID NO: 59225 - protein, 522 aa, Streptococcus pyogenes MGAS10394
MVTVYLKEREDNMENHKNEFTFSNKSIIAYVWRGVMVGIIAGVIVSLFRLLIEVTADWVIEWYRYAHINSLLLLPILSVSLLAVLFVGFLVKSDSDIKGSGIPHVEGELKGLMSPDWWSVLWKKFLGGIMAISMGFMLGREGPSIQLGAMSAKGLAKFLKSSRLEKRVLIASGAAAGLSAAFNAPIAGLLFVVEEIYHHFSRLIWITALVASLVANFISLNIFGLKPVLAMSEAMPFLGLNQYWLLLLLGLFLGCLGYLYEIVILNFNKLYVILGSWLHLPAYFYGIIMVFLILPIGYYLPQLLGGGHGLILSLSNQQLPLMTIFFYFIIRFIVSMFSYGSGLPGGIFLPILTLGALAGLLFGQIASQLGLLNQSFLSLFLILGMAGYFAAISKAPLTGMILVTEMVGDLKPLMAIAVVTFVSYLVMDLLNGQPIYEAMLDKMAMKHPTNLVEPTLIELTVGDKIAGKYVKELKLPENVLITTQIHHQKSQVVSGNTRLLSGATIFLVVNEADTGFVREVLM

SEQ ID NO: 59226 - protein, 402 aa, Sulfolobus solfataricus P2
MVSLLDFNGNMSQVTGETTLLYKEIARNVEKTKKIKIIDFGIGQPDLPTFKRIRDAAKEALDQGFTFYTSAFGIDELREKIAQYLNTRYGTDVKKEEVIVTPGAKPALFLVFILYINPSDEVILPDPSFYSYAEVVKLLGGKPIYANLKWSREEGFSIDVDDLQSKISKRTKMIVFNNPHNPTGTLFSPNDVKKIVDISRDNKIILLSDEIYDNFVYEGKMRSTLEDSDWRDFLIYVNGFSKTFSMTGWRLGYIVAKREIIQKMGILAANVYTAPTSFVQKAAVKAFDTFDEVNQMVSLFKKRRDVMYDELTKVKGVEVSKPNGAFYMFPNVSKILKTSGFDVKSLAIKLIEEKGVVTIPGEVFPLNIGKEFLRLSFAVNEEVIKEGIQKIREFAEQMMNSR

SEQ ID NO: 59227 - protein, 109 aa, Nicotiana tabacum
MSFSTLSLTGSLISGPFEEGIFLVNISPARMDFRSFLVDNFIAILSSLVTPAQATAVMDLIEERWEEWIGEMPLKITYPALEGHEWRIVTGFDPKNTGRSYLIGESWPG

SEQ ID NO: 59228 - protein, 194 aa, Oryza sativa (japonica cultivar-group)
MAAKRGSESDGDELGGGGAAEGTSPNDGGASPPPLAAAPAVCFIRSAGDFAGGAFIGSIVGYGQGLFTKKGFKGSFSTAGSSAKSLVVCLLRRLRGKDDIVNAGIAGCCTGLALSFPGTPQALLQSCATFAAFSCIMEGLNKQQAAMAQTLGGSALTVSHQNGGVLPPFTLPPLLDASDALSSCCQPLVLKPKH

SEQ ID NO: 59229 - protein, 640 aa, Medicago truncatula
MPLNFLLLLFFLFLSHQPFSSASEPRNPEVVALMSIKEALNDPHNVLSNWDEFSVDPCSWAMITCSSDSFVIGLGAPSQSLSGTLSSSIANLTNLKQVLLQNNNISGKIPPELGNLPKLQTLDLSNNRFSGFIPSSLNQLNSLQYMRLNNNSLSGPFPVSLSNITQLAFLDLSFNNLTGPLPKFPARSFNIVGNPLICVSTSIEGCSGSVTLMPVPFSQAILQGKHKSKKLAIALGVSFSCVSLIVLFLGLFWYRKKRQHGAILYIGDYKEEAVVSLGNLKHFGFRELQHATDSFSSKNILGAGGFGNVYRGKLGDGTLVAVKRLKDVNGSAGELQFQTELEMISLAVHRNLLRLIGYCATPNDKILVYPYMSNGSVASRLRGKPALDWNTRKRIAIGAARGLLYLHEQCDPKIIHRDVKAANVLLDDDYEAIVGDFGLAKLLDHADSHVTTAVRGTVGHIAPEYLSTGQSSEKTDVFGFGILLLELITGMTALEFGKTLNQKGAMLEWVKKIQQEKKVEVLVDKELGSNYDRIEVGEMLQVALLCTQYMTAHRPKMSEVVRMLEGDGLAEKWASTHNYGSNCWSHSHSNNSSSNSSSRPTTTSKHDENFHDRSSMFGMTMDDDDDQSLDSYAMELSGPR

SEQ ID NO: 59230 - protein, 62 aa, Nicotiana sylvestris
GVIGYMLCSTEGPEVDFKNPINPIDKETTQVKSKLAPLKFYNSDIHKAAFILPSFARSMIES

SEQ ID NO: 59231 - protein, 168 aa, Glycine max
  misc_feature (89)..(89): Xaa can be any naturally occurring amino acid
  misc_feature (140)..(140): Xaa can be any naturally occurring amino acid
YQEGGGNSTQAPIPSLVIRLPPDLPKLASPSDPGMKENIESFTFADDISSMIADRRFLPQFRPEIMPLLSSIRRKINILGTILDSLKSXFGQFLQRTMRVNEMRKLQHMLSILKCKFQHMGKIFHMFNFPNREDLLGQSXMPHDMCRISGLDNQGIVGPQRKIPKNGI

SEQ ID NO: 59232 - protein, 454 aa, Actinobacillus pleuropneumoniae serovar 1 str. 4074
MTIKTPVQAVLASNQYFLDRQDAMESNVRSYPRKLPFAYQKAQGVWVTDVEGNEYLDFLAGAGTLALGHNHPVLMQSIKDVLDSGLPLHTLDLTTPLKDAFTEELLSFFPKDQYILQFTGPSGADANEAAIKLAKTYTGRGNVIAFSGGFHGMTHGALSLTGNLSAKNAVQNLMAGVQFMPYPHEYRCPFGIGGEVGAKAVEHYFENFIEDVESGVVKPAAVILEAIQGEGGVVPAPISFLQKVREVTQKHGILMIVDEVQAGFCRSGKMFAFEHAGIEPDVVVMSKAVGGSLPLAVLAIRKEFDAWQPAGHTGTFRGNQLAMATGYASLKIMREENLAQNAQERGEYLTNALRELSKEFPCIGNVRGRGLMMGIDIVDERKPQDATGAYPQDGELAVAIQKACFNNKLLLERGGRGGNVVRVLCAVNINQAECEEFIKRFKQSVADALKAVRG

SEQ ID NO: 59233 - protein, 667 aa, Arabidopsis thaliana
MKQRSLFSVLCFFFISFGVASVSAQTCTTDKGTFRPNGTYDVNRRLILSSLPSNVTDQDGLYYNGSIGQQPNRVYAIGMCIPGSTSEDCSDCIKKESEFFLKNCPNQTEAYSWPGEPTLCYVRYSNTSFSGSADLNPRNWLTNTGDLDSNLTEFTKIWEGLMGRMISAASTAKSTPSSSDNHYSADSAVLTPLLNIYALMQCTPDLSSGDCENCLRQSAIDYQSCCSQKRGGVVMRPSCFLRWDLYTYSNAFDNLTVASPPPEPPVTVPQPAGDQDNPTNNDSKGISAGVVVAITVPTVIAILILLVLGFVLFRRRKSYQRTKTESESDISTTDSLVYDFKTIEAATNKFSTSNKLGEGGFGAVYKGKLSNGTDVAVKRLSKKSGQGTREFRNEAVLVTKLQHRNLVRLLGFCLEREEQILIYEFVHNKSLDYFLFDPEKQSQLDWTRRYKIIGGIARGILYLHQDSRLKIIHRDLKASNILLDADMNPKIADFGLATIFGVEQTQGNTNRIAGTYAYMSPEYAMHGQYSMKSDIYSFGVLVLEIISGKKNSGVYQMDETSTAGNLVTYASRLWRNKSPLELVDPTFGRNYQSNEVTRCIHIALLCVQENPEDRPMLSTIILMLTSNTITLPVPRLPGFFPRSRQLKLVSEGSESDQYTSKSSSFSS

SEQ ID NO: 59234 - protein, 349 aa, Actinobacillus pleuropneumoniae serovar 1 str. 4074
MMKMRAAVVAPQCDGTVEIVERDIPEIKNGEALVEVEYCGVCHTDLHVAAGDYGKKPGRILGHEGIGIVKSIAPDVTNLKVGDRVSIAWMFESCGSCEYCTTGRETLCRSVKNAGYTVDGGMATHCVVTADYAVKVPDGLDPAQASSITCAGVTTYKGIKVSGVRAGQWIAIYGAGGLGNLAVQYAKKVFGARVIAIDINDDKLAFAKEVGADLTINPLKEDSVQVIQEKVGGAHAAVVTAVSKVAFNAAVNCVRAGGRVVAIGLPPETMDLSIPRIVLDGIEIVGSLVGTRQDLAEAFQFGAEGLVVPLVQLRRLDEANDIFQEMRDGKIQGRMVIDMKKGCGCGCSH

SEQ ID NO: 59235 - protein, 131 aa, Hordeum vulgare subsp. spontaneum
HGHATDKVEEYGQPVAGHGGFTDGPTGTHGAAGVGGAQLQATRDGHKTDGVLRRSGSSSSSEDDGVGGRRKKGMKEKIKEKLPGGAHKDAAGQQQQTAMAGEYAGTHGTEATGEKKGVMDKIKEKLPGGQH

SEQ ID NO: 59236 - protein, 197 aa, Wolbachia endosymbiont of Drosophila simulans
MAKQITSNCNFIFGASDIKSLPNESAPEIAFAGRSNVGKSSLINLLINSKKAARVSSKPGCTRQINFYSMYNDKFRLVDLPGYGYSHAGKEEIIQYLNLIEYYLIQRRNLRRVFVLIDSKVGLKEIDKDFIYWLICNNINFNVVLTKIDKVSQKSLGAVIEDIQRWINNENVSIHQMSIRVKHKITKVRDEFFKFTR

SEQ ID NO: 59237 - protein, 579 aa, Coprinopsis cinerea okayama7#130
MAGSLDSVAQQIFRLLDDVTDGQLKSSLSTPSNSTEPAILPIPTSFSITSILTLLLSFSALRNYIKFAFLGTILETARRWAFYYWYKISNAFFINVHLEDDDEPYDWMMVWLSRQPEWRSAKHIEVTTDDWGLDTNASHIEGEEDDPTDALHRTSGLNFIPTISTPTTLWYKGRYWMYVSRQIREAKGPYDSATKILDLRIMAWDSRKVLNDLLREAKKLYKESQENNVCIYTADLSNYWKLLACRPKRPLDSIVLDPGVKTLILDDALDFMLSKNWYIKRGIPFRRGYLLHGPPGTGKTSIIHALAGELGLNVYIISLSRCGMDDNTLGDIISRLPERCIALMEDIDAAFSRTLNRDGGSDSGSDDGEKSTPTSRVSLSGLLNALDGVGAQEGRILFATTNKYGTLDPALTRPGRMDVHVEFKLASRLQAKELYKRFYLPDEEATRISEEGLIKGSEADSPEVDGKTLPIGGDEKTGASEEPLPIAPHKRRAPKLSLEQVEGLSTEFASFIPERELSMASIQGYLMIYKTRPFEAVKDAPEWVVKERKAAALREESEKRRKDNEPEAKDSTEKGSDES

SEQ ID NO: 59238 - protein, 232 aa, Dechloromonas aromatica RCB
MRSKPFRSITMTQDELKQAVAQAAADYVAQTAPAGSIIGVGTGSTANFFIDALAPLKDKYKGAVASSEATRKRLEGHGIAVYDLNDVEDIPVYVDGADEIDAGLNMIKGGGGALTREKIVAAVAREFVCICDGSKLVDTMGKFPLPVEVIPMARAHVARELAKLGGTPVLREGFVTDNGNIILDVKGLSITDPKGLEAQINQITGVVTNGLFAVRPANLLLLGTADGVRTIR

SEQ ID NO: 59239 - protein, 116 aa, Arabidopsis thaliana
MASLNSDVIMGESSSISVPSSSSKNSKRFELKKWSAVALWAWDIVVDNCAICRNHIMDLCIECLANQASATSEECTVAWGVCNHAFHFHCISRWLKTRQVCPLDVCEWEFQKYGHG

SEQ ID NO: 59240 - protein, 173 aa, Medicago truncatula
MANQGAKKRKEENSRHITKLRHIIIACNVIYLIIRMLIFHSSFTWKHWIGLVLTSLAYYFPYQQLAKMAKPSYTQDGELLDGGFDMTTGGVCGYLHDVIYITCFVQVASIISGKFWYIYLVIPAFGAYQSFGLIKGFLPQGSEESVEDEKTRKKREKMEKKASRPKFVKTRTR

SEQ ID NO: 59241 - protein, 274 aa, Mycobacterium sp. JLS
MGRPPLNKDTRLCISLAGRPSNIGTRFHNHLYEVLGLDFLYKAFTTTDIGAAIGGVRALGIRGCSVSMPFKQDVLDLVDEVEPSARIINAVNTIVNDDGHLTASNTDYLAVQRLIDQYGLEADRSVMVLGSGGMASAVGAAFRDRGFATGTVVARNEPTGRALAERLGYDYAAEVGSRSAEVIVNVTPIGMAGGPEERQQAFDADTIAQAHTVFDVVATPAETPLITAARQAGVAVITGAEVVALQAAEQFERYTGVRPTPEQVAEASAISRRD

SEQ ID NO: 59242 - protein, 264 aa, Solanum tuberosum
MAELREKWSLKGTTALVTGGSKGIGYAIVEELANFGARVYTCSRNENELQECLDIWRKKGLKVEGSVCDLLSRTEREKLMKTVEDVFDGKLNILVNNAGVAIHKEAKDFTKEDYNIIMGTNFEAAYHLSQIAYPLLKASQNGNVIFVSSIAGFSALPSLSLYSASKGAINQMTKNLACEWAKDNIRVNSVAPAVILTPLVETAIKKNPQQKEEIDSFVVKTPLGRAGKPEEASAVIAFLCFPAASYITGQIIWADGGFTANGGF

SEQ ID NO: 59243 - protein, 534 aa, Parachlorella kessleri
MAGGGVVVVSGRGLSTGDYRGGLTVYVVMVAFMAACGGLLLGYDNGVTGGVVSLEAFEKKFFPDVWAKKQEVHEDSPYCTYDNAKLQLFVSSLFLAGLVSCLFASWITRNWGRKVTMGIGGAFFVAGGLVNAFAQDMAMLIVGRVLLGFGVGLGSQVVPQYLSEVAPFSHRGMLNIGYQLFVTIGILIAGLVNYAVRDWENGWRLSLGPAAAPGAILFLGSLVLPESPNFLVEKGKTEKGREVLQKLCGTSEVDAEFADIVAAVEIARPITMRQSWASLFTRRYMPQLLTSFVIQFFQQFTGINAIIFYVPVLFSSLGSANSAALLNTVVVGAVNVGSTLIAVMFSDKFGRRFLLIEGGIQCCLAMLTTGVVLAIEFAKYGTDPLPKAVASGILAVICIFISGFAWSWGPMGWLIPSEIFTLETRPAGTAVAVVGNFLFSFVIGQAFVSMLCAMEYGVFLFFAGWLVIMVLCAIFLLPETKGVPIERVQALYARHWFWNRVMGPAAAEVIAEDEKRVAAASAIIKEEELSKAMK

SEQ ID NO: 59244 - protein, 180 aa, Zea mays
  misc_feature (15)..(15): Xaa can be any naturally occurring amino acid
  misc_feature (21)..(21): Xaa can be any naturally occurring amino acid
  misc_feature (40)..(40): Xaa can be any naturally occurring amino acid
  misc_feature (104)..(104): Xaa can be any naturally occurring amino acid
  misc_feature (128)..(128): Xaa can be any naturally occurring amino acid
  misc_feature (146)..(146): Xaa can be any naturally occurring amino acid
MTRCAQCDAPPPIRXTYSLLXLYLTFRTTADDLFPVFHKXAQIVDIDIPRDRRNWSLGWYSLYVRHEHQDQAQKADDRLDGRLRHGRQIMLHPAKSRVPNAERXTTCTITEPAPSPRGRSRRRRPSRXGTVMIYRDDYHDMDYIIXRSRMQSIYGYARDRDLHRDYHHRNLSRRYSPDDY

SEQ ID NO: 59245 - protein, 547 aa, Debaryomyces hansenii CBS767
MGIRIQSADELQVCEEVGRGGFGVVYRGVIKATNEEVAIKQIDLENEQTDLFEVNKEIMIISECRLSQITQYYGCFVNHYKLWVIMEYVNGGSLFELLKPGAVTDENVILIIAKEILIALEYLHDQGKIHRDLKSQNILLNQTGEVKLTDFGVSTQLSSNFSRRNTTVGTPYWMAPEVILNNNGGHSYKADLWSLGCCVYELFTGKPPLQNHFSPMKALRQISRCHYENNFAELIGLDDLEISGSFKDFLCLCFIIEPKERFSATKLLKHKFITNVSLSDNDKKKIVKKLITNKRRWDQENHVIQKQNYYVPTEIRNNQKKWNENELDEQKTIHFDFSLIQESASENPIIQYPPSPTASQKSSRESSLSPTSDSKETNQDPPLPKLNYQSLSKINTKQENLKKTIEPELRKILNKVFHKLDSKNSLTTQQYDLLVTFNDNMLNLMSFIQYSEPNNAPYNKLLICQYMKYFLKELLKLPAERQMENNPRFMLQKLIIPSNLNVKLNTLRTISDTTTMTTLNNKSFTQFDEIEFSLFETWIDKMNEKIS

SEQ ID NO: 59246 - protein, 394 aa, Nicotiana tabacum
MTTKNRQIKNFTSNFGPQHPAAHGVSRSVLEMNGEVVERAEPHIGLLHRGTEKLIEYKTYLQALPYSDRSDYVSMMAQEHAHSSAVERLLNCEVPLRAQYIRVLFREITRISNHSLALTTHAMDVGASTPFLWAFEEREKLLEFYERVSGARMHASFIRPGGVAQDLPLGLCIDIDSFTQQFASRIDELEEMSTGNRIWKQRLVDIGTVTAQQAKDWGFSGVMLRGSGVCWDLRKAAPYDVHDQLDPDIPVGTRGDRYDRYCIRIEEMRQSVRIIVQCLNQMPSGMIKADDRKLCPPSRSRMKLSMESSIHHFEPYTEGFSVPAPSTYTAVEAPKGEFGVFLVSNGSNRPYRRKIRAPGFAHSQGLDSMSKHHMPADVVTIIGTQDIVSGEVDR

SEQ ID NO: 59247 - protein, 238 aa, Triticum aestivum
  misc_feature (37)..(37): Xaa can be any naturally occurring amino acid
  misc_feature (223)..(223): Xaa can be any naturally occurring amino acid
  misc_feature (227)..(227): Xaa can be any naturally occurring amino acid
  misc_feature (230)..(231): Xaa can be any naturally occurring amino acid
  misc_feature (236)..(236): Xaa can be any naturally occurring amino acid
MEEHREERCWEDLLPDALGLIFRNLSLQEMLTVVPRXVCKSWSRVVSGPYCWQEIDIQEWSQQQNKPDQLTRMVHTLVTRSGDSFRRISVSGLPNDSLFTFIANHARSLKTLELPRSEISDCIVEDVAQRLSNVTFLDVSSCTKIGARALEAFGKNCKSLVGLRRVMHPIDVAGKVCQHDEARAIACSMPKLRHLEIGYMLIATNAVVEIASRCRDLSFLDLXGCWXVDXXLLQDXYP

SEQ ID NO: 59248 - protein, 377 aa, Debaryomyces hansenii CBS767
MNQVGLTNNTFNEYVLDQVVENITLHSDRMVVREYKKIGEGAFGTVVEAVLRKDYKTDSEQDREEPWLGPFAIKRVPAQTEYKSRELEILRVVNHPNIVSLRFFFDKKSSSDGKIYQNLVMECLPSNLQSEIKYYRHSKYTIPYPHMKTYTFQLARAMLYLHGFGISHRDIKPSNILVDPATVTLKICDFGSAKKLEPDQPSVSYICSRYYRAPELIIGCSIYTTKIDIWGLGCVIAEMFLGKPIFQGESPQSQLKEISKLLGPPSKTFFFNNNPKYRGNMYTNKLFSCTVEERFKQIFSNSPPDAIDLLMKILVYEPEKRASPRRVLCHPFFHELKKDDFQVYPRGSSEPIRLNLFNFSNYELELLGPLKDELLSS

SEQ ID NO: 59249 - protein, 366 aa, Listeria monocytogenes str. 1/2a F6854
MVFGELIGWLLGWALILEYGLAVASVASGWSSYLNALLSGFHISIPEAISGPFNPEVGTFINLPAIIIVLVIAFLLTLGIKESTRVNTIMVVIKVGVILLFLVVGVFYVKPDNWQPFMPFGISGVMNGAALVFFAYLGFDAVSSAAEEVKDPQRTMPIGIIGSLLICTVLYVAVSAVLTGMVPYTDLNVTDPVAYALQVINQDWVAGIVSLGAVVGMITVILVMSYGATRLIFAMGRDGLLPKVLAEINQKYQTPVKNTWIFAVIVAIISGLVPLDRLAELVNIGTLLAFMMVSIGIIFLRKNKDIQSRGFKVPLYPVLPIVSFLLCAFLISRLSVHTWILCGIWFVIGLIVYFAYGRKHSELLKK

SEQ ID NO: 59250 - protein, 453 aa, Streptomyces avermitilis MA-4680
MSRPRILIVGAGFAGYQTARTLSRLTRHKADITLLNPTDYFLYLPLLPQVAAGILEPRRVTVSLAGTLPHVRLVLGEAQTDGIDLDARTVRYTGPEGDVGTLTYDRLVLAAGSVNKLLPIPGVAEHAHGFRGLPEALYLRDHVTRQVELAAAAADSETCASRCTFVVVGAGYTGTEVAVQGQLLTDALVRNRPLREGRRPRWLLLDVAPRVLPGLDERLSRTADRVLRKRGVEVRMGTSVKEATSDGVLLSDGEFVDTRTLVWCVGVRPDPLAESLGLPMESGRLLVEPTLQVPGHPEVFACGDAAAVPDLENPGQYTPMTAQHAWRQGKTAGHNVAASFGIGTRRPYRHRDLGFVVDLGGVQAAANPLGIPLSGPLAGAVTRGYHLAAMPGNRVRVAADWLLEAVLPRQAVQLGLVRSWSVPLDTASPELARMPGAPERLATTDTPTTEGPS

SEQ ID NO: 59251 - protein, 261 aa, Vicia faba
AHIITAVIGSGVLSLAWAIAQLGWIAGPSMMLLFSFVTYYTSTLLSACYRTGDQLNGKRNYTYTDAVRAYLGGFKVKICGLVQYVNLFGVAIGYTIAASISMMAIKRSNCFHSSGGKDPCHMNGNLYMISFGIVEIFFSQIPDFDQLWWLSTLAAVMSFTYSTIGLGLGVGKVIENKGIKGSLTGITVGTVTQTQKVGRSFQALGNIAFAYSYSMILIEIQDTIKSPPSESKTMKAATLISVVVTTIFYMLCGCLGYAAFG

SEQ ID NO: 59252 - protein, 1118 aa, Hordeum vulgare subsp. vulgare
MDCLRLAVAAAALLLAALAAAADDAQLLDEFRMALPSQAPLEGWTAREGACRFPGAVCRGGRLTSLSLAAVTLNADFRAVANTLLQLSAVERLSLRGANVSGALAAARCGGKLEELDLSGNAALRGSVADVAALAGSCGALRTLNLSGDAVGAAKPAGGGGGGQGFAALDALDLSSNKIAGDADLRWMVGAGLGSVRWLDLAWNKISGGLSDFTNCSGLQYLDLSGNLIAGDVAAAALSGCRSLRALNLSSNHLAGAFPPNIAGLTSLTALNLSNNNFSGEVPADAFTGLQQLQSLSLSFNHFSGSIPDSVAALPDLEVLDLSSNNFSGSIPDSLCQDPNSRLRVLYLQNNYLSGSIPEAVSNCTDLVSLDLSLNYINGSIPESLGELSRLQDLIMWQNLLEGEIPASLSSIPGLEHLILDYNGLTGSIPPELAKCKQLNWISLASNRLSGPIPSWLGKLSNLAILKLSNNSFTGKIPAELGDCKSLVWLDLNSNQLNGSIPPELAEQSGKMTVGLIIGRPYVYLRNDELSSQCRGKGSLLEFSSIRSEDLSRMPSKKLCNFTRMYMGSTEYTFNKNGSMIFLDLSFNQLDSEIPKELGNMFYLMIMNLGHNLLSGAIPTELAGAKKLAVLDLSHNRLEGQIPSSFSSLSLSEINLSSNQLNGTIPELGSLATFPKSQYENNSGLCGFPLPPCESHTGQGSSNGGQSNRRKASLAGSVAMGLLFSLFCIFGLVIIAIESKKRRQKNDEASTSRDIYIDSRSHSGTMNSNWRLSGTNALSINLAAFEKPLQKLTLGDLVEATNGFHNDSLIGSGGFGDVYKAQLKDGRVVAIKKLIHVSGQGDREFTAEMETIGKIKRRNLVPLLGYCKIGEERLLMYDFMKYGSLEDVLHDRKKIGVRLNWAARRKIAIGAARGLAFLHHNCIPHIIHRDMKSSNVLVDENLEARVSDFGMARMMSVVDTHLSVSTLAGTPGYVPPEYYQSFRCTTKGDVYSYGVVLLELLTGKPPTDSTDFGEDHNLVGWVKMHTKLKITDVFDPELLKDDPTLELELLEHLKIACACLDDRPSRRPTMLKVMTMFKEIQAGSTVDSKTSSVATGLSDDPGFGVMDMTLKEAKEEKD

SEQ ID NO: 59253 - protein, 482 aa, Actinobacillus pleuropneumoniae serovar 1 str. 4074
MKINPLEGSPTMSVKRVFDLIKDNDIKFVMLKFTDIKGKEHGVSLPVSLIGDDLEDLFEEGKMFDGSSVEGWKAINKADMLLMPIAETAVVDPFARIPTLTLRCSIYDPNTMQSYDRDPRSIAIRAENYLKSTGIADSVMFGPEPEFFLFDDVRYNIGMNNVSYKIDDIEAAWNTNRKYEDGNTGYRPLKKGGYCAVAPIDSAHDIRSEMCLILEEMGLVVEAHHHEVATAGQNEIATKFNSLTLKADETQIYKYVVQNVALEHGKTACFMPKPFAGDNGSGMHCNMSLSKDGKNVFMGDKYAGLSETALYYIGGIIKHAKALNAFTNPSTNSYKRLVPGFEAPVLLAYSASNRSASIRIPAVTSPKATRVEARFPDPLANPYLCFAALLMAGLDGVVNKIHPGDAMDKNLYDLPPEELKEIPAVATSLEEALDSLAADYEFLTQGGVFTKEFVEAYINIRRKEVERLNMTPHPVEFEMYYA

SEQ ID NO: 59254 - protein, 422 aa, Wolbachia endosymbiont of Drosophila simulans
GKPCICSVSGLYIDKDGTLFSVGDTKVNKGEPITINGGTGEVMLGILPTISPELSQEFKTVINWIDEIKTVKVRANADTPKDAKIAKEFGAEGIGLCRTEHMFFASDRIEFIQKLIIADDENERANALIKLEEMQKSDFKEIFSIMEGREVTIRLLDPPLHEFLPNDQSTIEKIAKSLSKSVESVKNKIAQLSEKNPMLGHRGCRLAISHPEIYSMQIRAILSAASELKKEKKIEVEPEIMIPFIMSEKEFILICELAKKESSVISQTQIPASRAGMTSDKAYSIGTMIELPRAALIADKLAKHAEFFSFGTNDLTQTTMGLSRDDSVNFLDSYKKNNIFDNDPFEVLDIEGVGELIKMAIERGKKTRKEIKLGICGEHGADPKSIEFLIESGVDYVSCSPYRVPIAKLVAAQFSVRSKFAR

SEQ ID NO: 59255 - protein, 336 aa, Mycobacterium avium 104
MKLAVIGGDGIGPEVTAEALKVLDAVLPGVDKTEYDLGARRYHATGELLPDSVIDELRAHDAILLGAIGDPSVPSGVLERGLLLRLRFELDHHINLRPGRLYPGVSSPLAGNPDIDFVVVREGTEGPYTGTGGAIRVGTPNEVATEVSQNTAFGVRRVVVDAFERARRRRKHLTLVHKTNVLTFAGKLWSRIVAEVGRDYPDVEVAYQHIDAATIFMVTDPGRFDVIVTDNLFGDIITDLSAAVCGGIGLAASGNIDGTRTNPSMFEPVHGSAPDIAGQGVADPTAAIMSVALLLAHLGEDAAATRVDRAVERYLATRGNERPATTEVGERIAAAL

SEQ ID NO: 59256 - protein, 786 aa, Coccidioides immitis RS
MAILLGKFRGNSASGNGSQSSAPAKRDPVPPPLTPLQKMLLDAGPVRDDGSDKFFGMENAQFGNTCYCNSILQCLYYSVPFRESVINYPRRSPPDVLQNALRNNLRYPDPSVPLDELLKPKPPPTTPGKPSNSPLQVQKPEDKNSAEYKKKVALHTLPLLETTDNSASYGMKESLFTSLKDLFEAVIASPERVGVIRPYHFLEILRREHEMFRTTMHQDAHEFLNLLLNQVVSNVEDDAVLLSDADEQSDNSEETSEGTSEETATDGSVSTLPSNGVKSSRNTRWVHQLFEGTLTSETQCLTCETVSQRDEVFLDLSVDLEEHSSVTACLRKFSEEEVLCERNKFHCDNCGGLQEAERRMKIKRLPKILALHLKRFKYSEDLDRLQKLFHRVTYPYYLRLFNTTDDAEDPDRLYELYAVVVHIGGGPYHGHYVAIIKTEDRGWLLFDDEMVEPVDKSFVQNFFGDRPTLTSAYILFYQETTDEAMQQELAKENAASARDTPETKDGVAPLVKPNGHPVRPMKLDRSQTATDAVPTLDSAHLSPIKPTPTAPSQLPRSSEEPSSSPPSNGLSRPSLSSLIPKVDLHIKRQRTKNDKEQVKEERDRKAAEKEQAKLDKQKAKRQEFQRKQDEKREQAYIKAAMEESKITKAEEDRRNGVKGDKESGFFGLNKIKLRNRSASQSKLFLRAKENDVPDLPPLPPPNSLPESATDVSSRVPPSNESTDDDKADSANATAVSLQEQQPLASHVEALPPIPTSDTPDSRETPQTPATPKKTRFNIRKRSFNVF

SEQ ID NO: 59257 - protein, 317 aa, Zea mays
MASDGSGVVTVYGNNGAALLEPPKQPKSSTFSVKVGLAQMLRGGVIMDVVTPEQARLAEEAGACAVMALERVPADIRAQGGVARMSDPGLIRDIKRAVTIPVMAKARIGHFVEAQILEAVGVDYVDESEVLTPADDAHHINKHNFRVPFVCGCRDLGEALRRVREGAAMIRTKGEAGTGNVVEAVRHVRSVAGAVRALRGMDDDEVFAYAKRIAAPYDLVMQTKQLGRLPVVQFAAGGVATPADAALMMQLGCDGVFVGSGIFKSGDPARRARAIVQAVTHYSDPTILTDVSAGLGEAMVGINLNDPKVERYAARSE

SEQ ID NO: 59258 - protein, 131 aa, Hordeum vulgare subsp. spontaneum
HGHATDKVEEYGQPVAGHGGFTDGPTGTHGAAGVGGAQLQATRDGHKTDGVLRRSGSSSSSEDDGVGGRRKKGMKEKIKEKLPGGAHKDAAGQQQQTAMAGEYAGTHSTEATGEKKGVMDKIKEKLPGGQH

SEQ ID NO: 59259 - protein, 143 aa, Arabidopsis thaliana
  misc_feature (124)..(124): Xaa can be any naturally occurring amino acid
RTLASSMLSSATMVASPAQATMVAPFNGLKSSAAFPANRIANTYITSIISSCVTVNCMQVWPPIGKTKFETLSYLPDLTDSKLAKEVDYLIRSKWIPCVEFDLKHGFVYREYCNSPGYYDGRYXTMSNLPLFGCTDSAQLLNE

SEQ ID NO: 59260 - protein, 131 aa, Hordeum vulgare subsp. spontaneum
HGHATAKVEEYGQPVAGHGGFAGGPTGTHGAAGVGGTQLQATRDDHKTDGVLRRSGSSSSSSDDGVGGRRKKGMKEKIKEKLPGGAHKDAAGQQQQTAMAGEYAGTHGTEATGEKKGVMDKIKEKLPGGQH

SEQ ID NO: 59261 - protein, 561 aa, Thiocapsa roseopersicina
MSAPIHENERIKARSNCLRGTLRESLADTLTGAISPEDTQISKFHGFYQQDHRDRRQARPEQYLEPYFGFMLRAPLPGGVCTPAQWLAIDGMGRELGGGSLRLTTRQSFQYHGILKRDIASVIRGINAVMIDSIGGCGDVNRNVLCNPNPVESALHREVYDWAKRISEHLLPRTRAYHEIWLDGEQVGGGEDVEPIYGRTYLPRKFKTAVGVPPHNDVDVYANDLGFAAVADGSRLIGFNVSAGGTGRNTGIPATFPRLADVLGFVEPERTLAVAEAVVTTQRHFGDRLDRTQARLKYTIERMGLDAFRDEVERRAGIRFAPARPIGFTDQGDRTAWVRGQDGRWHLTLYIESGRLIDGPGQSSMQGLREIARIHQGDFRITPNQNLIVARVPEPGKSEIEALARKYGLLDKGIALRLNGMSCVALPTCPLAMAEAERYYPDFLAQVERLTRKHGLAEQEIVTRMTGCPNGCARPYLAELALVGKGPGRYNLMLGGNGRRYRLNRLYRENLDEAAIAILAEIDTLLGRYAACRQPGERFGDYLIRDGIVRPVVNPAEDFHE

SEQ ID NO: 59262 - protein, 202 aa, Oryza sativa
  misc_feature (22)..(22): Xaa can be any naturally occurring amino acid
  misc_feature (50)..(50): Xaa can be any naturally occurring amino acid
WREHVVVVPHKHDGVFICQCQXSDALCTKNIVPGEYVYCEKRISVQNEDXTNVEYRVLNPFRSKLAAAVLGGVDNIWIAPGTRVLYLGGASGTTVSHVSDIVGPTGLVYAVEFSHRSGRDLVNIAKKRTNVIPIIEDARHPARYRMLVGIVDVIFSDVAQPDQARILALNASYFLKNGGPFLSFQSMGIVSDSTMPGEAVFA

SEQ ID NO: 59263 - protein, 666 aa, Neurospora crassa
MDGSLMAALPQGQDVIRVISTGGVTKVVKIAECNTCEEVMRVTLRKFGLREDHERNYCFWVLAGVDPDPNQCRRLGDTELWRVIKDHTRPERNRLILRRVPSGEPGKAELERAAAIAMEEAQQTHRPPIEPSDKRSQLKLQKVLGVGWEDLQQQPPLSPMSYQDRERNVSNAARDLERPAPLETPRAMPRRTQALRQFGGLRPPSELIASDLTSYFPDHSREAIDRTARLSMRRSARLSRVNHRLSVASTLSFASSIQDAPPIPTIADSWLTASNQIAKVRPRDVLPRAPHGYRDSVASSVLDTLQEEGSPTEPNRRSFVPFSDSGSDTAAVSVIDPDGNIVRHSYYDSGTNNSADSAVIQEALAEDGEDAADKELQTFLAGDAWDDSMWMKGSLIGQGSFGSVYLALHAITGELLAVKQVETPAPGADSKNDARKKSMIEALKREITLLRDLQHPNIVQYLGCSSSAEYLNIFLEYVPGGSVQTMLDQYGALPESLVRSFVRQILQGLSYVHNRDIIHRDIKGANILVDNKGTIKISDFGISKKLEATNILNGANNNKHRPSLQGSVFWMAPEVVKQTSYTRKADIWSLGCLVVEMMTGTHPFPDCTQLQAIFKIGGSKASPTIPDNASEEAKQFLAQTFEIDHNKRPSADELMLSPFLTPVPGT

SEQ ID NO: 59264 - protein, 505 aa, Shigella flexneri 2a str. 301
MCLDSFINVNGCFLFWRAKGETLMSAIDSQLPSSSGQDRPTDEVDRILSPGKLIILGLQHVLVMYAGAVAVPLMIGDRLGLSKDAIAMLISSDLFCCGIVTLLQCIGIGRFMGIRLPVIMSVTFAAVTPMIAIGMNPDIGLLGIFGATIAAGFITTLLAPLIGRLMPLFPPLVTGVVITSIGLSIIQVGIDWAAGGKGNPQYGNPVYLGISFAVLIFILLITRYAKGFMSNVAVLLGIVFGFLLSWMMNEVNLSGLHDASWFAIVTPMSFGMPIFDPVSILTMTAVLIIVFIESMGMFLALGEIVGRKLSSHDIICGLRVDGVGTMIGGTFNSFPHTSFSQNVGLVSVMRVHSRWVCISSGIILILFGMVPKMAVLVASIPQFVLGGAGLVMFGMVLATGIRILSRCNYTTNRYNLYIVAISLGVGMTPTLSHDFFSKLPAVLQPLLHSGIMLATLSAVVLNVFFNGYQHHADLVKESVSDKDLEVRTVRMWLLMRKLKKNEHGE

SEQ ID NO: 59265 - protein, 275 aa, Parvularcula bermudensis HTCC2503
MATWGYRGTAVITGAGSGIGRALAFALAEKGMDLALVDIREDRLEELRQALASNQRKVTIYARDVADRDAMRRLPSDVAADHDQVSVLVNNAGVALGGQFDQVAEDDFDWLMNINFRSVVDLTRAFLPHLREAARARIVNTSSLFGIIAPPGQAAYSASKFAVRGFSEALRHELDGSNVGLTVVHPGGIATNIATDARIKIDAPPEEIEKRKQSMNKLLRLSPEKAAKAIVEGVEKHRGRVLIGNDAKAAALVARLFPETYYRLIGMQMKGNDGT

SEQ ID NO: 59266 - protein, 444 aa, Schizosaccharomyces pombe
CTDKPTLINLKTTIGYGSELQGTHSVHGSPLKPEDCVHVKKLFGFDPTKTFQVPPEVYAYYKERVAIASSAEEEYKKMYASYKQSYPDLSNQLERILSRKFPEGWEKHLPVYKPGDKAVATRKLSEIVLDALCPVLPELVGGSADLTPSNLTRWEGADDFQPPSSKLGTYAGRYIRYGIRENGMAGIMNGLAVYGPIIPYGGTFLNFVSYAAGAVRMAALNNSRVIYVATHDSIGLGEDGPTHQPIETFAHFRAMPNINCWRPADGNETSAAYYSALTSDSTPSILALTRQNLPQLENSTIENALKGGYVMLENKEADITLVGTGSEVSLCIDTVKTLETEYNLKARVVSLPCWEVFEQQPESYRLSVIPDGIPAMSVEVWATNGWRRYVHEAFGMHTFGDSGPAPKLYEKFHFTTSGVAQRAKKTVDAYKDIPYIRSPVRRAF

SEQ ID NO: 59267 - protein, 222 aa, Zea mays
RAWARWRGAPGPQRPVAAAGGLLLYRDPGTGDLTVVNPLTGAAHALPPPPPPALTRALQAIAMYGSPYRVVLILGELPELSTVAYDSSTNAWSEQAALSRKPEVEGAPSRERVAEVGDGDGDDTVYFLSKSGDVVASTMQRSASRQYSSAVACGGCGGGDAVAYFLSRSGTVVACDLARRAFAELPRILPAYHEHSIDVVACGGAAYAVVLSEFLDAASLRV

SEQ ID NO: 59268 - protein, 161 aa, Trichodesmium erythraeum IMS101
MNPLFSTRNSVEQVEEGLLLAPKFDCNGLIPVVTTDANTGEVLMHAYMNEEALVKTIETGEGHYYSRSRQQLWHKGQSSGLVQKVQQLAIDDDQDCLWMQVEVAGSGASCHVGYRSCFYRCIPTGKSAIDSQEPIQLTFTETEKTFDPKTVYGNAPNPTQL

SEQ ID NO: 59269 - protein, 249 aa, Candida glabrata CBS 138
MSLSREDSVFLTKLAEQAERYEEMVENMKDVASAGQELSVEERNLLSVAYKNVIGARRASWRIVSSIEQKEESKENSEHQIKLIKDYRAKIEAELTKISDDILSVLDKHLIPSASSGESKVFYYKMKGDYHRYLAEFSQGDVRENATKASLDAYQKASEIATTELPPTHPIRLGLALNFSVFYYEIQNSPDKACHLAKQAFDDAIAELDTLSEESYKDSTLIMQLLRDNLTLWTSDMSEADDQKNEESK

SEQ ID NO: 59270 - protein, 439 aa, Wolbachia endosymbiont of Drosophila simulans
MNIGSGRVVIQSLQRINQEIGTIENNVNLQSFISNLKSKNGVCHIMGLVSDGGVHSHQKHISTLANKISQHGIKVVIHAFLDGRDTLPNSGKKCIQEFIKSIKGNDIRIATVSGRYYAMDRDNRWERTIEAYEAIAFAKAPRHDNAVSLIDENYQNNITDEFIRPAVIGDYQGIKPEDGVLLANFRADRMIQLASILLGKTDYAKVAKFSSILSMMKYKKDLQIPYIFPPTSFADTLGQTIEDNKLQQLRIAETEKYAHVTFFFNCGKEEPFSGEERILIPSPKVQTYDLQPEMSAFELTEKLVEKIHSQEFALIVVNYANPDMVGHTGNIKAAEKAVLAVDDCLAKVLSAVKKSSNTALIVTADHGNVECMFDEENNTPHTAHTLNKVPFIVSCDNLKLRDGRLSDIAPTILQLLGIKKPDEMTGSSLISCITLCHSS

SEQ ID NO: 59271 - protein, 310 aa, Escherichia coli O157:H7 EDL933
MLDANKLQQAVDQAYTQFHSLNGGQNADYIPFLANVPGQLAAVAIVTSDGNVYSAGDSDYRFALESISKVCTLALALEDVGPQAVQDKIGADPTGLPFNSVIALELHGGKPLSPLVNAGAIATTSLINAENAEQRWQRILHIQQQLAGELVALSDEVNQSEQTTNFHNRAIAWLLYSAGYLYCDAMEACDVYTRQCSTLINTVELATLGATLAAGGVNPLTHKRVLQADNVPYILAEMMMEGLYGRSGDWAYRVGLPGKSGVGGGILAVVPGVMGIAAFSPPLDEEGNSVRGQKMVASVAKQLGYNVFKG

SEQ ID NO: 59272 - protein, 447 aa, Wolbachia endosymbiont of Drosophila simulans
HKKAVIALWNRLEERGQIYLDSYSGWYSVRDEAFYQESELIDGKAPTGAEVQWIKEESYFFRLSNWQDKLLELYKNQPSFIFPESRRNEVISFVRSGLIDLSISRTSFNWGIKVPGNDKHVIYVWIDALTNYLTSIGFPSTEGEEYKRFWAEPETQIPVSSTGMTPNQGKTQIPVSSTGMTPNLADNSFNVHVIGKDILRFHAVYWPAILLAADLPLPKQIAVHGWWLNEGEKISKSLGNVIDPIGLAQEFGVDQLRYFLLREASFGQDGNFSKKNMISRINSELANNIGNLVQRTISFLHKQCSGIVPTIDQILLKGEESLPGCKAILDQVMNHLSKYEFNHIILLIINISSEANAYIDKSAPWTLSKTDRERVNLVIYKLLEYIRIIGILLQPIVPKSAEMILNQLQIPKEQRDLKSLCNACVSLGITLPKPTPVFLRVDAKEEK

SEQ ID NO: 59273 - protein, 205 aa, Brassica napus
MPTSLQFQRPSTAAESANLHHKQLQKMSLTRGMADVPEHVELSHTHVVEPSQCFSVVVQDVDAPASAVWSILSRFEHPQAYKHFVRSCHVAAGDGREVGSVREVRVVSGLPAAFSLERLEIMDDDRHVMSFSVVGGDHRLQNYRSVTTVHESSDNNKKTRVVESYVVDVPAGNDKDETCSFADTIVRCNLQSWAKLAENRLESSN

SEQ ID NO: 59274 - protein, 282 aa, Agrobacterium tumefaciens str. C58
MPHDFLAEITGSFAMPAGENPTVAMIEAAYQHHGLNWRYINLEVSPENLKDAVAGARAMGWAGFNCSIPHKVAVIQHLDGLGESAEIIGAVNTIVRRGDRLIGENTDGKGFVKALRDVIDPKDKKVVLFGAGGAARAVCVEVALAGAAHITVVNRNRERGETVARLIDEKTPATATFAAWEDAFAIPEETDIVIHATSVGLYPDIDGLPDIDLKTLRPSMVVADGIHNPPRTRLIRAAEAAGSKTADGLGMLVNQGVIGIKYWTGVDVDAYVMRQALVDLNL

SEQ ID NO: 59275 - protein, 131 aa, Hordeum vulgare subsp. spontaneum
HGHATDKVEEYGQPVAGHGGFAGGPTGTHGAAGVGGTQLQATRDDHKTDGVLRRSGSSSSSSDDGVGGRRKKGMKEKIKEKLPGGAHKDAAGQQQQTAMAGEYAGTHGTEATGEKKGVMDKIKEKLPGGQH

SEQ ID NO: 59276 - protein, 563 aa, Kluyveromyces lactis NRRL Y-1140
MTGSYELNHTGEVVSNRGLKDAYNEVTEMEVDPKNNEYAEEQSLNREDTFDPDSGVKRQLKDRHISLLALGGIIGPGCLIGAGNALAIGGPLALLLGFGIIGILAFIMMESIGEMITLYPSGGGFTTLTRRFHSDALSAVCGYAYAVVFFAVLANEYNTLSSIMQFWGPQVPLYGYILIFWAAFQVFQLLGVGAFGETEYWLAWFKILGLLTYYIFSIVYISGGVKNRPAFGFQYWNDPGALSNGFKGIANVFVFCSTFYSGTESVALAATESKNPRRAVPIAIRQTFWRILIVYLGISIFYGVTVPYNDENLNFATKVLKSPIAIAISRAGWPAGVHLVNAFILITCISAINGSLYIGSRTLTHLANEGLAPKLLAWTDRRGVPIPAITVFNALGLISLMNVSVTAVDAYNYIVNLSGVGVFIVWGIISLTHLRFRKAWKLQGHTRDELPYKAKLFPVFPIVSIIANIFLGLVQGWSYFKPFDAKNFVDAYILIPAGIILYLGVSYWKTKGFLTAVDLSEVNLLFGQRLPTISQDMPSSTDSTTSVVITKTPRKINWKDILT

SEQ ID NO: 59277 - protein, 523 aa, Candida tropicalis
MATQEIIDSVLPYLTKWYTVITAAVLVFLISTNIKNYVKAKKLKCVDPPYLKDAGLTGISSLIAAIKAKNDGRLANFADEVFDEYPNHTFYLSVAGALKIVMTVDPENIKAVLATQFTDFSLGTRHAHFAPLLGDGIFTLDGEGWKHSRAMLRPQFARDQIGHVKALEPHIQIMAKQIKLNQGKTFDIQELFFRFTVDTATEFLFGESVHSLYDEKLGIPTPNEIPGRENFAAAFNVSQHYLATRSYSQTFYFLTNPKEFRDCNAKVHHLAKYFVNKALNFTPEELEEKSKSGYVFLYELVKQTRDPKVLQDQLLNIMVAGRDTTAGLLSFALFELARHPEMWSKLREEIEVNFGVGEDSRVEEITFEALKRCEYLKAILNETLRMYPSVPVNFRTATRDTTLPRGGGANGTDPIYIPKGSTVAYVVYKTHRLEEYYGKDANDFRPERWFEPSTKKLGWAYVPFNGGPRVCLGQQFALTEASYVITRLAQMFETVSSDPGLEYPPPKCIHLTMSHNDGVFVKM

SEQ ID NO: 59278 - protein, 643 aa, Coprinopsis cinerea okayama7#130
MAAPLDVAQQVFALLNGGALGSQQHVACVNNTLNGTATSFVPPTSAALPTSFDIHSILTFIFSFSALREWVKLAAIGAVLETFRRFVFHFYYKIWDAFFITVLFEDDDVAYGQARNIEISSKTFGLNTSATQIEGEELDPMDALASTRALNYVPSVHTAFTFWYKRRWVRITRGVRESNNYWNARAEQLWVCIFSMDHRILNQMLLEAKKAHKEAQENNISIYASDSNNQWRYIASRPKRPLTSIVLDPGVKDVILDDARDFMLSKSWYTTRGIPFRRGYLLYGAPGTGKTSIIHSLAGELGLNVYIISLSRSGLDDNALSELIADLPEQCIALMEDIDAAFSQTLNRDADESDGNKNNQQNAGPAPKTTSRISLSGLLNALDGVGAQEGRILFATTNKYTSLDPALCRPGRMDVHVEFKLASKYQARELFRRFFLPDSVDEVVKKESEKEKDVDSGYASCADGGDSEKAALIQAAKENEEVKPEQVSAVVQSSHRRRGPRLSSQEVEELAAKFADAVPEREFSMATLQGYLMTYKIRPCAAVEEAANWVAGRRAEAAAKAEKEKKEKEEAEKKEAERKQKEEEEKRKKEEEEKKKKEEEEEKRRKEEEREKRRKEREENKAKKKKSKKETEDEDSATSSWED

SEQ ID NO: 59279 - protein, 522 aa, Candida tropicalis
MTVHDIIATYFTKWYVIVPLALIAYRVLDYFYGRYLMYKLGAKPFFQKQTDGCFGFKAPLELLKKKSDGTLIDFTLQRIHDLDRPDIPTFTFPVFSINLVNTLEPENIKAILATQFNDFSLGTRHSHFAPLLGDGIFTLDGAGWKHSRSMLRPQFAREQISHVKLLEPHVQVFFKHVRKAQGKTFDIQELFFRLTVDSATEFLFGESVESLRDESIGMSINALDFDGKAGFADAFNYSQNYLASRAVMQQLYWVLNGKKFKECNAKVHKFADYYVNKALDLTPEQLEKQDGYVFLYELVKQTRDKQVLRDQLLNIMVAGRDTTAGLLSFVFFELARNPEVTNKLREEIEDKFGLGENASVEDISFESLKSCEYLKAVLNETLRLYPSVPQNFRVATKNTTLPRGGGKDGLSPVLVRKGQTVIYGVYAAHRNPAVYGKDALEFRPERWFEPETKKLGWAFLPFNGGPRICLGQQFALTEASYVTVRLLQEFAHLSMDPDTEYPPKKMSHLTMSLFDGANIEMY

SEQ ID NO: 59280 - protein, 522 aa, Candida tropicalis
MTAQDIIATYITKWYVIVPLALIAYRVLDYFYGRYLMYKLGAKPFFQKQTDGYFGFKAPLELLKKKSDGTLIDFTLERIQALNRPDIPTFTFPIFSINLISTLEPENIKAILATQFNDFSLGTRHSHFAPLLGDGIFTLDGAGWKHSRSMLRPQFAREQISHVKLLEPHMQVFFKHVRKAQGKTFDIQELFFRLTVDSATEFLFGESVESLRDESIGMSINALDFDGKAGFADAFNYSQNYLASRAVMQQLYWVLNGKKFKECNAKVHKFADYYVSKALDLTPEQLEKQDGYVFLYELVKQTRDRQVLRDQLLNIMVAGRDTTAGLLSFVFFELARNPEVTNKLREEIEDKFGLGENARVEDISFESLKSCEYLKAVLNETLRLYPSVPQNFRVATKNTTLPRGGGKDGLSPVLVRKGQTVMYGVYAAHRNPAVYGKDALEFRPERWFEPETKKLGWAFLPFNGGPRICLGQQFALTEASYVTVRLLQEFGHLSMDPNTEYPPRKMSHLTMSLFDGANIEMY

SEQ ID NO: 59281 - protein, 972 aa, Triticum aestivum
  misc_feature (88)..(88): Xaa can be any naturally occurring amino acid
  misc_feature (858)..(858): Xaa can be any naturally occurring amino acid
MPSVSRAVCLQRPTTSGGGRSREAARSVASPRARHAKSKTMIHPARGRHCSPPNAVAAPMPATTASIFHFCKCSTDVAGVACSIASHXMAPAQCARVQRVFHFGKGKSEGNKAMKDLLGGKGANLAEMASIGLSVPPGFTVSTEACEQYQAAGRALPPGLWEETLEGLRWVEEYMGARLGDPARPLLLSVRSGAAVSMPGMMDTVLNLGLNDEVAAGLAAKSGDRFAYDSYRRFLDMFGNVVMDIPHALFEEKLEAMKATKGVDNDTDLTANDLRELVGQYKNVYVEAKGEQFPSDPKRQLQLAVLAVFDSWDSPRANKYRSINQITGLRGTAVNVQCMVFGNMGNTSGTGVLFTRNPSTGEKKLYGEFLVNAQGEDVVAGIRTPEDLDAMRDHMPEAYAELVENCEILESHYKEMMDIEFTVQENRLWMLQCRSGKRTGTGAVKIAVDMVNEALVDRNTAIKMVEPGHLDQLLHPQFANPEAASYKGKVITTGLPASPGAAVGQIVFTAEDAEAWHAQGKSAILVRTETSPEDVGGMHAAAGILTARGGMTSHAAVVARGWGKCCVSGCSSIRVNEIEKVVAIEDKMLYEGDWISLNGSTGEVILGKQPLSPPALSADLETFMSWVDEVRQLKVMANADTPGDALAARKNGAEGIGLCRTEHMFFASDERIKAVRQMIMAPTVELRQKALDRLLPYQRSDFEGIFRAMDGLPVTIRLLDPPLHEFLPEGHVEDIVRELCAESGAAEDDVLARMEKLSEVNPMLGFRGCRLGISYPELTEMQARAIFEAAISMTNQGIQVFPEIMVPLVGTPQELGHQVALIRQIANNVFTNMGKTIDYKAGTMIEIPRAALVADEIXKQAEFFSFGTNDLTQMTFGYSRDDVGKFLPIYLAQGILQHDPFEVLDQRGVGELVKIATERGRKARPNLKVGICGEHGGEPSSVAFFAKAGLDYVSCSPFRVPIARLAAAQVLV

SEQ ID NO: 59282 - protein, 540 aa, Candida tropicalis
MSSSPSFAQEVLATTSPYIEYFLDNYTRWYYFIPLVLLSLNFISLLHTRYLERRFHAKPLGNFVRDPTFGIATPLLLIYLKSKGTVMKFAWGLWNNKYIVRDPKYKTTGLRIVGLPLIETMDPENIKAVLATQFNDFSLGTRHDFLYSLLGDGIFTLDGAGWKHSRTMLRPQFAREQVSHVKLLEPHVQVFFKHVRKHRGQTFDIQELFFRLTVDSATEFLFGESAESLRDESIGLTPTTKDFDGRRDFADAFNYSQTYQAYRFLLQQMYWILNGSEFRKSIAVVHKFADHYVQKALELTDDDLQKQDGYVFLYELAKQTRDPKVLRDQLLNILVAGRDTTAGLLSFVFYELSRNPEVFAKLREEVENRFGLGEEARVEEISFESLKSCEYLKAVINETLRLYPSVPHNFRVATRNTTLPRGGGEDGYSPIVVKKGQVVMYTVIATHRDPSIYGADADVFRPERWFEPETRKLGWAYVPFNGGPRICLGQQFALTEASYVTVRLLQEFAHLSMDPDTEYPPKLQNTLTLSLFDGADVRMY

SEQ ID NO: 59283 - protein, 568 aa, Coprinopsis cinerea okayama7#130
MQAAANAAQNYMGPLPTDVHPEYEPAESGEKMRALAWFGTKDVRMIDAPIPKVTEPDDVILKVTATTICGSDLHLYHGEIMALQKGEILGHEFMGVVDSVGPSVKNLEPGQRVVASFQIACGECEFCKKKISSMCDRTNPSSLQKAMYGTTDAGFFGYSHFAGGFPGGQAEYVRVPKGNVNLLPVPDDLADEQVLFLSDILPTSYHAVVDTGVEEGDTVAVWGLGPVGMYVAKFALLKGASKVIGIDQVPERLEFAEQSLGIETINFKEHKDVPARIREIIGEKGVDVCIDAGSFHEPKSFTHKVQKFLMLETDAPETINEMLLAVRKMGRCGIIAVYAGYANGVNVGALMEKGIRLIGNGQAPVHLYWKDILENYIKTGKLDPTFIISHRVGLEDLPALYAAFDARTAGVEKVVVDTKFTKALGRRSDNVPPLTRVQDWKNDPEKSSISHVEATKTPEDEARIQPLPRPNESESSLRARLVYQSRKRGTLETDLLLSTFAQENLAKMSVPELKEFDKLLDEPDWDIYYWCTGKRTPPERWAKSELLEKLRVHAQNEGKVVRRMPDLS

SEQ ID NO: 59284 - protein, 363 aa, Schizosaccharomyces pombe
FVADLNGVYRQLLRWHAKLPRVQPFYAVKCNPDPKVLALLNKFGTGLDCASKGELEQILGLGVSPDRIVYANPCKAITYVRYAASKGINLMTFDNADELYKVKQHHPNSRLLLRISTDDSNSLCRLSLKFGASLDDTGKLLDIAKSLELNVVGVSFHVGSGSYDPSAFLDAIQRSRQVFDQGLERGFNFDLLDIGGGFMNDSFDGVADLIRSALDTYFDPSIRVISEPGRFFVSSSFTLAVNVIAKRKLDDEEKVMYYVNDGVYGSLNCILFDHQHPVARVLKCGSRFVYNDLVGTGQHRCFIWGPTCDSLDVIANDAHLPYEPNVGDWIYFEDAGAYTVAAASCFNGFKTSRIVYLDTDILD

SEQ ID NO: 59285 - protein, 512 aa, Ocimum basilicum
MAALLLLLLLPLLLPAIFLLHHLYYRLRFRLPPGPRPLPIVGNLYDVKPVRFRCFADWAQSYGPIISVWFGSTLNVIVSNTELAKEVLKEKDQQLADRHRSRSAAKFSRDGQDLIWADYGPHYVKVRKVCTLELFSPKRLEALRPIREDEVTAMVESIYHDCTAPDNAGKSLLVKKYLGAVAFNNITRLAFGKRFVNSEGIIDKQGLEFKAIVSNGLKLGASLAMAEHIPSLRWMFPLDEDAFAKHGARRDQLTREIMEEHTRAREESGGAKQHFFDALLTLKDKYDLSEDTIIGLLWDMITAGMDTTAISVEWAMAELIKNPRVQQKAQEELDRVIGYERVMTELDFSNLPYLQCVAKEALRLHPPTPLMLPHRSNSNVKIGGYDIPKGSNVHVNVWAVARDPAVWKNPCEFRPERFLEEDVDMKGHDFRLLPFGAGRRVCPGAQLGINLVTSMIGHLLHHFNWAPPSGVSSDELDMGENPGLVTYMRTPLEAVPTPRLPSDLYKRIAVDL

SEQ ID NO: 59286 - protein, 330 aa, Bartonella taylorii
STASCESKITYIDGNKGILLYRGYPIDQLAEKGDFLESCYLLLYGELPTKQEKHDFDRCIMQHTMVHEQFARFFHGFRRDSHPMAVMVACLGAMSAFYHDSIDITDPQQRMIASVRLISKVPTLAAMAYKYSIGQAFVYPRNDLSYAANFLRMCFCVPCEEYKINPVLTRAMDRIFILHADHEQNASTSTVRLAGSSGANPFACIAAGVACLWGPAHGGANEACLKMLQEIGSVERIPEFIARAKDKNDPFRLMGFGHRVYKNYDPRAKIMQKTCHEVLKELNIQGDPLLDIAMELEKIALNDEYFVEKKLYPNVDFYSGITLKALGFPT

SEQ ID NO: 59287 - protein, 436 aa, Pseudomonas putida GB-1
QTMAEQMGGKVEGSDLREFGYARVDVVGKSRLLDGIEDHVDDNGVLGLDVWMSHGDKVTQMPGNFNILASTPSCPIAGMYDDARGYYGVQFHPEVTHTKQGGRILSRFVQDICGCEALWTASNIVEDAIAQVRAQVGSANVLLGLSGGVDSSVVAALLHRAIGDQLTCVFVDNGLLRLHEGDQVMAMFKENMGVKVIRADAEKQFLDNLEGEADPEKKRKIIGRTFIDIFDAEASKLENIQFLAQGTIYPDVIESAGAKSGKAHVIKSHHNVGGLPEEMNLKLVEPLRELFKDEVRKIGLELGLPYDMVYRHPFPGPGLGVRILGEVKKEYADILRRADHIFIKELRKADWYHKTSQAFVVFQPVKSVGVVGDGRRYTWVVALRAHETVDFMTARWAHLPYELLETVSGRIINEIDGISRVTYDVSSKPPATIEWE

SEQ ID NO: 59288 - protein, 330 aa, Bartonella taylorii
STASCESKITYIDGNKGILLYRGYPIDQLAERGDFLESCYLLLYGELPTQQEKHDFDRCIMQHTMVHEQFARFFHGFRRDSHPMAVMVACLGAMSAFYHDSIDITDPQQRMIASVRLISKVPTLAAMAYKYSIGQAFVYPRNDLSYAANFLRMCFCVPCEEYKINPVLTRAMDRIFILHADHEQNASTSTVRLAGSSGANPFACIAAGVACLWGPAHGGANEACLKMLQEIGSVERIPEFIARAKDKNDPFRLMGFGHRVYKNYDPRAKIMQKTCHEVLKELNIQGDPLLDIAMELEKIALNDEYFVEKKLYPNVDFYSGITLKALGFPT

SEQ ID NO: 59289 - protein, 330 aa, Bartonella grahamii
STASCESKITYIDGDKGILLYRGYPIDQLAEKGDFLESCYLLLYGELPTQQEKNEFDRCIMQHTMVHEQFARFFHGFRRDSHPMAVMVACLGAMSAFYHDSIDITDPHQRMIASVRLISKVPTLAAMAYKYSIGQAFVYPRNDLSYAANFLHMCFAVPCEEYKTNPVLARAMDQIFTLHADHEQNASTSTVRLAGSSGANPFACIAAGVACLWGPAHGGANEACLKMLQEIGSIKRIPEFIARAKDKNDSFRLMGFGHRVYKNYDPRAKIMQKTCHKVLKELNIQDDPLLDIAIELERIALSDEYFIEKKLYPNVDFYSGITLKALGFPT

SEQ ID NO: 59290 - protein, 499 aa, Candidatus Kuenenia stuttgartiensis
MQNKPMICVPIVANNNNDAIHDMECASKIADAVELRIDYIHDLNLRQILGKCTKPVIVTNRPVREGGKFRGTEEERLQLLKQAIQLQADYVDIEHDSIRNVKKNGNALFAASKTKIIVSYHNFRETPENLSEIYNTLFQSGADIVKIVTHANSITDNIKIYQLLQQSKIPIISFCMGEYGIISRILYKIFGSYLTFASLQKGKESAPGQINIEELLNRYNIKNQNKHTAVYGLIGNPVSHSISPVIHNALFKEIGMNCVYVPFKVDEIGRFISEFKKLNISGYSVTIPHKESIINYLDDADPIAKKIGAVNTVVNKNNRLIGFNTDLEAAVTVLAEVANVSGHTAADACFKNKHVTIIGAGGVARAIAFGLKMYGADITLVSRNHNRMQSLAGEVGCSFTNKNGLQNLETDIFVNATPVGMYPSINETPVDRKLLKPNMIVFDTIYNPPETKLIKDAKEIGCKTVGGMPMFIRQAAAQFRLWTDTEPPLNIIENIAYNA

SEQ ID NO: 59291 - protein, 330 aa, Bartonella grahamii
STASCESKITYIDGDKGILLYRGYPIDQLAEKGDFLESCYLLLYGELPTQQEKNEFDRCIMQHTMVHEQFARFFHGFRRDSHPMAVMVACLGAMSAFYHDSIDITDPHQRMIASVRLISKVPTLAAMAYKYSIGQAFVYPRNDLSYAANFLHMCFAVPCEEYKTNPVLARAMDQIFTLHADHEQNASTSTVRLAGSSGANPFACIAAGVACLWGPAHGGANEACLKMLQEIGSIKRIPEFIARAKDKNDPFRLMGFGHRVYKNYDPRAKIMQKTCHEVLKELNIQDDPLLDIAIELEKIALSDEYFIEKKLYPNVDFYSGITLKALGFPT

SEQ ID NO: 59292 - protein, 330 aa, Bartonella grahamii
STASCESKITYIDGDKGILLYRGYPIDQLAEKGDFLESCYLLLYGELPTQQEKNEFDRCIMQHTMVHEQFARFFHGFRRDSHPMAVMVACLGAMSAFYHDSIDITDPHQRMIASVRLISKVPTLAAMSYKYSIGQAFVYPRNDLSYAANFLHMCFAVPCEEYKTNPVLARAMDQIFTLHADHEQNASTSTVRLAGSSGANPFACIAAGVACLWGPAHGGANEACLKMLQEIGSIKRIPEFIARAKDKNDPFRLMGFGHRVYKNYDPRAKIMQKTCHEVLKELNIQDDPLLDIAIELEKIALSDEYFIEKKLYPNVDFYSGITLKALGFPT

SEQ ID NO: 59293 - protein, 1090 aa, Photorhabdus luminescens subsp. laumondii TTO1
MVAPFWKRAYLALLSSTFVLLLASCDNNRSLPKTPEKPMAHIPNKVPSEAATAGNFQAVIHLVDIAKLSQSPTTNRDYSTNTLYLWNDKNCDALASLSSSWNDTSATPTGSDSYGPYWVIPLTKNEGCINFIVRDGNNNKLIDSDLKISFSDFSNRTVSVIPGNYQIYGSRAAAFNSVFGVSQASAHWVDNQTLLWSGGADKPYVRLYYNRNGKVEANDEGNFIDSYLTLTPTTLSQKTAERFPHLKKLTAFHLPEDTDVDTLLTGELVALATNEAGLLLSATQVQTAGVLDDRFANVADTLEYGALINDTGVTFRLWAPTAQHVGLVIYDANKQIIANHAMKRDPASGSWSWQGDKELVGAYYRYALTVYHPYSRHVEHYEVTDPYSHSLSTNSEYSQVINLDDEALKPQNWDSLIMPRSQNTPADIARMTIYEAHIRDLSVADGTVTETWRGKYLALTADNSDMFKHLKTLSQAGVTHMELLPVFDVASINEFSNEVADLNHPFSRLCQVNPRVKNSRFANYCSGSQTVGEVLQALQRGDNANNPQVQELNAMIAETDSYNWGYDPFHYSVPEGSYATDAEGSVRINEFRAMIQAIKQQLGMNVIMDVAYNHTNAAGPAHRSSVLDKVVPWYYHRLDEITGNVESNTCCHDTAPEHRMFAKLIEDSLVTWVKDYKIDAFRFDLMGYHPKAQMLSALAKVRAINPSVYFFGEGWNSGQDDRFEIASQINLKGTGIGTFSDRLRDAVQGGGPFDSADTIRINQGVGNGAGTLLNEMAWLDANETRHLADLVRLGMAGNLADFVLINKDGAVKTGREINYKGAIAGYAADPIEVINYVSKHDNQTLWDIISYKAAREANLATRVRMQAISLATTFLGQGLAFAQHGSELLRSKSFTRDSYNSGDWFNRVSYTYQDNNYDVGMPDQRVDGENYALIEKVKNVVDKPGRTELLQMTAFYQELLRLRQYSPLMTLGDGTSVKQRVDFRNVGPHQQLGLLVMTIDDGNTTGDDRDSRFDGLVVMINAAPYPATVRDLNVKGLKLNDIQRELGHTSLAAGTRIAKDGTVTLPAWSVAVLVLPQDGKRGIGLPVRRK

SEQ ID NO: 59294 - protein, 397 aa, Desulfotalea psychrophila LSv54
MTEFRMPSLGADMKEGRLVEWKVKLGDQVKRGDIIAEVETAKGVIEIEVFTDGVIEQILVQRGENVPVGTVLATIQGNGEQGRELREEALPEPVFKYKACLIAAHREEPAAEPPPAVVTAAGKRLRISPRARKLLAELDVELSTVQGTGQGGAITGIDIERAAAAEKAAAQSVPSTPGAAMRQAIATAMARSNREIPHYYLASRIDMSNTLRWLEAENKKRSIKERVLPVVPLIKATALALAKVPELNGYWLDNRQQPEEAVHIGFVISLRQGGLVAPAIHHANLKSLPELMETLSDLITRTRSGHLRSSELTDATVTITNLGDLGVEVVHGVIYPPQVALVGFGKILEQPWAKDGMLGIRPILTATLAADHRATDGHRGAQFLEALNHHLQKPEEL

SEQ ID NO: 59295 - protein, 332 aa, Desulfotalea psychrophila LSv54
MSEKNMIQTTYREAVRAAMREAMQRDKRVFLLGEDVGRYGGCFAVSKGLLEEFGPERIIDTPLSESAFTGAGIGAALGGMRPIVEIMTVNFSLLAADQIINNAATFLHMSGGLFNVPLVIRMSTGGGKQLAAQHSHSLEGWYAHVPGIKVLTPATLEDARGMLWTALEDPDPVLIFEHQGLLNMEGPLAADAGAVDIDRALIRRRGRDLTIITYGASLFKALEAAEALAGEGIEAEVIDLRTLRPLDEETFLSSIATTHRALIVDEGWRSGGISAEISARIMEGAFYDLDVPVERICGAEVPMPYAKHLEDAAMPQAETIVTTAKRMVASND

SEQ ID NO: 59296 - protein, 335 aa, Desulfotalea psychrophila LSv54
MKVKATSGSAGAGVDPAHARQLLYQMVRIRRFEEKAAELYTKMKIRGFLHLYIGEEAVAAGVSAALEPEDASVGTYREHGNALARGISAGAIMAEMYGKQEGCSRGRGGSMHIFDDKTRFYGGNAIVGGGLPLAVGLALADKMQGKKRVTCCFFGDGAVSEGEFHESMNLAALWNLPVLFICENNLYAMGTALERSQSVTDLTRKAVSYRIAASAVDGMDVLAVEAAANEAVNAVRSGQKPYFLECRTYRFRAHSMFDPELYRSKAEVDKWKKRCPIDSFVKRLKKQDLLSDGDMEKLERQVAREIEEAVAFAENGTWEPVEDLTRFVYSERGTT

SEQ ID NO: 59297 - protein, 631 aa, Alkalilimnicola ehrlichei MLHE-1
MCGITGIFDLQAQRPIDVPLLEAMNQTQYHRGPDEGGLHHEPGVGLAHRRLSIIDLSSGQQPLFNEDGSVAVTYNGEIYNFPELTRTLQSAGHTFRTHCDTEVIVHAWEEWGEACVERFRGMFAFALWDRNRETLFLARDRLGIKPLYYAALPDGHLLFASELKALMAHPDLPRQLDPCAVEEYFGFGYVPEPRSIFAGVHKLPPGHTLTVRRGQGGVPASRAYWDVPFAPLPAMGEAEAAEELVRRLREAVEIRLVAEVPLGAFLSGGVDSSAVVAMMAGLSPDPVRTCSIGFDDPRYDESEYARMVAERYRTAHRLDQVNPDDFDLLGKLGALYDEPFADSSALPTYRVCEQARRQVVVALSGDGGDENLAGYRRYRHHLGEERLRGLLPLGLRRGLFGSLARVYPKADWAPRVFRAKATFQALARDAVEGYFQGVSILRDDLRRHLFSSGFRSELQGYSAVDVLRRHAAQAPTDHPLSLVQYLDMKTYLPGDILTKVDRASMAHALEVRVPILDHKLVEWMSGLPPEMKLNGSEGKHLLKKAMEPHLPHEVLYRKKRGFAVPVAEWFRGPLRQRVRDQVLGPRIGESGLFDMDFLNRLVDEHTRGARDHSPALWSLLMFDEFLAKARP

SEQ ID NO: 59298 - protein, 540 aa, Candida tropicalis
MSSSPSFAQEVLATTSPYIEYFLDNYTRWYYFIPLVLLSLNFISLLHTKYLERRFHAKPLGNVVLDPTFGIATPLILIYLKSKGTVMKFAWSFWNNKYIVKDPKYKTTGLRIVGLPLIETIDPENIKAVLATQFNDFSLGTRHDFLYSLLGDGIFTLDGAGWKHSRTMLRPQFAREQVSHVKLLEPHVQVFFKHVRKHRGQTFDIQELFFRLTVDSATEFLFGESAESLRDDSVGLTPTTKDFEGRGDFADAFNYSQTYQAYRFLLQQMYWILNGAEFRKSIAIVHKFADHYVQKALELTDDDLQKQDGYVFLYELAKQTRDPKVLRDQLLNILVAGRDTTAGLLSFVFYELSRNPEVFAKLREEVENRFGLGEEARVEEISFESLKSCEYLKAVINEALRLYPSVPHNFRVATRNTTLPRGGGKDGCSPIVVKKGQVVMYTVIGTHRDPSIYGADADVFRPERWFEPETRKLGWAYVPFNGGPRICLGQQFALTEASYVTVRLLQEFGNLSSDPNAEYPPKLQNTLTLSLFDGADVRMF

SEQ ID NO: 59299 - protein, 467 aa, Flavobacteria bacterium BBFL7
MSTYDVAIIGSGPGGYVAAIRCAQLGMKTAIIEKYNTLGGTCLNVGCIPSKALLDSSHHYDDAMKHFEDHGIEIPGDIKINFEKMIARKAQVVKQTCDGVSFLMKKNDIDVYTGMGSFKDATHINIDGEDGTQTIEAKNTIIATGSKPGSLPFISLDKERVITSTEALTLKEIPKHMIVIGGGVIGLELGQVYRRLGAEVTVIEYMDRITPVMDKMLSKELMKVLKKQKIKFHLSHAVNKVERNGDEVTVTAKNKKGEEVTFTGDYCLVSVGRRPYTDKLNATAAGVKINERGQVETNEHLQTNVSNIYAIGDVVKGAMLAHKAEEEGTFVAETIAGQKPHINYNLIPNVIYTWPEVASVGKTEEELKEAGTAIKVGQFPMRALGRARASGDIDGMVKIIADEKTDEVLGVHMIGARVADLIAEAVTAMEFRASAEDIARMSHAHPTYAEAVKEAALAATADRALHV

SEQ ID NO: 59300 - protein, 219 aa, Photorhabdus luminescens subsp. laumondii TTO1
MQDIIEGFLQFQREVFPKRCELFKRLATSQNPRTLFITCSDSRVVPELLTQSEPGDLFVIRNAGNIVPSYGAESGGVSATVEYAVAVLGVTDIVICGHSDCGAMTTIASCKCMNHLPAITSWLRYADCAKAISQARVHVNETAQIDSMVRENVIAQIANIKTHPSVALGLEQRHLNLHGWIYDIEAGSIDALDGLAGQFVSLADYPHVSATQSVFHHGI

SEQ ID NO: 59301 - protein, 509 aa, Ocimum basilicum
MAALLLLLLLLPAIFLLHHLYYRLRFRLPPGPRPLPVVGNLYDVKPVRFRCFADWAQSYGPIISVWFGSTLNVIVSNTELAKEVLKEKDQQLADRHRSRSAAKFSRDGQDLIWADYGPHYVKVRKVCMLELFSPKRLEALRPIREDEVTAMVESIYHDCTAPDNAGKSLLVKKYLGAVAFNNITRLAFGKRFVNSEGIIDKQGLEFKAIVSNGLKLGASLAMAEHIPWLRWMFPLDEDAFAKHGARRDQLTREIMEEHTRAREESGGAKQHFFDALLTLKDKYDLSEDTIIGLLWDMITAGMDTTAISVEWAMAELIKNPRVQQKAQEELDRVIGYERVMTELDFSNLPYLQCVAKEALRLHPPTPLMLPHRSNSNVKIGGYDIPKGSNVHVNVWAVARDPAVWKNPSEFRPERFLEEDVDMKGHDFRLLPFGAGRRVCPGAQLGINLVTSMIGHLLHHFNWAPPSGVSTDELDMGENPGLVTYMRTPLEAVPTPRLPSDLYKRIAVDL

SEQ ID NO: 59302 - protein, 484 aa, Pseudomonas fluorescens PfO-1
MQTYQVLIIGSGFGGQCAAVNLLKAGIDDFRLLERRDFFGGTWCQNTYPGAAVDVPSPLYSLSFAPYRWTQMFAEQAELHRYTDHVIERFGLRDRVELEANVERVEWDDTEKRWAVHTGTKGIFYAQFLINATGPLSQPVIPHFPGQDRFQGKTFHTNNWDHSYDYHGKRVAIVGSGASAAQVIPAIAPKVAHLHVFQRTAHWVLPRADRTFGRFQRWLLGLKPAYKLLRWMIYWQFETRVIAFKYSKPAIHMVQRHALKFLKRQVTDPELRKKLTPDFTIGCKRVLVSSTYYPALTRPNVTLHSREQGIASLDETGIITTDGQHIDVDLIVWSTGYDATDGVISYPVSGKNAVQLRDVWAQYPRAYLGTSLPDFPNLFIVTGPNTGIGHTSALFIIESQMNYILDCIRTVQAKGLRSIEVRPEAERTYTQMIHREMERTVWKTGGCHSWYQSRSGHVIAMFPGFSFSYHRLTRALKPADHILS

SEQ ID NO: 59303 - protein, 396 aa, Arabidopsis thaliana
MEQREENTERIHRERRKRQSSSIPKTTTLLCPLDLILEILLRLPVKSVLRFRCVSKLWLSTTTDPYFTNSYEARSSTRPSLLMFFKNKDKLFVFTFPHHNQNSKETHSYSQHVDSYHIKYPKYCCFPFTESVHGLISFRISTKPIIWNPTMRQFLILPKPEKSWKGLSVFLGYDPVEGKHKLMCMNRDNTSDECRVLTLGSAQEKWRRIKSNLKHRSILRYYGQCINGVIYYQAYIDQMGFISNPTIMSFEVRSEKFDTITLPSGSFANMLIPYQGRLACVNNTMDDVNGGITLWTLEDAEKHIWSCKLFLAPLAHYDRSLKTDFKLDGITHAGEFIYVLSTFLKSFYVLYFDPKKNSFRKVEFRGTAYEVFRLSHGLGNKKVNRLYTFSHHVTSF

SEQ ID NO: 59304 - protein, 1038 aa, Klebsiella pneumoniae
MLRYTCNALFLGSLILLSGCDNSSSSSSSGSPDNPGNPDNQDVVVRLPDVAVPGEAVMATANQAVIHLVDIAGITGTSPTDYSSKNLYLWNNETCDALSAPVADWNDVSTTPAGSDKYGPYWVIPLNKESGCINVIVRDGTNKLIDSDLRVSFGDFTDRTVSVIAGNSAIYDSRADAFAPLSAGRLPKLTGLIKRRCCGRGEDQPIVRLYYSHSSKVAADSEGKFTDRYLNWTPTTISQQVSMRFPQLSGYAAFKLPDDAKTDELLQGETVAIAAAEDGILISATQVQTAGVLDDTYAPAAEALNYGAQVSDGGVNFRLWAPTAQQVDLVLYSADKKVLASHPMTRDSTSGSWTWQGGSDLKGAFYRYALTVYHPQSRQVEQYEVTDPYSHSLSTNSEYSQVVDLNDSDLKPEGWDSLTMPHAQKTKADLAKMTIHESHIRDLSAWDQTVPAELRGKYLALTAGDSNMVQHLKKLSASGVTHVELLPVFDLATVNEFSDKVADIQQSFSHLCEVNSAVKSSEFAGYCTSGSTVEEVLNQLKQSDSQDNPQVQALNTLVAQTDSYNWGYDPFHYTVPEGSYATNPEGTTRIKEFRTMIQAIKQDLGMNVIMDVVYNHTNAAGPTDRTSVLDKIVPWYYQRLNESTGSVESATCCSDSAPEHRMFAKLIADSLAVWTTDYKIDGFRFDLMGYHPKAQILSAWDRIKALNPDIYFFGEGWDSNQSDRFEIASQINLKGTGIGTFSDRLREPCAAAARSIPAMRCVKTRGLAAARRVAKRADHPERRPGSSPGRPDSSGDGRNLADFILIDKDGAVKKGSEIDYNGAPGGYAADPTEVVNYVSKHDNQTLWDMITYKAAQQADLNTRVRMQAVSLATVMLGQGIAFDQQGSELLRSKSFTRDSYDSGDWFNRVDYAMQDNNFNVGMPRISDDGSNYDVISRVKEMVATPGEAELKQMTAFYRELTGLRKSSPLFTLGDGSAVMKRVDFRNTGPDQQAGLLIMTIDMACRQGRVSIAGLMTGGSDQRASESRTSMTSPATICS

SEQ ID NO: 59305 - protein, 517 aa, Candida tropicalis
MIEQLLEYWYVVVPVLYIIKQLLAYTKTRVLMKKLGAAPVTNKLYDNAFGIVNGWKALQFKKEGRAQEYNDYKFDHSKNPSVGTYVSILFGTRIVVTKDPENIKAILATQFGDFSLGKRHTLFKPLLGDGIFTLDGEGWKHSRAMLRPQFAREQVAHVTSLEPHFQLLKKHILKHKGEYFDIQELFFRFTVDSATEFLFGESVHSLKDESIGINQDDIDFAGRKDFAESFNKAQEYLAIRTLVQTFYWLVNNKEFRDCTKSVHKFTNYYVQKALDASPEELEKQSGYVFLYELVKQTRDPNVLRDQSLNILLAGRDTTAGLLSFAVFELARHPEIWAKLREEIEQQFGLGEDSRVEEITFESLKRCEYLKAFLNETLRIYPSVPRNFRIATKNTTLPRGGGSDGTSPILIQKGEAVSYGINSTHLDPVYYGPDAAEFRPERWFEPSTKKLGWAYLPFNGGPRICLGQQFALTEAGYVLVRLVQEFSHVRSDPDEVYPPKRLTNLTMCLQDGAIVKFD

SEQ ID NO: 59306 - protein, 560 aa, Listeria monocytogenes
MSNKVKSDIEIASKAEILPVTTIAEHLGLDADALELYGKYKAKLSYDTIHSLKDKEPGKLVLVTAINPTPAGEGKSTVTVGLGDALSKKDKKTVIALREPSLGPTMGIKGGATGGGYAQVIPMEDINLHFTGDFHAITAANNALSAFIDNHMQQGNDLEIDGRRIVWKRVVDLNDRALRKVVVGLGGPIQGVPREDGFDITVASEIMAIICLASDLKDLKKRLSEIVIGYNYKKEPITVGEMGYEGALTLLLKDALKPNLVQTLEHTPAIVHGGPFANIAHGCNSVSATSTALRLGDYVVTEAGFGADLGAEKFLDIKVPALGKAPDCVVIVATIRALKMHGGALKTELSEENVDALAKGFTNLQKHTESIQTFGIPYVVAINKFITDSDAEVAKLEALCEEHGIPFSLTEVWEKGGDGGLELADKVIAAVESGAADYKRIYDDAWSMEEKLEAIVTKVYGGIGVELSSKAQKQIVEFKKYGWDRYPICMAKTQYSLSDDPTLLGRPTDFVIHIREFIPKLGAGFVVALTGDVMTMPGLPKKPAALNMDVDENGNAQGLF

SEQ ID NO: 59307 - protein, 519 aa, Glycine max
MASSASTTLSSPFLRLEFPSSTKQRSSISIRASVSEKPPLPAVSVTSPEPSKLPIRKIPGDCGFPVIGPFKDRQDYFYKQGRDEFFKSRIQKYQSTVFRTNMPPGPFLAPDPNVVVLLDAKSFPVLFDNSKVEKKDVFTGTFMPSTELTGGYRVLSYLDPSEPKHALLKQLMFFLLKSRRAHVISEFHASYKELFHALEANLAEAGKASFGDANDQAAFNFLSRSLFNSNPADTKLGLDGPKIVQKWVLFQIGPILRLGLPQFLEESTIRTFRLPFSLIKKDYQRLYDFFYESSGLVLDEAERLGITRDEACHNLLFATCFNSFGGMKLFFPNVLKWIGRAGVKLHARLAEEIRSAVRSGGGEISMAAMEKMPLMKSVVYEAFRIDPPVALQFGRAKRDLIIESHDHAFQVKEGEMLFGYQPFATKDPRIFERAEEFVGDRFVGEEGEKLLKHVLWSNGPETESPTLGNKQCAGKDFVTLVSRLFVVEFFLRYDSFEIQVGTSPLGSSVTITSLKRASF

SEQ ID NO: 59308 - protein, 563 aa, Propionibacterium acnes
MKSDLEIAREAHLDPIEKVAARAGIDEKYLEPYGRGVAKVDLDVVTHNRDHSCGKYVVVTAMTPTPLGEGKTTTAVGLAQGLEKIGKHSVLALRQPSMGPTFGIKGGAAGAGYSQVLPMEKLNLHLTGDFHAIGAAHNLLAAMIDNHLHQGNELDIEPHSISWRRVVDINDRALRNTIVGLGSRVDGVPRETGFDITAASEVGVILSLATSLSDLRARLGRIVIGYNRSKEPVSAEDLHAAGSMAVILKDALKPNLLQTTENSPVLVHAGPFGNIATGNSSVIADRVGIGCGDYLLTEAGFGADMGAERFFNIKCRIGGMRPDAAVLVATVRALKTHAGRYKVIPGKPLPPAMLEDNPDDVLAGAANLRKHIEIVREFGVSPIVALNVFPTDHPDEIDAVRKVAEAAGAHFASSTHVVDGGDGAVDLAHAVVAACDHKADFRYTYDLEDSLVEKLTKVATKVYGADGIDIAPAAAKELAHFEDLGYGTFPVVIAKTHLSLSHDPSLKGAPTGWRLPVREVRAAVGAGYIYAICGDMRTMPGLGRHPAAERIDIDDNGETIGLF

SEQ ID NO: 59309 - protein, 332 aa, Candidatus Desulfococcus oleovorans Hxd3
MKQKKEITDITQQAIDVLKNEAKGILEVAANLDHQFEKAVDLICRSKGRLVVSGIGKSGIVGQKIVATLNSTGTRALFLHPVEAMHGDLGIVGPKDVFLGLSNSGETEELTGLIPTIRNVGCRVIAFTGNTHSSLARQSDIVINVGVKKEACPLGLAPTTSTTALMAMGDALAVSLSIRKDFKSSDFQRFHPGGSLGRRLALNVSEIMLTGDRVPAVPVKTPIEEALAVLDRQNLGALLVVRKNNTLAGILTDGDLRRLYLAKEPLSGGPVDSIMTKNPLTVHPDSPVYDALNILEQHQVTALPVTAAGKKVCGILHLHDILGKGAFKFNGR

SEQ ID NO: 59310 - protein, 517 aa, Candida tropicalis
MIEQILEYWYIVVPVLYIIKQLIAYSKTRVLMKQLGAAPITNQLYDNVFGIVNGWKALQFKKEGRAQEYNDHKFDSSKNPSVGTYVSILFGTKIVVTKDPENIKAILATQFGDFSLGKRHALFKPLLGDGIFTLDGEGWKHSRSMLRPQFAREQVAHVTSLEPHFQLLKKHILKHKGEYFDIQELFFRFTVDSATEFLFGESVHSLKDETIGINQDDIDFAGRKDFAESFNKAQEYLSIRILVQTFYWLINNKEFRDCTKSVHKFTNYYVQKALDATPEELEKQGGYVFLYELVKQTRDPKVLRDQSLNILLAGRDTTAGLLSFAVFELARNPHIWAKLREEIEQQFGLGEDSRVEEITFESLKRCEYLKAFLNETLRVYPSVPRNFRIATKNTTLPRGGGPDGTQPILIQKGEGVSYGINSTHLDPVYYGPDAAEFRPERWFEPSTRKLGWAYLPFNGGPRICLGQQFALTEAGYVLVRLVQEFSHIRSDPDEVYPPKRLTNLTMCLQDGAIVKFD

SEQ ID NO: 59311 - protein, 116 aa, Glycine max
TRVVCILKRLRGKDDVINAGVAGCCTGLALSFPGAPQALLQSCLTFGAFSFIMEGLNKQQPALAVPISWKKPVQHNASPPLVLPLQLPLPARGKDAFSFFSYSLKKRSKGPYPTSR

SEQ ID NO: 59312 - protein, 559 aa, Sinorhizobium meliloti
MGEVKSDIEIARAARKQPIMEVGAKLGIPPEHLLPYGHDKAKVSAEFIAAQNEKRNGRLILVTAINPTPAGEGKTTTTVGLGDGLNRIGKKAIVCIREASLGPCFGIKGGAAGGGYAQVVPMEDINLHFTGDFHAITSAHNLLSALIDNHIYWGNEQAIDIRRIAWRRVMDMNDRALRQIVGSLGGVANGYPRETGFDITVASEVMAILCLAMDIKDLEKRLGNIIIGYRRDKSPVFARDIKADGAMAVLLKDAMQPNLVQTLENNPAFVHGGPFANIAHGCNSVVATTTALKLADYVVTEAGFGADLGAEKFFDIKCRKAGLTPDAAVIVATVRAIKMNGGVKREDLGRESVEAVRKGCANLGRHIQNVKKFGVPVLVAINHFTSDTEAEVRAIKDYVRTLGSEAVLCKHWAEGSAGIEELAYKVVDLANAGHSQFSPLYPDEMPLFQKIETIAKDIYHASEVIADKLVREQLRTWEDQGYGDLPICMAKTQYSFSTDPNLRGAPTGHAVPIREVRLAAGAGFIVVITGEIMTMPGLPKVPSSERIRLNEQGYIEGLF

SEQ ID NO: 59313 - protein, 444 aa, Candidatus Desulfococcus oleovorans Hxd3
MNFDFTNEETLIEQLGEPRVTSPILREPNIDPEKDFTDDTARVLVNVNPDIIQARIQQGKTPLSFEMAGPRKKIFFDASKVRCALVTCGGLCPGLNDIIRAIVLELYYRYGVKSIHGIRYGLEGFIPDCGHEVVDLTPELVANILNTGGSMLGSSRGPQDISQIVDSLERMHVGILFMIGGDGTLMAATKIAEEIGRRNLKISVVGIPKTIDNDIHLISRSFGFDTAVDIATEAIKGAHNEAEGYPNGIGLIKLMGRHSGFIAATATLARQDVNFVLIPEIDFDLEGDHGLLAALEQRLKRRKHAVIVVAEGAGQKFFGDGTNATDASGNIRLNDIGLFLRERITAHFKSRGIPISLKYIDPSYMIRSLPANANDSVFCGFLGRDAVHAAMAGKTRMLVSHWNNHFVHVPMSLTVGKRKQVSPHSKLWWTVLEATGQGRFTNSG

SEQ ID NO: 59314 - protein, 512 aa, Candida tropicalis
MLDQILHYWYIVLPLLAIINQIVAHVRTNYLMKKLGAKPFTHVQRDGWLGFKFGREFLKAKSAGRSVDLIISRFHDNEDTFSSYAFGNHVVFTRDPENIKALLATQFGDFSLGSRVKFFKPLLGYGIFTLDAEGWKHSRAMLRPQFAREQVAHVTSLEPHFQLLKKHILKHKGEYFDIQELFFRFTVDSATEFLFGESVHSLKDEEIGYDTKDMSEERRRFADAFNKSQVYVATRVALQNLYWLVNNKEFKECNDIVHKFTNYYVQKALDATPEELEKQGGYVFLYELVKQTRDPKVLRDQSLNILLAGRDTTAGLLSFAVFELARNPHIWAKLREEIEQQFGLGEDSRVEEITFESLKRCEYLKAVLNETLRLHPSVPRNARFAIKDTTLPRGGGPNGKDPILIRKDEVVQYSISATQTNPAYYGADAADFRPERWFEPSTRNLGWAFLPFNGGPRICLGQQFALTEAGYVLVRLVQEFPNLSQDPETKYPPPRLAHLTMCLFDGAHVKMS

SEQ ID NO: 59315 - protein, 361 aa, Cryptococcus neoformans var. neoformans JEC21
MVADTVHVGQHLAGHPSVHLFGHEIVLDVSIPALILSTVGAAFLLRYTLSIFRLFLELTVLPGKDIKSFQSRKGETWAVVTGCTSGIGLEFARQLAAKKFNIILVGRRQSALTDLSKEIESKYDVHTKSVTVDVSTPGSARDDALTQLELLAQNLDVGILINNVGASHSMPVAFHETERSEMSRIIETNVTWTYLVTRSILPSMVARSKQKGAPKSLVITIGSLSGRIPSPLLASYSGTKAALATWTKALAEEVKPQGVIVELVQAAFVVSNMSKIRKSSPFVPTPAPFVRSTLNSIGLPRGAQGRPHERTPFWSHAILDYVVGFAGYVSEMAGIKVILGMHKDIRKRALKKAARDEKKAE

SEQ ID NO: 59316 - protein, 509 aa, Aspergillus oryzae
MGKNLGFVRAYYTVALACTGSFLFAYDTGIIGGVLTLKSFQNSFRYTEKQKSTINSNSNSLLQAGAFFACFFVWPFTAKYGRRWSIALASFIFCIGAIIQVIPTHSVAAFYVARVISGIGVGMATVIVPMYTSEMAPKSIRGKLGSFFQGFFVLGVFFSYWIDYAVEKHIPETSDSQWQIPIGLQLVPGGVLGLGMLFLKESVRWLAKKGRHDEAMRSLVWIRGGEETEEVRAEMAEILDGIEAENLATEGVTWKEILRVPGNLHRMCIAVTIQIGVQITGNTSLAYYAPQIFQAVGAGDNSLFISGFFGVAKVISCWFFLLFLVERIGRRWSLIIGAFLMGSLMLIVGILAKLFPPDPDATTISSAGIASILMVYFEAMCYNMSWGPVPWLYMSEIFPTRIREVGIAVGTATQWLFNFVFSQATPHALDSMGWGMFLMFCIFNWILVVYAWLFIKETTGKSLEEMEEVFNSRVGLYHKERPLDEQVQNKHSTERPTSTMRFAVIYVEG

SEQ ID NO: 59317 - protein, 231 aa, Haemophilus somnus 129PT
MYKKMSWLLLVFHNAIFPIGNDLSENKMTNIKLNYHKTHFLMSAPNIKVLPEDSGIEIAFAGRSNAGKSTALNALTQQKNLARTSKIPGRTQLINLFQVEPNCKLVDLPGYGYAAVPEQMKLQWQKSLGEYLQKRECLGGLVILMDIRHPLKDLDQQMIEWAVSADLPVLLLLTKADKLSQSARSKQVKMVREAILPFQGDVQVEAFSAQNKIGIERLSEKLDQWFSPLFS

SEQ ID NO: 59318 - protein, 419 aa, Streptococcus pyogenes MGAS8232
MKDVIYDVEEVPKAGMLVGLSFQHLFAMFGATVLVPILVGIDPSVALLSSGLGTLAHLSVTKFKIPAYMGSSFAYIAAMQLLMKTNGIGAVAQGAMTGGLVYLIAALIVKAIGNDWIDKILPPIVVGPIVMVIGLSLASTAVNDVMLKNGNYNLTYLVIGLVTLLSVIFFNIYGKGIVAIVPLLLGLLVGYVVALLVGVLTGQEIVDFTNVAQAKWFSIPSVEIPFLTYGVKFYPSAILTMAPIAFVTMTEHFGHIMVLNSLTKRDYFKDPGLEKTLTGDGFAQIIAGFLGAPPVTSYGENIGVMALNKIFSVYVIAGAAVIAALLSFIGKVSALIQSIPTPVIGGISVALFGVIASSGLKILIESKVDMDNKKNLLIASVILVSGIGGLMLQVNGLQISGVAFSTLLGIILYQVLPEK

SEQ ID NO: 59319 - protein, 932 aa, Vibrio parahaemolyticus RIMD 2210633
MRVRVLLFKNVLTALKALQPLQFGEAFFCSHGWVCKSCWSIAGGVMSQGCRKTTCPYCGVGCGVEVNSKGIVGDDNHPANAGALCVKGVALAESLNMPSRLLYPKLVTKERPQGKEIHWSQATNMIAEKIHQAKAEFGPDSVAMYVSGQLLTEDYYVANKLMKGYVGSANIDTNSRLCMSSAVAAHVRAFGEDVVPVNYDDIDNTELLIICGANTAWTHPVLFRRIQQARENNPNLKLVVIDPRETVTAQQADLHLPIKNDGDVSLFNGLLKFLIEKQGIDSQCINSYTSGFDALAKEITQQRYNVTNLATDVGVSQDKLTTFFQWFAHSPTAITLFCQGVNQAENGVDKGNAIINAHLATGKIGRVGCGPFSITGQPNAMGGREVGGLANQLAVHRGFDGESIQQVQAFWESPEIATKPGLKAVELFEAVERGEIKVLWIMATNPVVSLPDNQFVKRALERCPFVIVSDITAESDVARYADLLLPAAGWGEKQGMVTNSERRISRQRQFQNPPGEAKSDWWAVSQVGQALCTLEETKNGFDFDSEHEVFCEYAAMTGMNKKSPLKLDLSQYANLNEQEYEEWRPTQWGGERPFSDGVYSHPDGKARFVVTRESPQRLARTKGWWLNTGRQRDQWHTMTRTGHIAHLAASELEPTVYMNALSATQNRLKAGQLAKLFQPSSNTSIHAKIAIDDGLGFQELFMSMHWAGRYGGESSVNAIVNSAKDPISGQPAFKSSYVEVQDAAVKTYGMFIGTQFDSSKFLYSAFQAESNLGIWRFAHDKRPKKQSFCRTEKSRRIAIDIVQGWLAVDYDLVGDVRIIRSVLVVSSEPIQTDYTNFTGLTGKPMELSQLLTITQSQSSAKLVCSCFRVTDKQIHDAMEKQDCTSLTQLQNKLKCGTNCGSCISQIKQMVDSHQHQKGKQQASQQSLAIQIK

SEQ ID NO: 59320 - protein, 293 aa, Listeria monocytogenes str. 1/2a F6854
MNKENPLNKYHTGKFEKQRQDYPGLQSKMTPVPDTGESSYQGANKLTGKKAFVTGGDSGIGRAAVIAYAREGADVAINYHPDEEVDAQEVKAIVEEAGQKCVLLPGDLRKEGLAKDLVKKAYNELGGLDILVLNAGLQQYQLDIQKLPAEQLRDTFEVNVFSVVFAIQEALNYLKAGASIILTSSIQGVKPSAHLVDYAMTKSSLISLTKSLAAQLGEKGIRINAVAPGPIWTALQISGGQPQDSIPEFGQDQPLGRAGQPAELASAYVLLASDEASYTTGQVYGITGGAPIN

SEQ ID NO: 59321 - protein, 176 aa, Glycine max
  misc_feature (102)..(102): Xaa can be any naturally occurring amino acid
VAVLLTRKTDGLLLTGSQDRTVKCWDLSTADLEEPDEKHRFKSHYTIQAHDKDINAIAIAPNDKIFATGSQDKLAKIWNLQEGTLMGTCKGHKRGVWSVQFXPVDQCLATSSGDRTIKLWSLNDFSCLRTFEGHTNSILKVDFLTSGLQLVSCGSDGLVKLWTIRSNECVATLDNH

SEQ ID NO: 59322 - protein, 313 aa, Candida glabrata CBS 138
MSGSPEFQRFARALRQQITKVQQQGGRPGGPPRGGAGGAFAGIGGLLVLGAGALFFNNALFNVDGGHRAIVYSRIGGVSQKIFSEGTHIIIPWIETPIVYDVRAKPRNVASLTGTKDLQMVNITCRVLSRPNVGQLPTIYRTLGQDYDERVLPSIVNEVLKAVVAQFNASQLITQREKVSRLIRDNLVRRASGFNILLDDVSITYMTFSPEFTQAVEAKQIAQQDAQRAAFIVDKARQEKQGMVVKAQGEAKSAELIGDAIKKSRDYVELKRLDTAKDIAKILANSPNRVVLDNEALLLNTLVDARSATGSKK

SEQ ID NO: 59323 - protein, 188 aa, Streptomyces avermitilis MA-4680
MTGAGAGAGIQAAEESPIVLVVGVTGSGKTTVGKAVAEQLGLEFVEGDDFHPAANIAKMTAGHALDDADREPWLRALADRIRHSAAAGEGLVVACSALKRAYRDKLRAAAGPGLWCLYLALDRDTARDRVSRRTGHFMPAQLVDSQFETLEPLEPDEPGMTMDATAALATILTRVRAAVPRSGRGTAP

SEQ ID NO: 59324 - protein, 84 aa, Zea mays
RKVVRDNIQGITKPAIRRLAWRGGVKRISGVIFEETRGVLKIFLEKVIRDAVTYTEHARRKTVTAMDVVFALKRQGRTLYGFGG

SEQ ID NO: 59325 - protein, 544 aa, Caulobacter crescentus CB15
MLGLMQDTPLTLSSLLDHAARFHGEVEIVSREPGGVTRTNYARVAVRARKLAAALRRRGLREGDRVASLALNSARHLELYYGATGAGGILNTVNPRLFPEQIAFILRHAENRIVFFDPAFGPLLETLVDQAPQVEAYVCLSSAGDMPSLRLPNLIAYEDLLAPEADDAPWTVVSENAGAILCYTSGTTGDPKGVLYSHRSLALHAFVATGADGMAISRRDSILLVTPLFHVNAWGIPFSAAMCGAKLVLPGAAVDGENLFNLMRAERCTFSLGVPTVWLGFLDYVATHREELDLAGLALERILVGGSAAPRSMIERFDYMLGVYVIHAWGMTETSPLATIGTPLPEHAFLDRQARYDIQALQGRAIYGVELRIVDADGVVAPHDGMAVGDLQVRGPWVVRRYFKADAPATTEDGWFPTGDVAKIHPNGYLQLTDRSKDIIKSGGEWISSVDLENVAIAHPDIREAAVIGVPHPKWQERPLLIIVPAPETTPDKDDILKFLASRVARWQVPDDVVIVESLPHTATGKLLKAKLRETYRDYLAEPA

SEQ ID NO: 59326 - protein, 1194 aa, Arabidopsis thaliana
  misc_feature (152)..(152): Xaa can be any naturally occurring amino acid
  misc_feature (196)..(196): Xaa can be any naturally occurring amino acid
  misc_feature (561)..(561): Xaa can be any naturally occurring amino acid
  misc_feature (594)..(594): Xaa can be any naturally occurring amino acid
MRGYIRSTSVVILIDFGATSCFIHEGIVKHKGWRVTETRGFGVKVGGGRVIRGSGKCADIALEVQGIEFIEDFLLFDLGDLDVVLGFSWLARLGDTRAKWGQLRLSWQIGNTWVTLHGDPELCREQVSLRAMERVIKYTGAAYLLELSTLFXSYEPQDKKAIVQDIKRVLDNYGSVFQMPKGLPPSRNREHAITLXMKNEIEKLVREMLDSQIIRPRHMPHPRPTWIRPCSSPILLVKKRDGGWRFCVDYRALNKATIPDRYLIPVIEELLDELKGVAMFSKLDLKSGYFQIRMKAEDVEKTTFKTHQGHYEFLAATSSFQALKKAVTQLPVLILPDFQKQFTVETDASGTGIGVVLSQEKRPIAFLSQGFSSQGRIKSVYERELLAIVMVVTKWKHYLAGKEFVIKRDQRSLKHLLDQNAVSTIQQRWASKLIGLKYKIEYKPGVDNKVADALSRKPQTEVFSQLTLQATHTIDITALKEAVKADKELSKLLQDIEQGCQKNGDFTVEDGVPYRKGCLVVPVVTPFIPKLLETFHTSVVGGHEGALKTFKRLTKENKYSXTLSPAGLLAPLPIPQQTWEDISLDFVEGLPVSXRVLVVVDMLSKYGHFIALKHPFTAKTVVEAFIRDVIKLHEFPSMMVSDRDKIFLSHFWTELFKLQGTALHKSFAYHPQTDGQTEVDNRCLESYLRCFTGRRPTTWIQWLPWAEYWYNTSYHSATKTTPFMAVYGREPPAMIRYGDVPTPNANVEELLRDRDGILMELRENLVLAQNRMCKDANKHRRDVVFEVDEWVYLKLRPYRQNSVVHRKNEKLAPRYFGPYQIISKVGNVAYKLKLPAHSHIDPVFHVPQLKLAVHAAYSPQELPKIMTPLLEWAVGPEKLLDIRKAESGNSAEVLVQWSGLSELEPLITLVQQFPKFDLEDKINLLRESIDRLRVALGKMRRKMRSGGRKARALEKYLRKAYQDPDLYRNCDDISELKIIEDRLMRTRKHLMDCLEKKEKSQFVSDQKPSTDEIFNHGGFSSPFSQIASDFGQNPSTSTLSSSQIASNFGQNPSTYSPNSSQIVCFYQNHGEPRSSQVTCFDQNHIFFVDESLFDQSGYLVNDDQSGYLVNVNLGFVDSLCEIEEEKNGMSVPQETQTSTLFTEDQSFWENLFKDFNNENLEVPLQDHSSTNEKDEFMIDISEYLSEEAMEWPLV

SEQ ID NO: 59327 - protein, 636 aa, Lithospermum erythrorhizon
MDTQTKTDQKDIIFRSKLPDIYIPKHLPLHSYCGENISQFSSRPCLINGSNDRVYTYAEVEITSRKVAAGLHKHGIKQTETIMLLLPNCPEFVFAFLGASYIGAVSTTANPFFTSSEIIKQAKASKTKLIITVSTTVPKLKDFSQENHVKIMCIDDKIDGCLHFSSDLENSDETTLPDVEIRPDDVVALPYSSGTTGLPKGVMLTHKGLVTSVAQQVDGDNANLYMHHEDVVMCTLPLFHIYSMNSILLCGLRVGAAILLMHKFEIVTFLELIQRYKVTIGPFVPPIVLAIAKSNVVDQYDLSTVRTVMSGAAPLGSELEDAVRAKFPNAKLGQGYGMTEAGPVLAMCLAFAKEPFEIKSGACGTVVRNSEMKIIDTETGASLPRNQSGEICIRGDQIMKGYLNDPEATERTIDKEGWLHTGDIGYIDDDDELFIVDRLKELIKYKGFQVAPPELEALLVPHPNVSDAAVVSMKDEGAGEVPVAFVVRSNGSTTTEDEIKQFVSKQVIFYKRINRVFGVDSIPKSPSGKIVRKDLRAKLAARFLNGPTTNVVPNGGNVAKDNVPNGVSNGVSKANGGVAKEGVANGVPTDGDYGVATKGVANGISNGVYKQVSNGVVSNGVANGIVSNGIANGVHN

SEQ ID NO: 59328 - protein, 521 aa, Caulobacter crescentus CB15
MTSKAQSRVVLVTGGADGIGWAACQRFARAGDQVLVADRNVERARERADSLGPDHHAIAMDVSSEAQIREGFEQLHREFGRLDVLVNNAGVTDPQPTATLDQTAEEVARLQAINVTGAFLAAREAGRLMIEQGHGAIINLASGAGLVALAKRTSYSASKAAVISLTRTLACEWAAKGVRVNAVLPGYTRTQMVQDQIDAGLLDPSIVLSRIPLGRMGEPEEMAEGAFFLASDAASYVVGATLVVDGGYTVYGGSGPASTTPAPSPLAPSPRVSAITGGGRGIGRCVVDLFHAAGDRLLVIERDAEGAKALAEALGDEHIVVQADITDVAAVEAAFAQAQARWGRLDVLINNAGAADVFKPSLEQTAQDFTSVYDLNFSGPLATAKAAARLMSQGGVIVNLGSIAGLGALPQRNAYCAAKAAVTMMSRSLACEWASAGIRVNTVAPGYIETPAVLALKSAGRAQFDKIRRRAPIGRLGDPMEVARTIAFLASPAASYVAGATLTVDGGWTAFGDAGDASDIL

SEQ ID NO: 59329 - protein, 555 aa, Staphylococcus aureus subsp. aureus COL
MTHLSDLDIANQSTLQPIKDIAASVGISEDALEPYGHYKAKIDINKITPRENKGKVVLVTAMSPTPAGEGKSTVTVGLADAFHELNKNVMVALREPALGPTFGIKGGATGGGYAQVLPMEDINLHFNGDFHAITTANNALSAFIDNHIHQGNELGIDQRRIEWKRVLDMNDRALRHVNVGLGGPTNGVPREDGFNITVASEIMAILCLSRSIKDLKDKISRITIGYTRDRKPVTVADLKVEGALAMILKDAIKPNLVQSIEGTPTLVHGGPFANIAHGCNSILATETARDLADIVVTEAGFGSDLGAEKFMDIKVREAGFDPAAVVVVATIRALKMHGGVAKDNLKEENVEAVKAGIVNLERHVNNIKKFGVEPVVAINAFIHDTDAEVEYVKSWAKENNVRIALTEVWKKGGKGGVDLANEVLEVIDQPNSFKPLYELELPLEQKIEKIVTEIYGGSKVTFSSKAQKQLKQFKENGWDNYPVCMAKTQYSFSDDQTLLGAPSGFEITIRELEAKTGAGFIVALTGAIMTMPGLPKKPAALNMDVTDDGHAIGLF

SEQ ID NO: 59330 - protein, 526 aa, Coprinopsis cinerea okayama7#130
MAGGPSADGGGIGANAPKNKWAGILMTAFSAFGGILFGYDTGVISGIKEMNEWLRQFGNPDPTHPSGYNISSSTESLVVSILSAGTFFGALLGAPTADHLGRKWGVVVACLVFSVGIAMQTGAKDVPLFVVGRVFAGLGVGLVSVLIPMYQSECSPKWIRGAVVSTYQWAITIGLFLAACVNYGTKDYSGAKSYHIPIAIQFAWAAILAGGMALLPESPRWLIKRGRTEHAAAALSRLTGLPADDPAVQSELAEIQDNLDAERVMDESTYLDCFKFNNNKIAWRTLTGIFIQAWQQLTGINFIFYYGTTFFQRAGIDNPFLITIATNIVNVFMTLPGMWGVERFGRRSLLLWGAAGMAICEFIVAIVGVTVSDTNLAGQKVLIAFVCIYIAFFASTWGPVAWVITGEIFPLQVRAKAMSLSVASNWLWNFGIGYATPYLVNNEPGSAGLEVKVFFIWGSTCACCLIFTYFCVPETKGLSLEQIDHMYQNVYPWQSHVYRRRLIADGGADISSTPDQKEEISANEKA

SEQ ID NO: 59331 - protein, 512 aa, Candida tropicalis
MLDQIFHYWYIVLPLLVIIKQIVAHARTNYLMKKLGAKPFTHVQLDGWFGFKFGREFLKAKSAGRQVDLIISRFHDNEDTFSSYAFGNHVVFTRDPENIKALLATQFGDFSLGSRVKFFKPLLGYGIFTLDGEGWKHSRAMLRPQFAREQVAHVTSLEPHFQLLKKHILKHKGEYFDIQELFFRFTVDSATEFLFGESVHSLRDEEIGYDTKDMAEERRKFADAFNKSQVYLSTRVALQTLYWLVNNKEFKECNDIVHKFTNYYVQKALDATPEELEKQGGYVFLYELAKQTKDPNVLRDQSLNILLAGRDTTAGLLSFAVFELARNPHIWAKLREEIESHFGSGEDSRVEEITFESLKRCEYLKAVLNETLRLHPSVPRNARFAIKDTTLPRGGGPNGKDPILIRKNEVVQYSISATQTNPAYYGADAADFRPERWFEPSTRNLGWAYLPFNGGPRICLGQQFALTEAGYVLVRLVQEFPSLSQDPETEYPPPRLAHLTMCLFDGAYVKMQ

SEQ ID NO: 59332 - protein, 582 aa, Vibrio vulnificus
MLSDIDICRTTPLKPIEQIAAKAGLLADEFETHGLYKAKVSARCVKRLAEQQDGKLVLVTAITPTPLGEGKTVTTIGLAQGLQSLNQSVMACIRQPSMGPVFGVKGGAAGGGYSQVAPMDELNLHLTGDIHAVTAAHNLAAAAIDARIYHEQRAGYQAFEARTGLPALRIDPDRVVWKRVMDHNDRALRKVRVGINDEGKTINGFEREEGFDISAASELMAILALSKNLQDMRERIGKVVLAYNLDSEPVSAEQLQVAGAMTVTLKEAIKPTLMQTLEGVPTLIHAGPFANIAHGNSSIIADEIALKLSSYVVTEAGFGSDMGLEKACNIKSSTSHKAPDCVVIVATLRGLKANSGLYDLKPGMPLPDALFQPDRAALESGFSNLKWHIDNAQKYGLPVVVAINQFPQDSAEELGQLKLWIQQLPLNVRVAISEGFAKGGKGMEAVAREVIEACDAPANFRPLYRAEQTLEEKIITVCTKGYGCGEVQFSDTAKQQLALYQTLGFGELAVCMAKTPLSISSDSSLKGAPSGFTIMVREVRLCAGAGFVYALTGNVMTMPGLPDIPAFMALDIDENGDIVGLS

SEQ ID NO: 59333 - protein, 447 aa, Photorhabdus luminescens subsp. laumondii TTO1
MSCLLSLSSFLGSIQRRDEYQPEYLQAVREVFTSLWPFLEQNPKYREYSLLERMVEPERVIQFRVCWVDDQGKVQVNRAWRVQFSSAIGPYKGGMRFHPSVNLSILKFLGFEQTLKNALTTLPMGGGKGGSDFDPKGKSQGEVMRFCQALMTELYRHLGPDTDVPAGDIGVGGREVAFMSGMMKKLSNNTACVFTGKGLSFGGSLIRPEATGYGLVYFVNAMLKRHGMGFEGMRVSVSGAGNVAQYTIEKCMALGAKVVTASDSGGTLVDEDGFTPEKLTHLEEIKNQRYGRVEEYARERGLTFLKGLQPWSVPVDIALPCATQNELDLDAAKVLIKNGVKAVAEGANMPATISATEAFIEAGVLFAPGKAANAGGVATSGLEMAQNAARLGWKAEKVDARLHHIMLDIHHACVEYGGEGKQINYVQGANIAGFVKVADAMLAQGIL

SEQ ID NO: 59334 - protein, 557 aa, Zymomonas mobilis
MLSDIEIARAATLKPITEIAGRLNIPDESVLSYGHTIAKLDGEYLNSLSSKPRGKLVLVSAITPTPAGEGKTTTTVGLGDAFNRIGKKAVICLREPSLGPCFGVKGGAAGGGYAQVVPMERINLHFTGDFHAITSAHDLLAAMIDNHVHWGNEPVMDRNSITFRRVIDMNDRMLRNMVIGLGGKANGYPREGGFRYAAASEVMAILCLASDLKDLRSRLERIIIGEDNDHNPVAAAKIKAAGAMTALLKDALQPNLVQTLEGNPALIHGGPFANIAHGCNSLIATKAALHLGDIAITEAGFGADLGAEKFFDIKCRQANLEPDAVVLVATIRALKMHGGVALADLKNENIAALETGFANLARHAENLAKFGVKTVVAINRFHSDTEAELDKLQDLCASIGLDSAVCTHFTDGGAGAEDLARKLSAILDAPKEDSFRLLYPDEMPLWKKIETIAKEIYRAGEVVPQGTVLKKLKSFEEQGFGDLPVCIAKTQSSFSADPKAKNAPTGHIFPIREVRLNAGAGFIVAISGNIMTMPGLPRHPAAENIDINEDNEIIGLA

SEQ ID NO: 59335 - protein, 582 aa, Phaseolus vulgaris
MSSFSVRFLAPPCCPTSRSKTLLCASPTAAPAASEAVEASRLEPRVEERDGFWVLKEEYRGGISPQEKVKLEKDPMKLFMEGGIEDLAKMSLEEIESSKHTKDDIDVRLKWLGLFHRRKHHYGRFMMRLKLPNGVTTSSQTRYLASVIRKYGKDGCADVTTRQNWQIRGVVLPDVPEILKGLAEVGLTSLQSGMDNVRNSVGNPLAGIDPDEIVDTRPYNNLLSQFITANSLGNPAMSNLPRKWNVCVVGSHDLFEHPHINDLAYMPANNKDGRFGFNLLVGGFFSAKRCAEAIPLDAWVSADDVIPVCKAVLEAYRDLGFRGNRQKTRMMWLIDELGIEVFRSEVEKRMAGKQLERAQEDLVKKQWERRDYLGVHPQKQEGLSYVGIHIPVGRIQADEMDELALLADEYGSGELRLTVEQNIIIPNVDNSKLEALLQEPLLKHKFSPEPSLLMKTLVACTGNQFCGQAIIETKARALKVTEEVERQVAVTRPVRMHWTGCPNTCGQVQVADIGFMGCMARDENGKATEGVDIFLGGRIGSDSHLAELYKKGVPCKNLVPVVADILVKHFGAVQRNREEVED

SEQ ID NO: 59336 - protein, 1072 aa, Streptococcus pyogenes MGAS8232
MTLPLLVVFLVSLIMPKRKDIQKIMVIGSGPIIIGQAAEFDYAGTQACLALKEEGYKVILVNSNPATIMTDKEIADKIYIEPLTLEFVNRIIRKERPDAILPTLGGQTGLNMAMALSKAGILDDLEIELLGTKLSAIDQAEDRDLFKQLMQELDQPIPESTIVKTVDEAVTFARDIGYPVIVRPAFTLGGTGGGICSSEEELCEITENGLKLSPVTQCLIERSIAGFKEIEYEVMRDSADNALVVCNMENFDPVGIHTGDSIVFAPTQTLSDIENQMLRDASLKIIRALKIEGGCNVQLALDPYSFKYYVIEVNPRVSRSSALASKATGYPIAKLAAKIAVGLTLDEMINPITGTTYAMFEPALDYVVAKIPRFPFDKFEHGERQLGTQMKATGEVMAIGRNLEESLLKACRSLEIGVCHNEMTSLSNISDEELVTKVIKAQDDRLFYLSEAIRRGYSIEELESLTKIDLFFLDKLLHIVEIEQELQMHVDHLESLKKAKRYGFSDQKIAEIWQKDESDIRAMRHSHSLCPVYKMVDTCAAEFDAKTPYFYSTYELENESVQSNKESILVLGSGPIRIGQGVEFDYATVHSVKAIQKAGYEAIIMNSNPETVSTDFSVSDKLYFEPLTFEDVMNVIDLEQPKGVIVQFGGQTAINLAQSLSDAGVTILGTQVEDLDRAEDRDLFEKALKELGIPQPQGQTATNEEEALEAAKKIGFPVLVRPSYVLGGRAMEIVENKEDLREYIRTAVKASPEHPILVDSYIFGKECEVDAISDGKSVLIPGIMEHIERAGVHSGDSMAVYPPQQLSKQIQETIAEYTKRLAIGLNCIGMMNVQFVIKNEQVYVIEVNPRASRTVPFLSKVTGIPMAQIATKLILGQTLKDLGYEDGLYPQSQLVHIKAPVFSFTKLAQVDSLLGPEMKSTGEVMGSDTSLEKALYKAFEANNSHLSEFGQIVFTIADDSKAEALSLARRFKAIGYQIMATQGTAAYFAEQGLSACLVGKIGDAANDIPTLVRHGHVQAIVNTVGIKRTADKDGQMIRSSAIEQGVPLFTALDTAKAMLTVLESRCFNIEAI

SEQ ID NO: 59337 - protein, 565 aa, Coprinopsis cinerea okayama7#130
MSFPVKEIPTKPYDGQKPGTSGLRKRVKVFQQEHYTENFIQSIFDSIDAKDQTIVIGGDGRYFSPETVQTILKIGSANGVKKFIVGKDSILSTPAASNIIRKFKAYGGILLTASHNPGGPDNDFGIKYNVSNGGPAPESVTNKIYERTKTISSYRIIEAPPVDLSKIGESKFGPSDVSVIDSVEDYVILLKEIFDFPLIKKFLDAHREDFPVLFDGLNGVTGPYARAILIDTLGLPESSVQNCVPLPDFGGSHPDPNLTYAASLVEVVEKNNIPFGAASDGDGDRNMIYGKGAFVTPSDSVAIIAHWAHVIPYFKNGGVKGLARSMPTSKAIDLVAQKKGLEYFEVPTGWKFFGNLMDAGRLSICGEESFGTGSDHIREKDGLWAIVAWLNIIAAANKESPNKLIGINDILQEFYSIYGRSFFSRYDYEEVPSEGANKLVANLNEAITTGSLNNTAHTAAVAGTSFTVSGLYNFEYKDPIDHSVSKNQGQVITFSDGSRVVFRLSGTGSQGATVRMYVERYVAPSAPKEELEKPAAEGLAGLIEVALELSKLKEYLGVEKPTVIT

SEQ ID NO: 59338 - protein, 152 aa, Fortunella hindsii
LEPWLVSEVRISGDLELISVLASGLPTSEVLDEIVDLEDLRSVPLPLHHRLDLFIGVFSTANNFKRRMAVRRAWMQYPAVKAGAVAVRFFVGLHKNQIVNEELWTELQTYRDIQLMPFVDYYSLITWKTVAICIFGTEVVTAKYVMKHDDDA

SEQ ID NO: 59339 - protein, 86 aa, Arabidopsis thaliana
  misc_feature (45)..(45): Xaa can be any naturally occurring amino acid
  misc_feature (57)..(57): Xaa can be any naturally occurring amino acid
MANKALIHLVVIFVLALSYIFLFHSHASRLGSLMEKPSIVSNLNXDILMDVMKDVDXRMEMELNDYPGSGANIRHLPRVRRCVIDC

SEQ ID NO: 59340 - protein, 564 aa, Zea mays
MAAAAVTSNGGAVAANGPAPGRLASVYSEVQTNRLLHALPLPSVLRSNFSVVDGPASSAAGNPDEIAKLFPNLFGQPSASLVPSAEPAATRPLKVGVVLSGGQAPGGHNVICGIFDYLQERAKGSTLYGFKGGPAGIMKCKYVELTSDFVYPYRNQGGFDMICSGRDKIETPEQFKQAEDTANKLDLDGLVVIGGDDSNTNACLLGEYFRSRNMKTRVIGCPKTIDGDLKCKEVPTSFGFDTACKIYSEMIGNVMTDARSTGKYYHFVRLMGRAASHITLECALQTHPNAALIGEEVAAKKQTLKNVTNYITDIICKRADLGYNYGVILIPEGLIDFIPEVQKLIAELNEILAHDVVDEAGAWKSKLQPESRELFEFLPNTIQEQLMLERDPHGNVQVAKIETEKMLISMVETELEKRKAEGRYSAHFRGQAHFFGYEGRCGLPTNFDSNYCYALGYGAGALLQSGKTGLISSVGNLAAPVEEWTVGGTALTSLMDVERRHGKFKPVIKKAMVELDAAPFKKYASMRDEWAIKNRYISPGPIQFSGPGSNDSNHTLMLELGAAL

SEQ ID NO: 59341 - protein, 374 aa, Cryptococcus neoformans var. neoformans JEC21
MSPVRVPSHGDGWASTPQTKQVYSIASIPADGIGPEVVEAAITVLKAIAKKRGTFQLDFTNFDWSSETYKKTGRYVPDNHLDILRKFDAILFGAVGAPDVPDHISLWGLRLAICQPLQQYANVRRTRVLPGTESPLRNCKPGQLDWVIVRENSEGEYAGHGGRSHNGYNHEVATEISIFTRVGVERIARFAFQLAQSRPRKKLTYVTKSNAQRNGMVMWDEVVNEVAKEFPDVELDHMLVDAMTVRMVLHPESLDTIVATNLHADILSDLAAALAGSIGIAPTANLDPSRQNPSMFEPIHGSAFDITGKGIANPVATFWTAVEMLEWLGEKEAGQQLMEAVEAVCVDGIKTKDLGGSATTKEVTDAVVKRILQG

SEQ ID NO: 59342 - protein, 118 aa, Nicotiana tabacum
AVTIRPRVEVQGGDMRTFFTLVITDPDVPGPSDPYLREHVHWIVTDIPGTTDATFGKELVSYEIPRPNIGIHRFVFVLFKQKCRQSVSPPTSRDHFNTRNFANVNDLGPPVAAVFFNA

SEQ ID NO: 59343 - protein, 544 aa, Sinapis alba
MKLLHGLALVFLLAAASCKADEEITCEENEPFTCSNTDILSSKNFGKDFIFGVASSAYQIEGGRGRGVNVWDGFSHRYPEKSGSDLKNGDTSCESYTRWKKDVEIMGELNATGYRFSFAWSRIVPKGKVSRGVDQAGLDYYHNLIDALLEKNITPFVTLFHWDLPQTLQDEYEGFLDRQIIQDFKDYADLCFKEFGGKVKNWITINQLYTVPTRGYALGTDAPGRCSPKVDTKQRCYGGNSSTEPYIVAHNQLLAHAAIVDLYRTNYAFQNGKIGPVMITRWFLPYDESDPACIEAAERMNQFFHGWYMEPLTKGRYPDIMRQIVGSRLPNFTEAEAELVAGSYDFLGLNYYVTQYAKPKPNPYPSETHTALMDAGVDLTFNNSRGEYPGPVFAEDANSYYYPKGIYYVMDYFKTKYNNPLIYITENGISTPGSESRCEAIADYKRINYLCSHLCFLRKVIREKGVNIRGYFAWALGDNYEFCKGFTVRFGLSYVNWDDLDDRNLKESGKWYQRFINGTAKNPVKQDFLRSSLSSQSQKKRLAC

SEQ ID NO: 59344 - protein, 391 aa, Oceanicola granulosus HTCC2516
MSWKSLDDMDLAGKRVLTRVDINVPMEDGRVTDATRIERIVPTVRDILDKGGLPILLAHFGRPKGQVVPEMSLRHVVPALEEALGRSVTFVEGGYGEAVAGAGDGDVLLFENVRFNPGEEKNDEGFAERLASVGDVYCNDAFSAAHRAHATTEALAHLLPACAGRLMAAELRALEAALGDPERPVVAVVGGAKVSTKLDLLGNLVTRVDTLVIGGGMANTFLAAQGLDVGKSLCEHDLADTAREIAAKAAEAGCEILLPRDVVVAREFKAGAESEVVKAEDVPADAMILDAGPDSVAHVGMVFERSRTLVWNGPLGAFEIEPFDAASNAAARKAAELTRAGKLTSVAGGGDTVSALNQAGVADDFSYISTAGGAFLEWMEGKTLPGVAALR

SEQ ID NO: 59345 - protein, 436 aa, Synechococcus sp. WH 5701
MSGVLETLAFFRDPDFARSRFERYGDVYETTLLGQRTVFIRGGQAVGDLFAQGDAVQGWWPDSVRKLLGPLSLANRNGVDHKARRRVVGQLFTTVALKRYSPAIVALVNELSHDLLGCAAPVALVPRLRRFAFSVIASTVLGLDPVDRDALFVDFETWCQGLFSLPFALPGSPYARARQARGRLLLRLGSVLNKAQAAVAAGKPLAAGGLDLLAGGLDEAGLPLADDDVAEQLLLLLFAGYETTASSLSCLLQTLLQHPAELAWLQQELGALSWPPPQGEATTAYDAIRAPRLDAVVKEVMRLTPPVGGFFRRTLEPIALAGVLVPADRVVQVSIAASHRHGREDEDLEVFRPQRHLAGDSTATLLPYGGGERVCLGKSLAELEIRLLTVGMLKQLMLVLKPDQDLTLRVIPSPSPTDGLLVRPLPRATGLHSPVR

SEQ ID NO: 59346 - protein, 305 aa, Vibrio parahaemolyticus RIMD 2210633
MNKLVVLGSVNADHVLQVPSFPRPGETLHGRNYQVIPGGKGANQAVAAARLNADIGFIACVGDDSFGINIRENFKMDGIDIAGVKMQPNCPTGIAMIQVSDSGENSICISAEANAKLTSEAIEPDLERIRQADYLLMQLETPMCGIEKAARVAKDAKTNVILNPAPARELSDELLACIDVITPNETEAEVLTGVTVTDNESAQEAANVLHGKGIEIVMITLGAKGVWLSQNGRGEIIPGFRVEATDTTAAGDTFNGAFVTGLLEDLPLESAIKFAHAAAAISVTRFGAQTSIPTREEVDAFLAEQ

SEQ ID NO: 59347 - protein, 180 aa, Zea mays
MASADARLAGIASSIRVIPDFPKPGIMFQDITTLLLDPKAFRDTIDLFVERYKDQGITVVAGVEARGFIFGPPIALAIGAKFVPLRKPKKLPGEVISEEYSLEYGTDKIEMHVGAVQANDRALVVDDLIATGGTLCAAVKLIERVGAKVVECACVIELPELKGRDKLGDRPVFVLVEADA

SEQ ID NO: 59348 - protein, 348 aa, Glycine max
METRAAAKRKANAAIVVVVEKQHPKRQRVVLGELPNLQNLIVSKIQNPRKEKLQCRKNPNANKPSPTNNTLSSPQLDGSYVSDIHEYLREMEMQKKRRPMVNYIEKFQKIVTPTMRGILVDWLVEVAEEYKLLSDTLHLSVSYIDRFLSVNPVTKSRLQLLGVSSMLIAAKYEETDPPSVDEFCSITDNTYDKAEVVKMEADILKSLKFEMGNPTVSTFLRRYANVASDVQKTPNSQIEHLGSYIGELSLLDYDCLRFLPSIVAASVIFLAKFIIWPEVHPWTSSLCECSGYKPAELKECVLILHDLYLSRKAASFKAVREKYKHQKFKCVANLPTPPYVPSCYFEDQ

SEQ ID NO: 59349 - protein, 369 aa, Xanthomonas axonopodis pv. citri str. 306
MKSRAAVAFGPGKPLEIVEIDVAPPKAGEVLVRITHTGVCHTDAFTLSGDDPEGIFPSVLGHEGGGIVEQVGEGVTSVKIGDHVIPLYTAECRKCKFCLSGKTNLCQAVRATQGKGLMPDGTTRFSYNGEPIYHYMGCSTFSEYTVVPEISLAVVNPEAPLEKVCLLGCGVTTGIGAVHNTAKVKPGESVAVFGLGGIGLAVIQGAVQAKAGRILAIDTNPGKFDLARSMGATDCINPKDYDKPIQEVIVELTDGGVDFSFECIGNVNVMRSALECCHKGWGESVIIGVAGAGQEISTRPFQLVTGRVWRGSAFGGVKGRTQLPGMVEQSMKGAIDLDPFITHTMPLEEINEAFHLMHEGKSIRTVIHF

SEQ ID NO: 59350 - protein, 1028 aa, Oryza sativa
  misc_feature (611)..(611): Xaa can be any naturally occurring amino acid
MLLRRSACIHLASFSQQRSSRLLVHAHSLASASLSSGSLHARSLSSSARPVVAPSSSLLRFSAPRSRSLLTDAMASLATTPGGAKLIDGTALAKEVRARVAQRIAELKQQHSSFQPHLCIMQVGSQSASSTYIRMKKLAAEECGMRYTHVQLPDGASEQDIIQRVRELNEDISVDGILVQLPLGDHISSDAERRVTEAISPEKDVDGFHALNIGHLSSKACNPLFLPCTPAGCIKLLENAGITNMAGLRAVVIGRSDIVGNPVASLLRARDCTVTQCHSRTADLPAHLAQADIVIAAMGKPHFIQAEWLKKGAVVIDVGTNFVDDASKKSGYRLVGDVDFEPATKVASAITPAPGGVGPMTVAMLMENVLISAERSLADGRALGIGRGVVRPNPITPLAKVPSDIEVARSQTPKPITQVAREIGLISSELEPYGSVKAKVDLSVLKRLAHRNNGKYIVVAGITPTPLGEGKSTTTIGLAQALGAHLGKPAFACVRQPSQGPTFGIKGGAAGGGYSQVIPMEEFNLHLTGDNHAVQAANNLLAAAIDTRMFHEATQKDAALFDRLCPKKKGVRTFAPIMFRRLKKLGINKTNPDDLTDDEKARFARLDIDPXTVTWRRVTDTNDRYLRDITVGQAATEKGITRRTGFDIAVASECMAVLALSRDLKDMRERLGRMVIGTSRAGDPVTADDIGVGGALAILMKDAIKPNLMQTLEGTPVFVHAGPFANIAHGNSSILADAIALKLAGVEQGEPVERTGYVITEAGFGADIGMEKFCNIKCRESGLVPDAAVIVATVRALKTHGGGPEVMPGKPLSEVYLEENLEILDKGCVNLAKHIANAKKFGLKVIVAINQFTTDTPAELELVRKKALEAGADDAVPANHWALGGEGAIDLAKAVIQQLEGTASQFNFLYEPTLPITQKIEAIARDMYGADGIELSEAAEKQIQTIEKNGFGNLSICMAKTHLSLSADPSKKGAPTGFTIPVREVYASVGAGLLVVMCGAMSKMPGLNTRPGYYDMDLTEDGEVIGLS

SEQ ID NO: 59351 - protein, 478 aa, Zea mays
MATANGSSKGAFEVPKVEVRFTKLFIDGKFVDAVSGKTFETRDPRTGEVIASIAEGGKADVDLAVKAAREAFDNGPWPRMTGYERGRILHRFADLIDEHVEELAALDTVDAGKLFAVGKARDIPGAAHLLRYYAGAADKVHGATLKMAQRMHGYTLKEPVGVVGHIVPWNYPTTMFFFKVGPALAAGCAVVVKPAEQTPLSALFYAHLAREAGVPAGVLNVVPGFGPTAGAAVAAHMDVDKVSFTGSTETPEIVFDDADLVMAVNLVNFATYTNKGEICVAGTRIYVQEGIYDEFVKKAAELASKSVVGDPFNPSVSQGPQVDKDQYEKVLRYIDIGKREGATLVTGGKPCGDKGYYIEPTIFTDVKDDMTIAQDEIFGPVMALMKFKTVEEVIQKANNTRYGLAAGIVTKNIDVANTVSRSIRAGAIWINCYFAFDPDAPFGGYKMSGFGKDMGMDALDKYLQTKTVVTPLYNTPWL

SEQ ID NO: 59352 - protein, 466 aa, Agrobacterium tumefaciens str. C58
MDRKASRMTDPQTLAARFPGDFLFGVATASFQIEGATKADGRKPSIWDAFCNMPGHVFGRHNGDIACDHYNRWEEDLDLIKEMGVEAYRFSIAWPRIIPDGFGPINEKGLDFYDRLVDGCKARGIKTYATLYHWDLPLTLMGDGGWASRSTAHAFQRYAKTVMARLGDRLDAVATFNEPWCAVWLSHLYGIHAPGERNMEAALAAMHHINLAHGFGVEASRHVAPKVPVGLVLNAHSVIPASNSEADLKAAERAFQFHNGAFFDPVFKGEYPAEMMEALGDRMPVVEAEDLAIISQKLDWWGLNYYTPMRVADDATPGAEFPATTPAPAVSEVKTDIGWEVYAPALKSLVETLYKRYDLPECYITENGACYNMGIENGEVNDQPRLDYYAEHLGIVADLIRDGYPMRGYFAWSLMDNFEWAEGYRMRFGLVHVDYDTQVRTLKNSGKWYSALASRFPKGNHGVVKG

SEQ ID NO: 59353 - protein, 511 aa, Flavobacteria bacterium BBFL7
MQHDKVLILDFGSQYTQLIARRVRELNIYSEIHPFNKVPSNLDDYKAVILSGSPMSVRSESAFHIDLNEVRGKKPLLGVCYGAQYLAHFHGGEVGASSTREYGRANLSYVKSGETFLEGIASGSQVWMSHSDTIKKLPTDGELLASTHDVENAAYKINGEDTYAIQFHPEVYHSTDGKQILENFLIKIANVNPDWTPNAFVEETVEALQEKVGNDKVVLGLSGGVDSSVAAMLLHKAIGENLYCIFVNNGLLRKDEYTQVLKQYEGMGLNVKGVDASARFMDALAGLDDPELKRKAIGRVFIEVFDDEAKEVQNVTWLAQGTIYPDVIESVSATGGPSATIKSHHNVGGLPDFMKLKIVEPLRALFKDEVRRVGASMGMAAELLGRHPFPGPGLAIRILGDITPEKVAILQEVDAVFINNLKKWDLYDKVWQAGAILLPVNSVGVMGDERTYEKCVALRAVESTDGMTADWVNLPYEFLQATSNEIINKVKGVNRVVYDISSKPPATIEWE

SEQ ID NO: 59354 - protein, 445 aa, Pseudomonas fluorescens PfO-1
MFLDVFVKFSLPKIATAPFCPPEVAGSVPVDPNASFFKRVLRFAGPGLLVSIGYMDPGNWATAIEAGSRFGYSLLFVVLLASLAGMVVQCLCSRLGIATGRDLAQLSRERYSTPTARLQWVLAEISIIATDLAEVLGCALAFHLLLGCSLTFGIALTAFDTLLVLALQNRGFRRLEAIMLVLVGTIGACFFVELLLIKPYWPDVAQGFTPSLSAISDAAPLYLAIGILGATVMPHNLYLHTSIVQTRLIGKDLASKQDAVKLARIDTIGSLALALLVNAAILILAAAAFHQSGHTDVVDIQDAYHLLDPLVGGALASVLFGVALLASGQSSTFTGTIAGQVIMEGYLNLRIPCWQRRLITRGLALIPAFIGVWLMGDGAVGKLLVLSQVVLSLQLPFALYPLIRMTNDKQLMGPFVNRLPTQVLAWGLFVLISGANAWLILQLAA

SEQ ID NO: 59355 - protein, 462 aa, Oceanicola granulosus HTCC2516
MATEILMPALSPTMEEGTLAKWLVKEGDTVSSGDILAEIETDKATMEFEAVDEGTIGKILVEEGTEGVKVNQPIAVLLEEGEDASAADDVSSGAAEPAAAPEGDTDTREAKAPAAAAQPADPPKADASPDYPEGTETKTMTVREALNSAIAEEMERDENVFIMGEEVAEYQGAYKITQGLLDRFGDKRVIDTPITEHGFAGIGVGAAFGGLRPIVEFMTFNFAMQAMDQIINSAAKTLYMSGGQMGCPMVFRGPNGAAARVGAQHSQDYAAWYASVPGLKVVMPYSAADYKGLFKSAVRDPNPVIFLENEILYGRSFEVPVLDDFTIPFGKAKIARSGSDVTIVSWGIGMSYALEAAEKLAGEGVEAEVIDLRTLRPLDYATVIESVKKTNRCVTVEEGWPVASLSNHLSAYIMENAFDWLDAPVLNCTGKDVPMPYAANLERHALITTDEVVEAVKKVTYR

SEQ ID NO: 59356 - protein, 522 aa, Aspergillus oryzae
MDNSETVPSNADQAKNAHNVNNRRESFSSQNSQTAKEFIESQMQLEADAREILPYSFDSCTKALGPLRQTLYACLTCNPPPKTADEPHAAAGVCYSCSIACHGEHTLVELFNKRNFVCDCGTTRVPSSAPCTLRNDPKTGTKGVHSEEPHPENKYNQNFQNKFCGCSEDYNAEEEKGTMFQCLGLGTAESGGCGEDWWHPECLIGLPRDWYKDFKKEAGGNGQIEDDEETPLPPGFPGEDDFETFLCYKCVDSNPWLKRYAGTVGFLPPVYKEGGLPKTTKTAPETTATDVKEEEPTNPKKRKMEDEEEGEPTAKRIKEDSENTPSDSKPEPNSAPKEEPTQPPPLKNKHDSLTDPVPSGAFSLFLKEDFRDHFCRCRDCYPNLAPHIQLREEEETYEPPLSEDGEANGGGSTGTGSLLDRGEAALSNIDRVRAIEGAMVYNHLRDKVKEFLKPFAETGKAVGAEDIKSYFEKLRGDEQHIRDAAGQASALSGKDDSNDNEGGGGRREQNGTCKRHFLGNDR

SEQ ID NO: 59357 - protein, 431 aa, Aspergillus oryzae
MLKEHLDPRKPSGTGYTSKVRVRDKYHIVGFISSGTYGRVYKALGKNGQKGEFAIKKWAGSVRYFVSLGSLTSRRFKPDKEGEIIQYTGLSQSAIREMALCSELDHANVVQLEEIILEDKAIFMVFEYTEHDLLQIIHHHTQPHRHAIPAPMVRSILFQLLNGLLYLHTSWVLHRDLKPANILVTSSGAIRIGDLGLARLFYKPLNSLFSGDKVVVTIWYRAPELLMGSRHYTPAVDLWAVGCIFAELLSLRPIFKGEEAKMDSKKTVPFQRNQMMKIIEIMGLPTKDIWPGIVSMPEYSQLQSLAMSRAPGHFPRSSNLEGWYQSCLKNGGYATSSGAGTPGADGYDLLSRLLEYDPTKRITAQEALEHPYFKNGGPISANCFEGFEGKYPHRRVTQDDNDIRSGSLPGTKRSGLPDDSLMGRASKRLKE

SEQ ID NO: 59358 - protein, 482 aa, Mycobacterium sp. JLS
MDTTALLKSVPTGLWIGGEEREAKSTFNVLDPSSDEVLVAVGDATAEDAVAALDAACAVQAEWAATPARKRGEILRSVFETLTDRADDIAALMTLEMGKVLAESKGEVTYGAEFFRWFAEEAVRIGGRYTPSPAGTGRIIVTKQPVGPCYAITPWNFPLAMGTRKMGPAFAAGCTMIVKPAQETPLTMLYLAKLMAEAGLPKGVLSVLPTSSPGPVTEALVDDGRLRKLTFTGSTGVGKSLVKQSADKLLRTSMELGGNAPFIVFDDADIDAAVDGAMLAKMRNGGEACTAANRFHVANSVREEFTEKLVKRMSEVTLGNGLDESATLGPLINNKQLQKVTELVSDAVSRGATVAVGGVAPGGPGNFYPATVLADVPADARILKEEVFGPVAPITGFDSEEEGVAAANDTEYGLAAYVYTRSLDRALRVAEAIESGMVGINRGVISDAAAPFGGVKESGFGREGGTEGIEEYLDTKYIALTK

SEQ ID NO: 59359 - protein, 452 aa, Oceanicola granulosus HTCC2516
MPTEILMPALSPTMEEGTLAKWLVKEGDTVSSGDLLAEIETDKATMEFEAVDEGVVGKILVEAGTEGVKVNQPIAVLLEEGESADDISDTPATPSGDADSHAEPAAASEATEPQKGYGRGDAPAPAPAPSGGGEAAQEKGERIFASPLARRIAKDKGLDLAQLKGSGPKGRIVKADVEKAEPGQQQAAPKAEAPKAAATAGGEKPPMPAGMGADAVLKMYEGREFEEVKLDGMRKTIGARLTEAKQTIPHFYLRRDIRLDALLKFRSQLNKQLEAKGVKLSVNDFIIKAGALALQEVPDANAVWAGDRILKLKPSDVAVAVAIEGGLFTPVLKDAHQKSLSALSAEMKDLAKRARDRKLAPHEYQGGSFAISNLGMFGVENFDAVINPPHGSILAVGAGVKKPVVGEDGELAVATVMSVTLSVDHRVIDGALGAQFLSALKANLEAPMTMLA

SEQ ID NO: 59360 - protein, 415 aa, Acidobacteria bacterium Ellin345
MKWTRHWKTRLLLIFAVIGPGFITANVDNDAGGIFQYSAAGAQFGYGLLWTLLPTTIALIVVQEMAARLGAITGKGLSDLIREEYGLRITFFMMLGLVICNFGNVVAEFAGIASSLELFNVSKYISVPVCALIVWLLIVKGNYKNVEKVFLAASFVYFAYIVAGWWAGPAWKEALVATVKPSSNVNFRDKDYVYTIIGLVGTTIAPWMQFYLQASIVEKGITAKQYKTSRWDVIIGCIFTDVVAWFIIVACAATLFVHGFRTINTGADAAKALAPLAGQYAFILFAVGLFNASLFAASILPLSTAYTVCEGLGFESGVDKSFGEAPFFYWLYTILIAAGAAVILIPNLPLVRISILSQVVNGAVLPFVLVFMVLLANKHELMGKHVNGRVFNWIAWATTAIMVGLTVAWFGSLGK

SEQ ID NO: 59361 - protein, 554 aa, Mycobacterium sp. JLS
MTADDQLTDISATSAWQALQRHHGEIAGRHLRELFAEDPSRGTELTVSVGDLYIDYSKHRVTRETLRLLVDLARAAGLEKRRDAMLSGVHINTSEDRAVLHTALRLPRDASLTVDGQDVVADVHEVLDRMGDFTDRLRSGDWTGATGERIRTVVNIGIGGSDLGPVMVYEALRHYADAGISARFVSNVDPADLVAKLDGLDPATTLFIVASKTFSTLETLTNATAARRWLTDTLGDAAVARHFVAVSTNQKLVDEFGIDTANMFGFWDWVGGRYSVDSAIGLSVMAAIGRERFAEFLAGFHLVDEHFRTAPLEANAPALLGLIGLWYSNFFGAQSRAVLPYSNDLSRFAAYLQQLTMESNGKSVRADGTPVSTDTGEIFWGEPGTNGQHAFYQLLHQGTRLVPADFIGFSQPTDDLPTADGTGSMHDLLMSNFFAQTQVLAFGKTAEEIAAEDTPADVVPHKVMPGNRPTTSILATKLTPSVVGQLIALYEHQVFTEGVVWGVDSFDQWGVELGKTQAKALLPVITADDSPAEQSDTSTDALVRRYRAERGRSA

SEQ ID NO: 59362 - protein, 132 aa, Solanum lycopersicum
MISSDVLARELAETSTTTSEEDSKKSSNKNEVHEAEYGGYPGGGGGYPGGGGYPGGGRGGGGGGYPGGGRSGGGGGYPGGGYPGGGGYRGGGGRYPGGGGGGRGGGRYSGGGGRGGGGGRGGRGGGGRKCCS

SEQ ID NO: 59363 - protein, 625 aa, Glycine max
  misc_feature (450)..(450): Xaa can be any naturally occurring amino acid
IRLEEFMLKKKTWDLGREVDHIMRQKEAAMHVRMLTQEIRKSLDRHTILYTTLVELSKTLGLQNCAVWMPNVDKTEMNLTHELNGRNFNLTIRITDPDVVRIKGSDGVNILSSDSALAVGSRGVSGEAGPVAAIRMPMLRVCNFKGGTPELRQACYAILVLILPSGDNQEPRSWSNQELEIIKVVADQVAVALSHAAILEESQLMREKLEEQNRALQQAKRNALMASQARNAFQKVMSDGMRRPMHSILGLLSMIQDDKLKSEQKLIVDAMLRTSNVLSNLINDAMDNSTKDEGRFPLEIRSFGLHSMLKEAACLSKCMCVYKGFGFMVEVEKCLPDNVMGDERRVFQVILHMVGNLLEHNHGGGILVYRVFAETGSQGRSDKGWTTWRPSSSSGDVNIRFEIGINSSDSEVGSSISSGFGGRKYSSDRVGGRLSFSICKRVVQLMQGNXIWLVPCNHGFPQSMTLLLRFQLRPSISIAISDPGEGSERTDSNSMLRNLQVLLVENDDVNRAVTQRLLQKLGCVVTPVASGFECLTVIGPAGCSIQVILLDLHMPDLDGFEVATRIRKFRSGNQPMIVALTASAEEDLWERCMQVGINGVIRKPVLLHGIASELRRILMQGNNVL

SEQ ID NO: 59364 - protein, 237 aa, Trichodesmium erythraeum IMS101
MVTEQDPTTLMKQQVGKAAAEEVKSGMIVGLGTGSTTAYMIQFLGELLQRGELKDIKGIPTSFQSTVLAKKYGVPLTTLDEVDYMDIAIDGADEVDPQKNLIKGGGAAHTREKIVDCLAEKFVVVVDSSKLVDKLGSTFLLPVEVIPMAMNPVIRAIEKLGGQPEVRMGVKKAGPIVTDQGNLVIDVKFDSIDNPGELEKSLNNIPGVLENGLFVGVADVILVGEIDNGKPIVRTIS

SEQ ID NO: 59365 - protein, 226 aa, Oryza sativa (japonica cultivar-group)
MKLEVMPKQRAMEAEQREEAMEMSGLELWKHEKPASMVVFLPPPPPPPPLVPAAAAAAAAACGEEATLVPPLNFAMVDDGIFRSGFPAAANFRFLKSLNLRSIVYLCPEPYPETNAEFLAKNGIKLHQFGIEGRKEPFVNIPDDKIREALKVVLDVKNQPLLIHCKRGKHRTGCVVGCLRKLQKWCLSSVFDEYQRFAAAKARSTDQRFMELFDISSLKHLTASHC

SEQ ID NO: 59366 - protein, 198 aa, Coxiella symbiont of Carios capensis
EAVNQALFYEMAKDDSVIVLGEDVGINGGVFRATVGLVEKFGPQRVLDTPLAESMIAGISVGMAAQGLKPVAEFQFEGFIYSALDHILSHAARLRNRTRGRLHCPIVYRAPFGGGIHAPEHHSESMEALFAHIPGVRVVIPSSPARAYGLLLASIRNPDPVLFFEPKRIYRLVKQEVPNNGKALPLDQCFLLREVGRH

SEQ ID NO: 59367 - protein, 499 aa, Candidatus Protochlamydia amoebophila UWE25
MQVLSAQAVSELEKSAIKQGFSALDFMEKAGYGIALAIKEFILKHPLINHIVLLCGKGNNGGDAYVAGCYLLNYGYSVSSIQLESLENCSELCKKNALRFENLGGTISQQIQFDSNQLLIDGLFGTGFKGKIQELYTKLIEKANQSHAPILSIDIPSGLNGSTGEINGLAIRANETICLGFPKTGFFLQQGWNVVGQLKFVDFGLPLNVFSKENASFVLLTKSFIKNLLPKLVRNRHKYQAGYVMGLAGSRSMPGAALLSSLAALRAGSGMVHLLYPEDMRCELNNSPYELIKTPYALGDTQKVLQELQKAKAIFVGPGLGLTQPIDHLLRSCLPHLNASCVLDADALTLYTKTPFLLPKRTIFTPHTGEMQKLLQETSHLILNENILKKCQQYAEQHDITLILKGAPTFIFHPNQPIYVNPTGNCGMATAGSGDVLTGIIASFLSQGLESHQAALLGVFLHGLAGDIAKSKRLTERGMIASDLIDHLNLAYHALEQSV

SEQ ID NO: 59368 - protein, 372 aa, Actinobacillus pleuropneumoniae serovar 1 str. 4074
MEFIKTRAAVAWAPNEPLKIEELDLMPPQKGEVLVRLVATGVCHTDAYTLSGQDSEGVFPCVLGHEGAGIVEAVGEGVTDFKVGDHVIPLYTAECRKCKFCLSGKTNLCSAVRETQGKGLMPDGTVRFFKDDQPIFHYMGTSTFSEYTVVSEYSLAKIQENAPLDEVCLLGCGVTTGIGAVTRTAKVKKGDTVAIFGLGGIGLAAIIGARMAGAGRIIAIDINPAKFEKAKELGATDCINPKDYEQPIQNVIIEMTDGGVDFSFECVGNVDLMRSALECCHKGWGESIIIGVAPAGAEIRTRPFQLVTGRVWRGSAFGGVKGRTELPGIIDQFMKGEFKLRDFITHTMPLEDINKAFDLMHEGKSIRTVIHF

SEQ ID NO: 59369 - protein, 168 aa, Triticum aestivum
MATLTVEDVLRVNGSRRFAVALAAASPFGSLADALLAARRIWRNEVDVPGWLEAFAANPPLGTTSLSISKWSKEEQSVARSTATHSTAQDLSEWNAKYRDKFGFVFLICATGRTAPEVLAELKRRYANRLIVELEIAAAEELKITELRLAKLFSPETAAPRLQLLANQ

SEQ ID NO: 59370 - protein, 273 aa, Glycine max
NFPRQQGEKKNSDELAQKMAKLCDVYVNDAFGTAHRAEATTHGIAKFAPVACAGPLLAAELDALGKALGQPARPLAAIVAGSKVSTKLTILTSLAEKVDNLIVGGGIANTFMLASGLKIGKSLVEADLVGEAKAIIDMMAKRGASVPIPVDVVCAKEFSATAAATVKDVKDVTDDDMILDIGPKTASQLAEQIAKAGTVVWNGPVGVFEFDQFGEGTKTLAMAIANSKAFSIAGGGDTLAAIAKYNIADKVGYISTGRGAFPEFLERKTLPAV

SEQ ID NO: 59371 - protein, 489 aa, Photorhabdus luminescens subsp. laumondii TTO1
MRIQNKMLINGDWIDASDGQTIEVMNPHDGSLITRVAEAKEADVDCAVAAAKAAYPAWGRLQASERGALLLKLADKIEEHAAELAQLETMDTGHPIRDTLNIDVPRTAYCFRYFGGMADKLEGSVIPVEEGFLNYTTREPIGVVGQIVPWNFPLMFTSWKMAPALAAGNTIVIKPSEITPLSTLRIAELMMEVGFPPGVINVVVGYGNSAGARLSEHEDVGKIAFTGSTMTGQSIVAASAGNLKKVQLELGGKGANIIFEDADLTKAVGGSAWAIFHNQGQACIAGSRIILHESIADAFLEKFLTLAGSIRLGDPLLPETEMGPVTSLQHRERVLAYCDVARSQGCEILLGGKPPADPALANGCYIEPTVVRAKYSDRIAQEEVFGPFVTVITFKNDEEALAIANSTEYGLGSGLWTKDISRAHRFARDMHAGMVWINCYKRVNPASPFGGVGRSGYGREMGFEVMREYTQVKSVWVNVDAKIPPFYQR

SEQ ID NO: 59372 - protein, 459 aa, Phaseolus vulgaris
MGVVKGLLALALVLNVVVVSNGGKSSNFVRKTNKNRDMPLDSDVFRVPPGYNAPQQVHITQGDLVGRAMIISWVTMDEPGSSAVRYWSEKNGRKRIAKGKMSTYRFFNYSSGFIHHTTIRKLKYNTKYYYEVGLRNTTRRFSFITPPQTGLDVPYTFGLIGDLGQSFDSNTTLSHYELSPKKGQTVLFVGDLSYADRYPNHDNVRWDTWGRFTERSVAYQPWIWTAGNHEIEFAPEINETEPFKPFSYRYHVPYEASQSTSPFWYSIKRASAHIIVLSSYSAYGRGTPQYTWLKKELRKVKRSETPWLIVLMHSPLYNSYNHHFMEGEAMRTKFEAWFVKYKVDVVFAGHVHAYERSERVSNIAYKITNGLCTPVKDQSAPVYITIGDAGNYGVIDSNMIQPQPEYSAFREASFGHGMFDIKNRTHAHFSWNRNQDGVAVEADSVWFFNRHWYPVDDST

SEQ ID NO: 59373 - protein, 258 aa, Bacillus cereus ATCC 14579
MKKKLGLLAMVVALMAIATGCSETGQPITSKSTGIWNEYFVYPLSQLITYFADLFNSNYGLAIVITTLIIRFALLPLMIKQTKSTKAMQALQPEMVKLKEKYSSKDQATQQKLQQEMMQLYQKNGVNPLAGCLPIFVQMPILFAFYHAIMRTAEIKQHSFLWFDLGHADPFYILPVVAAITTFIQQKLAMAGTAGQNPQMAMMLWLMPIMILIFAINFPAALSLYWVVGNIFGIAQMYFIKGPEIKASKAGKAGGSSK

SEQ ID NO: 59374 - protein, 312 aa, Cryptococcus neoformans var. neoformans JEC21
MVQQTAAFVLSQLARHRSSWNKETVCPPLIVGVQGPQGAGKSHLTGLLPAYLEKHYDLRLATMSLDDFYLTHSDQVKLAQSEPDNPLLSGRGPAGTHDLPILEQCLAKLKSINDRVSAKSPTVTKGQSLQLPIYDKSLFKGEGDRSKEVVEVQGPIDVVIFEGWMNGFGPLSNDKLEERYAEAGRQWPSSSLNDPARVMPTILLYSRSTLHSINQNLRQYEVLWDQIDCFVQIRPLDLSYVWSWRLQQEHNMKAKNGGNGMTDEQVRHFINRYMPSYELFQDGIDKETSSWSGKGLRFIVNIQREIVGTESF

SEQ ID NO: 59375 - protein, 301 aa, Solanum tuberosum
MVSNYISATVSSILLFLLCSSSLFGASMAALVQEQPLVLKYHNGALLKGTVTVNLIWYGKFTPIQRSIIVDFLQSLNSPKAPNPSAASWWKTTEKYKTGASTVTLGKQILDENCSLGKSLKNSHIVYLASKGGYMGRSVNLVLTAKDVFVEGFCSRCGSHGSTRGKVRFTYAWVGNSETQCAGQCAWPFHQPIYGPQTPPLLAPNGDVGVDGMIINVATVLAGTVTNPFNNGYFQGPATAPLEAVSACTGMFGSGSYPGYPGQTLVDKSTGASYNAHGVNGRRFLLPAMWDPTKSACSALV

SEQ ID NO: 59376 - protein, 331 aa, Acidobacteria bacterium Ellin345
MLLQGVFPAITTPFYPDGRIYFRKLEHNVAKYSLTDIAGFVVLGSTGEVVMLSDGERREILLGAIEAAGGNKIMIAGTGAESVRGTLEMTEAAAEFGYDAALVRTPHYYKSQMTTAVMANFYRTVADRSALPVLIYSVPPFTGYDIPTEVVKELADHPNVIGIKESSGSVEKIAQMAKETAHVRRTVSATLRRSTGRRDVVSVSALAGTSTVVEERTQEVGFQILAGSAQKMLPSLEAGASGAVLAFGCVAPVACVEVHKAFRAGDIEKAKAAQEKIVGPATRIASQLGVAGVKYGMDFNGYYGGNPRLPLLPVSSEVRAEIEGLLGDLRG

SEQ ID NO: 59377 - protein, 340 aa, Glycine max
MASDKKIRIGINGFGRIGRLVARVALQRNDVELVAVNDPFITTDYMTYMFKYDTVHGQWKHFDVKVKDSKTLLFGEKPVTVFGIRNPEEIPWGEVGADYVVESTGVFTDKDKAAAHLKGGAKKVVISAPSKDAPMFVVGVNEKEYKPELDIVSNASCTTNCLAPLAKVINDRFGIVEGLMTTVHAITATQKTVDGPSNKDWRGGRAASFNIIPSSTGAAKAVGKVLPALNGKLTGMSFRVPTVDVSVVDLTVRLEKPATYEQIKSAIKEESEGKLKGILGYTEDDVVSTDFVGDNRSSIFDAKAGISLNDNFVKLVSWYDNEWGYSSRVIDLIVHIASVA

SEQ ID NO: 59378 - protein, 332 aa, Brassica napus
MEEAWRVIFTLCLLIYVANADPIQDKRALLEFLTLMRPTRSLNWNETTSVCNAWTGVTCNKDGSRITAVRLPGVGLNGQIPPNTLSRLSSLTVLSLRSNRISGLFHGDFAELKDLAFLYLQDNDFSGQLPEDFSVWKNLTSVNLSNNDFNGTVPDSLASLKRVQSLNLANNSLSGDIPDLSGVSTRQHMDLSYNNLNGPIPSWLQRFPTSSYQGVGGFSLVQPPPDLAHQELKPRQKPKPHFLGLTKTVFLLIVIAVSVVLLAVLVFVLAVCYLRMKLSQGDGIVTDAKLQKKGGMSPEKFVSRMEDVNNRLSFFEGCNYSFDLEDLLRASA

SEQ ID NO: 59379 - protein, 136 aa, Zea mays
  misc_feature (92)..(92): Xaa can be any naturally occurring amino acid
MTMFRSISMVMLLVALVTFISMVSSAASSPEADFVKKTISSHKIVIFSKSYCPYCNKAKSVFRELDQVPYVVELDEREDGWSIQTALGEIVXGRRTVPQVFINGKHLGGSDDTVYAYESGELAKLLGVSGNKEAEL

SEQ ID NO: 59380 - protein, 756 aa, Haemophilus influenzae 86-028NP
MSEQLRQAALDFHEFPIPGKIEVTPTKSLATQRDLALAYSPGVAEPCLEIEKDPAASYKYTARGNLVAVISNGTAVLGLGNIGALAGKPVMEGKGVLFKKFAGINVFDIEVNEHDPDKLVDIIASLEPTFGGVNLEDIKAPECFYIEQKLRERMNIPVFHDDQHGTAIISAAAIINSLRIVGKKIEDVRLVASGAGAASIACLNLLLSLGMKRENITVCDSKGVVYKGRDDKMDQTKKDYAIEDNGWRKLGDAMPNADIFLGCSAAGALTQDMVKTMAAHPIILALANPNPEITPPEAKAVRPDAIVCTGRSDYPNQVNNVLCFPFIFRGALDVGATTINEEMKRAAVYAIADLALEEQNEVVTSAYGGEGATFGADYVIPRPFDPRLIVRIAPAVAKAAMESGVATRPIQNWDIYIDQLTQFVYKTNLFMRPIFSQAKSAKQRIILAEGEENKALHATQEVISMGLANPILIGRRSVIEEKIKKLGLRLTAGVDFEIVDNEDNPRYEECWKHYYELTKRKGITPAIAKRVVRSNTTVLASTLLSLGYADALVCGLFGSYGKHLASIRDIIGLKDGVKTAAALNSLVLPTGNVFLTDTHVNSNPTAEELAEITLMAAEEIHRFGIEPAVALLSHSNFGSSDSLGAPKMREVLQIVKERNPHLMIDGEMRGDLAMNEAHRKEVMPDSPLKGSANLLVFPDLSASRISYSLLRSTTTAITVGPILMGMNKSAHILNPGASVRRIINMIAYAAVKAQQE

SEQ ID NO: 59381 - protein, 321 aa, Agrobacterium tumefaciens str. C58
MTSKLEQLRAITTVVADTGDIEAVARLKPVDCTTNPTIVLKALGTPAFADAVKEAVAWGRKQGGQSDAVVAAVADRLAISVGAALAGLVPGRVSTEVDADLSFDTQASITKARHIIASYKERGIERERILIKLASTWEGIKAAEVLQSEGIDCNLTLLFSQAQAIACAEAKAFLISPFVGRILDWYKKSTGETYTAETDPGVVSVRSIYNYYKANGIGTVVMGASFRNVGEIEALAGCDRLTISPALLEELDKDNGKLERKLSPDNVKAEALQSLDEKAFRWAMNEDAMATEKLSEGIRLFAKDLVTLREMVRKELTAAAA

SEQ ID NO: 59382 - protein, 211 aa, Alkalilimnicola ehrlichei MLHE-1
MKDKPALRVGIGGPVGSGKTALVEALCKALRDHYEIAVVTNDIYTREDAEFLTRNGALPADRIIGVETGGCPHTAIREDASMNLAAVGDLNQRFPELEVVFIESGGDNLSATFSPELSDLTLYVIDVCAGDKIPRKGGPGITRSDLLVINKIDLAAGVGASLEVMDRDSRRMRGDRPFIFTNLHAGEGLESVIDFIIREGMLDRKPGLAPA

SEQ ID NO: 59383 - protein, 310 aa, Synechococcus sp. WH 7805
MDLDRRPPAPLGGDALLELLGWPNPEGWWHHWQARGGVNLVRDRWSVPVDDAWIASLALPLLTRVEQAHVEDGLKLIGVSALPGCGKTTLCSWIKHASDHLGWSVEHLSIDDFYWPADELERSMAGNPWGVPRALPGSHDLIGMERSLQTWLQGGCLQAPRFDKSLRGGRGDRCGSSISKPRVVLLEGWFLGAVVGEEGNDAMEHSLTPAERQWRPQALRQLREYASIWSMLDELWHLRIENIDASARWKRQQLNTLFESTGVSFAENDLSGFNRMVEAALPKSCLNWIPGATIIVDLTSERAVREVRFS

SEQ ID NO: 59384 - protein, 1653 aa, Trichodesmium erythraeum IMS101
MTIFQTNPSNLHQLLQMVKDGDELNLQAGDYKAPFTIDKSITIRGSGSDTVIFAATETPLIITASKVRVENLTVERTVGGDNGEVAIFAEANTNPILSQVKLNGVAENVEWSGVSWNIPTILDFGEIEINRLVEREWELELGSACQVLCDLNWLQVRSSYLSPGRQNLQVVLNTANIPTGTNLSGLIFLSAADSRRELEVTAKVISPLPVTPVLAASTKALPAKVLNSQDWGYRFSGSAADKLVRAQLGEAALKKYPEFPQRRAKAEALMSEILDGNSHLYYVRRQAPGREEGEEIWELTMATDREEQEWEKTLKLRGAVNIDEDRVLKLLSVQLISQKAEKDEFSLALQIRLLPQHQYRRGIPLGVVRSMGKMPFFGDRIPTEEQLPIWTTFVEIEQRIAEKRQFCLQFLSHNYGSAGRKITFEIDVSSATIDGTAESAIDDLELRRRLFEAKNEDIQLFQTSPAGGDARDGEKLGAIATIDWKKGQVGVMLDSEIVEIISRGSYRIPSTGFLFFIASGDIAQVKRKRRALEDLQSGRCQNPYLGDFFFDATCARAPKQVVKLQPQDLLLPAANVNQIAAVETVLASPDLALIQGPPGTGKTTVIAEICYQVALRGGRTLIASQANLAVDNALSRLVHNPVIRAVRKGKAEKVQEEGEPFLEHRVIDTWLKNTANDCESDLDERLQRVEILRNLLIESERFNAYVELEEVWVSQQQELSDRQTILETSREVLASEVLQLETDTKELNFLMLGLDNLLNSAPNVNWQDEEVKSLLPRLQPYSQEEKSVKDLVENVRLARNISRDIGWEIPALGAFGLATWFQENLAILLPEFYNGLAVAKKVTLMMSELENLQQIYQQSHSKFEQLKKDIDNQDIVSENLQKNRQELESQKSQIDLVVSEVGAWINIGKNRIFEELKKCWETDQDFQLDLIGLPESLIKLVNRKKLQLLPEYAQPLHSLPDWERVEKALNAESNRGFQNIRGREHRFDNFLQIILSKPPIVLSERDYQKWQEYAIYFERYSQLNQTSRQGLVEKIQHFFDENRSKYSLVWKADNMLNTLAEVTDKISNKILHHSREMLLPMKRRNQKEILKNKEHLEEISELQKSYKQEREVVEEEGKNLHQKLEQKYQEFINKLTGIEVQLEFNPEIHSLAKKYLESTPLEVLNDQSNFVAKVNSWENNLKQLEKIAPLFEPFTVLTDIKNLLQNKLNTAQEKADKSQEELQSSETEINQIKTALQQEPSITLIEERDWWKSAWKKIPENIKPRVYETEIFAIEILQKIKLQLQNWQQELDTEKTYLNSHQKFIQDWIEKIKKPSEKDSNDLRKIYLDNANVIGITCVQAASRSFAEEFNSFDVVIIDEVSKCTPPEILIPALKGKKLVLVGDHRQLPPMLHNSTIEEIAEEMKSTKEELSFLEESLFKTHFDTATEKIKQMLTIQYRMHPNIMGAINQFYQHRLQCGIIQPNEERAHNLGGEILQDNKHIIWVKMPHLESFIEQKEGTSPFNEKEVDVIEKLCGEMEKSWRIKIAEGFPRKELGIITFYNAQLRLIDSRINPEKFPSLHIRTGTVDRFQGMERQVIIVSMVRNNEEGKVGFAKKPERVNVAFSRAQELLVIVGCHGLFTQHYGMVGNMYSEVSDVVRRQGGLIEFSDILGE

SEQ ID NO: 59385 - protein, 486 aa, Vibrio parahaemolyticus RIMD 2210633
MEMKTHYIDGAMYIGCSEEHFTTYNPANGEPLANIKQANQSDMEAAIESAKRGFEVWSAMTAIERSRILNKAVAILRERNDELAALEVADTGKPIQEAIAVDITTGADVIEYYAGLAPSLQGEQQPLNENQFFYTRREPLGICAGIGAWNYPIQIAMWKSAPALAAGNAMIFKPSEETPLTALKLAEIYSEAGLPDGVFNVVQGDYRVGQMLTAHPDIAKVSFTGESGTGKVVMGDSAKTLKQVTMELGGKSPLIVFDDAKLDDAVSAAMVANFYTQGEVCTNGTRVFVHESIYDDFVAQLKTRTEKLVVGDPLDENTQIGALISKEHESKVLSAIESAKASGATLLTGGYKVTDNGLQNGNFVAPTVFIDCDDSMSHVQQEIFGPVMSVLKFSEEAEVIERANDTDYGLAAGVFTQNLSRAHRVIHKIQAGICWVNAWGDSPAEMPVGGYKQSGIGRENGVETLKHYTQTKSVLVQLSDFESPYA

SEQ ID NO: 59386 - protein, 153 aa, Emericella nidulans
MTSEQTFIAIKPDGVQRGLVGPIISRFENRGFKLAAMKLTSPSRSLLEQHYSDLKEKPFFPGLVTYMLSGPIVAMVWEGKDVVKTGRTILGATNPLASAPGTIRGDFAIDVGRNVCHGSDSVESAKKEIGLWFTPEEIQNYKLNAFGWIYEKE

SEQ ID NO: 59387 - protein, 453 aa, Kineococcus radiotolerans SRS30216
MPFRPTVGGSRRRRHRGRHHPQLQRPGGFRGAAGRGRSPGCGGLARGGAALAAVVTGDADPWRPDTTAVRGGLARSQFEETAEALYLTSGYVYENAAAAEAAFSGETDRYVYSRYGNPTVSVFTERLRRLEGAEACYGLASGMSAVFYALAALLGAGDRVVASRSLFGSCFVVLDEILPRWGVSTEFVDGEDLAQWERALSTPAQAVFFETPANPMQTLVDVEAVSGLAHAAGATVVVDNAFASPVGQRPLRFGADVVVYSATKHIDGQGRVMGGAVLGTSEFIGGRFQELTRHTGPTLSPFNAWTLAKGLETLGLRVRHSAATALRIAGHLEQVPGIRWVRYPLLPSHPQFDLAQRQMELGGTILTFELDAPAGRGKDRAFEVLDALRVVDISNNLGDAKSLATHPATTTHRRLGAEGRAAIGLTDGVLRLSVGLEDPDDLLEDLDRALRAT

SEQ ID NO: 59388 - protein, 719 aa, Isatis tinctoria
MMENWVVVALFTLCIVGFELRFIHGATDASDTSALNTLFTSMHSPAQLTQWTASAGDPCGQNWRGVTCSGTRVTQIKIPSLELSGTLGYMLDRLTNLTELDLSSNNLGGDLPYQLPPNLQRLNLAYNQFTGAAQYSISQMAPLKYLNLGHNQFKGQIAVDFSKLTSLTFADFSFNSFTNSLPGTFTSLTSLKSLYLQNNQFSGTVDVLAGLPLETLNIANNDFTGWIPSSLKGIHLIKDGNSFSTGPAPPPPPGTPPIRGSPSHKSGGGTNRSSGDSTSNGDSKKSGIGAGAIAGIIISLLVVTALVAFFLVKRKRRSKRSSSMDIEKTDNQPFTLAPSDFHENNSIQSSSSVETKKLDTSLSINLRPPPADRHKSFDDEEDSTRKPILVKKSAVVVPSNVRAYSVADLQIATGSFSVDNLLGEGTFGRVYRAEFDDGKVLAVKKIDSSALPHGMTNDFAGIVSKIAILDHPNVTKLIGYCSEHGQHLLVYEFHKNGSLHDFLHLSEEESKALVWNSRVKIALGTARALEYLHEVCSPSIVDKNIKSANILLDSELNPHLSDSGLASFLPTANELLNQTDEGYSAPEVSMSGQYSLKSDVYSFGVVMLELLTGRKPFDSTRSRSEQSLVRWATPQLHDIDALGKMVDPALEGLYPVKSLSRFADVIALCVQPEPEFRPPMSEVVQALVVLVQRANMSKRTVGVDPSQRSGSADTTSDYM

SEQ ID NO: 59389 - protein, 259 aa, Helianthus annuus
ANYGGDKQYGRETRHTGDYESPIHSTGGQYEQEVLQTDEYGNPVRRTGQTDEYGNPVRRTDEYGNPVHSTTGGTMGDYGSTGLGQGTGTGGIGTGGYGTTGHHGLGTGVGHTTGGTGTDYTSGGRSTGQTGYQGLGTESDFGGKTGTFQNQPSATPVGGVGLNSGTGAGVGGTGTGTGILHRSGSSSSSSSEDDGQGGRRKKKGVMQKIKEKLPGGHRQEEQYQSQTTTTTTGGGAGYGETHEKKGMMEKIKEKLPGHH

SEQ ID NO: 59390 - protein, 477 aa, Acinetobacter sp. NCIMB9871
MNYPNIPLYINGEFLDHTNRDVKEVFNPVNHECIGLMACASQADLDYALESSQQAFLRWKKTSPITRSEILRTFAKLAREKAAEIGRNITLDQGKPLKEAIAEVTVCAEHAEWHAEECRRIYGRVIPPRNPNVQQLVVREPLGVCLAFSPWNFPFNQAIRKISAAIAAGCTIIVKGSGDTPSAVYAIAQLFHEAGLPNGVLNVIWGDSNFISDYMIKSPIIQKISFTGSTPVGKKLASQASLYMKPCTMELGGHAPVIVCDDADIDAAVEHLVGYKFRNAGQVCVSPTRFYVQEGIYKEFSEKVVLRAKQIKVGCGLDASSDMGPLAQARRMHAMQQIVEDAVHKGSKLLLGGNKISDKGNFFEPTVLGDLCNDTQFMNDEPFGPIIGLIPFDTIDHVLEEANRLPFGLASYAFTTSSKNAHQISYGLEAGMVSINHMGLALAETPFGGIKDSGFGSEGGIETFDGYLRTKFITQLN

SEQ ID NO: 59391 - protein, 131 aa, Zea mays
  misc_feature (76)..(76): Xaa can be any naturally occurring amino acid
TGVAITRSGVNAYHYHWHSSTRCGDMERTLSTLHEFDDMAHEIMRPTYEVMKILLRVSSRVHDRSIGDEDENSQEXNDIVANIDDVLNLCPEEVLMEPQGYDVTHSHIKRLDEELGQFAEDLKHEGKIPQD

SEQ ID NO: 59392 - protein, 381 aa, Haemophilus influenzae 86-028NP
MAKKDYYEVLGLQKGASEDDIKRAYKRLASKHHPDKNQGSKEAEEKFKEINEAYEVLGDDQKRAAYDQYGHAAFEQGGGTGGFGGGFGGADFGDMFGDIFGDIFGGGRGRQRVVRGEDLRYDLEISLEEAVKGTTKDIQINTLAHCDSCGGSGAEKGSKVETCPHCHGSGRIRRQQGFFVSESICPTCHGSGKKIEKPCRSCHGEGRVHKKENLSVKIPAGVDTGNQLRLAGKGAAGENGAPAGDLYVVIHVREHNIFERDGSNLYCEVPISFATAALGGEIEVPTLDGRVKLKIPAETQTGKLFRMRGKGVASTRSGYAGDLICRIVVETPVNLTSEQKELLHKLEESLQGKDLSKHAPKSSGFLDGVKKFFDNLGKSDK

SEQ ID NO: 59393 - protein, 111 aa, Cyanothece sp. ATCC 51142
MKRLLSLILLLFAFFCFSFVSPALAGDAAAGKGIFTANCASCHMGGGNVVAGASKGLTKDALENNKMLSEEAIIAQVTKGKAAMPAFLGRLTDTQIEDVAAYVLSQAEAGW

SEQ ID NO: 59394 - protein, 353 aa, Flavobacteria bacterium BBFL7
MTDAYEIVIDKIQESKISSTDFDNLTFGKTFTDHMLECTWRDGKWETAVIKPYGPIMVEPSCKVFHYGQAIFEGMKAFKDDAGDVFLFRPEDNWIRFNESAKRLAMPEVPEEVFVEGLKTLVNLDKEWVRHGEGLSLYLRPFMIASENGVAAAPSTEYKFMIVMSPAFAYYKGDVRVIIASDYSRAADGGVGYAKAAGNYAASFYPNNLALAEGYQQIIWTDAASHEYLEEAGTMNIFVRIGDTLLTAPNNDRILNGVTRRSVLQLAKDAGVNIEERRISVKELNDAAENGTLKEIFGSGTAAVIVPIKGYKHKEFKYELPNLDDSYAERFKSALKDIQYNRADDAHGWRVKI

SEQ ID NO: 59395 - protein, 357 aa, Ginkgo biloba
MAPVQSVSAAPVPKFLPTENEAKVLQSIFVRDEDERPKVAYNEFSKEIPIISLAGMEGEERGRVREEVRAACEEWGIFQVLHHGVPSDLVHRMSQLSRSFFALPSHEKLKFDMTGGKRGGFVVSSHLQGESVLDWREIFTYFSYPLRSRDYSRWPQNPDGWREVVEEYSQELMKLACKLLEIISESLGLEPQAVTKACLDMDQKVVINFYPKCPQPDMTLGLKRHTDPGTITLLLQDQVGGLQATKDGLNWITVEPVEGAFVVNLGDHMHYLSNGKYKNADHQAVVNADTSRLSIATFQNPAQEAIVYPLEGVVKAEDKCVMEEPITFAQMYSHKMNRDLELARQKKLAKLQQDESK

SEQ ID NO: 59396 - protein, 886 aa, Haemophilus influenzae 86-028NP
MSEILKNDIDPIETQDWLQSLDSLIREEGVERAQYIVEQVIGQARTSGVSLPTGVTTDYVNTIPVAEQPAYPGDHAIERRIRSAVRWNAIAMVLRSQKKDLDLGGHISTFQSAATMYEVCYNHFFKAATEKNGGDLIFFQGHAAPGMYARAFLEGRLTEEQMDNFRQEAFTDGLSSYPHPKLMPEFWQFSTVSMGLGPVNAIYQARFLKYLDNRGLKDTKDQKVYAFLGDGEMDEIESKGALTFAAREKLDNLIFTISCNLQRLDGPVNGNGKIVQELEGLFTGAGWEVIKVLWGSDWDKLFAKDTSGKLTQLMMEVVDGDYLTFKSKDGAYIREHFFGRYPETAALVADMTDDEIWALRRGAHDSEKLYAAYAKAQNATKPVVILAHQVKGYKIPEAESKNTAHQSKKMSYESLKGFRDFFELPLTDEQVEKLEYIKFAEGTPEYEYLHGHRKALNGYVPARRTKFDVEYKVPALEEFKALLEEQPRGISTTMAFTRALNILLKDKNIGKTIVPMIADEARTFGMEGLFRQVGIYNPHGQNYVPSDRDLVAYYREAKDGQVLQEGINELGATASWLAAANSYSVNNQPMIPFFIYYSMFGFQRVGDMMWAAGDQLARGFMVGGTSGRTTLNGEGLQHEDGHSHIQAGVIPNCVTYDPSFAFEVAVIMQDGINRMYGEKQEDVFYYMTTLNEVMDQPAMPAGAEEGIRKGLYKFETVEGKKGKGHVQLLGSGAIMRHVREAAQILANDYGVTSDVFSAPSFNELAREGHDAARWNLLHPTETQRVPYVAQVLADLPTVASTDYVKGYADQIRAFVPSKHYHVLGTDGFGRSDSRANLREHFEVDARYVVVAALSQLAKEGTVSNQVVADAIAKFGLNVDRINPLYA

SEQ ID NO: 59397 - protein, 239 aa, Agrobacterium tumefaciens str. C58
MRDGTGPLLIFDCDGVLVDSEPVSIAVLLDMLSHLGVTMGEEEAYERFLGRSVASMTTTLFEEYGVETDIDFLDHMRATLFERFRTELKPIDGIAETLDELLPLKRCVASSSQPERIRYSLGLTGLIDKFEPHVFSATMVRNGKPAPDLFLHAARSMGVEPRQCIVIEDSPAGIAAAKAAGMGVFAFTGGSHARFPAFREKIAGLGADAVFDAMPDLVQLVGSYVGRGGFDGQVERDAG

SEQ ID NO: 59398 - protein, 718 aa, Nicotiana tabacum
MAVPTIALYASPPSSVCSTPYPCQINSHGSYDFDLNGRSSSSSSTSSSSGKSFVGGLSSLFSSPTVKANYSTGTEDLGSLWHDRGDELSSSFRCSSLSSSLKRDQSPVSVFQGPASTSSSGIGSCSRSPPRRIAGDVGSIRSGTGGLFNGFVRHALGSCVDHDPTTFRVLDVDSPSSGLLDELTFNMEEGFLESNSEPYAKDLLLNAQSRHKIFCDDFVIKAFYEAEKAHRGQVRASGDPYLQHCVETAVLLAMIGANSTVVAAGLLHDTLDDTFMTYDYIFRTLGAGVADLVEGVSKLSQLSKLARDFNTASKTVEADRLHTMFLAMADARAVLIKLADRLHNMMTLDALPLAKQQRFAKETLEIFAPLANRLGISTWKEQLENLCFKHLNPDQHNELSSKLVKSFDEAMITSSVGKLEQALKDDSVSYHVLSGRHKSLYSIYCKMLKKKLNMDEVHDIHGLRLIVENKEDCYKALRVVHQLWSEVPGRYKDYIANPKFNGYQSLHTVVLGEGMVPLEVQIRTKEMHLQAEYGFAAHWRYKEGACKHSSFVNQMVEWARWVVTWQCETMNRDQSSVGHTESIQPPCKFPAHSEDCPFSCKPNCGTDGPVFIIMIDNDKMSVQEFPANSTVKDLLERAGRGSSRWTPYGFPLKEELRPRLNHEPVSDPNCKLRMGDVIELTPTIPHKSLTEYREEIQRMYDRGVSPLPAANAVVGLRS

SEQ ID NO: 59399 - protein, 474 aa, Haemophilus influenzae 86-028NP
MSKEIKTQVVVLGAGPAGYSAAFRCADLGLETVIVERYSTLGGVCLNVGCIPSKALLHVAKVIEEAKHANKNGIYFSEPRIELDEVRAGKEAVVAKLTGGLAGMAKARKVTVVEGLATFTDSHTLVARDRDGNPTTVKFDNAIIAAGSRPVQLPFIPHEDPRIWDSTDALKLKEVPKKLLIMGGGIIGLEMGTVYNALGSEVEVVEMFDQVIPAADKDVVGIYTKQVEKKFKLMLETKVTAVEAKDDGIYVSMEGKACNDTKRYDAVLVAIGRVPNGKLIDAGKAGVEVDDRGFIHVDKQMRTNVPHIYAIGDIVGQPMLAHKGVHEGHVAAEVIAGQKHYFDPKVIPSIAYTEPEVAWVGKTEKECKQEGLNYEVAKFPWAASGRAIASECSEGMTKLIFDKDTHRILGGAIVGSNGGELLGEIGLAIEMGCDAEDIALTIHAHPTLHESVGLAAEVFEGSITDLPNAKAKKK

SEQ ID NO: 59400 - protein, 126 aa, Pseudomonas syringae pv. tomato str. DC3000
MTKTVITSDKAPAAIGPYSQAIKAGNTVYMSGQIPLDPSTMELVEGIEAQITQVFENLKSVAQAAGGSFKDIVKLNIFLTDLGHFAKVNEIMGSYFSQPYPARAAIGVAALPRGAQVEMDAILVIE

SEQ ID NO: 59401 - protein, 347 aa, Cyanothece sp. ATCC 51142
MTVLLAGDIGGTKTILRLVNSEQPKNGENLPQQTTLYEKSYPSQNYDDLVPIVQEFLKEAKQELEQEITIKNGCFGIAGPVVNNTSELTNLSWSLTGDRLEKQLSLERVNLINDFAAIGYGILGLEKDDLYILQDMEPKPNTPMAVLGAGTGLGECFLTPLESGIYEVFSSEGSHGDFAPRNELEFELLTYIQDNYNLPRVSIERIVSGMGISAIYQFLRHKYPEKESEKFKEIYQAWESKQKVDLSAEVSKAAMENNDALCQQTMELFISAYGAEAGNLALKILPYGGLYVAGGIAAKILPLLKKGSFIEAFKAKGRMSSLLAQMPVYVILNPKVGLIGAALRAAR

SEQ ID NO: 59402 - protein, 562 aa, Photobacterium profundum
MNNDKRPLYIPYAGPALLETPLLNKGSAFSIEERMFFNLEGLLPEAIESIEEQTERAYQQYQKFDKDMDKHIYLRNIQDTNETLFYRLVENHITEMMPIIYTPTVGAACEDFSNIYRRGRGLFISYPNRDRIEDMLNNASRQNVKVIVVTDGERILGLGDQGIGGMGIPIGKLALYTACGGISPAYTLPVVLDVGTNNPQRLSDPMYMGWRHTRISGQEYDNFVDEFIQAVKRRWPDALIQFEDFAQKNAMPLLERYKNKICCFNDDIQGTAAVTVGSLLAACKAAKSKLSEQRISFLGAGSAGCGIAEAIIAQMVSEGISEAQARSQVFMVDRWGLLIDDMPNLLNFQQALVQKRDTVNEWDLADNNVSLLDVMRNAKPTVLIGVSGVPGLFSEDVIREMHAHCKRPIVFPLSNPTSRVEATPADIINWTDGNALVATGSPFEPVVHNGKTYPIAQCNNSYIFPGIGLGILAVNARRVTDEMLMASSRALAECSPLAINGHGALLPPLEDIQKVSRKIAFAVAKKAIEQGKAPKNSDERILDKIDANFWQSDYRNYKRTSF

SEQ ID NO: 59403 - protein, 199 aa, Streptococcus pyogenes MGAS8232
MAEEQVLNTHNASILLSAANKSHYPQDDLPEIALAGRSNVGKSSFINTILGRKNLARTSSKPGKTQLLNFFNIDDKLRFVDVPGYGYAKVSKSERAEWGKMIEEYLTSRDNLRAVVSLVDLRHAPSKEDIQMYDFLKYYDIPVIVVATKADKIPRGKWNKHESVVKKALNFDKSDTFIVFSSVERIGIDDSWDAILEQV

SEQ ID NO: 59404 - protein, 227 aa, Streptococcus pyogenes MGAS8232
MEALKKIAGVTAAQYVTDGMTIGLGTGSTAYYFVEEIGRRVKQEGLQVVGVTTSSVTSKQAEVLGIPLKSIDDIDSIDLTVDGADEVDKDFNGIKGGGAALLMEKIVATPTKEYIWVVDASKMVEHLGAFKLPVEVVQYGADRLFRVFEKAGYKPSFRMKGDSRLVTDMQNYIIDLDLGCIKDPVAFGHLLDGTVGVVEHGLFNGMVDKVIVASKDGVTVLEAPKAG

SEQ ID NO: 59405 - protein, 365 aa, Pimpinella anisum
MAPSTLTALAQEKTLNSKFVRDEDERPKIAYNQFSDEIPVISLAGIDDDKRSQICRKIVEACEGWGIFQVVDHGIDTDLISEMTRLAREFFALPAEEKLRFDMTGGKKGGFIVSSHLQGEAVQDWREIVTYFSYPVPARDYSRWPDKPEGWRSVTEVYSDKLMGLACKLLEVLSEAMGLEKEALTKACVDMDQKVIVNYYPKCPQPDLTLGLKRHTDPGTITLLLQDQVGGLQATRDGGKTWITVQPVEGAFVVNLGDHGHYLSNGRFKNADHQAVVNSNSSRMSIATFQNPAPNATVYPLTIREGEKAVMEEPITFAEMYKRKMSKDIEMAKLKKLAKEKVLQEQEAEKAKLQMTPKSADEIFA

SEQ ID NO: 59406 - protein, 840 aa, Oryza sativa (indica cultivar-group)
MASRRQWGAGAGAGDVPAQERKGEAAKIARRPKTTTVVAQQPPRIRRALADVSNLVNGRAALPVVNRQKAAAAAADKCRKPIKQRNENNKAAKPEVIVISSDSEKHKKNPAQRAASRRAPIQTLTSILTKCSRASDGVISPKKELIYDIDASDAHNELAVVDYVEDIYRFYRNTENTYRPLCTYMVSQTEINGRMRAILTDWLIEVHYRLMLMPETLYLTVYIIDQYLSLENVPRKELQLVGVSAMLIACKYEETWAPLVKDFLVISDNSFSRQQVLSTEKSILNKLQWNLTVPTMYMFILRYLKAALGDEELEHMTFFYAELALVQYSMLFFAPSVIAAAAVYAARCTLGLSPLWSDLLEYHTGLAEPQLLECARRLVSLHAAAPESRQKVVYKKYASPKLGAVSLHSPAKKLLPPPSPVCVLQFLVCCCCYGHIQFVFFSSWFVVVMACTMSSMACHSLPESGSNLSAADELFQNQRSEQGIYWTLWDSRLSDDLNTTTVYSDNHGSNGGGTQSFDTSEHCSTVPSDSDEQPGYPSQFEPLHMEQTNDMFLSQFSDEEVRRMDAPFQALDMFPDSMHRLMSYEHILNGALVSDSKNQEVNMDQDDMDTCGFPLYFSHGLQDDGGLPSFAKGMVAADTSSMDKAGASATERGDPGSSPPGFEEAVLEELEEVMVQMARTTRICLRDAFYRLAEGSRSPRSAAAAADGAAVAEATRYHAQAAVDLSRSLLEILQLVILMLSVSSSPLAAANPLQCVDDAAAPSPRRDRQDGGEPHLQAAAVLTGSRGGDDAAHACLRRPSSPSPDHRRTGGDSLGFSFQCDLARRIASSLACLTKDTLCM

SEQ ID NO: 59407 - protein, 472 aa, Candidatus Protochlamydia amoebophila UWE25
MIVFAFNKSYATVHFLTELYPMGEKMNTLTMLRQRSSQVVETSDSQSVDMRQVASLILSGGEGTRLHPLTLARCKPAINFGGKYRLIDVPISNSLHAGCKKVFLLTQFLSSSLHQHVFQTYMQGPGAGSIEILTAEQKPSKKNWFQGTADAVRQNIDYLLESPFEYFLILSGDQLYNIDFQEMVHFAKKNDSDVVVATIPVNTQDAKRMGILKVDEQNSITSFYEKPQDNDLLQQLRSPSNILEKAGVAPTGERVYLGSMGIYLFKRKALVELLSEDIREDFGKHLIPTKVASGKISAYLYTGYWEDIGTIETFYQANLALTETNPVFNFHNEARPIYTYRYDLPPAKFTTCQIQKSILCEGSIIEADEITHSLLGPRTVIGSGAIIRDSYLMGNDYYVSPVNDHCKLPSEPQIGENCIIKKAIIDKNVRIGKGVQLINKQQLTRYESELVFIRDGIIVVPRGSVLPDGFIL

SEQ ID NO: 59408 - protein, 131 aa, Trichodesmium erythraeum IMS101
MKIIKTDLTIICVRTDREEQMKKLLSIVVLTIMFVVVALQPSAFAADIASGKGVFQGNCAACHIGGKNNINPAKTLQKSDLEKYGMFAAEKIIYQVTNGKNAMPAFGRRLKPQQIENVAAYVMAQAEGGWK

SEQ ID NO: 59409 - protein, 306 aa, Glycine max
MTSTPHLEETSPNIASKMNFNNVNVPKVPGGGVAALLKVSIIGGLVVYGAANSLYNVEGGHRAIVFNRVVGVKDKVYPEGTHIMIPLFERPVIYDVRARPHLVESTSGSRDLQMVKIGLRVLTRPVPDQLPTVYRTLGENYNERVLPSIIHETLKAVVAQYNASQLITQRENVSREIRKILTQRASQFNIALDDVSITSLTFGKEFTAAIEAKQVAAQEAERAKFVVEKAEQDKQSAVIRAQGEAKSAQLIGEAIANNPAFITLRKIEAAREIAHTISNSANKVYLNSDDLLLNLQELNLEPSGKR

SEQ ID NO: 59410 - protein, 565 aa, Oryza sativa (japonica cultivar-group)
MATRGKKLGGVAGGGGAAVRVVGVVCVMAVPLFALLVLGGWASASTVWQSAARLTAVTAGFTNASKPSATGDAATGADELFGGLLAAGGCFDRGACLSRHESPRYYKSSPFSPSPYLLQKLRDYEARHRRCGPGTPGYAKSDEQLRSGHSSEVMECNYLVGLPYNGLGNRMLSLVASFLYALLTDRVFLVHFPDDFADHFCEPFPGGEGETATTWVLPPDFPVADLWRLGVHSNQSYGNLLAAKKITGDPARETPVSVPPYVYLHLAHDLRGDDERFYCNDDQLVLAKVNWLLLQSDLYFVPSLYAIPEFQDELRWMFPEKESVTHLLARYLLHPSNSVWGMVMRYHHAYLAPAAEMIGVQIRMFSWASIPVDDMYKQVMACSSQERILPDTDGGDAPAPARTNTSGGGATTAILVASLQVEYYERLKGKYYEHAATASGGGRRWVGVFQPSHEEKQEMGKRAHNQKALAEIYLLSFADVLLTSGMSTFGYMSSALAGLRPAMLLTAFNHKVPRTPCVRAVSMEPCFHKPPPAAATCQGKLAVSENVTRHIKRCEDLAGGIKLFD

SEQ ID NO: 59411 - protein, 403 aa, Triticum aestivum
  misc_feature (156)..(156): Xaa can be any naturally occurring amino acid
  misc_feature (190)..(190): Xaa can be any naturally occurring amino acid
MPTKRSVGTLGEKDLSGKKVLLRADLNVPLDDGQRIADDNRIRASVPTIKFLMGKGAKVVLASHLGRPKGVTPKYSLKPLVPRLSELLGVDVVMANDCIGEEVEKLAAALPDGGVLLLENVRFYKEEEKNDPEFAKKLASVADLYVNDAFGTAHRXAHASTEGVTKYLRPAVAGFLMQKELDYLVGAVAXNPKKPFAAIVGGSKVSTKIGVIESLLSKVDILILGGGMIYTFYKAQGHAVGKSLVEEDKLELANSLIEKAKSKGVSLLLPTDIVVADNFAADAESKIVPASAIPDAWMGLDIGPDSIKKFSETLDTTKTVIWNGPMGVFEFEKFAAGTDAIAKKLADITAKGVTTIIGGGDSVAAVEKAGLASKMSHISTGGGASLELLEGKTLPGVLALDDA

SEQ ID NO: 59412 - protein, 443 aa, Vibrio parahaemolyticus RIMD 2210633
MSYVFHRHCHATLPIIDKGEGVYLFDKQGKQYLDACGGAAVSNLGHSHQAVKKAMLEQLERVPFAHTGFFTSDSSERLAELICQHMPEQFNHVYLVSGGSEAVESALKMARQYFVESGKPEKKQFIARQQSYHGNTLGALAVGGNEWRREPFKPILHPSHHIAPCYAYRYQQSHESELDYSLRAANELEAKILELGADNVMAFVAEPIVGATAGAVPATQGYFKRIREICDQYDVLLILDEVMCGVGRSGSFFAFEQEEAEPDLVCMAKGLGAGYQPIGAVVANDRVYQAIADGSGFFQHGHTFMAHPVACAAAVATIQTIFQDDLLTAVNRQSALLRNELASALAHLPYIGDIRGKGLFFGIELVADKESKSPLSKATLADKRIKQRAMENGLMCYPMGGTIDGVNGHHILLAPPFIIQSHHIDELVGKLSLTLKEVAEIWK

SEQ ID NO: 59413 - protein, 556 aa, Oryza sativa (japonica cultivar-group)
MTKALQAAGGKPWRPGKMSTVLVAVLMTMPPLVVIFSGRIGDQAMWIKTAVDGIRGGTDDDVSFMKHPTTSHDKLLGGLLVDGFDQESCHSRYQSAAYRRNAGRRPSEHLVSKLRRHEDLQRRCGPGTAAYSAAVEQLKSGKSPAAAEASPEACRYLVSISYRGLGNRILAAASAFLYAMLTDRVLLVDPSNEMGELFCEPFAGTTWLLPPEFPLVGYQGFYLHTAERYGKMREDRVLRPDGGEAAAAAPPPAFAYIHLDYNQTDYDKLFFCDEDQRLLSSIQWLVMRTDSYIVPGLFLVDAFQDELAALFPERDAVFHHLGRYLFHPTNHVWGLVTRYYRGHLAWARRRVGIQVRVSSWEWESPEILRTITSCTQDEGLLPRVLDDTDQEPPATAAASARRGLRPSAVVITSLKSWYYEKMKGMYWERATESGEVVVFDQPSHEEQQMYGVRAHERKAWAEMYLLSTTDVLVTTGTSTFGYVAQGLGGLTPWVLPRREVNGTAPPCRRDMSMEPCFHVAPLYDCKRWEDAGKIVPHVRHCHDMPAGLKLVDRTEW

SEQ ID NO: 59414 - protein, 342 aa, Methanosarcina mazei Go1
MTKTAAVIKGDGVGPELVDAMLKVAEASGTDVEFVMCEAGAGWWEEHGGNSLIPEETWQILDSSDACFKGPTTTPGGIGSPRSVAVSIRRKYDLYANVRPIKTFPNSSAPLGDVEMVCVREGTEGLYIGEEIQLTDDVSIAIRKITRTASSKIARYAFEDAKKRGYDTVVPIHKSNILKLTCGSFLEEVEKVAHDFPDIEVWPYHIDNIAQQLIKNPQIFNKKVLLSTNLFMDVISEECSALVGSIGLIYSANIGDNFAMFEPAHGSAPKYAGLDKVNPVATVLAGAWMLDYLGEKDKSDAIFKATERVISEGKYVTYDLGGSAKLSQMADEIAKYTEEILK

SEQ ID NO: 59415 - protein, 228 aa, Staphylococcus aureus subsp. aureus Mu50
MPKLILCRHGQSEWNAKNLFTGWEDVNLSEQGINEATRAGEKVRENNIAIDVAFTSLLTRALDTTHYILTESKQQWIPVYKSWRLNERHYGGLQGLNKDDARKEFGEEQVHIWRRSYDVKPPAETEEQREAYLADRRYNHLDKRMMPYSESLKDTLVRVIPFWTDHISQYLLDGQTVLVSAHGNSIRALIKYLEDVSDEDIINYEIKTGAPLVYELTDDLEVIDKYYL

SEQ ID NO: 59416 - protein, 118 aa, Glycine max
  misc_feature (66)..(66): Xaa can be any naturally occurring amino acid
KLVNYYVKEKYTLRYTGGMVPDVNQIIVKEKGIFTNVTSPTAKAKLRLLFEVAPLGFLIEKAGGHXSSDGKQSVLDKVISQLDERTQVAYGSKNEIIRFEETLYGSSRLAASATVGAT

SEQ ID NO: 59417 - protein, 255 aa, Xanthomonas axonopodis pv. citri str. 306
MCLVALAWKVHPRWRLLLAGNRDEFHERPTAALARWAAPADNLLAGRDLRSGGSWVGLDRDGRAAVVTNVRDPLATSSGRSRGHLIADYLSGSLGATVYADALAGAAHAFPPFNLLLCDADRCEHLSNHPPLARQLAAGIHGMSNGPLDAPWPKTAALTKVLHRWCADGDEDLQPLWAALGNPAIAPDAALPQTGVDLATERLLSAAFISGPSYGTRASTIVAVDHHGHGFIHERRFGPNGIFQGEARLEIPGSR

SEQ ID NO: 59418 - protein, 591 aa, Oryza sativa (japonica cultivar-group)
MGSGGAAAAAAAVPLRKEKQRSAAGRWPEVEDGVVPATAKRHVRRAWRCGVNVVLAAFVMVVPPMVILLDARGAGAPAVWISSVNAFRRGDGSILQWPAAAAARDKLLGGLLADGLDDGSCHSRYQSAMYRRNAGREPSPHLVSKLRRHEELQRRCGPGTAAYSDAVERLRSGKSGGIVSPSPEAECRYLVSISYRGLGNRILAAASAFLYAMLTDRVLLVDPSNEMDELFCEPFPGATWLLPPGFPLANYTSFSVETAESYGNMVKNKVITTDAGDAAPTTAQLPAFAYIHLDHTSTVEDKFFFCDEDQRAIRNIPWLVMRTDSYIVPGLFLVTGFQDELDSLFPETDAVFHHLGRYLFHPTNHVWGLVTRYYDAYLATAQQRVGIQVRVFGAQPESPKLLDQITTCTQKEKLLPEVIAAGEPPVVDVAPANSKSKAVLVTSLKSWYYEKMKSMYWEHATATGEAVSVHQPSHEEYQRFGARSHDGKAWAEIYLLSLSDALVTSGWSTFGYVAQGLAGLTPWVMHKPANDTAAAAGDDPPCRRDVSMEPCFHAPPFYDCRLKRGADTGKMVPHVRHCDDVQWGLKLVRRG

SEQ ID NO: 59419 - protein, 440 aa, Methanosarcina mazei Go1
MNLNNIRSSMTESTKSKDESMRSHLVKPGSVYDGIEPGELGETTESVQDRVRQLESRNSFLEEQCSQIESEKRYLENQKIKYEREIRKLQSELDRMKTSPLIIGTVIDVIKNDRIIVRSSNGPQFLVNVSQYIDEKKLLPGAKVALNQHTLAIAEVIPSTEEPFVAAMEVIESVEVDYDQIGGLDEQIQELQEAVELPLTSPERFARIGIEPPKGVLLYGLPGTGKTLLAKAVAHRTNATFIRVVGSELVQKYIGDGSKLVREIFEMARKKAPSIIFIDELDSIAARRLNETTGADREVQRTLMQLLAEMDGFDKRKNIRIIAATNRPDVLDPAILRPGRFDRLVHVPMPGIEARGKILKIHCEKMTLAEDIDFKKLAKATEGMSGADLKAIATEAGMFAVRRDKELVEMEEFLEAVEKVSMAADTQKMMPSNLPETMFV

SEQ ID NO: 59420 - protein, 458 aa, Escherichia coli O157:H7 EDL933
MKNASNVSEDTASNQEPTLHRGLHNRHIQLIALGGAIGTGLFLGIGPAIQMAGPAVLLGYGVAGIIAFLIMRQLGEMVVEEPVSGSFAHFAYKYWGPFAGFLSGWNYWVMFVLVGMAELTAAGIYMQYWFPDVPTWIWAAAFFIIINAVNLVNVRLYGETEFWFALIKVLAIIGMIGFGLWLLFSGHGGEKASIDNLWRYGGFFATGWNGLILSLAVIMFSFGGLELIGITAAEARDPEKSIPKAVNQVVYRILLFYIGSLVVLLALYPWVEVKSNSSPFVMIFHNLDSNVVASALNFVILVASLSVYNSGVYSNSRMLFGLSVQGNAPKFLTRVSRRGVPINSLMLSGAITSLVVLINYLLPQKAFGLLMALVVATLLLNWIMICLAHLRFRAAMRRQGRETQFKALLYPFGNYLCIAFLAMILLLMCTMDDMRLSAILLPVWIVFLFVAFKTLRRK

SEQ ID NO: 59421 - protein, 565 aa, Escherichia coli O157:H7
MEPKTKKQRSLYIPYAGPVLLEFPLLNKGSAFSMEERRNFNLLGLLPEVVETIEEQAERAWIQYQGFKTEIDKHIYLRNIQDTNETLFYRLVNNHLDEMMPVIYTPTVGAACERFSEIYRRSRGVFISYQNRHNMDDILQNVPNHNIKVIVVTDGERILGLGDQGIGGMGIPIGKLSLYTACGGISPAYTLPVVLDVGTNNQQLLNDPLYMGWRNPRITDDEYYEFVDEFIQAVKQRWPDVLLQFEDFAQKNAMPLLNRYRNEICSFNDDIQGTAAVTVGTLIAASRAAGGQLSEKKIVFLGAGSAGCGIAEMIIAQTQREGLSEEAARQKVFMVDRFGLLTDKMPNLLPFQTKLVQKRENLSDRDTDSDVLSLLDVVRNVKPDILIGVSGQTGLFTEEIIREMHKHCPRPIVMPLSNPTSRVEATPQDIIAWTEGNALVATGSPFNPVVWKDKIYPIAQCNNAFIFPGIGLGVIASGASRITDEMLMSASETLAQYSPLVLNGEGLVLPELKDIQKVSRAIAFAVGKMAQQQGVAVKTSAEALQQAIDDNFWQAEYRDYRRTSI

SEQ ID NO: 59422 - protein, 565 aa, Escherichia coli O6
MEPKTKKQRSLYIPYAGPVLLEFPLLNKGSAFSMEERRNFNLLGLLPEVVETIEEQAERAWIQYQGFKTEIDKHIYLRNIQDTNETLFYRLVNNHLDEMMPVIYTPTVGAACERFSEIYRRSRGVFISYQNRHNMDDILQNVPNHNIKVIVVTDGERILGLGDQGIGGMGIPIGKLSLYTACGGISPAYTLPVVLDVGTNNQQLLNDPLYMGWRNPRITDDEYYEFVDEFIQAVKQRWPDVLLQFEDFAQKNAMPLLNRYRNEICSFNDDIQGTAAVTVGTLIAASRAAGGQLSEKKIVFLGAGSAGCGIAEMIIAQTQREGLSEEAARQKVFMVDRFGLLTDKMPNLLPFQTKLVQKRENLSDWDTDSDVLSLLDVVRNVKPDILIGVSGQTGLFTEEIIREMHKHCPRPIVMPLSNPTSRVEATPQDIIAWTEGNALVATGSPFNPVVWKDKIYPIAQCNNAFIFPGIGLGVIASGASRITDEMLMSASEMLAQYSPLVLNGEGLVLPELKDIQKVSRAIAFAVGKMAQQQGVAVKTSAEALQQAIDDNFWHAEYRDYRRTSI

SEQ ID NO: 59423 - protein, 563 aa, Pseudomonas syringae pv. phaseolicola 1448A
MTKTSRPLYISYAGPSLLEMPLLNKGSAFTPQERVEFNLIGLLPQNVETIEEQVTRVYSQYKQCASDLDKHIYLRSIQDNNETLFFRLLDSHLDEMLPIIYTPTVGQACQEFSKIYRTHRGLFISYPERDRIDDILRSATKDRIKIIVVTDSERILGLGDQGIGGMGIPIGKLSLYTACGGISPAYTLPIVLDVGTNNRELLDDPMYMGWRHERVSGKEYEDFIALFIDAVQRRWPDVLLQFEDFAQSNAMPLLEKYRDELCCFNDDIQGTASVAVGTLLAACKAKNETLGQQKVVFVGAGSAGCGIAEHIIAAMRIEGLSESEARKRIFMVDRFGLLTEGMDNLLDFQKRLAQKTADVSGWTAGTEAFPQLLDVVTNAGATVLIGVSGQRGLFTEQVIRELHKHCAKPLVMPLSNPTSKVEATPEEILRWTDGNALVATGSPFAPVEINGRTVHIAQCNNSYIFPGIGLGVVACKASRITDRMLMAASNALAECSPMVTGQGDAVLPPLKEIQQVSRKIALAVAKEAQAEGLALETSEEALLEAIERNFWLPGYRAYRRRSV

SEQ ID NO: 59424 - protein, 563 aa, Pseudomonas syringae pv. tomato
MTTTSRPLYISYAGPSLLEMPLLNKGSAFTPQERIEFNLIGLLPQNVETIEEQVTRVYSQYKQCASDLDKHIYLRSIQDNNETLFFRLLDSHLDEMLPIIYTPTVGQACQEFSKIYRTHRGLFISYPERDRIDDILRSATKDRIKIIVVTDSERILGLGDQGIGGMGIPIGKLSLYTACGGISPAYTLPIVLDVGTNNRELLDDPMYMGWRHERVSGKEYEDFIALFIDAVQRRWPDVLLQFEDFAQSNAMPLLEKYRDELCCFNDDIQGTASVAVGTLLAACKAKNETLGQQKVVFVGAGSAGCGIAEHIIAAMRIEGLSESEARKRIFMVDRFGLLTEGMGNLLDFQLRLAQKSADVAGWTAGTETFPQLLDVVTHAGATVLIGVSGQRGLFTEQVVRELYKHCAKPLVMPLSNPTSKVEATPEEILRWTDGNALVATGSPFAPVEINGRTVHIAQCNNSYIFPGIGLGVVACKASRITDRMLMAASNALAECSPMVTGQGDAVLPPLKEIQQVSRKIALAVAKEAQAEGLALETSEEALLAAIERNFWLPGYRAYRRRSV

SEQ ID NO: 59425 - protein, 231 aa, Oryza sativa (indica cultivar-group)
MDSKDKEKEHEQTASGRNPDVNDVEEEEEDEEGNKRAVVLGPQVPLKEQLELDKDDESLRRWKEQLLGQVDTEQLGETAEPEVKVLNLTILSPDRPDLVLPIPFVPDEKGYAFALKDGSTYSFRFSFIVSNNIVSGLKYTNTVWKTGVRVENQKVMLGTFSPQLEPYTYEGEEETTPAGMFARGSYSAKLKVFKLIKFSSDVLIEFVDDDGKCYLEMSYYFEIRKEWPTIQ

SEQ ID NO: 59426 - protein, 563 aa, Pseudomonas syringae pv. syringae B728a
MTKTSRPLYISYAGPSLLEMPLLNKGSAFTPQERVEFNLIGLLPQNVETIEEQVTRVYSQYKQCASDLDKHIYLRSIQDNNETLFFRLLDSHLDEMLPIIYTPTVGQACQEFSKIYRTHRGLFISYPERDRIDDILRSATKDRIKIIVVTDSERILGLGDQGIGGMGIPIGKLSLYTACGGISPAYTLPIVLDVGTNNRELLDDPMYMGWRHERVSGKEYEDFIALFIDAVQRRWPDVLLQFEDFAQSNAMPLLEKYRDELCCFNDDIQGTASVAVGTLLAACKAKNETLGQQKVVFVGAGSAGCGIAEHIIAAMRIEGLSESEARKRIFMVDRFGLLTESMDNLLDFQKRLAQKTADVSGWTAGSEAFPQLLDVVTHAGATVMIGVSGQRGLFTEQVIRELHKHCAKPLVMPLSNPTSKVEATPEEILRWTDGNALVATGSPFAPVEINGRTVHIAQCNNSYIFPGIGLGVVACKASRITDRMLMAASNALAECSPMVTGKGDAVLPPLKEIQQVSRKIALAVAREAQAEGLALETTEEALLEAIERNFWLPGYRAYRRRSV

SEQ ID NO: 59427 - protein, 420 aa, Glomerella cingulata
MTTNGSDKPQVQPCRYKVGKTLGAGSYSVVKECVHIDTGRYYAAKVINKRLMAGREHMVRNEIAVLKKVSMGHQNILTLVDYFETMNNLYLVTDLALGGELFDRICRKGSYYESDAADLIRATLSAVAYLHDHGIVHRDLKPENLLFRTPEDNADLLIADFGLSRIMDEEQFHVLTTTCGTPGYMAPEIFKKIGHGKPVDVWALGVITYFLLCGYTPFDRDSDFEEMQAILNADYSFTPFDYWRGVSEHAKDFIRKCLTIDPKKRMTAHEALQHPFVAGYLNGEGEGQNLLPTVKKNFNARRTLHAAIDTVRAINKLREGQQNLMDGAKSREPDRGLKSPPNAKKDDSAISMGNTNHKDSGYGTQPEADNQNDVCHDRCGTTPTSVPASLRVRAVSRTRSLRQAKDCGAVPQCDDSLEAV

SEQ ID NO: 59428 - protein, 565 aa, Salmonella choleraesuis
METTTKKARSLYIPYAGPVLLEFPLLNKGSAFSVEERRNFNLSGLLPEVVESIEEQAERAWLQYQGFKTEIDKHIYLRNIQDTNETLFYRLVQNHLEEMMPVIYTPTVGAACERFSEIYRRARGVFISYPNRHNMDDILQNVPNHNIKVIVVTDGERILGLGDQGIGGMGIPIGKLSLYTACGGISPAYTLPVVLDVGTNNQQLLNDPLYMGWRHPRITDDEYYAFVDEFIQAVKQRWPDILLQFEDFAQKNAMPLLTRYRDEICSFNDDIQGTAAVTVGTLIAASRAAGSQLSEQKIVFLGAGSAGCGIAEQIIAQTQREGLSEDAARQNVFMVDRFGLLTDRMPNLLPFQAKLVQKCDNLQHWDTENDVLSLLDVVRNVKPDILIGVSGQTGLFTEEIIREMHKHCPRPIVMPLSNPTSRVEATPQDIIVWTEGNALVATGSPFSPVIWKDKVYPIAQCNNAYIFPGIGLGVIASGASRITDEMLMSASETLAKHSPLVNNGEGLVLPALKDIQVVSRAIAFAVGKMAQQQGVAVKTSAEALQQAIDDNFWKPEYRDYRRTSI

SEQ ID NO: 59429 - protein, 196 aa, Salmonella typhimurium LT2
MSAQALVCLAPGSEETEAVTTIDLLVRGGIHVTTASVASDGNLTIVCSRGVKLLADAPLVEVADGDYDIIVLPGGIKGAECFRDSPLLVETVKQFHRSGRIVAAICAAAATVLVPHDIFPIGNMTGFPALKDKIPAEQWLDKRVVWDARVKLLTSQGPGTAIDFGLKIIDLLAGREKAHEVASQLVMAAGIYNYYE

SEQ ID NO: 59430 - protein, 617 aa, Gossypium hirsutum
MGLCTSKPSPNPSDSTNASINTRNNDIYRKPNSVSASPLPDGVNSKEDQGKQGEEEKESSNPNNEGKKSPFFPFYSPSPAHYLFSKKSPARSSTNSTPKRFFRRPFPPPSPAKHIRAVLARRHGSVKPNEAAIPEGSDAEAAGATGTGLDKSFGFSKHFGSKYELGDEVGRGHFGYTCTAKFKKGELKGQQVAVKVIPKAKMTTAIAIEDVRREVKILRALSGHSNLVQFYDAYEDHDNVYIVMELCEGGELLDRILSRGGKYTEDDAKAVMIQILNVVAFCHLQGVVHRDLKPENFLFTSKDENSQLKAIDFGLSDFVKPDERLNDIVGSAYYVAPEVLHRSYSTEADVWSIGVIAYILLCGSRPFWARTESGIFRAVLKADPSFDEAPWPSLSSEARDFVKRLLNKDPRKRLTAAQALSHPWIKKYNDVKVPLDILIFKLMKAYLRSSSLRKAALRALSKTLTVDELFYLKEQFALLEPNKNGTISLENIKAVLMKNATDAMKDARIPEFLASLNALQYRRMDFDEFCAAALTVHQLEALDRWEQHARCAYEIFEKEGNRPIVIEELASELGLSPSVPVHAVLHDWIRHTDGKLSFLGFVKLLHGVSSRTIAKAQ

SEQ ID NO: 59431 - protein, 519 aa, Gossypium hirsutum
IKRIMLPPSKREFKDLFVVFELMESDLHQVIKANDDLTREHHQFFLYQMLRAMKYMHTANVYHRDLKPKNILANANCKLKVCDFGLARVAFNDTPTTVFWTDYVATRWYRAPELCGSFFSKYTPAIDIWSIGCIFAEVLTGKPLFPGKSVIHQLELITDLIGTPSLETISGVRNDKARKYLSEMRKKKPVPFSQKFPNADPLAVRLLQRLLAFDPKDRPTAEEALADPYFKGLSKIEREPSCQPISKLEFEFERRRVTKEDVRELIYREALEYHPQLLKDYLNGHEGSNFLYPSPVGQFKKQFAYLEENGGRSAPVFPLERKHVSLPRSTVHSNGITPNTQSTSVSYENRQDREADARKAMDVISSKPKPTRPPPRVPSEVLSCPYSKPGRVVGSVVPYEDVKNIKDGYHAKNFYRNAVPPQNVSPHCFLLNQEKSGTQTDRNLQTKPQQQFSMVAKPSPGTAFDMNSNPYYRTQAKTERRLPIDAKLLQAQSQFGAVGAAAVAVAAHRNAGTVHYGLS

SEQ ID NO: 59432 - protein, 493 aa, Oryza sativa (japonica cultivar-group)
MSGWASPSRMYASKGSKRDVLMGGLLVPGLDERTCASRYSSAMYRKNTARSPCRHLVKRLREQEALQRRCGPGTAAYWRAAERLGSRRNGTAGADDEGCKYLVLVPYRGLGNRMLAMASAFLYAMLTGRALLVDRGESLADLFCEPFPGTSWLLPPEFPIKNLQDLTGEAPESYRNLVQSDRPATSVSELPYVFVDLDHGCTYHDKLFYCDDERHFLHRAPWLLMRTDGYFPPALFLNPAYQDELDRLFPRKDSVFYLLAHYLLHPTNKVWGLITRFYDSYLRDSDERLGIQVRVFDGDTPFKHILDQITACTSQERLLPEVVEQEPSSFPAPAAAATAARSKAVLMTGLNSWYYDNIRSRYWQSPTATGEVVRVHQPSHEEHQLSGSTTHDMKAMAEMYLLSMTDAIVTSGWSTFGYVGHGLGGLSPWVMFKPENLTTPDPPCRRAVSMEPCLHGPPFYDCRVKRGADTGKLVPHVRHCEDMSWGLKLVHPE

SEQ ID NO: 59433 - protein, 548 aa, Oryza sativa (japonica cultivar-group)
MDTDKLGEAAAAHPPEAEKRRGVAAPGAATVLVLVALPLMLVSYFFGDLAADTVVRLHRFKESSLSSSSPAAAADRLLGGLLSPEFDEASCLSRYEASSRWKPSPFRVSPYLVERLRRYEANHRRCGPGTARYRDAVARLRSGDGDGDAECRYVVWLPIQGLGNRMLSLVSTFLYALLTGRVVLVHEPPEMEGLFCEPFPGTSWLLPPDFPYKGGFSAASNESYVNMLKNGVVRHDGDGGALPPYVYLHLEQIHLRLQNHTFCEEDHRVLDRFNWMVLRSDSYFAVALFLVPAYRAELDRMFPAKGSVFHHLGRYLFHPGNRAWGIVERFYDGYLAGADERLGIQVRIVPQMAVPFDVMYEQILRCTREHGLLPQVTSTSESAGGRPPPPPTATATKVKAVLVVSLKREYYDKLHGAYYTNATASGEVVAVYQPSHDGDQHTEARAHNERALAEIYLLSFSDAVVTTAWSTFGYVAHALAGVRPWQLAPLDWGKMRADVACARPASVEPCLHSPPPLVCRARRDRDPAAHLPFLRHCEDVPAGLKLFD

SEQ ID NO: 59434 - protein, 452 aa, Staphylococcus aureus subsp. aureus Mu50
MNYTQQLKQKDSEYVWHPFTQMGVYSKEEAIIIEKGKGSYLYDTNGNKYLDGYASLWVNVHGHNNKYLNKVIKKQLNKIAHSTLLGSSNIPSIELAEKLIEITPSNLRKVFYSDTGSASVEIAIKMAYQYWKNIDREKYAKKNKFITLNHGYHGDTIGAVSVGGIKTFHKIFKDLIFENIQVESPSFYRSNYDTENEIMTAILTNIEQILIERNDEIAGFILEPLIQGATGLFVHPKGFLKEVEKLCKKYDVLLICDEVAVGFGRTGKMFACNHEDVQPDIMCLGKAITGGYLPLAATLTSQKIYNTFLSDSHGVNTFFHGHTYTGNQIVCTVALENIRLYEKRKLLSHIETTSSTLEKQLHALKRHRNVGDVRGRGLMFGVELVTDKDSKTPLEIEKVERIVRKCKENGLMIRNLENVITFVPVLSMSNKEVKTMVRIFKKAVHNILDRKC

SEQ ID NO: 59435 - protein, 395 aa, Campylobacter jejuni
MKMDYKEQSHIVPAYKRFDIVLEKGQGVYLFDDKAKKYLDFSSGIGVCALGYNHAKFNAKIKAQVDKLLHTSNLYYNENIAAAAKNLAKASALERVFFTNSGTESIEGAMKTARKYAFNKGIKGGQFIAFKHSFHGRTLGALSLTANEKYQKPFKPLISGVKFAKYNDISSVEKLVNEKTCAIILESVQGEGGINPANKDFYKALRKLCDEKDILLIADEIQCGMGRSGKFFAYEHAQILPDIMTSAKALGCGLSVGAFVINQKVASNSLEAGDHGSTYGGNPLVCAGVNAVFEIFKEEKILENVNKLTPYLEQSLDELINEFDFCKKRKGLGFMQGLSLDKNVKVAKVIQKCQENALLLISCGENDLRFLPPLILQKEHIDEMSEKLRKALKSF

SEQ ID NO: 59436 - protein, 544 aa, Cyanothece sp. ATCC 51142
MTIRTVTTTPFDDQKPGTSGLRKAVPTFQKPHYLENFIQSIFDSLDGCEGQTLVVGGDGRYYNRQAIQVILKMAAANNIGRILVGCGGIFSTPAASAVIRKYNAFGGIILSASHNPGGPNGDFGVKYNVSNGGPAPEKVTNAIYECTKTINEYKILDAADINLDRPGSFKLGTMDVEVIDSVTPYVELMQQLFDFDKIKSMVSSDNFRMCMDSLHAVTGPYARALFEQYLGAKEGTVQNGTPLEDFGGGHPDPNLVYAHDLVDIMFGDNAPDFGAASDGDGDRNMILGKNFFVTPSDSLAVLTANATLVPGYEGGIAGVARSMPTSAAADRVAAKLGIDCYETPTGWKFFGNLLDAGKATLCGEESFGTGSNHIREKDGLWAVLFWLNILAVKGESVEKIVRDHWQEYGRNFYSRHDYEEVESGPANELMNRLRSMVGDMKGKTYGNYEVAYSDDFAYTDPVDGSVSEKQGIRIGFTDGSRIVFRLSGTGTKGATLRVYLESYEPDGSKHDVDTQEALSSLIELAEEIAQIKKFTGRDKPTVIT

SEQ ID NO: 59437 - protein, 555 aa, Magnetospirillum magnetotacticum MS-1
MLRGTLAPLRRATERIQAMVEGRVPQQALEVSRGDEVGRLITAFNALQDKLAVADDALREREALYHALFSGCKAVEMLIDPADGGRIIDANRAAEIYYGWTHDQLVSMRISQINILDQSAIAEEMHKAKAEERDHFDFRHRLASGEIRDVEVWSGPVQVTGRKLLYSIVHDVTARRRAEHELGSLLAFRRAILDGAGSSIIATTIDGTIRLLNPTAEQWLGYGADEVVGRTTPALFHDPDEVAARAAQLSRELGREVEPGFECFVARTLLGGQPDSGEWTYVRKDGGRFRVLLTISALYDDDGQLSGFLGVAHDISARLSMERELQRSNAELENFAYVASHDLRQPLRMVSSYLTLLQRRLGESLDQDCREFIAYAVDGAQRMDHMITDLLGYSRIGRGGAPQEKVDLGDVMKLAQANLGALIEENGADITVSEGLPVVMGNEVELERLFQNLISNAVKFQVKGRSPQVDVTWSSSTDEWIISVRDNGIGIDEAGQARLFQIFQRLVGQDEYPGSGIGLASCRKIAEHHGGRIWVESVPGEGSVFHVALPKSVVR

SEQ ID NO: 59438 - protein, 415 aa, Alkalilimnicola ehrlichei MLHE-1
MQAFTLQDGRLCAEAVPLEDIAEQVGTPTYVYSKAAIESAWRGFDQALGDHPHQVCYAVKANSNLAVLQLLARLGSGFDIVSGGELERVLAAGGDPRRVVFSGVGKTADEMRRALEVGIRCFNVESTAELSRLNRVAGELRLTAPVSLRVNPDVDARTHPYISTGLRENKFGIDIREAEAIYRQAANAAHLSVEGVDFHIGSQLTDLSPIADALERVLALVDRLAAEGITIRHLDVGGGLGIRYRDETPPAAEDYARVLLDGLQGRDLELLMEPGRAVVGNAGVLITRVQYLKDGSEQRFAVVDAAMNDLLRPSLYDGWHAITPVRPRADTDTLPWDIVGPVCETGDFLGKQRELALAEGDLLAVHSAGAYGFVMASNYNTRPRPAEVLVAGGCHHLVREREPLRALWRGEHLLD

SEQ ID NO: 59439 - protein, 293 aa, Bacillus circulans
METGTSRVKRGMAEMQKGGVIMDVMNAEQAKVAEAAGASAVMALERVPSDIRAAGGVARMADPTVLEEVMKVVSIPVMAKARIGHIVEARVLEALGADYIDESEVLTPADEVFHIDKKDFTVPFVCGAKDIGEALRRINEGASMLRTKGEPGTGNIVEAVRHMRLIQSQIRKIQSLAKDELYAEAKNLGAPYDLVLYIHENGKLPVVNFAAGGVATPSDAALMMELGADGVFVGSGIFKSDSPEKFARAIVEATTHYKDYKLIAEVSKNLGAPMKGIEISKLHASERMQDRGW

SEQ ID NO: 59440 - protein, 390 aa, Glycine max
  misc_feature (72)..(72): Xaa can be any naturally occurring amino acid
LISICLWKKWKKGSVEEVHVFEEYMGKDFGRGGGPRKYSYAELTQAANGFKDEHKLGQGGFGGVYRGYLKDXSLMLPFKRVSEGSDQGIKEFASEVSTISRLRHRNLVHLIGWCHAGKKLLLVYEYMPNGSLDTHLFKKQSLLKWAVRYNIARGLASALLYLHDEWEHCVVHTDIHSSNIMLDSQLNAQLGVFALARFVDHAKGAQTTALAGTMGYMAPECATLGRASKESDVYSFGVVALEIACGRIPINHRAQENEISIVQWVWGLFGGGRILDAADPRLEGDFEEEQIKCLMIVGLWCAHPDHNNRASIRQAIQVLNFEAPLPNLPSSLPVPTYLDGPLHSSIAPFSITASVEGHSQIRSSTANTNSSGFTTTSDDASPSVSLLYSR

SEQ ID NO: 59441 - protein, 209 aa, Flavobacteria bacterium BBFL7
MKNINQIFDNNKEWIKSKLAKDSTYFDKLASGQDPEILYIGCSDSRATAEEIMGLGPGDVFVHRNIANMASNLDLTAMGVINYAVEHLKVDHVVVCGHYGCGGVKAAMQSQDLGILNPYLRNIRDVYRMHKEELNAISDEDQRYRRLIELNVQEQCINVLKTSDVQIAFKRRGITVHGWVFDLATGELIDLKIDFAKILEDIMEIYHLD

SEQ ID NO: 59442 - protein, 497 aa, Pseudomonas syringae pv. tomato str. DC3000
MTTLTRADWEQRAQNLKIEGRAFIQGEYTAAASGETFDCISPVDGRLLAKVASCDAADAQRAVESARSAFDSGAWSRLAPAKRKATMIRFAGLLEQNAEELALLETLDMGKPISDSLGVDIPGGARALSWSGEAIDKLYDEVAATPHDQLGLVTREPVGVVAAIVPWNFPLMMACWKLGPALSTGNSVVLKPSEKSPLTAIRIAQLAIEAGIPAGVLNVLPGYGHTVGKALALHMDVDTVVFTGSTKIAKQLMIYAGESNMKRVWLEAGGKSPNIVFADAPDLQAAADSAASAIAFNQGEVCTAGSRLLVERSIKDRFLPMVIEALGTWKPGNPLDPATNVGALVDTQQMNTVLSYIAAGHTDGARLVAGGKQILQETGGTYVEPTIFDGVNNAMRIAQEEIFGPVLSVLTFDTAEEAIQIANDTPYGLAAAVWTANLSKAHLTARALRAGSVWVNQYDGGDMTAPFGGFKQSGNGRDKSLHAFDKYTELKSTWIKL

SEQ ID NO: 59443 - protein, 340 aa, Streptococcus pyogenes MGAS8232
MTIAIDWDNLGFEYHKLPFRYISYYKNGQWDKGQLTEDATLHISESAPALHYGQQAFEGLKAYRTKDGSIQLFRPDRNAARLQATADRLLMPQVSTEQFIDAAKQVVKANEDFVPPYGTGATLYLRPLLIGVGDIIGVKPAEEYIFTIFAMPVGNYFKGGLAPTNFIVSEAFDRAAPYGTGAAKVGGNYAGSLLPGKAAKSAGFSDVIYLDPATHTKIEEVGAANFFGITANNEFVTPLSPSILPSITKYSLLQLAEERLGMTVIEGDVPINELDKFVEAGACGTAAVISPIGGIQYKDNLHVFYSETEVGPVTRRLYDELVGIQFGDIEAPEGWIVKVD

SEQ ID NO: 59444 - protein, 180 aa, Synechococcus sp. WH 7805
MRSRLICSALALTAGLFVSPALGQTASDATTATVNKVLASTGAGFNVAAVESLIQRGDSAVSSGNLDRAKKDYDNARTAAKQLLAFYRDLSGAFRGLDARIPREMDAKGRKALSLLAQANLRLAALFRRQNQPEVAVPVLVEVVRLMTPAKPEGQKAYQSLLELGFVDTPFRGGQSATGS

SEQ ID NO: 59445 - protein, 107 aa, Synechococcus sp. WH 7805
MDAQTKTRIETLINSSPVFVFMKGTKLMPQCGFSNNVVQILNALGIGFETFDVLTDMEIRQGIKDFSDWPTIPQVYVKGEFMGGSDILIEMYNNGELKDKLEIALAS

SEQ ID NO: 59446 - protein, 73 aa, Arabidopsis thaliana
  misc_feature (26)..(26): Xaa can be any naturally occurring amino acid
SYDTIVASTPHATIFARFNRQKAYTXFPATLKANNDITSITSNCGRVNSIHMLPPIGKNNFETLSYLPDLTDS

SEQ ID NO: 59447 - protein, 345 aa, Oryza sativa (japonica cultivar-group)
MSRRRKREVAPPPQAVVSSTAPFAVPTSQAAPYPYGGLGFPPPPTAWLASPQPQAMPGSSAFHPPAAGKTDVHPDLEEWTDKRLSWMKDEDLRLISAWLNNSNDPIESNFKKNDKYWGDVAAAYNSTTPKNRARLVKQVKDRFGKIRKKVGNFCCSWKEVNSLYASGESNEDLMNKAQKIYENDFKDGPFLFMHCWNELKKQPKWHAYLEQLDKSNKRKADYNDVIPLDDEEDIPRPIGAKASKAQRSCKEKSKVQVCTTELEDDIRKFMDAHAATKEGQNEVLETQIRVSIDNHAAKKLSRQTAMIETYRDLMNKDTRKMPDDMRSELVHMLKCMREEIFNKNQ

SEQ ID NO: 59448 - protein, 294 aa, Antirrhinum majus
MEQYEKVEKIGEGTYGVVYKARDRVTNETIALKKIRLEQEDEGVPSTAIREISLLKEMQHGNIVRLQDVVHSEKRLYLVFEYLDLDLKKHMDSCPEFSQDPRLVKMFLYQILRGIAYCHSHRVLHRDLKPQNLLIDRRTNALKLADFGLARAFGIPVRTFTHEVVTLWYRAPEILLGSRHYSTPVDVWSVGCIFAEMVNQRPLFPGDSEIDELFKIFRVMGTPNEETWPGVTSLPDFKSAFPKWPAKELAAVVPNLDASGLDLLDKMLRLDPSKRITARNALQHEYFKDIGFVP

SEQ ID NO: 59449 - protein, 447 aa, Silicibacter sp. TM1040
MATATAKDVDRAVVSARRAFDDGRWSGLAPAARKKVLHRIADKIEAEALALTVLGVRDNGTEFNMALKAEAGSAAGTFRYYAEALDKVAGEVAPTAPDVLGLVHRAPVGVVGAIVPWNFPLMIGAWKLAPALAMGNSVVLKPAETASLSLLRLAEICADCGLPDGVLNVVTGPGAVTGAALSEHMDVDVMVFTGSGATGRRLLVASARSNLKRCYLELGGKSPNIVFADAKDLDHVAKVSAMGIFRNSGQVCVAGSRLLVEASIHEEFVARVVAHAQALRVGDPLDMNTQIGAVNSETQLAANLAHVERAAAQGGEVLCGGGRILSETGGTYMAPTVVAGVTQDADLFQKEVFGPVLSVTAFESEDEALRLANATDYGLAAGVWSQDLSRAHRCVAGIRAGVVHVNTYGGADNTVPLGGVGQSGNGHDKSLHALEKYVDLKTAWIQL

SEQ ID NO: 59450 - protein, 317 aa, Zea mays
MAGLVVSSQCFLKLLLVVSVFHVSFAARRLNELVQNQSQLLHYHNGPLLYGKIAVNLIWYGNFKPSQKAIITDFVTSLSSPASQSSQPSVATWWKTTEKYYHLSPRKASLSLSLGDQILDETYSLGKSLTGKNLVQLASKGGQRNSINVVLTSADVAVEGFCMSRCGTHGSSASHLKKNSKSYKFAYIWVGNSETQCPGQCAWPFHQPIYGPQSPPLVAPNNDVGLDGMVINLASLLAGTATNPFGNGYFQGPAEAPLEAASACPGVYGKGAYPGYAGDLLVDSTTGASYNVKGANGRKYLVPALYDPSTSSCSTPV

SEQ ID NO: 59451 - protein, 172 aa, Zea mays
MAQGTLEVLLVGARGLENTDYLSNMDPYALLQCRSHEQKSSVASGKGCEPEWNETSVFTVSNGAAELFIKLLDSDGGTDDDFVGEATIPLEAVYTEGSIPPTVYNVVKDEEYRGEIKVGLTFTPEDKGFWGITWRVAAGTGGRQSSYDSEANDGSIPLVYCSPVSVHLQLVK

SEQ ID NO: 59452 - protein, 280 aa, Antirrhinum majus
AYGVVYKARDIETNEDIALKKIRLEQEDEGVPSTAIREISLLKEMHHENIVNLKDVVHREKRLYLVFEYLDLDLKKHMDSCPEFSQDLHMVKMFLCQILRGVAYCHSHRVLHRDLKPQNLLIDRGSNTIKLADFGLARAFGIPVRTFTHEVVTLWYRAPEVLLGSRHYSTPVDVWSVGCIFAEMVNQKPLFPGDSEIDELHKIFRIIGTPNEDIWPGVTSLPDFKSSFPKWPPKELATIVPNLGATGLDLLCKMLQLDPSKRITAKKALEHEYFKDIVLP

SEQ ID NO: 59453 - protein, 305 aa, Antirrhinum majus
MEKYEKLEKVGEGTYGKVYKALEKSTGQVVALKKTRLEMDEEGVPPTALREVSLLQMLSQSLYVVRLLSVEHVDCAKNGKPLLYLVFEYLDTDLKKFIDSHRKGPNPRPLPPQQIQSFLFQLCKGVSHCHAHGVLHRDLKPQNLLLDKDKGVLKIADLGLARAFTVPLKSYTHEIVTLSYRAPEVLLGSSHYSTAVDMSSVGCIFAEMVRRQALFPGDSEFQQLLHIFRLLGTPSDEQWPGVSSLRDWHVYPQWEPQNSAPAVPSLGPDGLDLLTKTLKYDPADRISAKAALDHPYFDTLDKSQF

SEQ ID NO: 59454 - protein, 214 aa, Streptococcus mutans UA159
MATKAVIFDMDGVLFDTEGFYYRRREIFLNDKGISIKHIPPAFFIGGNMKQVWQKILEDDYANWDVEQLQKDYTSYKNKHPLPYQNLIFPDVKVILEKLKQHQFKIALASSSTKSDILLALNKTGIYDYFDLVLSGEEFPESKPHPAIYNEAAYQLGFPKSELLIIEDSEKGIAAGVSAGIEVWAIKDRTFGLNQRAASRLFSNLTEVVDFLLK

SEQ ID NO: 59455 - protein, 409 aa, Gibberella zeae PH-1
MSADEKIRVSGETPRSTSPVLPTVNPGLENNFYPRIDFCDATFANGARSAWIGFSSSVILFNKWLLDTLNFRYPVILTTYHLTFSTIITQVMARWTPYLDGRKTVKMTARVYIRAVVPIGIFFSLSLICGNLTYLYLSVAFIQMLKATTPVAVLISGWILGVSAPNLKQFLNVSAIVVGVIIASMGEIHFVTVGVLFQMGGIIFEALRLTMVQRLLSSADYKMDPLVSLYYFAPICAVMNGVVALIWEVPNCTMAEVYHVGLFTFFLNGLCAFMLNVSVVFLIGKTSAVVLTLCGVLKDILLVGASMMIWGTQVSPLQFFGYSIALGGMVYYKLGYEQLKGHIADANRQWADFGARKPVLRKVTVLVATAFLIFTLFGGFAPSYSSEVDPATLANEVSNRFGINDAQHV

SEQ ID NO: 59456 - protein, 455 aa, Silicibacter sp. TM1040
MTAHQPDANFLKEHNARSLWHPMAHPGDSLANPPTIVTGASGVRIKDVDGHEVVDAVGGLWNVNLGFSCQPVKDAIAAQLDVLPYYSIFRGTTNDQVIQLAEELRDFFAPDGLSRAFFTSGGSDSVETALRLARQYHKVRGEPARVKYLSLKKGYHGTHFGGASVNGNANFRTAYEPLLAGCHHIPAPYTYRNPFNETDPERLAQLCLAALEDEIAFQGAGTIAAFIMEPILGAGGVIPPHESFMPGVAEICRRHGILLIADEVITAFGRTGSWSGSRHWGVQPDMMCTAKAITNGYFPFGALMLSERLVEVFEKDDTGKAAIGHGYTYSGHPVGAAAALACLAETKRLNVPENAAARGAQIFEGLQDLAARYDLIGDVRGGHGLMSALELVSDRATKAAVDKKVINRLQEVAYQNGAMVRVSGPNIILSPPLVLTEADAAQILSALDAGFAAVN

SEQ ID NO: 59457 - protein, 469 aa, Staphylococcus aureus subsp. aureus Mu50
MARKLHRELNNRHIQLIAIGGAIGTGLFLGSGQTISLTGPSLLFTYMIIGVVLFAFMRALGELLLSNTRFNSFVDIANEYLGPFGGFVIGWTYWLCWIVSSMSDLTAMGQYFAFWYPQVPNWITVLFIVLILISFNLLGARLFGELEFWFSIIKVVTIIAMVIVGLVLIFFSFKTHYGHASFTNLISHGGMFPGGTFGFLMSFQIAVYSFIGIELIGVTAGETKDPEKTLPKAINNVPIRILLFYIGGLLVIMSVIPWNDIDPNSSPFVKLFTLIGVPFAAGVVNFVVLTAAASATNSGIYSNSRILFGLSQQGLGPKVLNKTNSHGVPYLSMLVSSIALLIAALLNYIFPNAIQLFIYVTTLSTVLFLVVWAMIIVAYLMYLKKHPEAHKNSKFKLIGGKPIAYIILAFFFFVFILLFFSDETRAAIYISPFWFIFLFFFYKKYKTNAEKLAYEQRQNDSGHFRYDNQ

SEQ ID NO: 59458 - protein, 688 aa, Oryza sativa
MKDGWRAHQRVAYDGEAKNLTVALSYGDAAAARRIPIDPKDVWVVLGLYSLLLVLVAIGVLWFVSQWRKAGELADGDIFDEMVYDELADEEFFVESGPRRFRYSDARPHPTRAPAAARSPPHLPPPPRAASQPSTVAGGGAVLALVLLLVLLAAAEWWRRRSPSPSGGGGGSGRRPRRWRRGYGKSEAAAPCSRSSSSSFSSPSRHGAGEGHRLPPRAQQEYDVTSATATGPCDAYLVFRCSPPLYASAISISNVLNITATAVTESNAVDPVTPVAADPLVLAPVGNGGGRGGGGGEAKRSEIYTYEAGWHIYGMNWSVRRDKKYRLAIASLLEQHNNHVQVVQLDESSGDIAPVLTFDHPYPPTKTMFVPDPHSVRPDLLATSADHLRIWRIPSPDEAAAAAAASSNSGSVRCNGTASPDVELRCELNGNRNSDYCGPLTSFDWNDADPRRIGTSSIDTTCTIWDVEREAVDTQLIAHDKEVYDIAWGGAGVFASVSADGSVRVFDLRDKEHSTIIYESGSGGSSNSAGADGGAASPTPLVRLGWNKQDPRYMATIIMDSPKVVVLDIRYPTLPVVELHRHHSPVNAIAWAPHSSCHICTAGDDSQALIWDLSSMGTGSNNGGNGNGNAAAAAAAEGGLDPILAYTAGAEIEQLQWSATQPDWVAIAFSTKLQILRIYGVSHVVLLK

SEQ ID NO: 59459 - protein, 435 aa, Methanosarcina mazei Go1
MKVEVIKMTIVEDAKKGIITEEMKIVAKDEGLDPEFIRRGIAAGRIVIPTSPYRQVKLCGLGEGLRTKINASIGVSSDIVDDEMEVKKAIAAEKAGADTLMELGTGGDFLGIRKKVIDSISLSVGSVPLYQAFIEAARKYGSIVHMTEDELFKATEDQAKLGTNFMAIHTGVNNITLDRLKAHGRYGGLCSRGGAFMSAWMMHNEKENPLYSQFDYLVEILKEHEVVLSTGNGMRAGATHDATDRAQIQELIINTELGQRAHDAGLQVIIEGPGHIPLDQIETNVKIMKEMSGHKPFYMLGPLATDIAPGYDHIVTAIGASLSASYGCDFLCYVTPAEHLALPNIEDVITGVKTSKIAAHIGDMVKYPERARQWDLDMGRARRDLDWEKMYSLALDPEHARAVRNSRAPEDSDACTMCGNFCALKIVNQNYNLAK

SEQ ID NO: 59460 - protein, 413 aa, Colwellia psychrerythraea 34H
MTDLRQQALDYHALPTPGKISVSLTTAAETSQDLSLAYSPGVAEPCREIANNPDDVYKYTGKGNTVAVITNGTAVLGLGNIGPMASKPVMEGKSLLFKRFANIDSFDIEVKHKTVEEFVNTVANIADSFGGINLEDIKAPECFAIEKALIERCKIPVFHDDQHGTAIVTAAGMMNALDIQGKDIKQANIVCLGAGAAAIACMELLIKCGAQREKIYMLDTKGVIHTRRDDLNEYKKLFANNTDKRTLDDVIEGADVFVGVSGPDLLSQKQVKAMADRPIVFACSNPDPEIKPELALAARDDLIMATGRSDYPNQVNNVLCFPFIFRGALDVRARTINDAMKIAAVHAIRALAKEPVPAEVLKASCEKDLSFGKDYIIPKPMDPRLCGAVARAVAQAAVDSGVAALDMPENYMA

SEQ ID NO: 59461 - protein, 186 aa, Triticum aestivum
GARAGYMEVLTFVLTSHEENFDMLNRTDDGNKAVIIANPRTSEFEVVRSSLMSCLLKTLKHNIDHPRPIKIFEVGDVASLDTSRDVGASNNRRLAALYCNSNSGFEEIMGLVDRIVKIVRAPHINFGQTYYVPSSEPEFFTKRQCKIVMSDGKQVGYLGIVHAEVLRKFGIPDPCTFVEIDIEALL

SEQ ID NO: 59462 - protein, 149 aa, Capsicum annuum
MADQLTDDQISEFKEAFSLFDKDGDGCITTKELGTVMRSLGQNPTEAELQDMINEVDADGNGTIDFPEFLILMARKMKDTDSEEELKEAFRVFDKDQNGFISAAELRHVMTNLGEKLTDEEVDEMIREADVDGDGQINYDEFVKVMMAK

SEQ ID NO: 59463 - protein, 974 aa, Vibrio vulnificus YJ016
MRRGRESFFYFKGKCMSTAFEVDTNTIATIFSSQVPVVEGIYDLTPDQVLLDQAEHESEVRSYPRRLPIAIKQAYGCLVEDTRGQIFLDCLAGAGTLALGYNHPEINQALKEQLDSGLPYQTLDIATTAKTNFIKSVKAFLPEELGNNCVIQFCGPSGADAVEAAIKLAKQTTGRNTMFAFRGAYHGMTNGTMGMMGNLNTKARRTGLMSDVHFMPFPYSLRCPFGLGGDEGAKASIRYIERLLNDDEAGIMKPAAIIVEPVQGEGGVIPAPAFWLRELRRICDEHGMLLIFDEIQCGVGKSGYNFAFEEAGIVPDVLCLSKAIGGGLPMSLLVINKKHDTWRPGEHTGTFRGNQLAMVSGAKALEIITRDNLVEHANVAGQYLRHGLEKIQQRVDCIAEVRGKGLMLGVEIRKPGSELNKFGEPVSDGQLTLAIQRAALERGLMVEKGGRDGSVIRFLPPLIISFEQIDFALRILEEAILAAGGNLKAVEENAEWKKHFIHTGVNGSKEFASVMNHTTAALKNAFEEVDAPYSGMDPKALESAIYAVDLDNKNAPLKEIIDETTELVVKNSIFTQHPDCIAHLHTPPLMPAVAAEAMIAALNQSMDSWDQSSSATYVEQKVINWLCDKYELGAKADGIFTSGGTQSNQMGLMLARDWIADKLSGHSIQKLGLPDYADKLRIICSKKSHFTVQKSASWMGLGEKAVLTIDAHANGTMDVTKLEASVEQAKAEGLIPFAVVGTAGTTDHGAIDDLNTIADVAEKHDLWMHVDGAYGGALILSSQKARLKGVERAQSVSVDFHKLFYQTISCGAVLVNDKQNFKFLLHHADYLNREHDELPNLVDKSIATTKRFDALKVFMTMQNVGPKALGAMYDHILGQTLEVADLVRNTEGFELLAEPSLSTVLFRSTLGSDLDELNKTLRLEALTRGVAVLGETIVDGKTALKFTILNPCLKMSDFESLLSKINTLAAELAQ

SEQ ID NO: 59464 - protein, 185 aa, Oryza sativa (indica cultivar-group)
MACRSAVCSPSALAPPRHRLLSLGCARTAAPSGGLPLRLRLRLRLRSSPAPRGHGADLVGAVELQAKVTSKCFFDVEVGGEPAGRIVIGLFGEVVPKTVDNFRALCTGDKGYGYKGCSFHRIIKDFMIQGGDFQNNNGTGGRSIYGECFDDENFTLKHTGPGVLSMANAGPDTNGSQFFICNVKP

SEQ ID NO: 59465 - protein, 568 aa, Candida glabrata CBS 138
MLFSKKKEDPQAVPEASPENDFSPSLSQQDSSASPYENDVKKLEEEAEQTPIVDIPKKPASAYVTVSIFCLFIAFGGFVFGWDTGTISGFVAQTDFIRRLGQKRANGTHYLSKVRTGLVVSIFNIGCAIGGVILSKLGDVYGRKPGLIIVVVIYVVGIIIQIATIDKWYQYFIGRIISGLGVGGIAVLSPMLISEVSPKHLRATLVACYQLMITLGIFLGYCTNFGTKNYSNSVQWRVPLGLCFAWAIFMISGMTFVPESPRFLVEKGRIEDAKRSIASSNKVSVDDPAVVAEVDSVQAAVEAERLAGSASWGELFSTKTKIFQRLVMGIMIQSLQQLTGDNYFFYYGTIVFKAVGLEDSFETSIVIGVVNFFSTFVGIFLVGRFGRRTCLLWGAATMTACMVVFASVGVTRLWPHGKGNGSSKGAGNCMIVFTCFYIFCFATTWAPLAFVICSETFPLRVKAKCMALAQASNWIWGFLISFFTPFITDAINFNYGYVFMGCLCFSYFYVFFFVPETKGLTLEEVNTMWEEGVLPWKASQWVPPSRRGADYDADALMHDDTPWYKRFL

SEQ ID NO: 59466 - protein, 198 aa, Glycine max
VHLSINIHAITAANNLLAAAIDTRIFHESTQSDKALFNRLCPPNKEGKRSFSDVMFRRLTKLGISKTNPDDLTPEEVNKFARLDIDPNSITWRRVMDINDRFLRKIAIGQGLDEKGMVRETGFDISVASEIVAVLALTTSLADMRERLGKMVIGNTRESHFTFCFMLDLITEMAQETTRALRTGYILVYIYIWKHQHI

SEQ ID NO: 59467 - protein, 563 aa, Candida glabrata CBS 138
MNSQPDLISPQKSSSSNEVDSHESKYLNQVGKNDMADEFVQNEMIANPNTGKGAFVGVIISCFMVAFGGFVFGWDTGTISGFVAQKDFIHRFGMKHPDGTEYLSKVRTGLIVSIFNIGCAIGGIILSKLGDTKGRKMGLVVVVVIYIVGIIIQIASINKWYQYFIGRIISGLGVGGISVLSPMLISEVAPSDLRGSLVSCYQLMITLGIFLGYCTNFGTKNYTNSVQWRVPLGLCFAWALFMIGGMTFVPESPRYLVEAGQIEEARSSLARINKCSPDHPYIQQELDLIQASVDEARSAGSASWGELFTGKPAMFRRTLMGIMIQSLQQLTGDNYFFYYGTIVFKAVGLEDSFETSIVFGVVNFFSTCCSLLTVDRFGRRNCLLYGAIGMVCCYVVYASVGVTRLWPHGQGNGSSKGAGNCMIVFSCFYIFCFATTWAPIAYVIISETFPLRIKAKAMSIATAANWMWGFLIAFFTPFITNAINFYYGYVFMGCMVFAYFYVFFFVSETKGLTLEEVNEMYAEGVLPWKSSKWVPASRRGADYDADALMHDDTPWYKRVVGRG

SEQ ID NO: 59468 - protein, 94 aa, Brassica rapa
TRSTRAGRMRSTWGDDCLEFKPERWISGSDSGRFINHDPFKFVAFNAGPRIYLGKDLAYLQMKSIAAAVLLRHRLTVVTGHKVEQKMSLTLFMK

SEQ ID NO: 59469 - protein, 294 aa, Pinus contorta
MEQYEKVEKIGEGTYGVVYKARDRLTNETIALKKIRLEQEDEGVPSTAIREISLLKEMQHGNIVRLQDVVHSEKRLYLVFEYLDLDLKKHMDSCPELAKDPRLIKTFLYQILRGIAYCHSHRVLHRDLKPQNLLIDRKTNALKLADFGLARAFGIPVRTFTHEVVTLWYRAPEILLGSRHYSTPVDVWSVGCIFAEMVNQRPLFPGDSEIDELFKIFRVLGTPNEETWPGVTSLPDFKSAFPKWPAKDLATVVSGLEPAGIDILSKMLCLEPSRRITARSALEHEYFKDLGFVP

SEQ ID NO: 59470 - protein, 1071 aa, Colwellia psychrerythraea 34H
MGKRTDLKSILILGAGPIVIGQACEFDYSGAQACKALREEGYRVILVNSNPATIMTDPDMADATYIEPIHWEVVRNIIEKERPCAVLPTMGGQTALNCALELEAKGVLKEFNVEMIGATADAIDKAEDRSRFDKAMKAIGLDTPNAEIVHTIEEAHAASKVLGFPCIIRPSFTMGGTGGGIAYNIEEFDEICTRGLDLSPTSELLIDESLIGWKEYEMEVVRDKNDNCIIICAIENIDPMGIHTGDSITVAPAQTLTDKEYQIMRNASLAVLREIGVETGGSNVQFGICPETGRMVIIEMNPRVSRSSALASKATGFPIAKIAAKLAVGYTLDELSNDITGGKTPASFEPTIDYVVTKIPRFNFEKFAGAEDRLTTQMKSVGEVMAIGRNQQESMQKALRGLEVGVNGFDSIVDVTQPGAKTKIMHELQEAGADRIWYVADAFRLGLTVEDVYRTTMIDRWFLVQIEDIVLEEAKVSEGGLKILNPEYLRKLKRKGFADSRLADLIGVSEAEVRKKRHNADIYPVYKRVDTCAAEFSSDTAYMYSTYDEECESNPTDKESIMILGGGPNRIGQGIEFDYCCVHAALALREDGYETIMVNCNPETVSTDYDTSDRLYFESITFEDVLEIVRIEKPKGVIVQYGGQTPLKLARALEAAGVPIIGTSPDAIDRAEDRERFQQAVDRLGLLQPENATVTSLEEAMAKAEGIGFPLVVRPSYVLGGRAMEIVYDLDDLRRYMTEAVSVSNDSPVLLDHFLDDAIEVDIDVVCDGTDVVIGGIMQHIEQAGVHSGDSACSLPAYSLSQEIQDVMRKQVTDLAFELGVIGLMNTQMAVKDNEVYIIEVNPRAARTIPFVSKATSVPLAKVGARVMAGKSLKEQGITKEVIPKYFSVKEVVIPFNKFHGSDPLVGPEMRSTGEVMGVGDTFEEAYAKANLGAGVSVPKTGRALISVRNSDKKRVLELAKIMVDLGYDIDATHGTEVILREAGVPVRRVNKVHEGRPHILDRIKNSEYSYIINTTEGRKAIEDSKVLRGGALRYKVAYTTTLNAAFASCMAHAADEMSTVRTVQELHNTL

SEQ ID NO: 59471 - protein, 136 aa, Conocephalum conicum
MARTKQTARKSTGGKAPRKQLATKAARKSAPATGGVKKPHRYRPGTVALREIRRYQKSTELLIRKLPFQRLVREIAQDFKTDLRFQSSAVLALQEASEAYLVGLFEDTNLCAIHAKRVTIMPKDIQLARRIRGERN

SEQ ID NO: 59472 - protein, 533 aa, Candida glabrata CBS 138
MISGPKEELQKEVEEELHHKKKSDLIFVSLCCIMVAFGGFVFGWDTGTISGFVNQTDFLRRFGQQRSDGTYYLSNVRTGLIVAIFNIGCAIGGITLSKLGDIWGRRLGLVTVVVVYTIGIVIQIASIDKWYQYFIGRIISGLGVGGIAVLSPMLISEVSPKQLRGTLVSCYQLMITCGIFLGYCTNYGTKNYSNSVQWRVPLGLCFAWALFMIFGVMCVPESPRYLVEVGKLEEAKRSLARANKTTVDSPIVLLELDKYQASVEAERLAGSASWGELVTGKPQMLRRTIMGMMIQSLQQLTGANYFFYYGTTIFRAVGLDDSFQTAIVLGVVNFVSTFYALYTVDHYGRRNCLMWGCVGMVCCYVVYASVGVTRLWPNGEGNGSSKGAGNCMIVFACFFIFCFATTWAPIAYVIVSESYPLRIRGKAMSIAIAANWIWGFLIAFFTPFITSAINFYYGYVFMGCMVFAYFYVFFFVPETKGLTLEEVNQMYEEGVLPWKSSSWVPPDRRTAEYNLDDYSHDDKPWYKRVFSRN

SEQ ID NO: 59473 - protein, 529 aa, Synechococcus sp. WH 5701
MTYTLTTPLYYVNDKPHLGSAYTTLACDALARFQRLMGRQVVFITGCDEHGLKIQRTAEAAGLTPQAHCDQVSDQYRDLWQRWQISYDRFIRTSEPRHRLLVEQFYRRVEAAGDVVEGRQRGWYCVACEEFKDDPPEARAPQCSTHQRPLEWRDELNLFFRLSRYQQAIEELIQRPGFIAPASRRREVENFVAQGLHDFSISRLDLPWGIPVPGHEGHTFYVWFDALLGYLTALLEPGDPPDLALLSQRGWPASIHVIGKDILRFHAVYWPAMLLSAGLDLPERVFGHGFLTREGQKMGKSLGNVLDPGELLERCGPDAVRWYLLRDIPFGDDGDVQQQRFSDLVNNDLANTIGNLLNRTSSMARRWFDQAVPAPSEAVGSSHPLAQAALLAREQVIEGMERLDFRQAAAAALQLAISANGFLNDQAPWSRMKQEGQRQQVADDLYAVLEAARQVALLLAPILPDLSARMLLQLNQPLAPSGVVAGGQSGPAGAQVPWQERLTWGSLAAGTPLPEPEPVMARLELDGPL

SEQ ID NO: 59474 - protein, 136 aa, Conocephalum conicum
MARTKQTARKSTGGKAPRKQLASKAARKSAPSTGGVKKPHRYKPGTVALREIRRYQKSTELLIRKLPFQRLVREIAQDFKSDLRFQSPAIGALQESVESYLVSLFEDTNLCAIHAKRVTIQSKDIQLARRLRGERN

SEQ ID NO: 59475 - protein, 387 aa, Triticum aestivum
  misc_feature (68)..(68): Xaa can be any naturally occurring amino acid
  misc_feature (318)..(318): Xaa can be any naturally occurring amino acid
AYLGDTIEQVCTKKQAGTGPEFPGYRRQNPTPTTAKKIHRSIDLGARRTATRSDHIQRRKIKPPPPPXMKLQTEAAAAGGEGRLMIRQVWANNVESEFQAIRQVAERFPYVSMDTEFPGVIHCPSKHHATLTPSERYAALKANVDALHLIQVGLAFAASPDAAPAVAFEINLREFDPRVHRHNPSSVALLAGHGLDFAKQRREGVDARVFAALLMSSGLVCSGASAPTWVTFHSAYDFGYLVKLLMGRKLPRTLPEFLGLVRVFFGDQVYDARHVMDSCPGLYGGLDALAAQLGVERAAGMSHQAGSDAALTWDVFRXRIREVYSPGTPAGRAGRRQLAGVLYGLDLELTSRGPAPAAKGERNGNRNTEHWGGERAGGEEKTGGRGG

SEQ ID NO: 59476 - protein, 136 aa, Conocephalum conicum
MARTKQTARKSTGGKAPRKQLASKAARKSAPSTGGVKKPHRYKPGTVALREIRRYQKSTELLIRKLPSQRLVREIAQDFKSDLRFQSSAIGALQESVESYLVSLFEDTNLCAIHAKRVTIQSKDIQLARRLRGERN

SEQ ID NO: 59477 - protein, 434 aa, Candidatus Protochlamydia amoebophila UWE25
MSYIRSVKGREILDSRGNPTVEVELITDQNVMVKASVPSGASTGENEALELRDGDLNYYFGKGVLKAIANINGPIAQILVGEQVYDQERLDRMLIEADGTDNKGHFGANAILGVSLALARAGALTANLPLYRYIGGVHAHLLPCPMMNIINGGAHADNSLDFQEFMIRPVGASTLREAVRWGAEIFHTLKGILKKAGHVTAVGDEGGFAPNLSSNEEALELILLAIEKAGYQPGKQVVLAMDCAASEFYDKTTKQYFEKKKKQKNQVFAERTAEEQIAYLETLCQNYPIDSIEDALAEGDWCGWQRLTERLGRKIQIVGDDIFVTNPKFLEKGIELGVGNAILVKINQIGTLTETLQTIRLAQTNNYACIISHRSGETEDSIIADISVAANTGQIKTGSLSRSDRIAKYNRLLAIEAELESTALYQDSNRFQIF

SEQ ID NO: 59478 - protein, 117 aa, Phoenix dactylifera
DEYGNPIPEHQGYGGAGTGGTYGTTGTTTTPHGVVHGQGGGQQQQVHLGKEEPHGGRHHRSGSSSSSSSSEDDGHGGRRKKGLKEKIKEKMPGGGHKEEEHGQTAEGQHEKKGMMEK

SEQ ID NO: 59479 - protein, 136 aa, Conocephalum conicum
MARTKQTARKSTGGKAPRKQLASKAARKSAPFTGGVKKPHRYKPGTVALREIRRYQKSTELLIRKLPFQRLVREIAQDFKSDLRFQSSAIGALQESVESYLVSLFEDTNLCAIHAKRVTIQSKDIQLARRLRGERN

SEQ ID NO: 59480 - protein, 321 aa, Glycine max
MLKAVASGLVITSILICVSANDNGFPRCNCDDEASFWTIESILECQRVGDFLIAVAYFSIPIELLYFISCSNVPFKWVLIQFIAFIVLCGLTHLLNGWTYGPHTFQLMVALTVSKILTALVSCATAITLITLIPLLLKVKVREFMLKKKTWDLGREVDHIMRQKEAAMHVRMLTQEIRKSLDRHTILYTTLVELSKTLGLQNCAVWMPNVDKTEMNLTHELNGRNFNLTIRITDPDVVRIKGSDDVNILSSDSALAVGSRGVSGEAGPVAAIRMPMLRVCNFKGGTPELRQACYAILVLILPSGDNQEPRSWSNQELEILM

SEQ ID NO: 59481 - protein, 561 aa, Gibberella zeae PH-1
MAGRTGSIHGLTGKALIIFVSLGVFLFGYDQGVMSGIITGPYFIDYFGHPSKAYVGTMVAILEIGAFITSLMVGRIGDIIGRRRTIFYGSCVFFIGGALQTLATSMPMMMAGRFVAGFGVGALSTIVPVYQSEISPPHNRGKLACIEFTGNIVGYATSVWVDYGCGYIENDYSWRIPLGLQCIMGALLGLGSLVIVESPRWLLDNDHDEEGMVVIANLYGGGDIHDPKARDEYREIKMNVLLQRQEGERTYKDMFRRYKTRVFIAMSAQALAQLNGINVISYYAPYVFESAGWVGHDAVLMTGFNSLTYLMSTIPPWYLVDRWGRRKILLSGATAMAISLSLISYFLFLDIKWTPRLVVLFVMIYNAAFGYSWGPIPWLYPPEILPLSIRSKGASLSTATNWAANWLVGEMTPILQEWIKWRMYLVHAFFCVVSVVVVYFIYPETCGVRLEDMDSLFGDASTVAGTPSLHGTETGSLIRGGSPVGSSRGLIGPSSAIPGLSLDPPTVDDDNKSQMQSGADERSVGGWLSRVVGRNRSDSGSSAQGRYAPLGQQEEGRRNDR

SEQ ID NO: 59482 - protein, 301 aa, Methanosarcina acetivorans
MTFMDFEKLRHGTELIKRGFARMQKGGVIMDVTTPEQARIAEEAGAVAVMALQAVPADIRKAGGVARMADPEIVQQIIETVTIPVMAKARIGHFVEAEILEALGVDMVDESEVLTPADPFYHIDKTQFTVPFVCGARNLGEALRRINEGAAMIRTKGEAGTGDVSQAVKHMKQIQGEIRALAGKTKEELIMVAREIEAPIELVVETAKMQRLPVVNFAAGGVATPADAALMMRLGADGVFVGSGIFKAENPEKMAKAVVEAVNNYDNPVKLAEISKGVGAGMKGISADMIPAQEALQERGW

SEQ ID NO: 59483 - protein, 145 aa, Arabidopsis thaliana
  misc_feature (39)..(39): Xaa can be any naturally occurring amino acid
RPTRPEDEGRACAILYSFDVVTSPDQATMAGPFTDLKNXSSFPATLPASSDMTCITSLGGRVCCLNGCSPIDYRKVETLCYLHDLTDEKLAMEDDYLLPNKRNPRGECEHKHGLVLRGHENTPGYYHGRYWALWELTLAGCTDFT

SEQ ID NO: 59484 - protein, 138 aa, Candidatus Blochmannia floridanus
MNNINIINKKKIHAPMGPYTQAIDTGNIIFISGQIPIIPDTGMIPNNIQEQTYQALENIKSIITSKNLIINNIVKTTLFIKNINDLPIINISYEKFFKINLTTINHISILPARSCVEVSKLPNNALIEIEAIAMRFNK

SEQ ID NO: 59485 - protein, 337 aa, Haemophilus influenzae 86-028NP
MPNFSFVFFYDSAKITPISTALLGRKMNYLKIAQDSLSVESNALLQLSQRLGEDFNQVIDLILACEGRLVIGGIGKSGLIGKKMVATFASTGTPSFFLHPTEAFHGDLGMLKPIDIVMLISYSGETDDVNKLIPSLKNFGNKIIAVTSNKNSTLARHADYVLDITVEREVCPNNLAPTTSALVTLALGDALAVSLITARNFQPADFAKFHPGGSLGRRLLCKVKDQMQTRLPTILPNTNFTDCLTVMNEGRMGVALVMENEQLKGIITDGDIRRALTANGAETLNKTAKDFMTSSPKTIHQDEFLSKAEDFMKAKKIHSLVVVNDENHVVGLVEFSS

SEQ ID NO: 59486 - protein, 70 aa, Zea mays
MGFLVTTLIFVVIGIIACLCTRICCNRGPSTNLFHLTLVITATICCWMMWAIVYLAQMKPLIVPILNEGE

SEQ ID NO: 59487 - protein, 577 aa, Candida albicans
MRFKIRGPLIQLRYKSTKAFYITTPIFYVNAAPHIGHLYSMLIADTRNKWEKLNPSKESFMLTGTDEHGLKIQSTAEKLGLEPKVLVDKVSQNFSKLAEQFDVNYDRFIRTTDNDHIELVRYFWNLMMEKGFIYTDTHSGWYSISDETFFPETQIEEVVKNGKAVKISSETKNEVVYQEETNYFFKLSMFQEQLIQFLKQNPEFIKPKHRYQFILKELEDTKLPDLSISRPSSRLKWSIEVPNDSTQKIYVWFDALLNYLTATKFPHGFEVQDSKFVTPENSIWPATHVIGKDIIRFHCIYWPIFLMAAGIELPKQVIVHSHWLCDGFKMSKSLGNLVDPMEISEYYGVDPVRFFLVENSNIDDDCKFSEELLQRSRDAVLGKYCNLISRIGGKNFSIEEAVKSFASGEFNNIREIIETYTINKDSVEGLLSSLNKLTTDLNDLYNQMDHYFTNFDYIRAIQCWWSVINQANQIFQSAEPWTYVKLINSPETPAELKEKYRILNNYFVYLCAETTRISSILIQPVMPQLSKKILDRLNVSGRTSEFTTLSADLQYGSGANSKSHKVPLEKIAPRDIK

SEQ ID NO: 59488 - protein, 576 aa, Oryza sativa (indica cultivar-group)
MAAAAAAMATATSATATPPLRIRDAARRTRRRGHVRCAVASGAAEAPAAPGARVSADCVVVGGGISGLCTAQALATKHGVGDVLVTEARARPGGNITTAERAGEGYLWEEGPNSFQPSDPVLTMAVDSGLKDDLVFGDPNAPRFVLWEGKLRPVPSKPGDLPFFDLMSIPGKLRAGLGALGVRPPPPVCVLSPLCILDSLVKFDCAERFRRRFQGREESVEDFVRRNLGAEVFERLIEPFCSGVYAGDPSKLSMKAAFGKVWRLEDTGGSIIGGTIKTIQERGKNPKPPRDPRLPTPKGQTVASFRKGLTMLPDAITSRLGSKVKLSWKLTSITKSDNKGYALVYETPEGVVSVQAKTVVMTIPSYVASDILRPLSISVVIEFGLVIYLSDAADALSIFYYPPVAAVTVSYPKEAIRKECLIDGELQGFGQLHPRSQGVETLGTIYSSSLFPNRAPAGRVLLLNYIGGSTNTGIVSKTESELVEAVDRDLRKMLINPRAVDPLVLGVRVWPQAIPQFLIGHLDHLEAAKSALGKGGYDGLFLGGNYVAGVALGRCVEGAYESASQISDYLTKYAYK

SEQ ID NO: 59489 - protein, 90 aa, Thlaspi caerulescens
SRFTGQSSTITGTYAGQFIMGGFLNFRMKKWMRALITRSCAIIPTIIVALVFDSSEATLDVLNEWLNVLQSIQIPFALIPLLCLVSKERI

SEQ ID NO: 59490 - protein, 357 aa, Methylobacillus flagellatus KT
MATMKAAVFVSPGKIALRDKPVPEIGPLDALIRITTTTICGTDVHILKGEYPVAAGLTVGHEPVGIIEKLGSEVHGFKVGQRVIAGAITPSGHSNACLCGIGAQDGPDSPHGFKVAGGWKFGNTIDGSQAEFLRVPDAMANLSPIPDHLSDEQVLMCPDIMSTGFSGAERGNIKIGDTVVIFALGPIGLSAVAGAKLLGATKIIGVDSIPDRLNIARALGADHVINFKTHDPVQEILKLTDGRGVDVAIEALGVQQTFESSLRVLRPGGTLSSLGVYSSDLRLPLDAFGAGLGDFTIVSTLCPGGKERMRRLMEAVGSGRADLSNLVTHRFKLSEIEEAYDLFANQRDGVIKVAITP

SEQ ID NO: 59491 - protein, 181 aa, Cytophaga hutchinsonii ATCC 33406
MATSEEILEQTIKSTIRDIVDFPEPGIIFKDITPLLKDPQLCKAIVQSITDQLRPLQPDALACLDSRGFWFGLSIAMELGIPMIPIRKKGKLPYETVYEEYALEYGTNTIEMHTDAVQPGCRVAIHDDILATGGTAEATSKLIKKAKGEIIAYSFLIELDFLKGKDKLAPYCTTIQSLINY

SEQ ID NO: 59492 - protein, 136 aa, Conocephalum conicum
MARTKQTARKSTGGKAPRKQLASKAARKSAPSTGGVKKPHRYKPGTVALREIRRYQKSTELLIRKLPFQRLVREIAQDFKSDLRFQSSAFGALQESVESYLVSLFEDTNLCAIHAKRVTIQSKDIQLARRLRGERN

SEQ ID NO: 59493 - protein, 1149 aa, Oryza sativa (indica cultivar-group)
MSARKEAKGSAGGDRIGALPDEVLHRVLSFLPAQDAVRTCVLAPRWRHLWKSATGLRVGEDESNLGSVKEQQEFLDHLLVLRDSAPLETCVLRFNWYDDDDFEDIFRLNVWFRYAIHRKVRFLRLDVWQEEEFGNPVPIDEQPIVSQHLTRLQLYGIVLNDGLLDFSSCPSLEHLVFESCVFECAKISSNSVKHLSITFSNFPAGTSRVRIDIPSLVSLRLDRIYDRKPVLERMPSLVDAFVSVPSSSEDFCGESDSGDCGRDGCESCYGFTNKNCVLLEGLSEAKMLVLINEDESFIFKRDLKWCPTFSKLKTLILNGYWCVPDDSHMLARILEHSPALEKLVFQLGYQAYKRTNKIKGILNPMERSAGISEHLQIVEVQCNAIDGQVLKVLKYLSTFKIYSLFEHKNRVAHLSGSISSLPLPIVFLRSGDSSVHPHTYSCRRAVASREAADGDPERPLLLVSPRYLRSLCRLSGFLASCIAVGRAHAHAHNLFDGMRQRKKAKRAPCSTGVDRIGALPDEVLHRVLSFLLAPPLEVRHEAAHRRRSTLGSIKERRRFIENLLLLRDSAPLGTFVLRFRECEGIDDIARLNLWYQACSAPQGYNFTVQKLNDIFLNFSSCPALEHLVFDYCILECAKISSSSVKLLSITDSNFSETLRSANARGLFDEMPTGKEGMEEPLPTDADHIGALPDTVLHHVLSFLPSQDAVRTCVLAKRWLDLWKSVTALRIGDRDKRKLWTVKGLQGFVDHFLLLRESVPLHTCVLRFIVFSEDLNETSRLNLWIKHALLRMVQFLQVSIRQNTAFYHQINLGILPFVSRHLSMLELHGVRMVGSFLDFSRCPALQHLEFDRCELPCDKILSESLKLLRITRCKFSQTSRVRICVPSLVSLRLDDFYRRTPVLERMPSLVEAFVRVVHRTYDCCGYDYINSGDCGNEHCKSCHGIKDDNNCVLLDGLSEAKTLALIDGTISFIFNRDLKWCPTFSKLKTLLLNEYWCVPDEFSALACILEHAPVLENLILQLYSEGPKHTMKIKGNCHPMDRSAAISGHLETVEIRCEVVDKRVLKVLKYLSTFNIQFFLYLHMHETYEAVFQLLDGNVCYEQVFSFEQVKISEEDDSDDNDQEDEEDDDDDFYGEEEEEEEEDDEDEDD

SEQ ID NO: 59494 - protein, 487 aa, Oryza sativa (japonica cultivar-group)
MARSGDCCPVCAAPIASLIREYNVLVDTTGEKQYTIGKFTTGVPPFSDRENAGSRSWSLHPEGQQGRQPTGNIWENCSNRKSCILEDDTGDYQYQGQIQGLQSAASTYYLLMMHGKDVHAVPADSWYNFSKISQYKQLTLEEAEEKMSRRRSTATGYGRWMMKAATNGAAAFSSDVTQLDDANEGETDQVHLKKGNKNGDENKSDKGSGEERAHVPMTKGREEEGSKDRDFDLDDEIEKGDDWEHEEIFTDDDEAVDVDPEEGGDLADPEIPAPPEIKQDDNEKHGGVGLSKSGKELKKLLRRAAGQNESDDDDEDTDEDESPSPVLAPKQQDQLKSEPQEDNHSKPTVLGHPYSTPHVSKSNQKRRQRGDDSKTCATPKKPKIEPDTKKIVVKEETSCSLEPTSEPFASARSDTNVSPITVEEIRVVLRLYAPIAMRDFSKDFMPRFSPRLRSPEDREVFLANLRKISHLQKINGQKYIILLEEYK

SEQ ID NO: 59495 - protein, 143 aa, Pseudomonas aeruginosa
MALQRTLSIIKPDAVSKNVIGEILTRFEKAGLRVVAAKMVQLSEREAGGFYAEHKARPFFKDLVSFMTSGPVVVQVLEGEDAIAKNRELMGATDPKKADAGTIRADFAVSIDENAVHGSDSEASAAREIVYFFADTEVCERIR

SEQ ID NO: 59496 - protein, 469 aa, Candidatus Protochlamydia amoebophila UWE25
MMEIKKFDVAVLGGGPGGYPAAIRAAQRGKSVALIEAKELGGTCLNRGCIPSKALIAGAEVVDRIHEAKEFGIHVGEVNIDYAQLAFHKDRVIERMRKGLEGLMATNKITVFKGFGQFISPREIKIKGQDNTSITADQIIIATGSEPRNISAFPFDYERIHDSTSLLAMKTLPEKLIIVGGGVIGCEFASLYATLGVHVTILELLPRLISSEAIEVSQALTKAFIKRGIQVETGVKVQKIEQVEMGIQVQVEEGKHYVADCCLVAVGRSLNTKNIGLDKAGILVQENGMIAVNDKMQTNVDGIYAVGDIASKWWLAHVASHQGLIAADQICGKSSRMYYHAIPSVIFTHPEIATVGLSLEEATKRGYKAKLASFPFQALGKSQAALQAEGFAQIVVEEKSGQILGAQVVGYEASVMIAEMTLAIANELTVECVAETIHAHPTLPEAWLESALLGEGLPLHLPPKTQKKG

SEQ ID NO: 59497 - protein, 343 aa, Saccharum sp.
MDHAADAHRTDLMTITRHVLNEQSRNPESRGDFTILLSHIVLGCKFVASAVNKAGLAQLIGLAGETNVQGEEQKKLDVLSNEVFVKALVSSGRTCVLVSEEDEETTFVDPKLRGKYCVCFDPLDGSSNIDCGVSIGTIFGIYMIKDKDNVTLSDVLQPGKDMLAAGYCMYGSSCTLVLSTGTGVNGFTLDPSLGEFILTHPDIKIPKKGKIYSVNEGNAKNWDVPVAKFVEKCKYPKDGSPPKSLRYIGSMVADVHRTLLYGGVFLYPADQKSPNGKLRVLYEVFPMSFLMEQAGGQSFTGKERALDLVPTKIHERSPIFLGSYDDVEEIKALYAEQAKSSSA

SEQ ID NO: 59498 - protein, 136 aa, Conocephalum conicum
MARTKQTARKSTGGKAPRKQLASKAARKSAPSTGGVKKPHRYKPGTVALREIRRYQKSTELLIRKLPFQRFVREIAQDFKSDLRFQSSAIGALQESVESYLVSLFEDTNLCAIHAKRVTIQSKDIQLARRLRGERN

SEQ ID NO: 59499 - protein, 94 aa, Sulfolobus solfataricus
MSNEIVDELYKIILDRIEKRPTGSYTAEIVNKGKPYVARKVGEESVETIVASLAENKERFISEVADLIYHLLVLMALEGVTPEDIYRELERRRK

SEQ ID NO: 59500 - protein, 136 aa, Conocephalum conicum
MARTKQTARKSTGGKAPRKQLASKAARKSAPFTGGVKATHRYKPGTVALREIRRYQKSTELLIRKLPFQRLVREIAQDFKSDLRFQSSAIGALQESVESYLVSLFEGTNLCAIHAKRVTIQSKDIQLARRLRGERN

SEQ ID NO: 59501 - protein, 83 aa, Rhodobacter capsulatus
VDGSISAHQGFRILFEGGSRAVLRLSGTGTEGATLRVYLERYVAGPEGLTEDPQHALAPIIAATEDLVGIKARTGRKGPDVIT

SEQ ID NO: 59502 - protein, 205 aa, Zea mays
SGEYGATAYVTFKERFALETAVLLSGATIVDQPVCITYWGQPEETFNFWDRPTWEVEEEIEYTSYQSCQYNTTPQEALTVAQDIVKTMLAKGYVLSKDALAKARAFDESRGLTAAAAAKAAELSKRIGLTDRVSAGVGAMRSVDETYRVTETTKTVATATGRTAAKVVNGIVTSSYFSAGAMMLSDALTRAAKAAADLAAHGRQS

SEQ ID NO: 59503 - protein, 343 aa, Oryza sativa (indica cultivar-group)
MTLGDYDGSTTVAVDLVNEALGDNGNSVGIVNLTNTVLSDDVSNPSTQSAETMGRSKREVAPPPPPSPSQASPGSFASGMMLPGSLGNGAWQGPAPPQPPHPLLYAYGAAASAFPMAQMKQGLDRSAIDLSDLQERGMDFHPPGGFLSYFQDPSILQNHRPFVPPNYYPAEQVAPCSKLRPGAQQPVNIDSGDEEAHTVRTEKRLTWSTEEDIRLVSAWLNNSNDSISGNFKKNDRYWGDVTAEYNSTTPKNRTRQEKQIKDRFHKIKKNVGHFCCVYKEVKSIYVSGQNDMQLREKAEAAYQADYKEGPFSFLHCWNILRDQPKWHSYLEELEKPNKPKMDD

SEQ ID NO: 59504 - protein, 1015 aa, Arabidopsis thaliana
MVLPLFRRAAIARTSSLLRARLFAPASEFHSRFSNGLYHLDDKISSSNGVRSASIDLITRMDDSSPKPILRFGVQNFSSTGPISQTVLAMPALSPTMSHGNVVKWMKKEGDKVEVGDVLCEIETDKATVEFESQEEGFLAKILVTEGSKDIPVNEPIAIMVEEEDDIKNVPATIEGGRDGKEETSAHQVMKPDESTQQKSSIQPDASDLPPHVVLEMPALSPTMNQGNIAKWWKKEGDKIEVGDVIGEIETDKATLEFESLEEGYLAKILIPEGSKDVAVGKPIALIVEDAESIEAIKSSSAGSSEVDTVKEVPDSVVDKPTERKAGFTKISPAAKLLILEHGLEASSIEASGPYGTLLKSDVVAAIASGKASKSSASTKKKQPSKETPSKSSSTSKPSVTQSDNNYEDFPNSQIRKNDEICPAAFCFTFPTWQIIAKRLLESKQKIPHLYLQSDVVLDPLLAFRKELQENHGVKVSVNDIVIKAVAVALRNVRQANAFWDAEKGDIVMCDSVDISIAVATEKGLMTPIIKNADQKSISAISLEVKELAQKARSGKLAPHEFQGGTFSISNLGMYPVDNFCAIINPPQAGILAVGRGNKVVEPVIGLDGIEKPSVVTKMNVTLSADHRIFDGQVGELQPEKKDMSGFVVSKPEQSHHRLFDFAKTAIINIFAHPYATVCELYCGGAPETDKWEAAPIGHYIGIDTSSGISSVREAWESQRKNYDVEFFEADPSKARPFFDDFEIQLQKKLEQADLVSCWRHLQLCFETEESARRLLTNVACLLKPGGYFFGITPDSSTIWAKYQKNVEAYHNRSGAKPNVFPNYIRSESYMITFELEEEKFPLFGKRYQLKFSGDNASEDHCLVHFPSLIRLAREAGLEFVEIQSLTDFYDDNRAQFASLLMNAGPNFVDPRGKLLPRAFDLLGLYATFIFQKPDPDIEPPLTTPIPFESSNNHDEASTFVLSYSRSTQRELPVITVITDASAPAEDPSQGLGKIVEQKGILGPGPADLRFSEAI

SEQ ID NO: 59505 - protein, 150 aa, Glycine max
MEFQGQHDNPANRVDEYGNPFPLAGGVGGGHAAPGTGGQLQARRGEHKTGGILHRSGSSSSTSSSEDDGMGGRRKKGMKEKIKEKLPGGHKDNQQHMATGTGTGGAYGPGTGTGGAYGQQGHAGMAGAGTGTGEKKGIMDKIKEKLPGQH

SEQ ID NO: 59506 - protein, 267 aa, Oryza sativa (japonica cultivar-group)
MGEIHALRNMDDDEVFAYAKRIAAPYNLVMQTKQLGRLPVVQFAAGGVATPADAALMMQLGCDGVFVASGIFKSGDPARRARAIVQSVTHCRSSRPSTLPPRRPCWHTFAVELCPNRYMVMEAFIDTAGKDQSDPLILTQLNSTKAIRDSIQINFGECGLAACLGSLQGIYELYSSIVKYVNPITKLCVIRVSREDHQKVWAAITMVRSIGKIPVSFNLRDVSGSIRACKKAALECEEAKFEYYKLAAGDRITPKFVETMESCFNKD

SEQ ID NO: 59507 - protein, 307 aa, Ustilago maydis 521
MASKIAANAPLVAVDVFGQHVVQELKTFRSRIPAKSGTAPLFVAMQGPQGSGKTTVTRSLVQHLESIGLTVGVLSTDDLYHTHENLRRVAEESAANPLLSGRGQPGTHDIELGTQILDQVYNINTPRASTQNAVVQLPVFDKSLFNGEGDRAPCSDTAPTVAPPLDVFILEGWSMGFSPMSAAEVESKQAASSPDSPLRRYTLDALQQINRNLGAYTAWYTHFNVFLQIRPTDLENVYIWRTQQEHAMKARNGGFGMSDDGVKAFVERYMPGYHLFLDTIQQNEQWKGKGKTITIDIDRTIVEVHDW

SEQ ID NO: 59508 - protein, 209 aa, Triticum aestivum
  misc_feature (84)..(84): Xaa can be any naturally occurring amino acid
  misc_feature (127)..(127): Xaa can be any naturally occurring amino acid
  misc_feature (154)..(154): Xaa can be any naturally occurring amino acid
MALLATTPLLAPLALSPAPISASQSSLLFLRAPAPALLSLRSASPGARLLAAVASKEPELGGGGSGGGDGAGSGGGGGGGKQPXGGGDEGEEEKMGEGLSMSQKLTLAYAALVGAGGVLGYIKSGSXKSLAAGGISRLVLFLVHTQVPVKPVLXSAIGLGIWAGCGEWVPQQFSRDVREARNILFLIMDKDACVRVQYEVAATLPSICL

SEQ ID NO: 59509 - protein, 466 aa, Colwellia psychrerythraea 34H
MSDTPTKFTDLGLSEALLKAVRDKGYETPSPIQAQAIPAVISGRDVMAAAQTGTGKTAGFTLPLLQRLSSSKGNKVSSNNVRALILTPTRELAAQISESIEVYGKYLNLHSMVVFGGVKINPQIARLRQGVDVLVATPGRLLDLYNQRAVKFSQLEVFILDEADRMLDMGFIRDIKKLMTALPKDRQNLLFSATFSPEIRALAKGMVNNPLEISVDAENSTAEKVTQWLTAVDKKRKPAVLTHLIKENNWQQVLVFTKTKHGANKLTKHLEAEGLTAAAIHGNKSQGARTKALAAFKDGSVKILVATDIAARGIDIDLLPQVVNFDLPNVPEDYVHRIGRTARAGNTGQALSLVCADELDLLWGIEHVIQQHIERKVIEKFIPANELGESRVIKPLKQGKPPKSAKPHGAGKGRVEHKDGQRSGRNANGNNAGGNKAKPGNDSSRRKKPEYDGTGPKPRRAIRPTK

SEQ ID NO: 59510 - protein, 541 aa, Hyphomonas neptunium ATCC 15444
MKGIMQDWPLTVDKILEHARLQHGQREIITRRVEGNITRTTYSQLYDMSKQVSTALKDEGIALGDRVATLGWNSERHMASWYGAMGIGAVLHTINPRLHPEQIAWIANHAEDKVLIFDKTFLPIVEAIKDKLETVKTFVIYAGADTMPENTLGAIAFDIWIDGRSKSVRWGDFPEDTACGLCYTSGTTGNPKGVLYSHRSNVLHTLVTMGKDAMGMGAADSVMPVVPMFHANAWGLAMSCPATGANMVMPGAQMDGASIYELLDSEKVSLTAAVPTVWLMLLTHLQQNDLKLPYLKKVLIGGSAIPEKILRAFEEEYEVEVIHAWGMTETSPLGTLGALPPHLEKAPVDARMKQKLKQGRPPFGVELKLVDDDGEDVARDGQASGRLLVRGAAVAAGYFKGAGGHVLDADGWFDTGDVATIDEIGTMTITDRAKDVIKSGGEWISSIDIENIAVGHPKVANAAAIGIYHPKWDERPLLIVQAAAGETPTKEEILKSLEGKIAKWWTPDDVQFVDNIPLGATGKINKLALRETFKDYKLPTA

SEQ ID NO: 59511 - protein, 433 aa, Brassica napus
QAVFHDLLGQGIFNSDGDTWLFQRKTAALEFTTRTLRQAMARWVNRAIKLRLPILETARLDSEPIDLQDLLLRLTFDNICGLTFGKDPRTCAPGLPVNTFSVAFDRATEASLQRFILPEILWKFKRLAGLGLEVSLTRSLVQVDNYLSEIIKTRKQDLTSKPNNDGAQHDDLLSRFIKKKETYSDEVLQRVALNFVLAGRDTSSVALSWFFWLITQNPTVEDKILREICAVLIETRGDDVALWIDEPLACEELDRLVYLKAALSETLRLYPSVPEDSKRAVKDDVLPDGTFVPAGSSVTYSIYSAGRMRSTWGDDCLEFKPERWISRSDGGRFINHDPFKFVAFNAGPRICLGKDLAYLQMKSIAAAVLLRHRLTVVTGHKVEQKMSLTLFMKYGLLVNVRNRDLTAIAADLREKTDCESNAVNDGVGNGVRR

SEQ ID NO: 59512 - protein, 448 aa, Echium plantagineum
MANAIKKYITAEELKKHDKAGDLWISIQGKIYDVSDWLKDHPGGNFPLLSLAGQEVTDAFVAFHSGTTWKLLEKFFTGYYLKDYSVSEVSKDYRKLVFEFNKMGLFDKKGHIVLVTVLFIAMLFGMSVYGVLFCEGVLVHLLAGGLMGFVWIQSGWIGHDAGHYIVMPDARLNKLMGIVAANCLSGISIGWWKWNHNAHHIACNSLDYDPDLQYIPFLVVSSKLFSSLTSHFYEKKLTFDSLSRFFVSHQHWTFYPVMCMARVNMFVQSLIMLLTKRNVFYRSQELLGLVVFWIWYPLLVSCLPNWGERVMFVVASLSVTGMQQVQFSLNHFSSSVYVGQPKGNDWFEKQTCGTLDISCPSWMDWFHGGLQFQVEHHLFPKLPRCHLRKISPFVMELCKKHNLSYNCASFSEANNMTLRTLRDTALQARDLTKPLPKNLVWEALNTHG

SEQ ID NO: 59513 - protein, 136 aa, Conocephalum conicum
MARTKQTARKSTGGKAPRKQLASKAARKSAPSTGGVKKAHRYKPGTVALREIRRYQKSTELLIRKLPFQRLVREIAQDFKSDLRFQSSAIGALQESVESYLVSLFEDTNLCAIHAKRVTIQSKDIQLARRLRGERN

SEQ ID NO: 59514 - protein, 136 aa, Conocephalum conicum
MARTKQTARKSTGGKAPRKQLASKAARKSAPSTGGVKKPHRYKTGTVALREIRRYQKSTELLIRKLPFQRLVREIAQDFKSDLRFQSSAIVALQESVESYLVSLFEDTNLCAIHAKRVTIQSKDIQLARRLRGERN

SEQ ID NO: 59515 - protein, 226 aa, Candidatus Protochlamydia amoebophila UWE25
MVKLILMRHGQSQWNLANLFTGWVDIPLSFKGIEEAIEAGKQIKNYPIDLIFTSSLIRAQMTAMLAMSVHTSGKVPVILHTGEGRLEEWASIYSSESQSQTIPVIRAWELNERMYGELQGINKEEMAKKYGAEQVHIWRRSFDVPPPNGESLQMTAARTIPYFENTIVPHLKEKKNIFIAAHGNSLRSIIMKLDGLTTDQVVKLELATGVPVIYDFNHDEYIKQQK

SEQ ID NO: 59516 - protein, 136 aa, Conocephalum supradecompositum
MARTKQTARKSTGGKAPRKQLASKAARKSAPSTGGVKKPHRYKPGTVALREIRRYQKSTELLIRKLPFQRLVREIAQEFKSDLRFQSSAIGALQESVESYLASLFEETNLCAIHAKRVTIQSKDIQLARRLRGERN

SEQ ID NO: 59517 - protein, 350 aa, Triticum aestivum
SWCASCNKGFPFAFGLVWRPVGMGISHPLSDEFYGGPRGGGLGSALLLSPSSPPPPASCCSPVDDGQQDFLQHQVSRMDTLAGIAIKYGVEISDIKRANSLVTDSQMYAHKALLIPLPGRPMPSSVKLNGSSLRSKRAWAPNNQQNRDIMDSLDSVKSRQQQSSLAMSSLQSYYGLSSERGDDMDCSTEMSLYSKGGSQGIGSEISPNASPPPDSTQSTGRGNGATKEKQDGSIRRRQKVEADTNDDLLSDSIKMIKSFLPRPVSSMRLSTDSSSPDSAAKSNGGSFLDGFKSVVRRSPSAPSFADSENGGGVSMWSSSKWTFNHESFTRPLLDGLPKPSPGRRMKAALD

SEQ ID NO: 59518 - protein, 314 aa, Arabidopsis thaliana
MDLFSSLPNELLYHILSFLSTKEAALTSVLSKRWRNLFAFVPYLEFDDSVFLHPEERKREKEGILQSFMDFVDRVLDLHGDSLIKTFSLKCKTGVDSDHVDRWICNVLARGVSDLDLFIDFRDLYSLPHEVGVSRTLVVLRVGSESDLYWWQKFLCLPMLKTLVLDSCWLCIGQFQILLLACPALEELDMTNTRWKDSNVTVSSSILKELTIDLHGCCSVVNLKSLSFDAPSLVYFYYCDSLAEDYPQVNLKNLVEAQINLLLTQAQIEQVRALNNEMLVADDVFPGLGNAWKLITGLRNVQQLYLSPDTLEVL

SEQ ID NO: 59519 - protein, 136 aa, Encephalartos altensteinii
MARTKQTARKSTGGKAPRKQLATKAARKSAPATGGVKKPHRFRPGTVALREIRRYQKSTELLIRKLPFQRLVREIAQDFKTDLRFQSSAVAALQEAAEAYLVGLFEDTNLCAIHAKRVTIMPKDIQLARRIRGERA

SEQ ID NO: 59520 - protein, 281 aa, Zea mays
MAAKGLREVGRRRAAEVGRRCLSGGSAGPPAPAAKRKEGGKAVNLFTAVNQALHIALDTDPRAYVFGEDVGFGGVFRCTTGLADRFGKSRVFNTPLCEQGIAGFAIGLAAMIVNEAAKFRYRSGNEFNCGGLTIRTPYGAVGHGGHYHSQSPEAFFCHVPGLKWLYRLAVEEVPEEDYMLPLSEAEVIREGSDITLVGWGAQLAVLKEACEDAAKVSHEAPVTGGFGAEIAASIAERCFQRLEAPVARVCGLDTPFPLVYEPFYMPTKNKVLDAIKATVDF

SEQ ID NO: 59521 - protein, 234 aa, Lycopodium annotinum
MGRGKIEIKRIENSTSRQVTFSKRRGGLLKKAHELAVLCDAQVALIIFSNTGKLFEYASTSMKEILDRYRKYPDGIQTGRVMEYDNDVMVQHWSREVMRMKQQIERSYQTQRHMMGEDLGLLPLKELQHLEQQLDTGLNRVRARKDQVLREQIDSLRIKELQWHEENEILRRKIAGAHGMTEVAVRSFSSQNIVNPLETREPPSIGQVSVPFSLHVNQKNLRENQNLQTSLQLG

SEQ ID NO: 59522 - protein, 461 aa, Vibrio angustum S14
MKHPNVLQITLVVALGGLLFGYDTAVISGATESLQIFFNLNPAELGFAAASALIGCVIGSIAAGYTSTKYGRRGALLIAALLFFISALGSAVPDQYWTFIFYRIIGGIGVGIASMVSPMYIAEIAPRQKRGALVSCNQFAIIFGMLVVYFVNYGIALMGSESWLNEMGWRYMFGSEMIPAGLFFFLLFSVPETPRWLAMRGRDEQAKELLSKISKGKDFDSQWKEIKDSLVEVSTASITSRKILPILVIGIMLSVLQQVTGINVFLYYAPVILKSFSSSSTDIALLQTILVGAVNLTFTVIAIITVDKYGRKPLMMLGAGLMAISMIAIGTAAYLNAIGGYLLVFVLTYIAAFALSLGPVTWVLLSEIFPNNVRSKALSIAVFAQWVANYAVSQTFPMMNDQNSWLFKEFNGGFPFWFYGVMGLVTIYFVHRFVPETKGKSLEELEELWEKPDELETVTHN

SEQ ID NO: 59523 - protein, 940 aa, Arabidopsis thaliana
MSLFLKDDSIQIREVWNDNLQEEMDLIRDVVDDFPYVAMDTEFPGIVVRPVGTFKSNADYHYETLKTNVNILKMIQLGLTFSNEQGNLPTCGTDKYCIWQFNFREFDLDSDIFALDSIELLKQSGIDLAKNTLDGIDSKRFAELLMSSGIVLNENVHWVTFHSGYDFGYLLKLLTCQNLPDSQTDFFKLINVYFPTVYDIKHLMKFCNSLHGGLNKLAELLEVERVGICHQAGSDSLLTSCTFRKLKENFFVGPLHKYSGVLYGLGVENGQRLVGIIESQASSSRKLRSSSSEIKGTENVSGPPTRMDNSSDEESEISESEIDVYYEKPYEKLMNGDYKVKVKDTFRCPFCAGKKKQHYKYKELLAHASGVAKGSASRSAKQKANHFALAKYMENELAGDADVPRPQIPSSSTEQSQAVVDDIYVWPWMGIVINPVRRTDNKNVLLDSAYWLKKLARFNPLEVKTLWLDQESVVAVIPQFNSGWSGFKSVTELEKEYEIRGCGRKDWIDKRGDWRSKAYGWCARADDYNSQGSIAEYLSKVGKLRSFSDITKEEIQNKSIVVDDLANKIAMTNEDLNKLQYMNNEKTLSLRRVLIEKDELDRVYKQETKKMQELSREKINRIFREKERLTNELEAKMNNLKIWSKQLDKKQALTELERQKLDEDKKKSDVMNSSLQLASLEQKKTDDRVLRLVDEHKRKKEETLNKILQLEKELDSKQKLQMEIQELKGKLKVMKHEDEDDEGIKKKMKKMKEELEEKCSELQDLEDTNSALMVKERKSNDEIVEARKFLITELRELVSDRNIIRVKRMGELEEKPFMTACRQRCTVEEEAQVQYAMLCSKWQEKVKDSAWQPFKHVGTGDRKKEVVDEEDEEIKKLREEWGEEVKNAVKTALEELNEFNPSGRYSVPELWNSKQGRKATLKEVIDYITQQVKTLKRRRA

SEQ ID NO: 59524 - protein, 183 aa, Salmonella typhimurium LT2
MTATAQQLEFLKNSIKSIQDYPKPGILFRDVTSLLEDPKAYALSIELLVERYKNAGITKVVGTEARGFLFGAPVALGLGVGFVPVRKPRKLPRETIAETYELEYGTDQLEIHVDAIKPGDNVLVVDDLLATGGTIEATVKLIRRLGGKVTDAAFIINLFDLGGEQRLEKQGITCYSLVPFPGH

SEQ ID NO: 59525 - protein, 188 aa, Picrophilus torridus
MKIYIIDNGGQWTHREWRTVRDLGVDSTIVPNTVDADVLADADGIILSGGPASIESEISKLGNIKEYMHRYNYPVLGICVGAQFIAIDSGGRVSKALHAEYGKKIVNFTSKDGIFYNIPDSINAWENHNDEIKSISDDYIICAYSDTCRVQAFYHKNRDIFGVQFHPEVNNTEHGTTIFKNFIEKCRR

SEQ ID NO: 59526 - protein, 513 aa, Photobacterium profundum
MSAKKPLALVILDGWGYREDNSDNAIANANTPVMDSLIANEANTLISASGFDVGLPDGQMGNSEVGHTNIGAGRVVYQDLTRITKSIADGDFFENEALTTAMDKAINAGKAVHIMGLMSPGGVHSHEDHIAAAIEMAAKRGAEKIYLHCFLDGRDTPPRSAQNSLERFDALFAELGKGRTASLVGRYYAMDRDNNWDRVEVAYNLLSAAKADFTVDSAVAGLTDAYSRDENDEFVKATEIRAEGQESAAMVDGDTVIFMNYRADRAREITRAFEADFTSFVRTQTPALAEFVMLTRYAANIKLPAAFPPATLKNTLGEWLSKKGKKQLRISETEKYAHVTFFFNGGVEDEFDGETRSLVASPKVATYDLQPEMSAPELTEKLVAAIKGGEFDTIICNYPNGDMVGHTGVYDAAVKACEALDGCIGQVVEAIKSVGGQLLITADHGNAEMMINPETGGVHTAHTNLPVPLIYVGDKSLTLKDGGKLSDLAPTMLSLSDIEIPAEMTGQVLFDLK

SEQ ID NO: 59527 - protein, 552 aa, Candida glabrata CBS 138
MSDQESRSQSVLSASNSKADREDEFKAYVDEEGQPMVEIPKKPASAYVSISIFCLFIAFGGFVFGWDTGTISGFVAQTDFIRRLGQTRANGTHYLSKVRTGLVVSIFNIGCAIGGIVLSKLGDMYGRKIGLISVVVIYIVGIVIQIATIDKWYQYFIGRIISGLGVGGIAVLSPMLISEVSPKHMRGSLVSCYQLMITCGIFLGYCTNYGTKNYSNSVQWRVPLGLCFAWALFMIGGMTFVPESPRYLIEVGRVEEARRSIAISNKVSPDDPAVTFEVENVQAAVEAERLAGSASWGELFSTKTKVFQRLIMGIMIQSLQQLTGDNYFFYYGTTVFKAVGLEDSFETSIVIGIVNFASTFVALYVVDRFGRRRCLLWGAAAMTACMVVFASVGVTRLWPNGQDQPSSKGAGNCMIVFTCFYIFCFATTWAPIPFVVNSETFPLRVKAKCMAIAQASNWIWGFLIAFFTPFITNAINFYYGYVFMGCLCFSYFYVFFFIPETKGLTLEEVNTLWEEGVLPWKSPNWVPPSKRDASYDADAMMHDDKPWYKRFV

SEQ ID NO: 59528 - protein, 191 aa, Yarrowia lipolytica
MQTIKCVVVGDGAVGKTCLLISYTTNKFPSEYVPTVFDNYAVTVMIGDEPYTLGLFDTAGQEDYDRLRPLCYPQTDVFLVCFSVTSPASFENVKEKWFPEVHHHCPGVPCLIVGTQVDPRSDRMILDKLSRHKLRPMTTEQGYQLARELGAVKYVECSALTQKGLKDVFDEAIVAALEPPVVKKNKKCIVL

SEQ ID NO: 59529 - protein, 202 aa, Clostridium thermocellum ATCC 27405
MNYVKIGVGGPVGSGKTALIEKLTRILADSYSIGVVTNDIYTKEDAEFLIKNSVLPKERIIGVETGGCPHTAIREDASMNLEAVEELVQRFPDIQIVFIESGGDNLSATFSPELADATIYVIDVAEGDKIPRKGGPGITRSDLLVINKIDLAPYVGASLEVMERDSKKMRGEKPFIFTNLNTNEGVDKIIDWIKKSVLLEGV

SEQ ID NO: 59530 - protein, 136 aa, Conocephalum supradecompositum
MARTKQTARKSTGGKAPRKQLASKAARKSAPSTGGVKKPHRYKPGTVALREIRRYQKSTELLIRKLPFQRLVREIAQDFKSDLRFQSSAIGALQESVESYLVSLFEDTNLCAIHAKRVTIRSKDIQLARRLRGERN

SEQ ID NO: 59531 - protein, 549 aa, Candida glabrata CBS 138
MSEESQSALSASNSKVEREDEFKAYTDEDGQPMVEIPKKPASAYVAISIFCLFIAFGGFVFGWDTGTISGFVAQTDFIRRMGQTRANGTHYLSKVRTGLIVSIFNIGCAIGGVVLSKLGDVYGRKIGLISVVVIYIVGIVIQIATIDKWYQYFIGRIISGLGVGGIAVLSPMLISEVSPKHMRGSLVSCYQLMITCGIFLGYCTNYGTKNYSNSVQWRVPLGLCFAWALFMIGGMTFVPESPRYLIEVGRVEEARRSIAISNKVSPDDPAVTFEVENVQAGVEAERLAGSASWGELFSTKTKIFQRLIMGIMIQSLQQLTGDNYFFYYGTTVFKAVGLEDSFETSIVIGIVNFASTFVALYVVDRFGRRRCLLWGAAAMTACMVVFASVGVTRLYPHGMKQPSSKGAGNCMIVFTCFYIFCFATTWAPIPFVVNSETFPLRVKAKCMAIAQASNWIWGFLIAFFTPFITNAINFYYGYVFMGCLCFSYFYVFFFIPETKGLTLEEVNTMWEEGVLAWKSPNWVPPSKRDASYDADALMHDDKPWYKRFY

SEQ ID NO: 59532 - protein, 139 aa, Brassica napus
MAGGGGYGGASGKVDYVFKVVLIGDSAVGKSQLLARFARDEFSLDSKATIGVEFQTRTLTIEEKSVKAQIWDTAGQERYRAVTSAYYRGAVGAMLVYDITKRETFDHIPRWLEELRAHADKNIVIILIGNKSDLEDQRA

SEQ ID NO: 59533 - protein, 280 aa, Arabidopsis thaliana
MAIIKPNRDLKPDGVTVVTREVWAENLESEFELISEIIDDYPFISMDTEFPGVIFKSDLRFTNPDDLYTLLKANVDALSLIQVGLTLSDVNGNLPDLGDDLHRGFIWEFNFRDFDVARDAHAPDSIELLRRQGIDFERNCRDGVESERFAELMMSSGLVCNEEVSWVTFHSAYDFGYLMKILTRRELPGALGEFKRVMRVLFGERVYDVKHMMKFCERRLFGGLDRVARTLEVNRAVGKCHQAGSDSLLTWHAFQRMRDLYFVQDGPEKHAGVLYGLEVF

SEQ ID NO: 59534 - protein, 136 aa, Conocephalum supradecompositum
MARTKQTARKSTGGKVPRKQLASKAARKSAPSTGGVKKPHRYKPGTVALREIRRYQKSTELLIRKLPFQRLVREIAQDFKSDLRFQSSAIGALQESVESYLVSLFEDTNLCAIHAKRVTIQSKDIQLARRLRGERN

SEQ ID NO: 59535 - protein, 317 aa, Escherichia coli
MSERHLPDDQSSTIDPYLITSVRQTLAEEGARLQNLSKQLDSGQYQRVLNLIMNCKGHVILSGMGKSGHVGRKMSATLASTGTPSFFIHPAEAFHGDLGMITPYDLLILISASGETDEILKLVPSLKNFGNRIIAITNNGNSTLAKNADAVLELHMANETCPNNLAPTTSTTLTMAIGDALAIAMIRQRKFMPNDFARYHPGGSLGRRLLTRVADVMQHDVPAVQLDASFKTVIQRITSGCQGMVMVEDAEGGLAGIITDGDLRRFMEKEDSLTSATAAQMMTREPLTLPEDTMIIEAEEKMQKDKCLNVIGDQQGK

SEQ ID NO: 59536 - protein, 136 aa, Conocephalum supradecompositum
MARTKQTARKSTGGNAPRKQLASKAARKSAPSTGGVKKPHRYKPGTVALREIRRYQKSTELLIRKLPFQRLVREIAQDFKSDLRFQSSAIGALQESVESYLVSLFEDTNLCAIHAKRVTIQSKDIQLARRLRGERN

SEQ ID NO: 59537 - protein, 791 aa, Pseudomonas aeruginosa PAO1
MVEYVVSLDKLGVHDVEHVGGKNASLGEMISNLAGAGVSVPGGFATTAQAYRDFLEQSGLNDRIHAALDALDVDDVNALAKTGAQIRQWVMEAEFPARLDSEIRQAFAALANGNDNLAVAVRSSATAEDLPDASFAGQQETFLNIRGVDNVIRAAKEVFASLFNDRAIAYRVHQGFDHKLVALSAGVQRMVRSETGTAGVMFTLDTESGFRDVVFITGAYGLGETVVQGAVNPDEFYVHKPTLEAGRPAILRRNLGSKAIKMIYGDEAKAGRSVKVVDVDRADRARFALSDAEVTELAKQAMIIEKHYGRPMDIEWAKDGDDGKLYIVQARPETVKSRASATVMERYLLKEKGTVLVEGRAIGQRIGAGPVKVINDVSEMDKVQPGDVLVSDMTDPDWEPVMKRASAIVTNRGGRTCHAAIIARELGIPAVVGCGNATQILQDGQGVTVSCAEGDTGFIFEGELGFDVRKNSVDAMPDLPFKIMMNVGNPDRAFDFAQLPNEGVGLARLEFIINRMIGVHPKALLNFAGLPADIKESVEKRIAGYPDPVGFYVEKLVEGISTLAAAFWPKKVIVRLSDFKSNEYANLIGGKLYEPEEENPMLGFRGASRYISESFRDCFELECRALKKVRNEMGLTNVEIMVPFVRTLGEASQVVELLAGNGLKRGENGLKVIMMCELPSNALLADEFLEFFDGFSIGSNDLTQLTLGLDRDSGIVAHLFDERNPAVKKLLANAIAACNKAGKYIGICGQGPSDHPDLARWLMEQGIESVSLNPDSVLDTWFFLAEGQDQA

SEQ ID NO: 59538 - protein, 136 aa, Conocephalum supradecompositum
MARTKQTARKSTGGKAPGKQLASKAARKSAPSTGGVKKPHRYKPGTVALREIRRYQKSTELLIRKLPFQRLVREIAQDFKSDLRFQSSAIGALQESVESYLVSLFEDTNLCAIHAKRVTIQSKDIQLARRLRGERN

SEQ ID NO: 59539 - protein, 505 aa, Arabidopsis thaliana
MEISVSSVTFSLAVVVVSWWVWRTLKWVWFTPKMLERSLRRQGLSGTSYTPLIGDFKKMISMFIEATSKPIKPTDDITPRVMPHPLQMLKTHGRTILTWFGPIPTITIMDPEQIKEVFNKVYDFQKAHTFPLGKILGTGLVSYDGDKWAQHRRIINPAFHLEKIKNMVPAFHQSCSELVGEWGKLVSDKGSSSCEVDVWPGLASMTADVISRTAFGSSYREGHRIFELQAELAQLVLQAFRKVFIPGYQRMKAAAREIQVILRGIVNKRVRAREAGEAAPSDDLLGILLESNLGQAEGNGMSTEDVMEECKLFYFAGQETTSVLLVWAMVLLSHHQDWQARAREEVKQVFGDKQPDTEGLSQLKMTMIIYEVLRLYPPVIQMNRATHKEIKLGDMTLPGCIQVHMPVLLIHRDTKLWGDDAAEFKPERFKEGIAKATKNQVCFLPFGWGPRICIGQNFALLEAKMALALILQRFSFELSPSYVHSPYRVFTIHPQCGAHLILHKL

SEQ ID NO: 59540 - protein, 195 aa, Brassica napus
IANIFKAADVDNSGTLTEEELQDVVEDINVRYPQVELYLKSKHVRSIKDLLTDSEGNPKKEVDIKAFESALSGVDSQMKSLPATAQVAAQQGSYLAKCFNKMEHCKEHPEGPKRFRTGGHHQFRPFQYKHFGQFAPLGGDQAAAELPGDWVSAGRSTQWLWYSVYASKQVSWRTRALVVSDWTRRYIFGRDSSRI

SEQ ID NO: 59541 - protein, 740 aa, Cucumis melo var. cantalupensis
MENCYCIEPQWPADELLMKYQYISDFFIALAYFSIPLELIYFVKKSAVFPYRWVLVQFGAFIVLCGATHLINLWTFTMHSRTVAVVMTTAKVLTAVVSCATALMLVHIIPDLLSVKTRELFLKNKAAELDREMGLIRTQEETGRHVRMLTHEIRSTLDRHTILKTTLVELGRTLALEECALWMPTRTGLELQLSYTLHQQNPVGYTVPINLPVISQVFSSNRALKISPNSPVASLRPRAGRYVAGEVVAVRVPLLHLSNFQINDWPELSTKRYALMVLMLPSDSARQWRVHELELVEVVADQVAVALSHAAILEESMRARDLLMEQNVALDLARREAETAIRARNDFLAVMNHEMRTPMHAIIALSSLLQETELTPEQRLMVETILKSSNLLATLINDVLDLSRLEDGSLQLDIGTFNLHAVFKEVLNLIKPVTLVKKLSLTLHLGPDLPVFAVGDEKRLMQAILNVVGNAVKFSKEGSISISAIVAKSETFREIRVPDFHPVPSDSHFYLRVQVKDTGSGISPQDIPKLFTKFAQTTVGPRNSGGSGLGLAICKRFVNLMEGHIWLESEGLGKGCTATFIVKLGIADQSNESKLPYTSKIHENSIHTSFPGLKVLVMDDNGVSRSVTKGLLVHLGCEVTTAGSIEEFLRVVSQEHKVVFMDICTPGVDGYELAIRIREKFAKCHERPFMVVLTGNSDKVTKESCLRAGMDGLILKPVSIDKMRSVLSELIERRVLFETS

SEQ ID NO: 59542 - protein, 540 aa, Glycine max
MATRRLSLLLSRSLSSTSFQAASLLHSLGRNSGKWGNFNRFSTAAAVEDLITPQVPITYTKHLINGQFVDAASGKTFPTYDPRTGEVIAQVAEGDAEDINRAVSAARKAFDEGPWPKLTAYERCKIILRFADLVEKHGDELAALETWNNGKPYEQSATAELPTFVRLFRYYAGWADKIHGLTVPADGNYHVETLHEPIGVAGQIIPWNFPLLMFAWKVGPALACGNTVILKTAEQTPLTALYVAKLFHEAGLPPGVLNVVSGYGPTAGAALASHMDVDKLAFTGSTETGKVVLGLAAQSNLKPVTLELGGKSPFIVCEDADVDQAVELAHFALFFNQGQCCCAGSRTFVHEHIYDEFLEKAKARALKRVVGDPFKKGVEQGPQIDVEQFQKVLRYIKSGIESKATLECGGDQIGSKGFFVQPTVFSNVQDDMLIAKDEIFGPVQTILKFKDIDEVIRRSNATHYGLAAGVFTKNVHTANTLMRALRVGTVWINCFDVFDAAIPFGGYKMSGIGREKGIYSLNNYLQVKAVVSPVKKPAWL

SEQ ID NO: 59543 - protein, 368 aa, Brassica napus
IDLQDLVLRLTFDNICGLAFGKDTRTCAPGLPENGFATAFDRATEASLQRFIMPEFLWKLKKWLRLGLEVSLSRSLGEIDGYLAKVISTRKQELMSQQESGAQGHDDLLSRFMMKKKEAYSDTFLQHVALNFILAGRDTSSVALSWFFWLITMHPAVEDKIVREICSVLIETRGTENNPALWPGEPLNFDEIDRLVYLKAALSETLRLYPSVPEDSKHVENDDVLPDGTFVPAGSSVSYSIYAAGRMKSTWGEDCLEFIPERWISPIDGKFINHDQYRFVAFNAGPRICLGKDLAYLQMKSIAAAVLLRHRITVVPGHRVEQKMSLTLFMKNGLLVNLHKRDLEGTIKSLVVAKGDGVIDGKCDGVAV

SEQ ID NO: 59544 - protein, 362 aa, Colwellia psychrerythraea 34H
MSNIAILAGDGIGPEVMVEAKKVLNTVASKFDFEITTQDYDIGGAAIDNHGNALPDSTMAGCIESDAILFGSVGGPKWANLPPTEQPERCALLGLRSHFDLFCNMRPATLQPALSSLSTLRSDISEQGFDVLVIRELTGDIYFGEPKGRRGEGEEETGFDSMFYSRREVKRISHLAFQAAQKRNNKVTSVDKANVLATSQLWRQVVEEVAVEYPDVELEHLYVDNAAMQLVRDPNQFDVMLCPNLFGDILSDICAMITGSMGLLPSASLNSDGFGMYEPAGGSAPDIAGLGVANPIAQILSAALMLRYSLNQGAAAKAIEDAVSNALDNGVLTADLLPANERKNAKSTSEVGDYICKQIESA

SEQ ID NO: 59545 - protein, 416 aa, Glomus mosseae
MSLSNKLSIRDLNVKDKRVLIRVDFNVPLDGTTITNNQRIVAALPTIKYALEQKAKTVVLMSHLGRPDGKKVDKYSLAPVAKEVERLLGKKVTFLEDCVGEGVENYVKNACDGEVILLENLRFHAEEEGSSKGPDGKKVKADLEKVKEFRRSLTALGDVYINDAFGTAHRAHSSMVGVELPQKAAGFLVKKELEYFAKALESPERPFLAILGGAKVSDKIQLIDNLIAKVDSLIICGGMAFTFKKTLENVKIGNSLFDADGAKTVGEVMEKAKKHDVEVVLPVDYITADKFAKDAQVGYATDQEGIPDGWMGLDCGEKSVELYKQTIAKAKTILWNGPAGVFEFDNFAKGTKATLDCAVEAAQSGKIVIIGGGDTATVAAKYGVEDKLSHVSTGGGASLELLEGKDLPGVSALSSK

SEQ ID NO: 59546 - protein, 416 aa, Agaricus bisporus
MSLSNKLSITDLALTGKRVLIRVDFNSPIQDGKITNPARINAALPTIKYALDNGASKVILMSHLGRPDGKAISKYSLKPVASELEKLLKKPVFFLHDCVGPDIEKAVLEAPEGAVVLLENLRFHIEEEGSAKNEEGKKIKADPSKVTQFREQLTRLGDVYVNDAFGTAHRAHSSMVGIKLPRRASGFLVKKELDYFAKALENPERPFLAILGGAKVSDKIQLIENMLDKVNCLVIGGGMAFTFKKTMQNVAIGNSLFDKPGSEKVAGIVEKAKKNNVEIVFPVDYVVGDKFDANANHKIVTDDEGVPDGWMGLDVGPKSNELFREAVLKAKTILWNGPPGVFEFPAFAKGSKVLLDATVEAVQKGATVIVGGGDTATVVANHDAEEKLSHVSTGGGASLELLEGKTLPGVAELSNK

SEQ ID NO: 59547 - protein, 246 aa, Glycine max
MDPQQRPLMSDRVTVNGSVTPLALLADGRLWWSEGIQRCLSIEKDVLGIVASGPYIKIKSLVETRDGCCITSAPARLVRNDVVFMPSSEESHRLWCHKLREFIDSLGRPKRLLVFVNPFGGKKSATKIFAEQVKPLFEDAHIQITVQETKHQLHAKEVARSLDITKYDGIVCVSGDGILVEVVNGLLQREDWDTAIKMPLGVVPAGTGNGMAKSLLVSFIAITLVALFVIIILIVIVMFVVINTKQ

SEQ ID NO: 59548 - protein, 186 aa, Spirochaeta aurantia
MIRALFFDLDGTLVDTHQANFVAYRQALEAHGVTVTEDEFRKCQGHQARVFLRWFLPDMTPEVYRDIAQRKSRLYAENLDLTLVNDHLLGLLRAVCPDTTCAIVTTATRTNSEAVLRHHGLADRFSFMVTADDVQNAKPHPEGYLLALARANVPAADALAFEDSRPGIEAAEAAGLAVVHIANLVP

SEQ ID NO: 59549 - protein, 448 aa, Coprinopsis cinerea okayama7#130
MASSLPLELVLITHGQLETIRLLNQLSQQDFEALDGVEWDGIDDDELDEALLLSGLSLHDLLKQYNTTFLIQKLVSTGHKERGPYNIDFPKSFAYFEAALGWPPDLFRHEFRQLVEVLERNPIFQSRGRKPQRAVRYQLATFLLRYASRGSDTLSVAKRMGIGVGTVWLYCRRVTRALRELGLEVITWGDEDRHRETADHVCERTGFPDCIGMIDCTLIRLTDVPSMWGEVYYCRKKYPAVNVQGVCDHKLRFISFEMGWPGSTPDVTVLKNSDLWRNRTKYFTGDQYLFADRGYQSSPYLLRPFTEPEVDAFAGPERRRRLDFNRTLSGTRIYIEHAFGLLKGRFHSLKDLGRHRNVNEIYQVIHALMVLHNLCIDWEDSPHDFIDPDVLEEMTEDEGEPVEVITFGEVHYGDGHIAPYETDEWHKEEGRMKRDEMLNRRFPLSAYV

SEQ ID NO: 59550 - protein, 421 aa, Brachyspira murdochii
  misc_feature (381)..(381): Xaa can be any naturally occurring amino acid
TWAAKTLKATDPNCQVVTYDRNDNISFLACGIALWVGGVVKDPKGLFYASPESLKAEGIDVYMGHDVTKIDWANKKLHVKELKTGKEFDDNYDKLILATGSWPVTPPIEGLMQEGTEYGLKKGIFFSKLFQQGQEIIDEIAKPEVKKVMVVGAGYIGVELIEAFKNHGKEVILMEAMPRVMANYFDKEITDEAEKRIKEAGIEMHLGETVKKFEGDDRVKRVVTDKGSYDVDMVVMSVGFRPNSELYKDYLETLPNGAIKVDTTMKTTKDPNVFAIGDCATVYSRASGKEEYIALATNAVRMGIVAANNALGKHVEYCGTQGSNAICVFGYNMASTGWSEETAKKKGLKVKSNFFKDAERPEFMPSYEDVLVKIIYEEDTXRMVGAQIASKHNHAEAIHAFSLAIQNGMTVDQFALSDFFF

SEQ ID NO: 59551 - protein, 357 aa, Prochlorococcus marinus str. AS9601
MLTNQNFVKVFFLETHVERISNLQDIKKAELDRETGLFLYEDMTLGRRFEDKCAEMYYRGKMFGFVHLYNGQEAISTGVIGAMKKKHDWFCSTYRDHVHALSAGVPSFEVMSELFGKSTGCSKGRGGSMHLFSREHHLLGGYAFIGEGIPVALGAAFSSKYKKEVAGNSNSDAVTAAFFGDGTCNNGQFFECLNMAQLWKLPIIFVVENNKWAIGMAHDRATSNPEIWRKASAFGMHGEEVDGMDVLAVRGAAQRAIERARAGEGPTLLECLTYRYRGHSLADPDELRSEKEKEFWGKRDPIKKLAQEIIDGKFATEEELKIIEKKIDAEIAESVKNAIEAPEPPSEELTKYIWAED

SEQ ID NO: 59552 - protein, 437 aa, Streptococcus mutans UA159
MGNKQPTARSGALFVLTEIFDKTAYSNIALRHYLSKHKLSQADRSLLTELVYGTLTRKITLEWYLAHYIEDRNKLETWIYYLLMLSLYQILYLDKIPQHAIVNEAVDLAKSRNRGAEKLVNAVLRQFLRQKRPDITVIKRKNKRYSITYSVPVWLVKKMIDQFGEDRAISILKSLLVRSKASIRVVNPDQIEVIAKATGAKKSVLSPCGLVKASGQFFDSDLFKQGKITIQDESSQLVAPTLAIKGNETVLDACSAPGGKAVHIASYLTTGQIIALDLYDHKLKLIKDNADRLKAANYIKPQKLDARKVHKYFAKDTFDKILVDAPCSGIGLIRRKPDIKYNKDSKDFTSLQKIQLEILDSVCQTIKKGGIITYSTCTIFAEENQMVLKQFLEQHPNFEQVKLNHKKKDIVVDGCLLITPEQYLTDGFFISQVKRIS

SEQ ID NO: 59553 - protein, 413 aa, Brachyspira innocens
WAAKTLKATDPNCQVVTYDRNDNISFLACGIALWVGGVVKDPKGLFYASPESLKAEGIDVYMGHDVTKIDWANKKLHVKELKTGKEFDDNYDKLILATGSWPVTPPIEGLMQEGTEYGLKKGIFFSKLFQQGQEIIDEIAKPEVKKVMVVGAGYIGVELIEAFKNHGKEVILMEAMPRVMANYFDKEITDEAEKRIKEAGIEMHLGETVKKFEGDDRVKKVITDKGSYDVDMVVMSVGFRPNSELYKDYLETLPNGAIKVDTTMKTTKDPNVFAIGDCATVYSRASGKEEYIALATNAVRMGIVAANNALGKHVEYCGTQGSNAICVFGYNMASTGWSEETAKKKGLKVKSNFFKDAERPEFMPSYEDVLVKVIYEEDTRRMVGAQIASNHNHAEAIHAFSLAIQNGMTVDQF

SEQ ID NO: 59554 - protein, 432 aa, Mycobacterium smegmatis str. MC2 155
MADLTPAQISAVDAAHIWHPYSKIGADAFPPVVAVGAKGAWLTVIDPSDGARIDVLDAMASWWTAVHGHGHPVLDAAISRQLSTMNHVMFGGLTHEPAARLAQLLVELTPDGLDTVFFSDSGSVSVEVAVKMALQYWRSLGRGAKHRLMTWRGGYHGDTFTPMSVCDPDGGMHSLWTDVLAAQEFAEAVPREYDPAYSAAFEKQLAANAGSLAAVIVEPVVQGAGGMRFHDPRYLADLRAICDRHDVLLIFDEIATGFGRTGKLFAAEHAGVSPDIMCVGKALTGGYITLAATLCTARVAQTISSGEPGALMHGPTFMANALACAVGVAAVELLIDSDWPARVAAIEEGLRSGLEPARALPGVADVRVLGAIGVIEMREPVDMPLATTTALAHGVWLRPFGKLIYAMPPFICTPEEVAQITAGMVGVARALT

SEQ ID NO: 59555 - protein, 416 aa, Brachyspira innocens
HAGTWAAKTLKATDPNCQVVTYDRNDNISFLACGIALWVGGVVKDPKGLFYASPESLKAEGIDVYMGHDVTKIDWANKKLHVKELKTGKEFDDNYDKLILATGSWPVTPPIEGLMQEGTEYGLKKGIFFSKLFQQGQEIIDEIAKPEVKKVMVVGAGYIGVELIEAFKNHGKEVILMEAMPRVMANYFDKEITDETEKRIKEAGIEMHLGETVKKFEGDDRVKKVITDKGSYDVDMVVMSVGFRPNSELYKDYLETLPNGAIKVDTTMKTTKDPNVFAIGDCATVYSRASGKEEYIALATNAVRMGIVAANNALGKHVEYCGTQGSNAICVFGYNMASTGWSEETAKKKGLKVKSNFFKDAERPEFMPSYEDVLVKIIYEEDTRRMVGAQIASNHNHAEAIHAFSLAIQNGMTVDQ

SEQ ID NO: 59556 - protein, 207 aa, Methylobacillus flagellatus KT
MPLFQNATFHISAHNLSDLPAPAGIEVVFAGRSNAGKSSALNTLANHNRLAFVSKQPGRTQLINFFSLGNDRFLVDLPGYGYAKVPEAVRKHWQLTLASYLSQRPCIGGLVLVMDCRHPLTPLDRQMLNWYSPSGKPIHALLTKADKLSRQAANQTLQQVRKELEASWGNCSVQLFSSLKKQGVEEAETVIGRWLFAPEDDVPDAVA

SEQ ID NO: 59557 - protein, 556 aa, Candida glabrata CBS 138
MSSSNKDSESFENYPSQNSDNSYKRDDLDPDTLEKEAKIENPNGKSAYIAVSISCALVAFGGFIFGWDTGTISGFVNQTDFIRRIGSKHADGTSYLSKVRTGLVVGIFNIGCAIGGVVLSKIGDTKGRKAGLVTVVLIYIVGIVIQIATIDKWYQYFIGRIISGLGVGGISVLSPTLISEVAPKELRGSLVSLYQIMITLGIFLGYCTNYGTKNYSNSVQWRVPLGLCFAWALLMIGGMTFVPESPRYLIEAGDDDAARKSLCAANKLPAEHPFIEQEFTILKAKVEEANAAGTASWSELITGKPAMLRRTIMGIMIQSLQQLTGDNYFFYYGTTVFKAVGLEDSFQTSIVFGVVNFFSTFLSLFTVDRFGRRNCLLYGAAGMVCCYVVYASVGVTRLWPNGQGNGSSKGAGNCMIVFSCFYIFCFATTWAPIAYVIISESFPLRIKTKAMSIASASNWIWGFLIAFFTPFITNAINFYYGYVFMGCMVFAYFYVFFFVNETRGLTLEEVDEMYAEGVLPWKSSKWVPESERDDSYDADALLHDDTPWYKRVIGRN

SEQ ID NO: 59558 - protein, 490 aa, Colwellia psychrerythraea 34H
MQEHQELGLQDNQLVRSFSYINGRWHSSDSYISVTNPANGKVIAQVSNAGVVETELAVKAAKDALKMWSAKSANERATLMRNWFNLIMENQDDLGRILTLEQGKPLAEAKGEIGYGAAFIEWFAEEGKRVYGDTIPAPSGDKRIIVIKQPVGVVASVTPWNFPNAMIARKAAAALSAGCTFVVRPATQTPLSALAMAELAERAGIPAGVFNVVVGEDAHGIGKVLTQHPDIAKFTFTGSTPVGKALISQCATSVKKVSMELGGNAPFIVFDDADIDAAVQGALVSKYRNAGQTCVCTNRIFVQKGVIEQFTKKFTSAVAALAIGDGLTDGVSIGPMISSDAVCDVELLVKDSITAGAILALGGERDQAGDAFYQPTILTNVTNDMPIAKNEIFGPVTPIISFEDEDEVIAMANDTEYGLASYFYARDIGRIWRVAEGLEYGMVGINEGMISNAAAPFGGVKQSGNGREGSKYGLDDYLEIKYLCMGGLGK

SEQ ID NO: 59559 - protein, 136 aa, Conocephalum supradecompositum
MARTKQTARKSTGGKAPRKQLASKAARKSAPSTGGVKKPHRYKPGTVALREIRRYQKSTELLIRKLPFQRLVREIAQDFKSDLRFQSSAIGALQESVESYLVSLFEETNLCAIHAKRVTIQSKEIQLARRLRRERN

SEQ ID NO: 59560 - protein, 203 aa, Zea mays
  misc_feature (84)..(84): Xaa can be any naturally occurring amino acid
  misc_feature (193)..(193): Xaa can be any naturally occurring amino acid
KPAAKTYYMSGGLQPVPIVFRGPNGASAGVAAQHSQCFAAWYGHCPGLKVVSPWNSEDAKGLIKSAIRDNNPVVVLENELMYGXPFEFPPEAQSKDFLIPIGKAKIERQGTHITVVSHSRPVGHCLEAAAVLSKEGVECEVINMRTIRPMDMETIEASVMKTNHLVTVEGGWPQFGVGAEICARIMEGPAFNXLDAPAVRVTG

SEQ ID NO: 59561 - protein, 136 aa, Conocephalum supradecompositum
MARTKQTARKSTGGKAPRKQLASKAARKSAPSTGGVKKPHRYKPGTVALREIRRYQKSTELLIRKLPFQRLVREIAQDFKSDLRFQSSAIGALQESVESYLVSPFEDTNLCAIHAKRVTIQSKDIQLARRLRGERN

SEQ ID NO: 59562 - protein, 52 aa, Glycine max
MNKDCEKVGRWKSNLLSTQQRENPLMGYTSTGDPYSYVGDTALTLDSKQAAK

SEQ ID NO: 59563 - protein, 250 aa, Zea mays
AKMLEALQDIEIASKIVGFDSDSDESLDDKYMKLHCDITPLAHDSEDYKLIEQYLLNTHAPTHKDWSLELEEVFSLDRDGELNKYSRYKNNLHNKMLLWHGSRLTNFVGILSQGLRIAPPEAPVTGYMFGKGLYFADLVSKSAQYCYVDRNNPVGLMLLSEVALGDMYELKKATSMDKPPRGKHSTKGLGKTVPLESEFVKWRDDVVVPCGKPVPSSIRSSELMYNEYIVYNTSQVKMQFLLKVRFHHKR

SEQ ID NO: 59564 - protein, 908 aa, Pseudomonas aeruginosa PAO1
MSTDSPLRTTASTCCYCGVGCGVLIEHDGERILGVQGDPRHPANFGRLCSKGASLHLTGDLQARALYPQLRLGKQLARARSDWESALEHAAGRFAETIREHGPDSVAFYISGQLLTEDYYAFNKLARALVGTNNIDSNSRLCMSSAVVGYKRSLGADAPPCSYEDLDCADCVLIAGSNMAFAHPVLFRRLEAAKAARPEMRIVVIDPRRTDTCELADLHLALLPGTDVALFHGILHILLWEDWIDRSFIAEHTEGFADLKELVRDYTPAAVADICGIDRADLQRCAEWIGRSPRFLSLWCMGLNQSSAGSAKNSALINLHLATGKIGRAGCGPFSLTGQPNAMGGRETGSLANLLPGHREAADPGHRAEVAHYWGVEQLPTSPGLSAIELFDAVHDGRIKALWIACTNPAQSLPDQRKIHEALARCPFVVVQEAFAGTETCQYADLLLPAASWGEKEGSVTNSERRISHVRRAVPPPGEARQDWNIVCDFARRLEGHLRPAKPGLFAFADSRSLFDEYKLLTAGRDLDLSGLSYALLDRLGPQQWPFPTGAEQGTARLYADGRFPTASGRAQLVAEPYRAAQEKRDARYPLTLNTGRLRDQWHGMSRTGTCARLFGHEEEALVHLHPEELRRRQLLDGQLVRLKSRRGALVLPVSADDSVRPGQAFLPMHWGDRFLKGLGCNVLTLPAFDPLSKQPELKHAGVQVESVELPWRLFALVETDIQARFEALRALCEVFDHASFSLAGRERPALLVSAAHHEAPGADLLERIDRQLELLDGPILAYDDPRRAIGKRVRLEDGRIVAVRLAGETLARDWLKELWLTGRADSELRRWLLAPLGAAPGRPSQGAGGKTLCSCQNVSQQTVLGGIARGLDLDGLKREFGCGTGCGSCVPEIKRLLAAPRPMAANA

SEQ ID NO: 59565 - protein, 520 aa, Glycine max
MASDQAATTVPLDCWEDNEKKRVVLAEASGDFIDVLFSFLTLPLGTIVRLGINFQLSVEMGSIKKLYESVQNLGSDVFWNDICKQMLLNPRNPLEASCQRLKVKVDDTNPTKYFICHSCSTEKNLLLSTFDGGRCYCGKLMRKNMDLLVESKEETAAENGVFVKGDAKFLIFDDLTVLRSTPSKSVQKFLEHRRKDFEIPTISKDVDMKEIFSILKQALISKSPLSEVFFKKEGSKSCSCPYSCPCSRNTNPIHWKDSIKIKVMVNKSNNKIVLAEADGDFVDFLFSFLTTPLGSILNLTNGKFPLGSIGNLYRSVKRLDPSWFKGSSKESLLNLRVAPHFGCKSSPFQEDHTPNYWYGTVAGKDNNEGRTMISKKKDMLQTAKELKLFDPRCSDGAKEPGVGFVKRPCLFVVKDDLEVIQMTTTSSIEYLRDEKVKVGDLEEHLVEIRSNEVMNLLRASLTSNEATLTRSLGCLLMKWKCQRCIPLWGRLQRMKKIHRKKKENGENSCNILCCCSVCDK

SEQ ID NO: 59566 - protein, 136 aa, Conocephalum conicum
MARTKQTARKSTGGKAPRKQLATKAARKSAPSAGGVKKPHRYRPGTVALREIRRYQKSTELLIRKLPFQRLVREIAQDFKTDLRFQSSAVMALQESAEAYLVSLFEDTNLAAIHAKRVTIQPKDIALARRLRGERN

SEQ ID NO: 59567 - protein, 816 aa, Pseudomonas aeruginosa PAO1
MKKIKLVMVGNGMAGVRTLEELLKLNSDFYDITVFGAEPHPNYNRILLSPVLAGEQTFEEIVLNDLNWYAENGIKLLLDRKVVQIDRLRRRVVAADGSEAEYDRLLLATGSLPFILPIPGNRLQGVIGYRDIADTQAMIDCARTHSHAVVIGGGLLGLEAANGLKQRGMDVTVVHLSDWLLERQLDRTAGKLLQGALEARGIRFRLNTQTQELMDNGSGRVCAVQFNDGDVIPADLVVMAAGIRPNTELAESAGIPCNRGILVNDTLQTYDPRIYAVGECANHRGIAYGLVAPLFEQAKVCANHLAHLGYARYQGSVTSTKLKVTGIDLFSAGDFIGGEGSETITLSDPIGGVYKKLVIKDDVLVGACLYGDTADGGWYFRQIRENHNVAQIRDHLMFGENALGDVGHQGQNSAASMPDTAEVCGCNGVCKGTIVKAIQEHGLFSVDEVKKHTKAASSCGSCAGLVEQILISTVGGAADVKPKSEKAICGCSDLNHGQIRKAIREHRLTSLDAAMRFMDWKTPNGCATCRPALNYYLISTWPGEAKDDPQSRLINERAHANIQKDGTYSVVPRMWGGVTNAAELRRIADVADKYQVPMVKVTGGQRIDLLGVKKDDLPAIWKDLDMPSGHAYGKSIRTVKTCVGSEFCRFGTQNSTQLGIDLEHDLFNMWSPHKVKLAVSGCPRNCAEAGIKDVGIIGVDSGWEMYIGGNGGIKTEVAEFFVKLKTAEEVREYNGAFLQLYREEAFYLERTVHYLQRVGMEHIRKAVVEDAENRKALNDRLQFALSFEQDPWKQRIEQPQLKKEFERISLKQLENV

SEQ ID NO: 59568 - protein, 136 aa, Conocephalum conicum
MARTKQTARKSTGGKVPRKQLASKAVRKSAPSTGGVKKPHRYKPGTVALREIRRYQKSTELLIRKLPFQRLVREIAQDFKSDLRFQSSAIGALQESVESYLVSLFEDTNLCAIHAKRVTIQSKDIQLARRLRGERN

SEQ ID NO: 59569 - protein, 269 aa, Gibberella zeae PH-1
MADESTLRQRKPQPKDDSASEVSQPSTPTKKGKKTSSSKADQDDTWDGYSPYVDILRVISFLFVASMGLSYVISGGESYWWGHKNKPEWMTQKFYRELILGPPPPTYMTLDELSLYDGRDPDRPILLAINGTIYDVSPGRRMYGPGGSYSYFAATDAARGFVTGCFAEDQTADLRGVEETFLPIDNPEIDSHWTPEELAELKVKELEEAKQKAHATLKHWVDFFANNKKYSKVGYVQRDPDWLEKEKPKKLCGQAQKSRKARKIPQNKQ

SEQ ID NO: 59570 - protein, 1644 aa, Arabidopsis thaliana
MGSYSAGFPGSLDWFDFPGLGNGSYLNDQPLLDIGSVPPPLDPYPQQNLASADADFSDSVLKYISQVLMEEDMEDKPCMFHDALSLQAAEKSLYEALGEKYPVDDSDQPLTTTTSLAQLVSSPGGSSYASSTTTTSSDSQWSFDCLENNRPSSWLQTPIPSNFIFQSTSTRASSGNAVFGSSFSGDLVSNMFNDTDLALQFKKGMEEASKFLPKSSQLVIDNSVPNRLTGKKSHWREEEHLTEERSKKQSAIYVDETDELTDMFDNILIFGEAKEQPVCILNESFPKEPAKASTFSKSPKGEKPEASGNSYTKETPDLRTMLVSCAQAVSINDRRTADELLSRIRQHSSSYGDGTERLAHYFANSLEARLAGIGTQVYTALSSKKTSTSDMLKAYQTYISVCPFKKIAIIFANHSIMRLASSANAKTIHIIDFGISDGFQWPSLIHRLAWRRGSSCKLRITGIELPQRGFRPAEGVIETGRRLAKYCQKFNIPFEYNAIAQKWESIKLEDLKLKEGEFVAVNSLFRFRNLLDETVAVHSPRDTVLKLIRKIKPDVFIPGILSGSYNAPFFVTRFREVLFHYSSLFDMCDTNLTREDPMRVMFEKEFYGREIMNVVACEGTERVERPESYKQWQARAMRAGFRQIPLEKELVQKLKLMVESGYKPKEFDVDQDCHWLLQGWKDSFKLSFFYVGRATRVLIMDPNFSESLNGFEYFDGNPNLLTDPMEDQYPPPSDTLLKYVSEILMEESNGDYKQSMFYDSLALRKTEEMLQQVITDSQNQSFSPADSLITNSWDASGSIDESAYSADPQPVNEIMVKSMFSDAESALQFKKGVEEASKFLPNSDQWVINLDIERSERRDSVKEEMGLDQLRVKKNHERDFEEVRSSKQFASNVEDSKVTDMFDKVLLLDGECDPQTLLDSEIQAIRSSKNIGEKGKKKKKKKSQVVDFRTLLTHCAQAISTGDKTTALEFLLQIRQQSSPLGDAGQRLAHCFANALEARLQGSTGPMIQTYYNALTSSLKDTAADTIRAYRVYLSSSPFVTLMYFFSIWMILDVAKDAPVLHIVDFGILYGFQWPMFIQSISDRKDVPRKLRITGIELPQCGFRPAERIEETGRRLAEYCKRFNVPFEYKAIASQNWETIRIEDLDIRPNEVLAVNAGLRLKNLQDETGSEENCPRDAVLKLIRNMNPDVFIHAIVNGSFNAPFFISRFKEAVYHYSALFDMFDSTLPRDNKERIRFEREFYGREAMNVIACEEADRVERPETYRQWQVRMVRAGFKQKTIKPELVELFRGKLKKWRYHKDFVVDENSKWLLQGWKGRTLYASSCWVPAYGDMDGDGSSFEQCYRCYPVTFIDKAHLEKGDKIIMPPSALDRLASLHIEYPMLFQLSNVSVEKTSHCGVLEFTADEGLVYLPYWMMQNMSLEEGDVMQVKNISLVKGTYIKLQPHTQDFLDISNPKAILETTLRSYSCLTTGDTIMVPYNNKQYYINVVEAKPSSAVSIIETDCEVDFAPPLDYKEPEKPQKLTPSNKRPLQVKEEEEPASKVPKFTPFTGSGKRLDGKAQTQTEPEDTKQQEKPTENGKDDEKLSVTTPRQISGKLVFGSNSKSAAKETAKVDDPKNIVQESSTKSDEAKFKVFTGKKYSLNG

SEQ ID NO: 59571 - protein, 521 aa, Prochlorococcus marinus str. AS9601
MNEIVWPTIDSEHLIVDSKQMLVLEKEMFSDGMPKEALMEKAGIQISRWLLKKKPLLKHGITFFIGPGHNGGDGAVIARELFLRGFNVQVWCPFPIKKTLTNNHLNYLTSIGVTKLVEPPDANGKELWIDAVFGNNQTRKVDDKLIKLFNQKFHKKHGKVISIDIPTGLCPDKGEPFLDNAVKADYTLTIGLYKIGLTQDSALPFIGELHHIDVGIPTSKLSKVDKKIFKVTYKDIKHIDLPSLPKNYNKYQRGRTLLIAGSEKYPGAAYLALKGAMSSGAGFISAVLPGIVSESIWQVAPEIVLKETMQSNQNGNASLFSALRNIDLSAFDSLAVGPGIGIDNDDWQKSKDYLIDFGGLLILDADALNRISESKLGANFFLERKFKTWITPHSKEFGRLFPNINSHTNVGLAREAAKEFNISILLKGANSVVADNRKVWQLFGTDSQTARAGLGDLLSGFVAGSSAIDSTLCRNISTDFFAKYVLLHSFAASKCKKGSNASVIGDELSKLMRNIKTRQIS

SEQ ID NO: 59572 - protein, 210 aa, Triticum aestivum
  misc_feature (77)..(77): Xaa can be any naturally occurring amino acid
TKGFRDWSPRTLTWTEGVEIQCKPASSSPPVNRIPWPPAVMASSATTVAPFQGLKSTAGLPVSRRSSASLGSVSNGXGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 59573 - protein, 515 aa, Coprinopsis cinerea okayama7#130
MAEIHDQFDTILILDFGSQYSHLITRRCREHKVYAELLPCTTKIKDINFKPKGVILSGSPYSVYDKDSPHVDPAVFDLGVPILGICYGLQELAWNLGGEVTKCDHREYGFAEVKINKIGSGNGVDALFEGLGDEMQVWMSHGDQLSKPPANFHVIGHTQSAPYAALAHDSKPIYGIQFHPEVTHSPRGKEVIGRFILNICGCKPTWTMEEFIGKEINRIREICGPKGRVIGAVSGGVDSTVAAKLMHEAIGDRFHAIMVDNGVLRKDEAKQVYEMLNRDLGVNLTVVDASERFLSRLEGIEDPEQKRKIIGNTFIHVFEDEAAKIEAAAEAEEAKGADAKGRVEWLLQGTLYPDVIESISFKGPSATIKTHHNVGGLLKDMKLKLIEPLRELFKGPGLAIRILGPVTREQVKILQHADSIYIEEIRKAGLYDQISQAFAVLLPVKAVGVMGDARTYEQVIALRAVQSEDFMTADWYVFPPDVLRRISSRITNEVAGINRVTYDISSKPPATVEWL

SEQ ID NO: 59574 - protein, 268 aa, Triticum aestivum
  misc_feature (234)..(234): Xaa can be any naturally occurring amino acid
  misc_feature (243)..(243): Xaa can be any naturally occurring amino acid
VTSRTSLYKKAVSYRSGIPGISSTHASDFSEDNRSGINHSLHRISAIRNRKANIIGLTCRVGRAISGSAEMIRDLVVGGGSILVIGPPGVGKTTLIREIARILADEGNKRVIIVDTSNEIGGDGDVPHSGIGRSRRMQVPKVTMQHNVMIEAVENHMPEVIVIDEIGTELEAMAASTIAQRGVQLVGTAHGVTIDSIIKNPCLQMLVGGIESVTLGDEEAKKRKVQKTILERKXGPPTFSCAXEMVSKTECQVHHKLESTVDAILAGK

SEQ ID NO: 59575 - protein, 223 aa, Prochlorococcus marinus str. AS9601
MQAVILTGIVSGFVHVVSGADHLIAMAPAAINNPQKALKNSFSWGLGHSSGVLLLAFLAIFIKDITPLNKFSSIAEFLVGISLLIVGVFAIKNSFQLSIHSHSHKHENGIAHRHFHFHVKEQKNNNKHSHALTGLGLLHGIAGGSHFLAVLPALALPLISACFYLISYLIGSIISMNLFTFLISFTTFKASQKFIKRLITVAGGLSFSLGLFWIQRSASVFLN

SEQ ID NO: 59576 - protein, 248 aa, Corynebacterium diphtheriae
MTTGKLILLRHGQSEWNASNQFTGWVDVNLTEKGEAEAKRGGELLKAQGVLPSVVYTSLLRRAIRTANIALNAADRHWIPVVRDWRLNERHYGALQGLNKAETKEKYGDEQFMAWRRSYGTPPPELEDSSEFSQANDPRYANLDVVPRTECLKDVVERFVPYFKEEILPRVKNGETVLIAAHGNSLRALVKHLDNISDADIAELNIPTGIPLVYELDEAGTVLNPGGTYLDPEAAAAGAAAVAAQGAK

SEQ ID NO: 59577 - protein, 104 aa, Oryza sativa
MDTECVTVTSYVLEQKKKYPGASGELTILLNALLTAIKACAAAVRKAGIAKLYGLAGSSNTTGDDQKKLDVLANELFINMLKSSYTVYAMASEENENLIEVEVP

SEQ ID NO: 59578 - protein, 464 aa, Oryza sativa (indica cultivar-group)
MGGDGDQRLSLTAPGRRLLARYEIGRTLGEGNFGKVKYARHLATGAHFAIKILDRNKILSLRFDDQIRREIGTLKLLKHPNVVRLHEVAASKTKIYMVLEYVNGGELFDKIAVKGKLSEHEGRRLFQQLIDAVSYCHDKGVYHRDLKPENVLVDRRGNIKISDFGLSALPQHLGNDGLLHTTCGSPNYIAPEVLQNRGYDGSLSDIWSCGVILYVMLVGYLPFDDRNLVVLYQKIFKGDTQIPKWLSPSARDLLRRILEPNPMKRINIAGIKEHEWFQKDYTPVVPYDDDDDNYLDSVLPIKEQIDEAKQEKPTHINAFQLIGMASALDLSGFFEEEDASQRKIRFTSTHSPKDLFDKIENVVTEMGFQVQRGNSKLKVMKNGKGSKNLRNPSSFLVCTEVVELGPSLYVVELKKSHGDPILYRQLCERLSDELGVCKTEQIQRTESLEDDLESFDSGSSLPGF

SEQ ID NO: 59579 - protein, 477 aa, Lotus japonicus
MASVSLYRRVLPSPPAIDFASQEGKKIFVEALGQGTMEGFFKLISFYQTQSEPAYCGLATLSVVLNALAIDPGPWRWFDDSMLDCCEPLEKVKVQGITFGKVACLARCNGAKVEAFRSNESTVSDFRNRVISCCSSEDRHAIVSYHRSGLKQTGEGHFSPLGGYHAERDMVLILDVTRYKYPPHWVPVTLLWNAMNTIDRATGLQRGYMIISKLNRAPSILYTLSCRHEGWSSVAKFLTENVPLLLKSEDLKDIQEVLSVVFKSPPSELREFITWIAEVRRQEDGNLTLSEEEKGRLVIKAEILEKIRTAGLFKHVTSWLDSQRSRCSTIANLQDKDMLPELAARVCCQGACLLTGCCLSGGKCCCQIDVKHLNVDSKNLATTFVSGTFTTGSSSEQGVDVLVPLCQRGPEGHYIAMHPSTADVLTVLLLALPLHTWSGIKEEKLRAEVTSLVTTEDLPSLLQEEVILYMEPVLQFF

SEQ ID NO: 59580 - protein, 499 aa, Mycoplasma hominis
MKKIILTIIDGLGLRKERQGNAYLQAKHPCFDYLFSMCPNSVLQASGQYVGLPEGQIGNSEVGHLNIGAGRVVYTGLSLINKAIENNTFKDNEILNDVIDKTIKNNTTLHVMGLLSNGGVHSLDLHLFEILKLAHSKGLKNVSVHVFGDGRDVKPQSIKNSLETLKDLCQKFGYKISSISGRFYAMDRDSIFSRNQEAYDAILGQSKNVIENIDDYIESQYKKGIFDEFFEPAQLKDGVFVKNGDSIIFFNFRPDRARQLSHMFIGSNLYTYKPKNQVQIDNFVSLMKYEGINSKIAFKEMEVVNPLGKVLESNDIKQLRLAETQKYAHVTFFFDGGVDIEYKNENRILVDSLKVDSFADYPHMSAKEITDSLLNNIEKNDFIIMNYANPDMVGHTGNLNATIEAIEFLDSQFQRILEYVSLNHENVTWFITADHGNAEITEDENNKPATKHTTSPVMFICTDKNVNLGNGSLCDVAPTILDYLKINKPKEMTGKSLLK

SEQ ID NO: 59581 - protein, 466 aa, Sinorhizobium fredii
MSKRFRSRSAARAARHRLRRGEQDMSNRLNTTPNDLSAFWMPFTANRQFKKEPRLFVGAKDMYYTTHDGRTVLDGTAGLWCVNAGHCRPKITEAIREQAGELDYAPAFQLGHPKAFELANRLVDIAPEGLNHVLYTNSGSESVDTALKVALAYHRAKGNGSRFRLIGRERGYHGVNFGGISVGGIVANRKMFGTLLTGVDHLPHTHLPAKNAFTRGEPKHGGDLASELERIVTLHDASTIAAVIVEPVAGSTGVLIPPKGYLQKLREICTKHGILLIFDEVITGYGRLGTPFAAQYFDVKPDIITTAKGLTNGVIPMGAVFVTSEIHDAFMTGPEHLIEFFHGYTYSGNPIASAAALGTLDTYKEEGLLTRAAELASYWEEALHSLKDCPHVIDIRNIGLIGAVELEPIAGEPTKRAFSAFLKAYEKGLLIRTTGDIIALSPPLIIEKHQIDELIDKLRDVLKNNI

SEQ ID NO: 59582 - protein, 136 aa, Oryza sativa (japonica cultivar-group)
MRLTSHCSFCFRELNEKGSPLPKFGEWDVNDPASAEGFTVIFNKARDEKKTGGNSQGQDLAAKSEQPSGQGLYPAKPNSSAILVISFTLQVHKCLVDSAREQVILKHNFTPATLALECFFNLKKWFCCMQPTAAES

SEQ ID NO: 59583 - protein, 378 aa, Streptococcus pyogenes
MNNTEYYDRLGVSKDASQDDIKKAYRKMSKKYHPDINKEAGAEQKYKDVQEAYETLSDSQKRAAYDQYGAAGAQGGFGGGAGGFGGFDGGGFGGFEDIFSSFFGGGGSRNPNAPRQGDDLQYRVNLSFEEAVFGVEKEVSYNREATCGTCLGSGAKPGTAPVTCRKCHGSGVMTIDTQTPLGMMRRQVTCDICHGSGKEIKEPCQTCHGTGHEKQAHKVSVKIPAGVETGQQIRLQGQGEAGFNGGPYGDLFVILNVLPSKQFERNGSTIYYSLDISFTQAALGDTVEIPTVHGDVELAIPAGTQTGKTFRLKGKGAPKLRGGGQGDQHVTVNIVTPTKLNDAQREALQAFAEASGEKMLHPKKKGFFDKVKDALEDI

SEQ ID NO: 59584 - protein, 136 aa, Conocephalum conicum
MARTKQTASKSTGGKVPRKQLATKAARKSAPSAGGVKKPHRYRPGTVALREIRRYQKSTELLIRKLPFQRLVREIAQDFKTDLRFQSSAVMALQESAEAYLVSLFEDTNLAAIHAKRVTIQPKDIALARRLRGERN

SEQ ID NO: 59585 - protein, 134 aa, Conocephalum conicum
MARTKQTARKSTGGKAPRKQLASKAARKSAPSTGGVKKPHRYPGTVALREIRRYESTDLHIRKLPFQRLVREIAHDFKSDLRFQSSAIGAFQESVESYLVSLFEDTNLCAIHAKRVTIQSKDIQLARRLRGERN

SEQ ID NO: 59586 - protein, 136 aa, Conocephalum conicum
MARTKQTARKSTGGKAPRKQLASKAARKSAPSTGGVKKPHRYRPGTVALREIRRYQKSTGLLIRKLPFQRLVREIAQDFKSDLRFQSSAIGALQESVESYLVSLFEDTDLCAIHAKRVTIQSKDIQLARRLRGERN

SEQ ID NO: 59587 - protein, 391 aa, Prochlorococcus marinus str. AS9601
MNTYSRFDISFKKGKGCWLWDKSGKKYLDAVAGIATCSLGHSDRVLRRRLSSQLKKIQHISNLYNIEEQEQLSRTLTNMSCAKSVFFCNSGAEANESAIKLIKKYGNTTNKGKESIILAAESSFHGRTLAALSATGQPKYQKGFEPMIQGFKFFKFNNFDSVKKLFEECENNDQKISGVLVEPIQGEGGVIPGSKIFFKGLRDICNRHNSLLILDEVQSGVGRTGKMWGYENLGIEPDGFTLAKGLGGGHAIGALLVKEKANIFTPGDHASTFGGNPFACKAALTVLEEINRRNLINNVYLRGEQLSAGFEELSKKFPNIISEKRGLGLIQGLVINDDYAEAKKITLKAFDKGLLVVPAGGNVVRIVPPLVISRREINILLNKLNSIFEEL

SEQ ID NO: 59588 - protein, 417 aa, Oryza sativa (indica cultivar-group)
MEGGGAKDGSAAAAQTRGSGDDGSHKPLPPCCLKAKAAAAESEAKCHATVVSGWFTEPRSHSGKTSKVQYFNNPMWPGEAHSLKVENILYQGKSPYQEILVFESSTYGNVLVLDGIVQLTEKDECAYQEMVTHLPLCSIPSPKSVLVVGGGDGGVLREIARHASVENIDICEIDQLVIDVCKDFFPQLSVGFKDPRVQLHVGDAVDFLRNAPEGKYDAIIVDSSDPIGEILLLLNHHMFQFCAPFVFVPHEDPSHIIGPAQELVEKPFFQTIARALKPGGVLCNQAESMWLHTHLIQDMLSICRETFKGAVHYAWTSVPTYPSGVIGFLLCAKEGPAVNFLSPVNPIEKLEGAMEAGREIRFYNSEVHRAAFVLPTFVRRELESHNTCAEKDKSETKPVAKPKKMKIMPNSAIPTAS

SEQ ID NO: 59589 - protein, 324 aa, Candidatus Blochmannia floridanus
MNINQINKLIKQDIININFEIHKRLKSNIILINKFIKYIINSGGKKIRSTMILLIAKSLTYNKTQHTILATLIEFIHTATLLHDDVIDHSTTRRGKTTANIIFGNPASILIGDFIYTRAFQMMTELQSLRILSLMADAVNIIAEGEILQLTYCNDPTITMNNYMQIIYKKTARLFEVASQSSAILAHANIQQEQALSNYGKYIGIAFQLIDDLLDYNASDIVSFGKNIGNDLNEGKLTLPLLHAIYHSTPKEASIIHQAITDKNNQNLLYTVLNIMQQYGSLDYTRKCAETKINKAINCLNILSPSPYKHALKHLAYFILTRCY

SEQ ID NO: 59590 - protein, 130 aa, Zea mays
MVKTSVLNDALNAINNAEKAGKRQVMIRPSSKVIVKFLTVMQRHGYIGEFEEVDDHRNGKIVIQLNGRINKTGVISPRYNVQLRDVEKWVVKLLPSRQFGFIVLTTSAGIMDHEEARRKHVAGKILGFFY

SEQ ID NO: 59591 - protein, 136 aa, Conocephalum conicum
MVRTKQTVRKSTGGKAPRKQLASKAARKSAPSTGGVKKPHRYKPGTVALREIRRYQKSTELLIRKLPFQRLVREIAQDFKSDLRFQSSAIGALQESVESYLVSLFEDTDLCAIHAKRVTIQSKDIQLARRLRGERN

SEQ ID NO: 59592 - protein, 136 aa, Conocephalum conicum
MARTKQTARKSTGGKVPRKQLATKAARKSAPSAGGVKKPHRYRPGTVALREIRRYQKSTELLIRKLPFQRLVREIAQDFKTDLRFQSSAVMALQESAEGYLVSFFEDHNLAAIHAKRVTIQPKDIALARRLRGERN

SEQ ID NO: 59593 - protein, 136 aa, Conocephalum conicum
MARTKQTARKSTGGKAPRKQFATKAVRKSAPSAGGVKKPHRYRPGTVALREIRRYQKSTELLIRKLPFQRLVREIAQDFKTDLRFQSSAVMALQESAEAYLVSLFEDTNLAAIHAKRVTIQPKDIALARRLRGERN

SEQ ID NO: 59594 - protein, 738 aa, Prunus persica
MEACNCIEPQWPADELLMKYQYISDFFIALAYFSIPLELIYFVKKSAVFPYRWVLVQFGAFIVLCGATHLINLWTFSMHSRTVAIVMTTAKVLTAVVSCATALMLVHIIPDLLSVKTRELFLKNKAAELDREMGLIRTQEETGRHVRMLTHEIRSTLDRHTILKTTLVELGRTLALEECALWMPTRTGLELQLSYTLRQQNPVGYTVPIHLPVINQVFSSNRALKISPNSPVARMRPLAGKHMPGEVVAVRVPLLHLSNFQINDWPELSTKRYALMVLMLPSDSARQWHVHELELVEVVADQVAVALSHAAILEESMRARDLLMEQNIALDLARREAETAIRARNDFLAVMNHEMRTPMHAIIALSSLLQETELTPEQRLMVETILKSSHLLATLINDVLDLSRLEDGSLQLEIATFNLHSVFREVHNLIKPVASVKKLSVSLNLAADLPVQAVGDEKRLMQIVLNVVGNAVKFSKEGSISITAFVAKSESLRDFRAPEFFPAQSDNHFYLRVQVKDSGSGINPQDIPKLFTKFAQTQSLATRNSGGSGLGLAICKRFVNLMEGHIWIESEGPGKGCTAIFIVKLGFAERSNESKLPFLTKVQANHVQTNFPGLKVLVMDDNGSVTKGLLVHLGCDVTTVSSIDEFLHVISQEHKVVFMDVCMPGIDGYELAVRIHEKFTKRHERPVLVALTGNIDKMTKENCMRVGMDGVILKPVSVDKMRSVLSELLEHRVLFEAM

SEQ ID NO: 59595 - protein, 133 aa, Marchantia polymorpha
MARTKQTARKSTGGKAPRKQLASKAARKSAPSTGGVKKPHRYKPGTVALREIGRYQKSTELLIRKLPFQRLIAQDFKSDLRFQSSAIGALQESVESYLVSFLEDTNLCAIHAKRVTIQSKDIQLARRLRGERN

SEQ ID NO: 59596 - protein, 149 aa, Brassica rapa
GTLLKPNMVTPGSDSAKVAPEVIAEHTVRALQRTVPAAVPAIVFLSGGQSEEEATKNLNAMNQLKTKKPWSLSFSFGRALQQSTLKTWAGKEENVKAAQEALYVRCKANSEATLGPYKGDAKLGDGAAESLSRQGLQVLENSLYMVSGL

SEQ ID NO: 59597 - protein, 197 aa, Oceanospirillum sp. MED92
MAERVAKVSRNTLETQIKVSVNIDGTGQFKADTGVPFLEHMMEQISRHGLIDLDIHCVGDTHIDDHHTVEDIGITLGQAFKEAVGDRKGIMRYGHAYCPLDEALSRVVIDFSGRPGLHMDVEFTRANIGKLDTQLFWEFFQGFVNHAGVTLHIDNIKGFNAHHQAETIFKAFGRALRFALEIDARAADVMPSTKGCL

SEQ ID NO: 59598 - protein, 103 aa, Oryza sativa (japonica cultivar-group)
MAPRSVAISGRGTSGARRHRIVFRGYIQGIAKPVIRRLARKGGVKRISGLIYKETRGVLEIFLKNVICDAITYTEHAHRKTVMAMDVVYALKLQGRTIYDFGG

SEQ ID NO: 59599 - protein, 466 aa, Oryza sativa (indica cultivar-group)
MAGEGSGGGGGAGAFEDEAEPTVTIGEYIEGIEAEELEADLVLGGDEGKECTYGGGYLKRQAVFSCLTCVPAGVAGVCTACSLACHDGHELGLVSLFIWVRRMSATRVILGVALAVAKLSIAIFCIKYLYDWVMRTQLMLGWFFLLKVVELWTKRKFRCDCGNSKFGSHVCKLCPEKDPENPANSYNHNFKGSYCTCGRPYPDPEAEKQVEMIQCCICEDWFHEDHIGLNSIEEIPRDEEGEPLYEDFICPKCSTKCYFLKLYPDTIWASNKQSSAPQAETTNSTVMNGNSSLGDIEKSENGALINHLNCEKTSDNENCPKDSVAPEKASLDDSSDGKCKLGMNICSNTPSADSEKKMPFFMSKSWREVICRCETCTDFYAQQGVAYLIDKEDSIEEYEKVAKQKREKKLEQQEGVEANFLNSLDHVQKIEILSGINDMKNELQSFLSISQINGDTSHVSVSGFEF

SEQ ID NO: 59600 - protein, 738 aa, Passiflora edulis
MESCNCIEPQWPAEELLMKYQYISDFFIALAYFSIPLELIYFVKKSAVFPYRWVLVQFGAFIVLCGATHLINLWTFTMHSRTVATVMTIAKVLTAVVSCATALMLVHIIPDLLSVKTRELFLKNKAAELDREMGLIRTQEETGRHVRMLTHEIRSTLDRHTILRTTLVELGRTLALEECALWMPTRTGLELQLSYTLRQQNPVGYTVPIQLPVINQVFSTNRAVKISPNCPVARLRPLAGKYVPGEVVAVRVPLLHLNNFQINDWPELSTRRYALMVLMLPSDSARQWRVHELELVEVVADQVAVALSHAAILEESMRARDLLMEQNVALDLARREAETAIRARNDFLAVMNHEMRTPMHAVIALSSLLQETELTPEQRLMVETILKSSNLLATLINDVLDLSKLEDGSLQLDSGTFNLHAVFREVLNLIKPIASVKKLLLLLNLAPDLPEYAVGDEKRLIQIILNIVGNAMKFSKEGSISITAIVAKLESLRDARVPDFFPTPSENHFYLRVQVKDSGVGINPQDIPKLFIKFAQTQTTGARNSSGSGLGLAICRRFVNLMDGHIWLESEGLGKGCTAIFIVKLGIPERLNESKPPFMSKVAVDHGQTTFPGLKVLLMDDNGVSRMVTKGLLLHLGCDVTTVGSSEECIRVASQDHRVVFMDVGMPEGFEAAVRLHEKFTKRHERPLVVALTASTDRMTKENCMRVGMDGAILKPVSVDKMRSVLSDLLEHKVLFEC

SEQ ID NO: 59601 - protein, 295 aa, Staphylococcus aureus subsp. aureus COL
MTHLFEGVGVALTTPFTNNKVNIEALKTHVNFLLENNAQAIIVNGTTAESPTLTTDEKERILKTVIDLVDKRVPVIAGTGTNDTEKSIQASIQAKALGADAIMLITPYYNKTNQRGLVKHFEAIADAVKLPVVLYNVPSRTNMTIEPETVEILSQHPYIVALKDATNDFEYLEEVKKRIDTNSFALYSGNDDNVVEYYQRGGQGVISVIANVIPKEFQALYDAQQSGLDIQDQFKPIGTLLSALSVDINPIPIKALTSYLGFGNYELRLPLVSLEDTDTKVLRETYDTFKAGENE

SEQ ID NO: 59602 - protein, 143 aa, Brassica napus
DDGSKKNVELKIEEFKSALSQVDSEVKFLPATAQVAAQQGTYLAKCFDRMEECEKNPEGPIRMRGEGRHRFRPFRYRHLGSFAPLGGEQTAAELPGDWVSIGHSSQWLWYSVYASKQVSWRTRVLVVSDWMRRFIFGRDSSSI

SEQ ID NO: 59603 - protein, 459 aa, Oryza sativa (indica cultivar-group)
MKTSLCVLLCILVVSEVVGVPRCAAALGINYGQVGNNLPSPAQVVSLLASLRIGKVRIYDANPQVLAAFAGTGIELIVTVPNDLVRPMAASPGEALQWVSSSVRPYFPATRVTGIAVGNEVLTDDDEALKAALVPAMRNLHAALAQLGMDGYVHVSTASSLAVLATSYPPSQGAFTAEVAPLMAQFLRFLAETNAPFWINAYPYFAYKGDPTRVSLDYALSNPYHVGAIDPYTRLQYTSMLYAQVDAVAYATSQLGYNNIPVYVSETGWPSKGDTDEVGATVENARAYNRNLLLRQAAGEGTPLRPRQRLEVYLFALFNENMKPGPTSERNYGLYQPDGRTMVYNVGLMQQSTSAASLSLAASPATKTDAKKNFAGLCFLSSLAILQCPNASSTLRKSFWHKQNGLTIVDQKPLQDQRGDAPFQGGKRKIKGSSCCQEEKLEEATLGCGRHYLGDGTEL

SEQ ID NO: 59604 - protein, 340 aa, Legionella pneumophila str. Paris
MKSLVKAKKEPGIWMQDIPVPEYGVNDVLIKIKRTAICGTDIHIYSWDEWAQATIPVPMTVGHEFYGEIVEVGKEVQGLKVGQRVSGEGHITCGFCRNCRAGKRHLCRNTLGVGVNRPGCFAEYLALPATNVIALPDNITEEQAAILDPFGNAAHCALAFDVVGEDVLITGAGPIGIMAAAIVRHIGARHVVITDVNDHRLELARQMGVSRAVNVKYQKLIDVANELGMLEGFDVGLEMSGNPMALNDMMKAMNHGGHVALLGIPPQETPIDWNQVIFKGLVIKGIYGREMFETWYKMIAMLQSGLNISPVITHNFPVDEYQHAFQIMASGQSGKVILNW

SEQ ID NO: 59605 - protein, 765 aa, Sclerotinia sclerotiorum
MNRYDDGELEISLAPSANHRAQHRSSEASSNPRRDSQNGGNRRMESAPQKKTEQRVGAYSVVRTLGEGSFGKVKLAVHRVTQQQVALKIIARRKLISRDMAGRVEREIEYLQLLRHPHIIKLYTVIKTPHEIIMVSEYAGNELFDYIVQHGKMREDEARRFFQQIICAVEYCHRHKIVHRDLKPENLLLDENLNVKIADFGLSNIMTDGNFLKTSCGSPNYAAPEVINGKLYAGPEVDVWSCGVILYVLLVGRLPFDDEHIPSLFAKIARGQYNVPSYMGREAAALIKKMLAVNPVYRATIAEIRDDPWFTTNLPAYLQPPVEEFIDTGVDPAKAINPRAIAPHASPAIQEKLHVQVTEKISKTMGYGIKDVQEALAAEEPSAIKDAYLIVRENKLMQANPNLTDDKNQLLFQIPSPPTYDSTIPPSMPDSPSPLVKERPGNIPPTAPPFQPRPSPLLDAVSPRSSSSIGTDRSFVRPYVSKIGILPSSIPQYHKEFMETHKSGHQESTLSNSHSETIEPSPQTEAEKAETVRRLNPHSRSLAKLDEGKKPAGMTPVPVKKAKPTKWQFGIRSRNQPLEAIGCIYRALQKLGAEWLVGDEWTPGQSENNGNKRNDDNDDNDDPNGSGASLHRETSMNDNSKKNRFSGIDKKGNYKLPEDPWVLHVRWKKTDIRRHSIASLNSSTSSPAHPSSMPKDEGLDSIDGGVIMHLDIQLYEMEPGVYLVDFKCAGYETADGMMCEEKDVTSPFPFLDLASKLIIQLAEAD

SEQ ID NO: 59606 - protein, 314 aa, Triticum aestivum
  misc_feature (24)..(24): Xaa can be any naturally occurring amino acid
  misc_feature (147)..(147): Xaa can be any naturally occurring amino acid
SHLRWGHWYTLRELDEATAGFAPXRVVGEGGYGIVYLGVFADGRQVAVKNLLNNRGQAEREFTVEVEAIGRVRHKNLVRLLGYCVEGAHLILVYEYVDNGNLEQWLHGDVGPVSPLSWDARMDIVLGTAKGITYLHEGLEPKVVHRXIKSSNILLDKRWNSKVSDFGLAKLLGSDSNYVTTRVMGTFGYVAPEYASTGMLNERSDVYSFGVLIMEIISGRCPVDYARPPTEVNLVEWLKKMVSNRDYEAVLDPKLPEKPTSKALKKALLVALRCVDPDSQKRPKMGHAIHMLEVDDFPYREDRRTLRPCQGSPL

SEQ ID NO: 59607 - protein, 515 aa, Triticum aestivum
MASAALPAAAAAAVEPKKKSNFKYACTCALSASMATVVLGYDVGVMSGASLYIKEDLRLTDVQVEIMMGILSVYALLGSFAGARTSDWIGRRYTVIIAAAIFFAGSLVMGFAVNYVMFMFGRFVCGMGVGFAIMVAPVYTAEVAPASTRGLLTSFTEVFINVGILLGYVSNFAFARLPHHINWRIMLGIGAVPSALLALMVLGMPESPRWLVMKGRLADARVVLEKTSDTPEEAVERLDQIKAAAGIPRDLDGDVVAVPKRKGGDEKQVWKELIFSPTPVMRRILLAALGVHFFQQATGSDSVVLYSPRVFKSAGITGDNHLLGVTCAMGVTKTLFILLATFQIDRVGRRPLLLTSTAGMLVCLIGLGTGLTVVGQHPDEKITWAVGLCIASTLAYVSFFSMGLGPITSVYVSEVFPLRVRALGFALGVACNRVTSAAISMTFLSLSKAITIGGSFFLYAGLAALGWLYFYAFVPETRGQPLEDIGKLFGMKDAAVEDDDTATKDKQVKAAVEMN

SEQ ID NO: 59608 - protein, 378 aa, Hyphomonas neptunium ATCC 15444
MGQDIAPFQAISISRRAHELKAAGQRILHMEFGQPSTGAPKAAIAAAHGVLDSEAMGYWESLPLKERICQHYQDSYGVSLSPRRLVITCGASPALVLALATAFSPGDRIAIARPGYVAYRNTLRALNMEPVEIACGAEVRFQLSAAALEALEPAPMGVIIASPANPTGTIIPKEELAAIAEVCARRGIQIISDEIYHGLTYGPKIHSMLEFAPSAYIVNSFSKYFSMAGWRLGWLVSPEAGVARTGAYIGNLFLTAPSLAQHAGLVAMDSREELEGHLDVYRRNRELLLGALPGLGLEKIAPPDGAFYIYADVSRFTDDSLGFCLKLLEETGVATAPGVDFDPVEGGRFMRFSFALSTPEIEEALARLEPWFKAQPRR

SEQ ID NO: 59609 - protein, 183 aa, Raphanus sativus
KGKIQGYGSKLANNASGQLEWEDYFFHLVYPEDKRDLSLWPKTPTDYIEATSEYAKCLRLLATKVFKALSIGLGLEPDRIEKEVGGLEELLLQMKINYYPKCPQPELALGVEAHTDVSALTFILHNMVPGLQLFYEGKWVIAKCVPDSIVMHIGDTLEILSNGKFKSILHRGLVNKEKVRVSW

SEQ ID NO: 59610 - protein, 139 aa, Populus tremula x Populus tremuloides
MATRIRLPSILATAVTLTVLAASLTWAAGSPEATFVKKTISSHQIVIFSKSYCPYCKKAKGVFKELNQTPHVVELDQREDGHDIQDAMSEIVGRRTVPQVFIDGKHIGGSDDTVEAYESGELAKLLGVASEQKDDFKLE

SEQ ID NO: 59611 - protein, 137 aa, Marchantia polymorpha
MARTKQTARKSTGGKAPRKQLASKAARKTAPVTTGGVKKPHRYKPGTVALREIRRYQKSTELLIRKLPFQRLVREIAQDFKSDLRFQSSAIGALQESVESYLVSLFEDTNLCAIHAKRVTIQSKDIQLARRLRGERN

SEQ ID NO: 59612 - protein, 136 aa, Marchantia polymorpha
MARTKQTARKSTGGKAPRKQLASKAARKSAPSTGGVKKPHRYKPGTVALREIRRYQKSTELLIRKLPFQRLVREIAQDFKSDLRFQSSAIGALQESVESYLVSLFEDTNFCAIHAKRVTIQSKDIQLARRLRGERN

SEQ ID NO: 59613 - protein, 136 aa, Marchantia polymorpha
MARTKQTARKSTGGKAPRKQLASKAARKSAPSTGGVKKPHRYKPGTVALREIRRYQKSTGLLIRKLPFQRLVREIAQDFKSDLRFQSSAIGALQESVESYLVSLFEDTNLCAIHAKRVTIQSKDIQLARRLRGERN

SEQ ID NO: 59614 - protein, 136 aa, Marchantia polymorpha
MARTKQTARKSTGGQGPRKQLASKAARKSAPSTGGVKKPHRYKPGTVALREIRRYQKSTELLIRKLPFQRLVREIAQDFKSDLRFQSSAIGALQESVESYLVSLFEDTNLCAIHAKRVTIQSKDIQLARRLRGERN

SEQ ID NO: 59615 - protein, 240 aa, Oryza sativa (japonica cultivar-group)
MTSPPPPPSSLLRRLPTTRCCCFASASSGWSASASVRLGSLGGKQRRGHRGVAVMAAAAAGGGGFEARVARIASTIRVIPDFPKPGIMFQDITTMLLKPDAFRDTIELFVERYKDKGITVIAGVEARGFIFGPPIALALGAKFVPLRKPKKLPGEVISEEYSLEYGTDKIEMHVGAVEPNGRAVVVDDLIATGGTLSAAVKLIERAGAEVVECACVIELPELKGRDKLGNKPVFVLVKAD

SEQ ID NO: 59616 - protein, 420 aa, Solibacter usitatus Ellin6076
MRQRRRTIGEFFGQLGPGLITGAADDDPSGIATYSVSGAGFGYSPLWTALFCFPLMVAVQMMCARLGMVSGRGLAAVVRRRYSRWVLWGACLLLTVANVINIGADLGGMADATEMVTGIPSWWLTPFYAALIIAVMMWSSYRAIARVFKWLTLVLFAYVITAFVVHPDWRAVLHATFVPQIVWSSEYLSVLVGILGTTISPYLFFWQAAQEVEEERAAGRTTVAQRRGATAKELRESRNDVMIGMFFSNFVMYFIILTTASTLHAHGVTHIATAKQAAEALRPLAGAGAYWLFTLGLIGTGMLGVPVLAGSSAYAIAEAMNWMGSLDRKPKLAVKFYSVLGVAMALGLALDYAGLDAVKMLFWSAVANGVLAPPLVVIVVLLTTDSSVMGEHVNSPLLKWLGWTTAVVMTAAAVAMMLAG

SEQ ID NO: 59617 - protein, 274 aa, Brassica napus
MSGLLNTSFLPSSTCRTRSCSSSAPHFRVNKPRVVTVRAKIREIFMPALSSTMTEGKIVSWVKSEGDKLSKGESVVVVESDKADMDVETFYDGYLAAIMVEEGGVAPVGSAIALLAETEEEIADARAKASVGGGGTSPSPPVSQAPPVVEEKVSASVPPPKVVSSASASASAVHPASEGGKRVVASPYAKKLAKELKVELAALVGSGPMGRIVAKDVEAAVAAAPPVQKEPSVELGSVVPFTTMQAAVSRNMAESLSVPTFRVGYTINTDALDA

SEQ ID NO: 59618 - protein, 677 aa, Prochlorococcus marinus str. AS9601
MTHINKGKPFPLGSSLTSQGVNFSLVATNAEYVEILLFEKEGSISPKSILKLDQNHNTGPYWHAEVKNLNEGCIYAFRVKQKNNAINNNYEKKVLLDPCSRGITGWESYKRENALKTQENTNSCLKSVVCDRKLFNFKDFPRPKHSWEETIIYELHIKSFTESNDKTESCFKKFLKKIPYLKELGITSIELLPIFCFDPTDAPSGLENFWGYSPINWFTPHFEYVSNESAEKNREEFRKLVEECHKSGIEVILDVVYNHTSEGDYKGPAICWKGIDENLYYFIGKDKNYQDVSGCGNTIAANRGLVRKLIIESLKCWASEFGVDGFRFDLGIALSRGENLSPLDNPPIFEDIECEPELVDIKFISEPWDCGGLYKLGDFPSKNTFTWNGHFRDDLRRFWKGDKDTAWNMSDKIKGTPSIYKEDTIFPKSINFITSHDGFTLKDLVTFNRKHNFANREQNRDGDNHNNSWNHGTEGPTTNLLINDLRKRQQKNLILSLLISKGVPMILMGDEIGRSQGGNNNSWCQNNLLGWMNWEHGQQDLELLEYFKYVIKIRKKLIHIFNPSFFPNNQTNENIPTYHWHGTKLDSPDWSSWSHTVAFSINEGNTNPLVWIGLNAYSKSIDFPLPKCKYNWLKVVDTSMSEIFEPLTINQKSVSIKSRSSLLIISEEVFLEKNNIF

SEQ ID NO: 59619 - protein, 391 aa, Ginkgo biloba
MAASAMTASYQSLHFCLQSKNMASPECILKSFSLPCSRFNGASTSLGASNGQYMGFRGHLRKGLLSSRGVMSSGSLNTVAQLVSEAETVKEKKDFEFDFKKYMYSKAISVNEALDKAVPTHYPEKIHESMRYSLLAGGKRVRPTLCIAACELVGGTEDLAMPAACAMEMIHTMTLIHDDLPCMDNDNLRRGKPTNHKAFGEDTAVLAGDALLSFAFEHIARSTSKTVESERVLRVICELGKSMGSEGLVAGQIVDIASEGDTSVDLKTLEYIHLHKTAVLLECSVVSGAIIGGASEEEIERTRRYARCVGLLFQVVDDILDVTKTSEELGKTAGKDLISDKATYPKLMGLEKAKEFAVELVNKAKEELSYFDPVKAAPLLGLADYIAFRQN

SEQ ID NO: 59620 - protein, 519 aa, Oryza sativa (japonica cultivar-group)
MEFAAALKKLDASRWPAPSPWLVGLVWLLATTPTTTTIPSLVCSDERVVDSRVGSARLTAWRCSHRRAKARDTGGWGGDREGEGEGEGERDAAGFFRLLPLVLPRVLSTNWGTGFALRFQEGHRIWRMGVSASCLWGGSESRGNQNGSAAVTSPRSGQVISRAGSNVRVFSLKELKLATRNFHMMNCVGRGGFGAVYKGNLKDGTQIAIKKLSAESKQGANEFLTEINVISNVRHPNLVKLIGCCVEGTNRLLVYEYAENNSLAHALLGPRSRCIPLNWQKRAAICIGTASGLAFLHEEAQPRIVHRDIKASNILLDKKLLPKIGDFGLAKLFPDTITHISTRVAGTMGYLAPEYALLGQLTKKADIYSFGVLVLEVISGESSSKSTWGQDMNVLVEWTWKLREQGRLLEIVDPELEEYPEEEMLRFIKVALVCTQATSQQRPSMKQVVDMLSNPTEISLENLVAPGVLKEPRHHSSSSGLTPDTTSNRSTKANPADSYSTQTRDMNSYQLSTIEVSPR

SEQ ID NO: 59621 - protein, 213 aa, Magnetospirillum magnetotacticum MS-1
SRSDAVTRAAGAIVFEVRRQFREHPGIMTFQERPEYGRVVDICTRDSLRELATPGLLAAFAPIAVGFGLGVGPLAGFLAGAIGAGVLMAVFLANSGGAWDNAKKIVEDGEYGGKGSEAHAATVIGDTVGDPFKDTAGPAINPLIKVMNLVSVLIAPAVVLMSVPEDANHVLRIAIAVVAAAIAFGAVIMSRLRAARVDREESAVERERVATGA

SEQ ID NO: 59622 - protein, 386 aa, Candida albicans SC5314
MDIVLEICDYYLFDKVYADVFPKDGAVHEFLKPAIQSFSQIDFPSLPNLDSFDTNSTLISSNNFNISNVNPATIPSYLFSKIASYQDKSEIYGLAPKFFPATDFINTSFLARSNIFRETLSLFIITTIFGWLLYFIVAYLSYVFVFDKKIFNHPRYLKNQMSLEIKRATTAIPVMVLLTIPFFLLELNGYSFLYLDINECTGGYKAILWQIPKFILFTDCGIYFLHRWLHWPSVYKVLHKPHHKWIVCTPFASHAFHPVDGFFQSLPYHLYPLLFPLHKVLYLFLFTFVNFWTVMIHDGSYWSNDPVVNGTACHTVHHLYFNYNYGQFTTLWDRLGNSYRRPDDSLFVKDAKAEEEKKIWKEQTRKMEEIRGEVEGKVDDREYVEQ

SEQ ID NO: 59623 - protein, 149 aa, Oryza sativa (japonica cultivar-group)
MSIELILWLFSFASIMVLIGLTAYQLICLSDLEFDYINPYDSSSRINSVVLIEYALQGALCASFLLTLHWFPFLVMAPVAYYHGKLYMDRKHLVDVTEIFRQLNWEKKYRMIKLAFYFSLFIITIYRLVMTAVTLFIDEDANLVDTRTI

SEQ ID NO: 59624 - protein, 136 aa, Conocephalum conicum
MARTKQTARKSTGGKAPRKQLATKAARKSAPATGGVKKPHRYRPGTVALREIRRYQKSTELLIRKLPFQRLVREIAQDFKTDLRFQSSVVLVLQEGSEAYLVGLFEDTNLCVIHVKRVTIMPKDIQLAPRIRGERN

SEQ ID NO: 59625 - protein, 661 aa, Streptococcus agalactiae NEM316
MTFDTIDQLAVNTVRTLSIDAIQAANSGHPGLPMGAAPMAYVLWNKFLNVNPKTSRNWTNRDRFVLSAGHGSALLYSLLHLAGYDLSIDDLKQFRQWGSKTPGHPEVNHTDGVEATTGPLGQGIANAVGMAMAEAHLAAKFNKPGFDLVDHYTYTLHGDGCLMEGVSQEAASLAGHLKLGKLVLLYDSNDISLDGPTSQSFTEDVKGRFESYGWQHILVKDGNDLEAIAAAIEAAKAETDKPTIIEVKTIIGFGAEKQGTSSVHGAPLGAEGITFAKKAYGWEYPDFTVPAEVVARFASDLQARGAKAEEAWNDLFAKYEVEYPELAAEYKEAFAGQAETVELKAHDLGSSVASRVSSQQAIQQLSTQLPNLWGGSADLSASNNTMVAAETDFQASNYAGRNIWFGVREFAMAAAMNGIALHGGTRVYGGTFFVFSNYLLPAVRMAALQNLPTVYVMTHDSIAVGEDGPTHEPIEQLASVRSMPNLNVIRPADGNETNAAWQRAVSETDRPTMLVLTRQNLPVLEGTSELAQEGVNKGAYILSEAKGELDGIIIATGSEVKLALDTQDKLESEGIHVRVVSMPAQNIFDEQEASYQEQVLPSAVTKRLAIEAGSSFGWGKYVGLNGLTLTIDTWGASAPGNRIFEEYGFTVENAVSLYKEL

SEQ ID NO: 59626 - protein, 320 aa, Colwellia psychrerythraea 34H
MTNSSSQLAQLKQMTTVVADTGDIEAIAKFQPQDATTNPSLLLKAASLPNYQGLVKDSVAWAKTQSDNAEQQVIDAADKISVLIGLEILKIVPGRISTEVDARLSFDTSASITKAHKLIAMYNEAGISNDRILIKLASTWEGIKAAEQLEQEGINCNLTLLFSFAQARACAEAGAYLISPFVGRILDWYKKDTGRNDYASNEDPGVVSVTSIFNYYKLQGFNTVVMGASFRNIGEILELAGCDRLTISPQLMEELANSTDTVIQKLTACEATAEKEAALSQAEFRWQMNEDPMATEKLAEGIRNFTIDQVKLEKQLTDLL

SEQ ID NO: 59627 - protein, 578 aa, Solibacter usitatus Ellin6076
MNPTAQIIVLDAGGQYCHLIARKVRDLGVYAEVRASETPAAELAAAKGIIISGGPSSVYDPESPTVDPDIFSLGIPVLGICYGQQLMAHLLGGEVRPGQKGEYGLATLDLAETGDPLFGGLGGTQQVWMSHRDVVGRAPEGFAVTGRTGTCEIAAIADPKRRFYAVQFHLEVVHTPRGKEYLANFTFRVCGCVPDWDPRNRVPMLEQEIRECVGERSVFFFVSGGVDSSVAFALCTRALSADRVRGVYVDTGLMREGETDFVRRIGNLTVEHAEDQFLTALSGVTDPETKRHIIGEEFVRVQERIIESRHLMNENWILGQGTIYPDTIESGGTAKAALIKTHHNRVAGIQKLIACGRIVEPLKSFYKDEVREVGRELGLSSELLDRHPFPGPGLAIRCLCSEFDAPVRATAEGLIVPVHSVGVQGDSRTYAPVLAIDALDHSRATELINAIAGVNRVIAPVETAAPASEMQVRACSLTEERLKRLRRADSIVRRLSHASGYDHQVWQFPVILIPLGTQGAPDSVVLRPVDSVDGMTAQSVLMDAELSHAICAEVLQIGGIAGVFYDLTHKPPGTIEWE

SEQ ID NO: 59628 - protein, 377 aa, Candidatus Blochmannia floridanus
MVKSDYYEILGVSKNADEREIKKSYKRLAMKFHPDRNPGDVSAESKFKEIKEAYEVLSNPEKRSAYDQYGHAIFEQNSGGMGGSNTGGSDFSDIFGDVFGDIFGGSRRSRSRRGSDLRYDIELSLEEAVKGVVREICVPTLVTCLQCRGSGAKSSASIVSCVTCHGHGQIQMRQGFFSVQQSCPSCNGHGKIIKEICNKCRGSGRIERTKTLSVKIPAGVSTGDRIRLSGEGESGKNGAPAGDLYVQVQIKKHPIFDREEKNLYCEVPISFSMAALGGEIEVPTLDGRVKLKIPPETQTGKLFRMRGKGVKSVRGIGGHGDLLCRVVVETPVRLSDRQKQLLQDLSDSFGGPYGHKNSPKSKTFFDGVKKFFDDLTR

SEQ ID NO: 59629 - protein, 180 aa, Brassica napus
  misc_feature (38)..(38): Xaa can be any naturally occurring amino acid
LLLKLHIATTMMDTFLRLAKSNTKKNLETCGILAGSLXKNRKFYITALIIPKQESTSDSCQATNEEEIFEAQDKQSLFPLGWIHTHPTQSCFMSSIDVHTHYSYQIMLPEAVAIVMAPQDSSRKHGIFRLTTPGGMTVIRNCDQRGFHAHSSPADGGPIYNTCTDVYMNPNLKFDVIDLR

SEQ ID NO: 59630 - protein, 182 aa, Medicago sativa
VQQRPAHEHAPRRVKSTLLLDKLDDISHQWIDSDILIFNTGHWWVPSKLFHTGCYFQVGRSLKLGMSIPAAYKIALKTWTSWIERKIDKNRTRVFFRTFEPSHWSDDTRRTCNVTQFPTFETNATEQNSFSDTVLEVVKNVNFPINVLHVTSMSAPRSDAHVGNWNDNPLSQDCSHWCLPGS

SEQ ID NO: 59631 - protein, 1088 aa, Candidatus Blochmannia floridanus
MPKRTDIRSILVLGAGPIIIGQACEFDYSGTQACRALREEGYRLILVNSNPATIMTDPNMADATYIESIKWEIIYKIIKKERPDALLPTMGGQTALNCVLDLDRQGILKEYNIIIIGSTVDAINKAENRKKFQESIKKIGLEVPKSGIACNIDEAMLILENIGLPCIIRPSFTLGGSGGGVAYHVQEFQSICQNGFRLSLNHELLIDESLIGWKEFEMEVIRDLNDNCIVVCSIENIDPMGIHTGDSITVAPAQTLTDKEYQIMRNASFMILREIGVRSGGANVQFAVNPDNGRIVIIEMNPRVSRSSALASKATGFPIAKIAAKLAVGYTLDELSNDTTNGRIPASFEPTLDYVVTKIPRFDFEKFPGQNNRLLTTQMKSVGEVMAIGRNQQESLQKAMRALEIEVSGFNPKVQLNNFDTLQIIMYKLKNASDDRIWYIADAFRYGMSIDEIFNLTNIDRWFLSQIEEIVQLESIIHSHGVSWLDKKNLFFLKQKGFSDIRLGQLTNTSENKIRALRYRYGVHPTYKHVDACSAEFSTDTAYMYSTYDDECEYDNHSNNEVIMILGGGPNRIGQGIEFDYCCVHAAMTLREEGYTVMMVNCNPETVSTDYDISDILYFEPITLEDILEIARVNKLKGVIIQYGGQTPLKLAKSIESYGIPILGTSSDSIDQAENRGRFQSTIKNLGLKQPRNITVTSIQLAIKKAVNIGYPIVVRPSYVLGGRAMQIVYNEKELLYYLKDAIHVSNHAPVLLDHFLENAIEVDVDVVCDGEHVFIGGIMEHIEHAGVHSGDSACSLPAYTLNREIQDKIRQQVKKIALGFNIKGLMNVQLAIQKDEIYIIEINPRASRTIPFVSKAINVPLAKVGTRVMIGQSLCNQKILQEIIPPYYSVKEVVLPFNKFLNVDPKLGPEMRSTGEVMGIGRTFEEAFAKAVFSSQSDVKKNNCVKNCILLSVSERDSKQEVANLVVLFLKKGFILEVTRKTADILKDVGMISDMVRPIDNITEEYLLKKIRSGIYSYIIDTTSAQNVLKSNDLLLRGIALRNAIRYSTTINGSFAIAMSVAEDATKYVSSIQDIHYKLINCMSINI

SEQ ID NO: 59632 - protein, 1067 aa, Clostridium thermocellum ATCC 27405
MPKIDKIKKVLVIGSGPIVIGQAAEFDYSGTQACKALREEGIEVVLVNSNPATIMTDTQSADRVYIEPITLDFVKKIIRREKPDGILASLGGQTGLNMAIQLAEDGILDEMGIELLGTSLESIRKAEDRELFKKTMQEIGEKVPLSTIATDLDSAVKFAEEVGFPIIIRPAYTLGGTGGGIAHNMEEFKYICGKGLKLSLIHQVLLEQSVAGWKEIEYEVIRDGADNSIIICNMENFDPVGVHTGDSIVVAPCQTLSDVEAQMLRAASLKIIRALNIKGGCNIQYALNPNSFEYVVIEVNPRVSRSSALASKATGYPIARVAAKIAIGLNLDEIKNSVTHTTYACFEPSIDYVVTKVPRWPFDKFSNADRSLGTQMKATGEVMAIGRTFEESLLKAIDSLDIKMNYQLGLSLFDNKSVEELLDFIKTPSDERIFAISKALQKGVSPEEISNITKIDIFFIKKLEKIVKVAEEIKNAGIAWLDYDLYYKAKKTGFGDSYIANLINVPLDTILELRNKYPIRPVYKMVDTCAGEFEAVTPYYYSTYEETDEVVVSGKKKVIVIGSGPIRIGQGIEFDYCSVHSVKTLKEMGFEAIIINNNPETVSTDFDTSDKLYFEPLTKECVLDIIEKEKPLGVIVQFGGQTSINLAGTLAKEGVNILGTSVESIDIAEDRDRFLNLLEELGIPLPEGDTAFSYEEAKAIAQRIGYPVLVRPSYVLGGRAMEVVYNDETLKEYMQLAVGLATNHPVLIDKYIEGKEVEVDGICDGEDVLIPGIMEHIERAGVHSGDSISIYPPQTLDDETKNTIVDYTIRLAKALKIVGLFNIQFVIDRHSKVYVIEVNPRASRTVPVMSKVTGIPMVDVATKFIMGYKMRDLGYTPGLYKESEFVAVKAPVFSFSKLTTVDTFLGPEMKSTGEVMGIAKDYHIALYKALVASGIKIPSGGNVLLSIADRDKTECIEIAQALSDLGFNLVASEGTYTNLSGVGIEVDMVTDDEMIEMIKKDKISLVINTPTRGKIPERHGFILRRTAIEYNIPCITSLDTARSMISILEHMTSGEEIEIYSLDEYSK

SEQ ID NO: 59633 - protein, 472 aa, Aspergillus oryzae
MPAIKKRKIAREAPQQEDHSDSEAHSSASEDAAPNTTEQEQEPSEAPKQAPKSFKELGLIEQLCEACDSMGYKAPTAIQAEAIPLALQGRDLIGLAETGSGKTAAFALPILQALMDKPSSFFGLVLAPTRELAYQISQAFEGLGSTISVRSTVLVGGMDMVSQSIALGKKPHIIVATPGRLLDHLENTKGFSLRNLKYLVMDEADRLLDMDFGPILDKILKVLPRERRTYLFSATMSSKVESLQRASLQNPLRVAVSSSKFQTVSTLQQSYIFIPHKHKDLYLVYLLNEFVGQSCIIFCRTVHETQRLSFFLRLLGFGAIPLHGQLSQSARLGALGKFRSRSRDILVATDVAARGLDIPSVDVVLNFDLPGDSKTFIHRIGRTARAGKSGVAISFATQYDVEAWLRIEGALGKKLPEYPAEKDEVMVLAERVSEAQRSAILEMKNYDEKKGSRGKKFAKGKRSREDMDQEEG

SEQ ID NO: 59634 - protein, 256 aa, Aspergillus nidulans FGSC A4
MARNSEKAQSMLFRFRAQQAADLGIIDIGRTRRPKAITSVDSIPACEKWRGQVLKEISRKVSRIQEPSLSDHQIRDLNDEINKLMREKWAWEMQIRNMGGPNYMRGSGRVYDDEGREIPGGGKGYRYFGRARELPGVKEMLEAAARRGRGPAEEEEDDGKTVGRGGDIATKKVDANYFGYGLDEEDGTLLAYEMQREKEAVEKLRKEGEDEEDVEDGWEPLPGDAGDGIEWRLPTLEEVQEELVDRRRRRLLEKIS

SEQ ID NO: 59635 - protein, 477 aa, Debaryomyces hansenii
MSVKVDGMINKKSKTHSKKLDARALAEKIKKNALKQQAQEEPAKEENVAENFDTVVDPTAELKFKSFNELKLIPELLEAIQQMKFTKPTPIQSEAIPHALEGKDIIGLAQTGSGKTAAFAIPILQALWEAQAAYYGLVLAPTRELAYQIKETFDALGSSMGLRSVCIVGGMDMMDQARDLMRKPHILVATPGRIMDHLEHTKGFSLKNLKYLVMDEADRLLDMDFGPALDKILKIIPTQRTTYLFSATMTNKIAKLQRASLHNPVRVAVSNKYQTADNLVQSMMLVSDGYKNTYLIHLLNEFLGKSIIIFTRTCAHSQRTALLARILGFSAVPLHGQLTQAQRLGSLNKFKAGKANILIATDVAARGLDIPSVDIVINYDIPTDSKAYIHRVGRTARAGKSGKSISLITQYDLEMYLRIESVLGKKLPKDPSPSKAVLDTLHVHVDRASAEAIRQTKDFHEKRNPKKNRDDRDREER

SEQ ID NO: 59636 - protein, 697 aa, Arabidopsis thaliana
MNDLPFHLLDNILFRLDPKSLGIMRCTNRSINSHISNDPNFVSGYSSEYSSRVGSSLFHVGISLGDNFIICHHFSYSCDSTSVKERSVLEFLSCYILGSCSGLLLLFIDGLFLANPLTKRFRPLNHSGSKLLSPIFGRNSQITSRDDGIEDYKARKERRMRVGFVVSPTKGFKIVCILEMETVYGFEISDGDSWRLSETTITTSSKSLLTTWMKPVYLDGTLHWLRNDGSIIAFDPETEQARFVPSVFHRGGPGTKLIFTEDSKKNRLTLISGTKETISVYTLVNNSKWDLTRQIANVYVNEIDLLCWQLIVCDGKCLVVVENTHSGYGVVHVYDLEANSWKVSGSNEFMGMSIGDFYKFTPSLVFVEGDEQEIIASTEKRIISALTAYVDGDRKQQKLYPNLDKEALKRVGILMLEEADKQRKKQSTVNHLSAIKTERESQQAQQRARDSKNIVDEPFSVSAIDRSIRKAEWVKTETDQILSGRCPETDGTWLGISTRGRVAFLVEAGTINRDRFNGAESRTLEFLESNESPEDFAKSSAADYIRNKNTAAFHLIVADIASNSMLYISKPRFSDYGIVYTEPVGPGVHTLSSAGLDSDVGYRDLRMRHSFCEMINRERLPPIRDIAEIMYDPVKAYESVLLSSIFFVDMKIGYEHYGTRITTALVVKRTKEVLFFERYREIFNDDWDDHDFAFTII

SEQ ID NO: 59637 - protein, 557 aa, Ustilago maydis 521
MSILLPTVHSSFEHLTPTHVAIASVLILGLLCLIAPDRYIFVSHRKGIKEVPGALPLIGNLLFLLDIAAKRRRFLDEFLRMQKSIGAGGMPWAATFPYLGGRVTSINRPEYIRWVQKTNFENYIKGSFFQKSMGDVMSLHGIFVADGEIWRKQRKMASHIFSVGNFRTHVQNTIHRDLAILNKLFRDASSKNTELNLPDLFFRFTLSSFSLMAFSADIKCLPSNVGDLSKVVEFAANFDYAQRVMDERFVDPLARFTELFSPQGRKMRRTIKELHSFCYEIIDLRLAARARGEAQAASGKGDKDLLALFMEQNLTRDELLPVVLNFLIAGRDTTAQALGWLFYELSKHPECIEKARQEIHEKLGSGSSFQSMAYDDLSSLVYVQACFLEALRLHPSVPKNIKLAVKDDVIRPYAQPCSDADVAPNAVPTTQKLPDLVIKKGETVTWQDHTMARMPELWGEDCEQFKPERFIEERKDGSIGIKTYSQYLFHAFNAGPRLCLGQTLATYEGCAVVAEILGNFDVVYDHKALKEDEPTYDDSLTLPIKNPYTIHVRARDD

SEQ ID NO: 59638 - protein, 314 aa, Triticum aestivum
  misc_feature (248)..(248): Xaa can be any naturally occurring amino acid
  misc_feature (272)..(272): Xaa can be any naturally occurring amino acid
  misc_feature (296)..(296): Xaa can be any naturally occurring amino acid
MADAEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNTPAMYVAIQAVLSLYASGRTTGIVLDSGDGVSHTVPIYEGYALPHAILRLDLAGRDLTDHLMKILTERGYSFTTTAEREIVRDVKEKLSYIALDYDQEMETSKTSSSVEKSYELPDGXQVITIGSERFRCPEVLFQPSFIGXWEAAGIHETTYNSIMKCDVDIRKXLYGTLSLMGGHYVPWTDR

SEQ ID NO: 59639 - protein, 480 aa, Deinococcus radiodurans R1
MPLWRGGTLRSDMDTFDVLVIGGGPAGYVAAIRAAQLGFKTACVDAFERGGKPSLGGTCLNVGCIPSKALLDSSERFEMISHDTAEHGIQVAQPQIDVSKMLARKDGVVDKLTGGVAFLFRKNKVTSFHGYGKLVRQDGQEWVVDAAGTEVKAKNVIVATGSNPRALPGVPFGGHIVENSGALQIDQVPGKLGVIGAGVIGLELGSVWRRLGAQVTILEAMPGFLMAADDAIAKEALKQFQKQGLDFHFGVKIGEIKQDDSGVTVTYEENGSQVTAQFDKLIVSIGRVPNTGGLNADGVGLALDERGFVKVDQHYRTNLPGVYAIGDVIGGAMLAHKAEEEGVALAEMIAGQAGHVNYDVIPWIIYTSPEIAWAGLTEKQAKERGLNVKTGQFPFSANGRALGHGDPRGFVKVVADAQTDKLLGVHMIGGGVSELIGEIVAIMEFGGSAEDLARTIHAHPTLSEVVKEAALAVDKRAIHM

SEQ ID NO: 59640 - protein, 297 aa, Escherichia coli
MATNLRGVMAALLTPFDQQQALDKASLRRLVQFNIQQGIDGLYVGGSTGEAFVQSLSEREQVLEIVAEEGKGKIKLIAHVGCVTTAESQQLAASAKRYGFDAVSAVTPFYYPFSFEEHCDHYRAIIDSADGLPMVVYNIPALSGVKLTLDQINTLVTLPGVGALKQTSGDLYQMEQIRREHPDLVLYNGYDEIFASGLLAGADGGIGSTYNIMGWRYQGIVKALKEGDIQTAQKLQTECNKVIDLLIKTGVFRGLKTVLHYMDVVSVPLCRKPFGPVDEKYQPELKALAQQLMQERG

SEQ ID NO: 59641 - protein, 1205 aa, Oceanospirillum sp. MED92
MSITIEQSRHAIRNSYLADEAAVITGLINNSGLDETERQSISASAADLVRKVRSESSPSMMEKFLAEYGLTTKEGVALMCLAEALLRVPDSLTIDALIEDKVVSGNWKGHLGQSASSLVNSSTWALLITGKLLKDDEAKGIGSTVKGMIKRLGEPVVRTAVAQAMKELGRQFVLGRDINEATKRAKKLEKQGYSYSYDMLGEAARTDADAIRYHQAYSQAISELTPACTSNDIRTNPGISVKLSALHARYELGQKTRVMQELVDRTLTLALQAKDANMGFNIDAEEADRLDLSLDVIEAVLADKRLADWDGFGIVVQAFGPRAAHVLDWLYATAQRLDRRIMVRLVKGAYWDAEIKRAQVLGLDGFPVFTRKVNSDLSYMCCAEKLMQMTDRIYPQFATHNAHSAAAILFMAKKHNVDNFEFQRLHGMGESLHDTVLKSNNTRCRIYAPVGAHRDLLAYLVRRLLENGANSSFVNQIVDTRITPEEIAKDPFSQVLESQDQISNNYIPKPAEIFGDKRLNAKGWDITDHVTLEQLEPAREAFQTTQWHAKPMIAGDATSSDTSEVRNPANPEDLVGMVTEANPADIESAIAAAELGFQRWSKTAPSERAACLRRVADLFEANAPELFALASREAGKTLLDAVGEIREAVDFARYYANEAEKHAESEARGVITCISPWNFPLAIFAGQVLAGLASGNTVIAKPADQTPLMAARAVALMHEAGIPNDVIQLLPGSGINVGAPLTSDPRISAVCFTGSTLTAQRINKVMAENMAPDAPLVAETGGMNAMIVDSTALPEQVVRDVLMSSFQSAGQRCSALRVLYVQEDIADNLLEMLYGAMDELRMGNPWLLSTDIGPVIDSNAQAKIEAHCEKFAAKGKLLKKLNTPEGGTFVAPTVLKVEGIEEIEEEIFGPVLHVATFAAKDLDQVVDSINSKGYGLTFGLHTRVDNRVERIINQIKVGNIYVNRNQIGAIVGSQPFGGEGLSGTGPKAGGPHYVKRFTRSAISQGTDAPSGQSVNTETLEQLIQQLDLTTQGLKADPEQLQKVFAGIASELPKPVTEATEMPGPTGELNLLSETGRGVVLCLGPDAESAVKQAATALFQGNAVVIIAQGIADLLKQCADAKLPVQGMVGQLTAEAITEAHGFAAVSCNASHDVLKTIRQALAAREGALLPLITELDQPERFVMERHLCIDTTAAGGNASLIATAG

SEQ ID NO: 59642 - protein, 1267 aa, Oryza sativa
MHQTSSQLVLASFLLLLCHHAHADCEPATCGNLTINPPFWLDEPGRPPCGPPTFQLQCRGSEAFVAHSFFQTYQVVRIFTGNSSVVVVDRSLPLESGCPVPWFNISIGFVMGPFLISRANKELVFVHNCTTTKRRPPQGFRRMPCSPDESFVFLGDGRPRLLLPGCSMSVVPVLGLQDGDYVASMRRGLLLEWMLVPGDCQKCSASGGQCEYSSDGMGFSCKCPSGVHNPTSCVAGGCISPIPDSKSNGRKKTLIAPKRYKYSEVAKITSFLSNKLGEGGYGVVFKGKLQDGRLVAVKFLHDSKGNGEEFVNEVMSIGRTSHVNIVSLFGFCLEGSKRALIYDYMPNSSLDNYIYSEKPKETLGWEKLYDIAIGIARGLEYLHHGCNTRIVHFDIKPQNILLDQDFCPKIADFGLAKLCCTKESKLSMTGARGTIGFIAPEVLYRSFGVVSIKSDVYSYGMMLLEMIGGRKNVKSMVQNSSEKYFPDWIYDHFYQGDGLQACEVTSEVEEIAKKMTLIGLWCVQVLPMHRPTITQVLDMFEKALDELDMPPKQSFCESLEHPVHKLNAESTSSATDKAYASPAHRCRNSPSADLTAVITEPDRVGTILCSATPFVAKAAKSAFTPATELWPVTAMAAARRALRHLHGFRVVVLFGCGGRYAWAVKAIGPKVRRTAAAHPRRKTEAGACWGRERRPVLFATASSSSSLSLLTGGGARGRRLRPTHAGREGTAPCDLRRGIVVVVVADPAAARARRKTEAGTQTEGGRRWSSPACGGRAAASRARRKEEAGARGVVTARRRSSPARGREAPPPPDLRLIYPAATGSTACTPPWPELHHHRCSSSSSSSPSPPRQLGATAPTARRCRSHKSAPPRAPSDRRRRLLSSPPPPPQIVAAAPSDRRRLGPPQIAAAAALHHNEWALAGQCLTPPPPPPQLAAAAPLASRRHTRRSSPPLHARSQWPPSSPSLSPHHSSEPVAAVVPVALAPPLVGAGGHRRGGGGDDEELGDGCGEQEGERERWRGGRCRRRGSRCWLRTPAAEEDDDGAASARVVLKLASLAAPLWLPALVGLLIGCPASPTTGFAAASSTLRLADHRIRAPPPSPAPRGCLLLSLFLLQAPGYQVPGTKHQGTRYQVSRVSGTRYQSGEEETAGFFCFCGGGGGATCAHRQGGGGSSGQGRRRPWRGARGRRGEAPAPAATRALVEEAAPQRVEAAPQRAEDDVVEVRRDHPRRRPYLTDAVTSSSMAAGDDDDPFLLSSFISALSFSSPV

SEQ ID NO: 59643 - protein, 473 aa, Mycobacterium bovis AF2122/97
MRHYYSVDTIRAAEAPLLASLPDGALMRRAAFGLATEIGRELTARTGGVVGRRVCAVVGSGDNGGDALWAATFLRRRGAAADAVLLNPDRTHRKALAAFTKSGGRLVESVSAATDLVIDGVVGISGSGPLRPAAAQVFAAVQAAAIPVVAVDIPSGIDVATGAITGPAVHAALTVTFGGLKPVHALADCGRVVLVDIGLDLAHTDVLGFEATDVAARWPVPGPRDDKYTQGVTGVLAGSSTYPGAAVLCTGAAVAATSGMVRYAGTAHAEVLAHWPEVIASPTPAAAGRVQAWVVGPGLGTDEAGAAALWFALDTDLPVLVDADGLTMLADHPDLVAGRNAPTVLTPHAGEFARLAGAPPGDDRVGACRQLADALGATVLLKGNVTVIADPGGPVYLNPAGQSWAATAGSGDVLSGMIGALLASGLPSGEAAAAAAFVHARAAAAAAADPGPGDAPTSASRISGHIRAALAAL

SEQ ID NO: 59644 - protein, 117 aa, Medicago sativa
MAAEEGQVIGVHTVEAWKEHLEKGNGSKKLIVVDFTASWCGPCRFIAPILAEIAKKLPNVTFLKVDVDELKTVAEEWAVDAMPTFLFLKEGKLVDKVVGAQKEQLQAAITKHATTDA

SEQ ID NO: 59645 - protein, 867 aa, Arabidopsis thaliana
MAKAVDKKFCWEIKNFSSLNSERCHSVPVVIGDCKWRLVAFPKGYKADYLSLYLEVADFKSLPSGWRRYVKFRACIVNQLSQELSVQQETQRWFDQNAPGWGFENMLLLTELNAKDGGFLVNGQVMIVAEVEFLEVIGTLDESEEIIKSSDLINKTQEVAQQVKEIIQPNDLINKTQEVAQQVKESIDVNGFQVLPSQVESVRRIFKKHPDIAVGFQVKNQHLRKTFMNFLVNVIETMCQSLQELSNEDLVEVDIALTYLKDAGFKVDWLEKKLDHVKEKKEKEQSGLIILQGIEQQLHELMHKCEKKKSETHIDRSKPAKLKISAGLNPFKVWLGQILANDSDDGDFSPSQDSSEDEETVEVNGFHVLPSQNQQLKNAYMDVLVDISETLSQSTKALSMEDLDKAESTLFDLTKAGLKVGWLRQKLDEAYLKKEKQRISGVRIRELEEQFLLLFRFSDSLLCSATFNRFIKNNEQAKGDKIQLDARGNGFLVRDRLIIVAEVQILPVIDVPKDTVKITEPLCWKEGDPATDASEEDLDDYDDSSEEDLDDNDDDDDASEEGLDDTDASEEVLDDDDESEESLDDDDDDAFEEDLDDDDDDDDDDDDDDDDSSPVSDDEGQEICPLNQLNAWNKAFRSVGNRGMKCNNVIVSEADTDDTAKEDLFEDGTVEEYPDDDDASSLHQWKSMVYTSKTVENFGTECNNKESFYESWWISDFLETIDVNGFQVLASQVQSVSQIFKRHPDTAIGFRPKNQQIRKAYMDALLSLIETLCQSPDKLSDDDLSNADETLVDLIDVGFKLDWLKTKLNDVSEKKKLGESSVVRLETMEEQLQKLKHMVLDLESQMQKEKEKVLAARAPLSFKDIFY

SEQ ID NO: 59646 - protein, 556 aa, Clostridium acidurici
MKTDIQIAQEAQMKHIKDVAELIDIHEDDLELYGKYKAKVSLDVLDQLKDKPDGKLVLVTAINPTPAGEGKTTTNIGLSMGLNKLGKKTSTALREPSLGPSFGVKGGAAGGGYAQVVPMADINLHFTGDFHAITSAHSLLAALVDNHLHHGNALRIDTNRIVWKRVVDMNDRALRKIVVGLGGKAQGITREDGFDITVASEIMAILCLANDREDLKERLGNMVVAYNVDGDAVRAKDLEAQGALTLILKDAINPNIVQTLENTPAFIHGGPFANIAHGCNSVLATKLALKTGDYAVTEAGFGADLGAEKFFDIKCRYAGLNPDVAVIVATVRALKMHGGVAKEDLGTENLDALAKGMTNLERHIENVAKFGVPSVVAINAFPTDTEAEKQLVFDKCKEMGVDVAISDVFAKGGDGGVELAQKVIDVCENKKSDFKVLYDVEESIPEKITKIAKEIYRADKVNFSKAAKKQIAELEKLGLDKLPICMAKTQYSFSDDPALLGAPEGFELTIRDLELAAGAGFIVALTGDIMRMPGLPKVPAANRMDVLPNGEIIGLF

SEQ ID NO: 59647 - protein, 510 aa, Vibrio vulnificus YJ016
MSAKKPLALVILDGYGYREDTASNAIANAKTPVMDALIANQPNTLISASGMDVGLPDGQMGNSEVGHTNIGAGRVVYQDLTRITKSILDGEFQQTAALVEAIDTAVKAEKAVHIMGLMSPGGVHSHEDHILAAVEMAAERGAEKIYLHCFLDGRDTPPRSAEGSLQRFQDLFAKLGKGRVASLVGRYYAMDRDNNWDRVQVAYDLLTQAKADFTYDSAVAGLAAAYERGENDEFVKATEIKAEGQESAAMQDGDAVIFMNYRADRARQITRTFVADFAGFERAAFPAVNFVMLTQYAADIPLAIAFPPASLENTYGEWLSKQGQTQLRISETEKYAHVTFFFNGGVETEFAGEERQLVASPKVATYDLQPEMSSTELTEKMVAAIKSGKYDTIICNYPNADMVGHTGVYEAAEKAIEALDASVGQVVEAIKEVGGQLLITADHGNAEMMVDPETGGIHTAHTSLPVPLIYVGDKAVEFKEGGKLSDLAPTMLSLAGLEIPAEMTGQVLVK

SEQ ID NO: 59648 - protein, 759 aa, Bacillus thuringiensis serovar konkukian str. 97-27
MNTPTQTPSLSETMKEWHYALAYEIKHWKTIGGSKISIMNGRFLYTDYESTVYVFQLISEVSLPEGSPIRIEFDGEEATGEVLSVHGLEIELKLNDYIQGEIREAVLYSEPWQLLEQLQERLKEARKDKLKRNRIKRLVDGTSSPKHMEKMKNPKNELAYRSFYNPTTYVWGPPGTGKSYNLSRIISAHYQKGKSVLVLAHSNAAVDVLMSEVTKQIEKKKKWTPGEIVRYGYSQHEHIRNHETLLASKLVETTNGSWGEERLYLEETRQELREKILSYKATSADKKRIQEIESDLRKQKAKIKEVEKEYIENAKVIGATLSKCAIDSLIYERTFDLVVVDEVSMAFVPQIALAASLGKRIVVCGDFLQLPPIAMANHELVRKWLGEDMFYHAGIVESVNKSEVHPNLFMLQEQRRMHADISKFTNSFIYKNRVYDHPSVSERKELAQLQPFANEASVLFDTGQMGAFSLKDAASGSRFNIMSGLVAMQMMLIGLLDGVQSIGVVTPYRAQSRFLSTCIREMLQRTKYQNIPVLAATVHKFQGSERDMMIFDTVDSYPQERPGVLFFDHKNHRLVNVAVTRARGKFIQLSDCHYMRKNLSRKQALSQLTAHIERHGDVYDRTTSRQLWERKISKRLRWFMEMNLEEPKGLLKDILAAKRKIIISLPSTKQVDKRVWQALMRTNAQITVYSDGPVPLKNVKLQRQNKAFPFIVIDDEIFWAGAPLTSQMIFEGSTEFPYVCARLQAPETIGVLKGFLDIR

SEQ ID NO: 59649 - protein, 559 aa, Moorella thermoacetica
MSKVPSDIEIAQAAKMKPVMELARGLGIQEDEVELYGKYKAKISLDVYRRLKDKPDGKLILVTAITPTPAGEGKTTTSVGLTDALARLGKRVMVCLREPSLGPSFGIKGGAAGGGYAQVVPMEDINLHFTGDIHAVTYAHNLLAAMVDNHLQQGNVLNIDPRTITWRRVIDLNDRALRNIVIGLGGKANGVPRETGFDISVASEVMACLCLASDLMDLKERFSRIVVGYTYDGKPVTAGDLEAQGSMALLMKDAIKPNLVQTLENTPAFIHGGPFANIAHGCNSIIATKTALKLADYVVTEAGFGADLGAEKFYDVKCRYAGFKPDATVIVATVRALKMHGGVPKSDLATENLEALREGFANLEKHIENIGKFGVPAVVAINAFPTDTEAELNLLYELCAKAGAEVALSEVWAKGGEGGLELARKVLQTLESRPSNFHVLYNLDLSIKDKIAKIATEIYGADGVNYTAEADKAIQRYESLGYGNLPVVMAKTQYSFSDDMTKLGRPRNFTITVREVRLSAGGRLIVPITGAIMTMPGLPKRPAACNIDIDADGVITGLF

SEQ ID NO: 59650 - protein, 556 aa, Alkaliphilus metalliredigenes QYMF
MKTDVQIGQEAKMLPITEIAARLGIKEDELELYGKYKAKVSLDVFDRLKDKPNGKLILVTAINPTPAGEGKTTTNVGLSMGLNAIGKTTMTTLREPSLGPNFGVKGGAAGGGYAQVVPMEDINLHFTGDIHAITTAHNLLAALLDNHIHQGNVLDIDTRRIAWRRVLDINDRTLRNTIVGLGNRGDGVAREDGFDITVASEIMAILCLATGMDDLKMRLAKMIVAYNGANEPVTAGDLEATGSLALLLKDAIKPNLVQTLENTPAFIHGGPFANIAHGCNSALATKLALKVADYVVTEAGFGADLGAEKFFDIKCRFADLKPDCAVIVATVRALKNHGGVPKGQLNEENLQALEKGFGNLEKHIENVQKFGVPVVVAMNEFPTDSEAEVALLRALCESKGAEVVLSQVWAKGGQGGVEMAKKVVEIVESKPSEFKPLYDVNDSIVDKINTIAKEVYGADGVDFSKGALKQIKGYEELGLDKMPICMAKTQYSLSDDPTLLGRPTGFRVTVKEIRVSAGAGFLVALTGDIMTMPGLPRVPAANHMNILESGEIIGLF

SEQ ID NO: 59651 - protein, 335 aa, Moorella thermoacetica ATCC 39073
MAIKVGINGFGRIGRLVFRASLEKPELEVVAINDITDVKTNAHLLKYDSVHGRLNATVEAREGAMVVNGREIKVLAERDPAKLPWKDLGVDIVIESTGVFTDATKAAAHRQAGAKKVIITAPAKNEDITIVMGVNNDKYNPAQHHIVSNASCTTNCLAPIAKVLHDNFTIKRGLMTTAHSYTNDQRILDLTHKDLRRARAGALSIIPTTTGAAKAIGLVLPELKGKLNGMAMRVPTPNVSVVDLVAELEKPATVESINAAMKAAAEGPMKGILGYCEEPLVSRDFNGDPRSSIVDALSTMVIDGTLAKVVSWYDNEWAYSKRVVDLAAFMAAKGL

SEQ ID NO: 59652 - protein, 393 aa, Moorella thermoacetica ATCC 39073
MAKLTLKDLELNNKRVLVRVDFNVPLEAGRVTDNTRIRAALPTIEYLLDHGARVILMSHLGRPKGKVKEELRLDPVARELESLLGRQVHKVNDCVGPEVEAAAAALKPGEVLLLENLRFHPEEEKNDPGFARQLASLADVYVNDAFGAAHRAHASTEGVAHYLPAAAGFLLQKEIETLGKALADPERPFVAIIGGAKVSDKISVIRNLLTKVDTLIIGGGMANTFLKAQGYAMGKSLVEEDQVPLAQELIQLAAQKGVKMLLPRDLVVAQEFKADAPHQVVAVNAVPDGWMALDIGPETARAYAGALEGARTVVWNGPMGVFEMEAFAHGTEAVARAVAAVDGMTIVGGGDSVAAVEKMGVAGKIGHISTGGGASLEFLEGKALPGVVALTEK

SEQ ID NO: 59653 - protein, 249 aa, Moorella thermoacetica ATCC 39073
MRRPIIAGNWKMHNTTEEARDLVTLLRPLVGTARAEVVVCPPFTAIAATVNAASGSNISVGAQDLFWEDKGAYTGEVSGPMLRDLGCRYVIIGHSERRQYFGETDATVNKKLLAAYRNELLPIVCVGETLAEREAGHTLEVVGRQVREGLKGLETGQARDLVVAYEPVWAIGTGKTATAADAQEVIAFIRKTLGEMYGETAAAIRIQYGGSVKPENIAELMAQPDIDGALVGGASLDAVSFAAIVNYDQ

SEQ ID NO: 59654 - protein, 513 aa, Moorella thermoacetica ATCC 39073
MAIAVNRPLMLMILDGFGLGPEGEGNAISQGRLPNYRRLLAGYPHTRLRASGEAVGLPAGQMGNSEVGHLNIGAGRIVYQELTRISKAIRDGSFFSNAALVGAVRAAREHGGALHLMGLVSDGGVHSHLDHLYALLDLAKREGLERVYIHAFLDGRDVPPASAAGYLEQVEDECRQKGIGAIATIMGRYYAMDRDRRWERTARAYRALVAGEGHQASSPSEAIRASYERDITDEFVEPAVITRDGRPLATVREGDSVVFFNFRADRARQLTRAFVDRDFDAFERPGGRLDIQFVCLTQYDVTIPAPVAFPPQVLQNVLGEVIAGAGLKQLRIAETEKYAHVTFFFNGGVEEPFPGEDRLLIPSPKVATYDQKPSMSAREVTDAVLERLDKYDFIVLNFANPDMVGHTGDLAAAIAAVETVDECIGRIVQAMAERRAPLLLTADHGNAEEMREPDGEPHTAHTSNLVPFILVDDRYRGASLREGALEDVAPTVLDILHIQQPAEMTGKSLIVKG

SEQ ID NO: 59655 - protein, 233 aa, Sulfolobus tokodaii
MSELVKISKTQFENVFQCEFNDGTVRLCTKNLAPGFSVYGERLFKVEGVEYREWNAFRSKLGGAILKGLKQNPIVKGTKVLYLGAASGTTPSHVSDIVELEGKVYGVEFSPRVVREFLLVAQHRPNLFPILADARFPQYYRTLVEDVDVLYVDIAQPDETDIAIYNAKFFLKNGGYMMMAIKARSIDVTKEPTEIYEMEVNKLKENNFDVIQVIQLDPYDKDHAMVLAKYKGK

SEQ ID NO: 59656 - protein, 428 aa, Moorella thermoacetica ATCC 39073
MTTISDIYAREILDSRGNPTVEVEVFLESGGWGRAAVPSGASTGAYEAVELRDKDPKRYGGKGVLDAVNNINAIIAPELVGSDALDQREIDRQLIEMDGTPNKGKLGANAILGVSLAVAKAAADALGLPLYRYLGGVNAHTLPVPMMNILNGGKHADNNVDIQEFMVMPAGASDFASALRMGAEVFHSLKAVLQSKGLNTAVGDEGGFAPNLRSNVEAIEVLLEAIAKAGYEPGKDCFIALDPASTELYKDGKYVFAGEGVTRTSDEMVEFWASLVDKYPIISIEDGLAEDDWEGWQNLTKRLGHKVQLVGDDLFVTNTERLSRGIEMGAANAILIKVNQIGTLTETLEAIEMAKKAGYTAVVSHRSGETEDTTIADIVVAVNAGQIKTGAPSRTERVAKYNQLLRIEEELDAAALYPGLKAFYNLKK

SEQ ID NO: 59657 - protein, 506 aa, Oceanospirillum sp. MED92
MSEQLQENIAKAEGYLARFKENTLGHYINGEWTLGQGETFDNTTPFDQSFLGKVAAATEADVNAACEAAEAAAAEWAATPGAERRKILHRLGDELEKRAEEIAMVESMDCGQAIRFMRQAAVRGAANFRFFADQAPEARNGLSLHQQEHTNYTVRNPIGPVAVITPWNTPFMLSTWKIAPALAAGCTVVHKPAELSPLTASILAECAEAAGLPKGVWNMVNGFGAVAGKTLTEHPAIKAVALVGDSATGKLIQAQTAQTLKRLHLELGGKNPVIVFDDADFDRALDAVVFMIYSLNGQRCTSSSRLLVQSGIKDKFLAALKERVANIKVGHPLDPATEVGPLVHTGHYDKVTSYFEIAKEDGATVAVGGKSLRDEMGPGNFVTPTLFVEAKNSMRIAQEEIFGPVLTAIEFETEEEAVKLANETIYGLAGYIWTSNTGRAMRMADKVEAGMLWVNSENNRNLPSPFGGVKMSGIGRDGGDWSFDFYMETKNVCIAHDTHRVPVLGR

SEQ ID NO: 59658 - protein, 345 aa, Thermus thermophilus HB27 [sequence omitted]

SEQ ID NO: 59659 - protein, 245 aa, Citrus unshiu
MARGGRVELKRIENKINRQVTFAKRRNGLLKKAYELSVLCDAEVALIIFSNRGKLYEFCSSSSMLKTLERYQKCNYGAPEPNVSAREALELSSQQEYLKLKARYEALQRSQRNLLGEELGPLNSKELESLERQLDMSLKQIRSTRTQYMLDTLTELQHKEQLLSEANKTLKQRLMEGYQVNTLQLNPSAEDCGYGLKPAQPQGDTFFHALECEPTLQIGYQPADPISVVTAGPSLNNYMQGWLPC

SEQ ID NO: 59660 - protein, 461 aa, Mycobacterium smegmatis str. MC2 155
MTTADITQTAPTDLGAKANRHLWGHFARHGDGITPPIITRGEGVKIFDDSGKSYIDGLSGLFVVQVGHGRKELAEAAAKQAEKLSFFPLWSYATPPAIELAERVASFAPGDLNRVFFTTGGGEAVESAWKLAKQYFKLTGKPGKHKVVSRSIAYHGTPQGALAITGIPAFKAPFEPLTPGGFRAPNTNFYRAPAEYAHDEKAFGRYCADRIAEAIEFEGPDTVAAVFLEPVQNAGGCFPPPPGYFERVREICDEYDVLLVSDEVICAYGRIGSMFACNDFGYVPDIITSAKGLTSGYSPLGAMVASDRLFEPFNDGKTVFGHGYTFGGHPVSAAVAMANLDIFEREGINDHVKTMAPAFRATLEKLYDLPIVGDVRGEGFFYGIELVKDKTTKETFNDEESERLLRGFLTPALWEAGLYCRADDRGDPVVQLAPPLISGQAEFDAIYDILHNVLTEAGNRL

SEQ ID NO: 59661 - protein, 144 aa, Legionella pneumophila str. Paris
MAHLIHSVLPVPPRKIAYIHPDDSVKECIKQMVEKDIGALVVFDNDAHLIGIVSERDILRCYFHKSLSLETAKVSDVVYTNVTILSPHDSVEKAMQVITETKRRHVLIQEEGELLAILSIGDLLYHVLEDKLRVIEHLENYIHS

SEQ ID NO: 59662 - protein, 254 aa, Arabidopsis thaliana
MMWLIDELGVEGFRTEVEKRMPNGKLERGSSEDLVNKQWERRDYFGVNPQKQEGLSFVGLHVPVGRLQADDMDELARLADTYGSGELRLTVEQNIIIPNVETSKTEALLQEPFLKNRFSPEPSILMKGLVACTGSQFCGQAIIETKLRALKVTEEVERLVSVPRPIRMHWTGCPNTCGQVQVADIGFMGCLTRGEEGKPVEGADVYVGGRIGSDSHIGEIYKKGVRVTELVTLVAEILIKEFGAVPREREENED

SEQ ID NO: 59663 - protein, 222 aa, Echinochloa crus-galli
EHMKESKGLKNDTDLTASDLKELVEQYKDVYVEAKGEPFPSDPKKQLELSVLAVFNSWDSPRAKKYRSINQITGLRGTAVNVQCMVFGNMGNTSGTGVLFTRNPSTGEKKLYGEFLVNAQGEDVVAGIRTPEDLDAMKDCMPQAYEELVENCNILEGHYKDMMDIEFTVQENRLWMLQCRSGKRTGKGAVKIAVDVVNEGLVDRHAAIKMVEPGHLDQLLHP

SEQ ID NO: 59664 - protein, 472 aa, Xylella fastidiosa 9a5c
MSCGIANAIRWDVSLLIHRSMSSSMSSVQPTSPVSDSPSLGEMHASVAVSRRGHWGFRLLAFLGPGYMVSVGYMDPGNWATGLAGGSRFGYMLLSVILLSNVMAIVLQALAARLGIASDMDLAQACRARYSRGTTLALWVVCELAIIACDLAEVIGTAIALNLLLGVPIIWGVVITAVDVVLVLLLMHRGFRALEAFVIALLLVIFGCFVVQIVLAAPPLQEVLGGFVPRWQVVADPQALYLAIGIVGATVMPHNLYLHSSIVQTRAYPRTPVGRRSALRWAVADSTLALMLALFINASILILAAAVFHAQHHFDVEEIEQAYQLLAPVLGVGVAATLFATALLASGINSTVTATLAGQIVMEGFLRLRLRPWLRRVLTRGLAIVPVIVVVALYGEQGTGRLLLLSQVILSMQLPFAVIPLLRCVADRKVMGALVAPRWLMVVAWLIAGVIVVLNVKLLGDYAVHLMVGVSD

SEQ ID NO: 59665 - protein, 230 aa, Beta vulgaris
  misc_feature (199)..(199): Xaa can be any naturally occurring amino acid
  misc_feature (212)..(212): Xaa can be any naturally occurring amino acid
MGRGKIEIKRIENTTNRQVTFCKRRNGLLKKAYELSVLCDAEVALIVFSSRGRLYEYANHSVKGTIDRYKKACSNQSGAGSVAEANAQYYQQEAAKLRNQIRTATENNRLLSRHMMGEGLSSLSMKELKNLETKLERGISRIRSKKNELLFAEIEFMQKREIELHNNNQFLRARISENERAQQSMSLMPGGSDYDLVPXQSFDSRNYFQVNXLQPSSQYARQDQTPLQLV

SEQ ID NO: 59666 - protein, 346 aa, Gibberella zeae PH-1
MEAPSTATKRHNAYATLITRDSYLPGVIILAYTLQRNNASYPLIVCYTPNLPKDARRVLELEAPKCNMVLRECDYLLPPKNIKMTIIAERFVDTWTKLRVFELFEYDAVCYLDADMAILDNMDVVFQCEEQLPDDWIAANHVCVCNLDSDSWAPEDWKAENCAYTPLSHPTALKEPLQPTESSPAPHKLLNGGMFIFHPSKGLWDRMLDVFNTTPLLSDFMFPDQDFLAFFFENKWYALGWQYNAIKTMRYWHPNIWRDERVICLHYIVDKPWAKRVGLDGVAGYKGLDGVTHCWWWQLYQYWEDERTSDGKGGNEAISLLQKLIAPAYTRESGVGYLRVALPVRA

SEQ ID NO: 59667 - protein, 480 aa, Zymomonas mobilis subsp. mobilis ZM4
MNNNSEIENDTQTNVRNTVSDFIGSQLYLLGTVLVTAIAGFLYGYDTGIISGALMNIAHDFKLDAHQQEIITSILLFGAVIGSLVCGRLSAFVGRRHMIMIVTAIFGFSVIAAGYAPTAFWLGAARLVLGFAVGGSSQIVPVYIAELAPADQRGRMVTFYNISIGLGILAAGIVGAFLQEEWTWRTMFSVAAIPAAVLFCSMMMLPESPRWLVRQERVEEARDMLDTVRETDHEVTKELRSIKKISNRTKEAAQDGWKALAQPWVRPALIAGLGVAAFTQLSGIEMMIYYTPTFLRDSGFTEKMAYYSALGVALIYVIMTTIGKLLVDHVGRRKLALCMMPLAALSLFALGIAFNLPGGASEHRWLILACLFAFMVFNAGGIQVIGWLIGSEVYPLCIRARATSLHAATLWGSNLILTSTALTMTSLLGIGGSMWFYGGLNALGFVFVYFMVPETKGRSLEEIESSLKDGSFLPSKKASA

SEQ ID NO: 59668 - protein, 475 aa, Frankia sp. EAN1pec
MTTHEQIYLDGTWVTPDGTEEVSVPNSTTGKEIGTIRLGSEKDVTAAVEAARTAFTTWSDTPIAERIRILDEMTRILTSRHSELSDLFSQEVGTPTAQAGAFQGLATSLFGMYAQKASTFDYEDRRGNITVLREPIGVVGAITPWNFPLLLMCLKVAPALAVGCTAVLKPAHIAPLSAYALAEAADAAGLPRGVLNVVPGGPRAGEALVAHPDVDMISFTGSTKAGRRISAVAGETIKRVTLELGGKSALVVLDDADLQAAVTTGMQSVTTNNGQGCACLTRVVVPRARLAEAEEMARAFAESTVIGDPRDPATTLGPMASAEHRDRVDGYIRTGIDEGARLVSGGPGAPDRWSGGFFVRPTVFTVEDVSATIAQQEIFGPVQVLIPHDGDDDAARIANATVYGLAGAVFGTDPDRIRRVTRLMRTGKVDINGTTFDPEAPLGGYRQSGNGREFGDYSLEEFLETKAVADLTAGA

SEQ ID NO: 59669 - protein, 343 aa, Deinococcus radiodurans R1
MTDASFPALPPPLVSLGDLAWDVLAKPDTLLLPGGDTTGRLELSGGGSAANLAVWAARLGAPTTFVGKIGQDRFGELATAELRAEGVRAEVLASAAHPTGVILALIDRRGQRAMLTGQGADWELLPEELPRDVLSSAGHLHLTAWSLFRDPPRAAALEAARIAKAGGATLSLDPGSFQMIQQLGREAFLNIVDALPFDVMFPNDDEARAMSGERDNEAALTWLRARYPRALIALKMDEDGALIEGPQTARVQVPATRDPLVDATGAGDAFGGAFLSQWLRHHDAERAARVAVQVGGWVVSRFGARPPADPDLTRRLASVGADLLTPDPAAAPDPSQDSPEVNA

SEQ ID NO: 59670 - protein, 91 aa, Triticum aestivum
  misc_feature (58)..(58): Xaa can be any naturally occurring amino acid
  misc_feature (65)..(65): Xaa can be any naturally occurring amino acid
  misc_feature (72)..(72): Xaa can be any naturally occurring amino acid
  misc_feature (80)..(80): Xaa can be any naturally occurring amino acid
MPATPTIIGALLGLGTQMYSNALRKLPYMRHPWEHVLGMGLGAVFVNQLVKFDEKLKXDLDKMLXRARLANXQRYIDDDXYLSFQRLFFQN

SEQ ID NO: 59671 - protein, 331 aa, Shewanella sp. MR-7
MAPQPESIMDLNAIRQLADTDMQAVNQLIYKQLESDVALINQLGFYIINGGGKRLRPLLSVLAARAVDYQGEAHLKLAAIIEFIHTASLLHDDVVDESTLRRGRETANALFGNSASVLVGDFLYTRSFQMMTELDSMRVLRVLADTTNVLAEGEVLQLMNCNDPNTTEESYMRVIYCKTAKLFEAATLLAAVLAGATPEQETALGDYGKYLGTAFQLTDDLLDYTADSEELGKNIGDDLAEGKPTLPLIYAIAHGTEEEQQLIRQAIEQGDGTHAIEKIVAALHHCGALTYTQQKAIEESNKAIAALSVLPDSNFKTALISLAKISVDRNH

SEQ ID NO: 59672 - protein, 249 aa, Solibacter usitatus Ellin6076
MRKPVMAGNWKMYKTPAETIAFFEKFRPLVEKSSHCEIVICPPFTNLAAAVDAVRGTSIRVGAQNVGWAKEGAFTGEVSGPMLNAMGVSHVIIGHSERRQYFNETDETVLKRTQAALEFGLTPIVCVGELLADREGGRTEAVLAGQFQKGIAGLTEQQFAKIVIAYEPVWAIGTGKTATPEIAADTHRAIRGQVREKFGKEAADAVRILYGGSVKPDNAKVLMGQPEIDGVLVGGAALDPVSFASIVNF

SEQ ID NO: 59673 - protein, 370 aa, Zea mays
  misc_feature (125)..(125): Xaa can be any naturally occurring amino acid
MGRNGSVRRSAFSGAAGAAAGPPSFSVNPADYRLMEEVGYGAHAVVYRAIFLPTKGVVAVKCLDLDQLNNNIDEIQREAQIMSLIDHPNVIRAYCSFVVEHSLWVIMPFMTEGSCLHLMNISTPXFGFDEPIIGSILKETLKALDYLHRQGQIHRDVKAGNILIDGAGVVKLGDFGVSACMFDRGDRQRSRNTFVGTPCWMAPEVLQPGTGYNFKADIWSFGITALELAHGHAPFSKYPPMKVLLMTLQNAPPGLDYERDKRFSKSFKEMVAMCLVKDQTKRPTAEKLLKHSFFKNAKPPELTIKSILSGLPPLWDRVKALQLKDEAQLALKKMPSSEQEALSLVCDIPFLFFMFCLVVGTVLNIMDPFF

SEQ ID NO: 59674 - protein, 1004 aa, Shewanella oneidensis MR-1
  misc_feature (194)..(194): Xaa can be any naturally occurring amino acid
MNRRQFFKLCAAGAATSAISALGLMSEKAYAAVREFKLLGAKETRNNCPYCSVGCGLLMYSQGSGGKNSEHAIFHIEGDADHPVNRGALCSKGAGLVDYVNSPHRLQYPEYRAPGSNKWERISWQDAFKRIARLMKDDRDANLIEKNADGVTVNRWLTTGMMTSSGMANESGLATQKFARALGLVAIDTIARNXHSPTVASLAPTFGRGAMTNHWIDIKNSNVVIIMGGNAAEAHPVGFGWVTEAMQHNNAKLIVVDPRFNRSASLADHYAPIRSGTDIAFLLGVIRYLISTNQVNFDYVKAYTNASYLVRDDFDFHDGLFSGFDEAKGEYNKESWFYQLDEDGYAIVDETLEHPRCVWNLLKQHVERYDFATVSNITGTPTEDYQVVCDAIASTHTKDRVATFMYALGWTHHSKGAQNIRSMAMIQLLLGNIGQLGGGVNALRGHANVQGSTDMGLLAQSLPGYLKLPNDKEPTLAAHLAANTPKPLRPGQTNYWQNYPKFYVSLLKAFWGENATPENEFGYQWLPKWDQMYDFGKHLDMMYRGKVNGCIVQGVNAINSMPNRNKNIKALSNLKFLVVLDNLSSETATFWQNEPGFNEVDTASIQTEVFRLPATVFAEEEGSIVNSGRWMQWHYKWANPPGEAMSDSEIVSGLLLELRKLYREEGGKLPEPIQAINWNYTDPHNPSSIELTKELNGYDVATKRQISSFAELKADGSTASACWVYAGSWTEAGNQMARRDNHDPSGKGITPGWAFAWPLNRRVLYNRASCDVNGKPWDEHRKIVEWKDGKWEGIDVPDFNAKLNPQESAHPFIMQADGVGRFFALKLLKEGPFPEHYEPVESPIGTNPLHPNVVHSPVLRWFEGVKDTIGTKEEYPYACTTYSLTEHFNFWTTHCRLAAIAMPETFVEMNEQLAAEKGIKNGDWVKVSSKRGHILTKALVTKRMRPLQVNGQTVHTLGIPRHGSHNALTRKSYSCNVLTTEMGDANTGVPEYKAFLVNVEKAEV

SEQ ID NO: 59675 - protein, 521 aa, Mycobacterium tuberculosis H37Rv
MGSEHPVDGMTRRQFFAKAAAATTAGAFMSLAGPIIEKAYGAGPCPGHLTDIEHIVLLMQENRSFDHYFGTLSDTRGFDDTTPPVVFAQSGWNPMTQAVDPAGVTLPYRFDTTRGPLVAGECVNDPDHSWIGMHNSWNGGANDNWLPAQVPFSPLQGNVPVTMGFYTRRDLPIHYLLADTFTVCDGYFCSLLGGTTPNRLYWMSAWIDPDGTDGGPVLIEPNIQPLQHYSWRIMPENLEDAGVSWKVYQNKLLGALNNTVVGYNGLVNDFKQAADPRSNLARFGISPTYPLDFAADVRNNRLTKVSWVLPGFLLSEHPAFPVNVGAVAIVDALRILLSNPAVWEKTALIVNYDENGGFFDHVVPPTPPPGTPGEFVTVPDIDSVPGSGGIRGAIGLGPRVPCLFISPYTGPLMVHDTFDHTSTLKLIRARFGVPVPNLTAWRDATVGDITSTFNFAAPPNPSKPNLDHPRAQCALPKLPQCVPNAVLGTVTKTAIPYRVPFPQSMPTQETAPTRGIPSGLC

SEQ ID NO: 59676 - protein, 120 aa, Mycobacterium smegmatis str. MC2 155
MTTKPEIEFPDGPAPTELVITDLVVGDGPEAVAGANVEVHYVGVEYDTGEEFDSSWNRGESIEFPLRGLIQGWQDGIPGMRVGGRRKLIIPPEQAYGPAGGGHRLSGKTLIFVIDLLATR

SEQ ID NO: 59677 - protein, 162 aa, Zea mays
  misc_feature (14)..(14): Xaa can be any naturally occurring amino acid
  misc_feature (23)..(23): Xaa can be any naturally occurring amino acid
  misc_feature (58)..(58): Xaa can be any naturally occurring amino acid
  misc_feature (90)..(90): Xaa can be any naturally occurring amino acid
LAIGANFVLLRKRXKLPAKVIAXEYFLEYETARIEMHVGSEQRTDRAIVIDGLIATGXTLCAVVKLIKSVGAKVVKWACVIALQELKGRXDKVGVRPVFVPCASTWRERKLELFTKFGPVKAPLCGEVHSLTCLPCWVCSVSRVKKFGLANCDPLNVLSMYT

SEQ ID NO: 59678 - protein, 402 aa, Triticum aestivum
MPALGTLSAGGAAAGVAGLLRLRRGPALASPLPAAARAGAVHDGAQLVWGRQLRPALVLPAGLLPLQASKRLTLRPPAASAEPAGEAKSPGLLEKYPAITTGFFFFMWYFLNVIFNILNKKIYNYFPYPYFVSVIHLLVGVVYCLLSWAVGLPKRAPINATLLKLLFPVALCHALGHVTSNVSFATVAVSFAHTIKALEPFFNAAATQFVLGQTVPLSLWLSLAPVVLGVSMASLTELSFSWKGFINAMISNISFTYRSIYSKKAMTDMDSTNVYAYISIIALVVCIPPALIIEGPQLMQYGLNDAIAKVGMTKFVSDLFLVGLFYHLYNQIATNTLERVAPLTHAVGNVLKRVFVIGFSIIIFGNKITTQTGIGTCVAIAGVALYSYIKAKIEEEKRAKAA

SEQ ID NO: 59679 - protein, 411 aa, Coxiella burnetii RSA 493
MSFEVLGLSAELLRAIREQGYVEPTPVQRQAIPVILQARDVMVTAQTGTGKTAGFTLPLLQRLFVSRPPLQRSAKPVIRALILTPTRELAVQVFECVRAYGKYLPLKATVVHGGVSIKPQINHLRRGVDILVATPGRLLDLVNQGVLNLSRVEFFVLDEADRMLDMGFLPDIRRILKLLPESRQNLLFSATFSKEIKELTDKLLHSPALIEVARRNTAAARITHVVHPVDRQRKRELLSFMIGSKNWRQVLVFTRTKHGANRLSQQLESDGLSSAAIHGNKSQAARMRALTQFKQGKIRVLVATDVAARGLDIDKLPHVINFELPDAAKDYVHRVGRTGRASNDGVAISLVSGDEVRLLRDIEKLLQSKMPQEVIPGYEPSPFTKAAPVQAVRRARSNQRGKNNGKRARWG

SEQ ID NO: 59680 - protein, 441 aa, Zymomonas mobilis subsp. mobilis ZM4
MTPHPPLTPFPWHDCLLLIALIAFNGLFAMSELAIISSRRPKLEAMAKTRKGASAALALSAHPGRFLSTMQVGITGISTLAGAVSGETLGGPIGERLAAMDVPNAMAWGFTVAIVVTTYFSLIAGELVPKQIALKAPEQIAAFTAIPVLWLSRLTAPAVWLLDKSSALVFHLAGMTREAHNQVTAEEVRLTITEAFQAGVIEENERQIISGVIRLADRPVREIMTPRTEVGWLDMEADIPTLSKNLASMPHSRMPVAIGSVDNIIGVVHSRDIVRVLMRGEKLDIKRLMRPAPIVPDQTTVMAALDSLRLAEVPLGLVHDEYGHFEGVVAPADLLAAMSGHFVSDVEGRNDPSIIEDKEGHYILSGSLSADQMADKLGFELDEDRDYATVAGFALSVLRHLPKIGEYFTSNGWLFEILDITGHKIEKVGVSKADGENREEN

SEQ ID NO: 59681 - protein, 590 aa, Schizosaccharomyces pombe
MLDNSQVNDLYPIAVLIDELKHDEITYRLNALERLSTIALALGPERTRDELIPFLDESIDDEDEVLSALADQLGNFVDYVGGPEYAHVRLSPLENLAATEETVVRDKAVDSLNKVCICLSQEQLEQYFVPLVQRLSTAEWFTSRASSAGLYCAAYSQSENPAVKVSLRQSFSHLCHDEAPMVRRPAATNCAKFVFLVTKQEAIDEFIPLFNSLSNDDQDSVRLLSFDIMVSLAEVLKSDSEIRHYLLQPLRSFVSDSSWRTRYMVAANFVKLAKVVGPSLIKDELIKPFVLLMKDTEQEVRRAIATQIPGFCELLDKRIVLEEIIPVIQELINDPAQHVRAALGMNIGALAPQLGKEKTTEYLLPMFLELLKDENPEVRLNIISKLEVVNKVVGIELLSQSLLPAIVTLAEDKQWRVRLAIIDYIPLLAQQLGVEFFNEKMGNLCMSWLEDHVYSIREAAIKNLRKLTEIFGLEWATETIIPKFLAMRSHPNYLYRMTTIFAISEIAPALNAEVIEKQILPTLEQLVNDPIPNIRFNVAKAFEVLKPVLAAGGDSTVYEQQIIPLLEQLTKDNDPDVQYFATQALEQTND

SEQ ID NO: 59682 - protein, 242 aa, Erythrobacter sp. NAP1
MHGTRAMLSEARAIDRAAQRHMKVEVALAPPYTLIHPIHREAEQIAVGAQDCHHEEGGAHTGDISAAMVADAGAKFVILGHSERRQNHGEKDAVVRAKAESALAAGLRIILCCGESEETRDAGKAVAFVSKQLKASLPKTIEDVAEKLTVAYEPIWAIGTGKTATVEDIAEMHAEIRALLVKMYGEEAGAEVRILYGGSVKPENAGEILSTAEVGGALVGGASLAADSFMGIALAAGEADEG

SEQ ID NO: 59683 - protein, 381 aa, Yarrowia lipolytica CLIB122
MSTEGKTITCKAAVAWEAGKPLTLEDVEVAPPQAHEVRVKVTYTGVCHTDAYTLSGSDPEGIFPSVLGHEGAGIVESIGEGVTSVKPGDSVILLYTAECKECKFCKSGKTNLCQKVRATQGKGVLPDGTTRFKCKGKDLYSYMGCSSFSQYTVVADVSLVAVDPSAPQDRTCLLGCGVTTGYGAATVTANVQKGDNVAVFGAGCVGLAVVMGAKERGAAKIIVIDINGNKEAWAYKFGATDFVNPTKLPEGTTIVDKLVEMTDGGCDFTFDCTGNVTVMRQALEACHKGWGESIIIGVAAAGQEIATRPFQLVTGRVWKGSAFGGVKGRTQLPEIVKRYKDGSFEIDNFITHSKPLKDINSAFTDLHKGDCIRTVVDMWQV

SEQ ID NO: 59684 - protein, 307 aa, Escherichia coli
MSAKVWVLGDAVVDLLPESDGRLLPCPGGAPANVAVGIARLGGTSGFIGRVGDDPFGALMQRTLLTEGVDITYLKQDEWHRTSTVLVDLNDQGERSFTFMVRPSADLFLETTDLPCWRHGEWLHLCSIALSAEPSRTSAFTAMTAIRHAGGFVSFDPNIREDLWQDEHLLRLCLRQALQLADVVKLSEEEWRLISGKTQNDRDICALAKEYEIAMLLVTKGAEGVVVCYRGQVHHFAGMSVNCVDSTGAGDAFVAGLLTGLSSTGLSTDEREMRRIIDLAQRCGALAVTAKGAMTALPCRQELESEK

SEQ ID NO: 59685 - protein, 448 aa, Oceanospirillum sp. MED92
MNNKNEILNQAGLSSEQLDAHWMPFTGNREFKKNPRIITAAEGNYYTSSDGRKIFDGLSGLWTCGAGHSRPEIAEAVSKQVRELDYSPAFQFGHPKSFELAHRITEMMPEGLNRVFFTGSGSESVETALKIARAYWRKKGQSSKTRLIGRAKGYHGVNFGGISVGGIAPNRAIYGQGIDAIHLPHTQIPENRFVQGLPEHGASQADELENLIATHDASNIAAVIVEPLAGSAGVIPPPKGYLQKLRDICNKHDILLIFDEVITAFGRMGAKTGSEAFGVTPDLMTTAKQLTNGVIPMGAVIAKQEIYDTFMETGGPDYMLELPHGYTYSAHPVACAAGLAALDILEQDKLIERVNSIAPQFQEMLHSLKGTQYISDIRNFGLAGALTIEAAPGEPALRPFQIAMKCWEKGFYVRYGGDTIQLGLPFTTEIDEIDSLINALGDSISELD

SEQ ID NO: 59686 - protein, 337 aa, Acrosiphonia duriuscula
MPRNRDDSPDGAYLIHGRYEKIEKLGEGTYGKVYKARDSKTDQVVALKKCRLQLDAEGVPPTTIREVSLLQVLSRSNHVVKLLGVEQIEEDGKVVLYLIFEYLQHDLKKFMDFKKKEKHNPLQPELVKPYLFQLIRGMAFMHQHGVMHRDLKPQNLLVDPKTNVLKIADLGLGRVFALPCKAYTHEIVTLWYRAPEVLLGTKIYSLPVDVWSIGCIFAEMVKGIPFFPADCEIAQLFMIFQVLGTPNEEVWPGVTSLRDWHMYPQWQPMDLHTHLEGLLDHQGCDLLKKMLVYNPNKRIPAKQAMKHPYFDDLDMEVMDALENPEVLNAGMEYQENA

SEQ ID NO: 59687 - protein, 54 aa, Glycine max
MASLATLAAVQPAALNGLAGSSLSGTKLSFKPSRHTVQTKKLQSGGVGNKYGDK

SEQ ID NO: 59688 - protein, 520 aa, Enterococcus faecalis V583
MTNVADLTSVEKIIVLDFGSQFNQLITRRIREFGVFSELLSHRTTAEEIRKIAPKGIIFSGGPNSVYDKDAFSIDPEIYELGIPILGICYGMQLMTHNLGGKVEPAANREYGKAELEILGDATLFQGTPAKQTVWMSHGDLVTEIAPGFEKVGTSNDCPIASIEDANRKFYGVQFHPEVRHSEYGNDLLRHFAFDVCGCTGDWSMENFIDMEVAKIREQVGDKKVLLGLSGGVDSSVVGVLLQKAIGDQLTCIFVDHGLLRKGEAEQVMESLGGKFGLNIIKVDAKERFLSKLAGVSDPEQKRKIIGNEFVYVFDDEATKLAGEEGVSFLAQGTLYTDVIESGTETAQTIKSHHNVGGLPEDMQFELIEPLNTLFKDEVRALGTELGMPDAIVWRQPFPGPGLGIRVLGEITEDKLQIVRDSDAILREEIAAAGLDRDIWQYFTVLPGIRSVGVMGDGRTYDYTVGIRAVTSIDGMTADFARIPWDVLQKISVRIVNEVAHVNRIVYDITSKPPATVEWE

SEQ ID NO: 59689 - protein, 80 aa, Oryza sativa
MACLHDHSCEDHNCAADWSLFNHIDVPKVVALNESVAGSVKSVFKPWEQRLDTSGVCSNVAVAMSLPTHVSSNRRSVGFH

SEQ ID NO: 59690 - protein, 144 aa, Triticum aestivum
MAQGTLEVLLVGAKALENTDYLCNMDPYAVLKCTSQEQKSTVASGKGSDPEWNETFVFTVSENATELVIKLLDSDGGTDDDSVGEATIPLDGVYTEGSIPPTVYNVVKDEEYRGEIKIGLTFTPEEARDQDQPEENYGGWNQSS

SEQ ID NO: 59691 - protein, 377 aa, Zea mays
  misc_feature (201)..(201): Xaa can be any naturally occurring amino acid
MADGEDIQPLVCDNGTGMVKAGFAGDDAPRAVFPSIVGRPRHTGVMVGMGQKDAYVGDEAQSKRGILTLKYPIEHGIVNNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTEERLXFTTSAEREIVRDIKEKLAYVALEYDQELENAKSSSSVEKSYELPDGQVITIGAERFRCPEVLFQPSFIGMEAPGIHETTYNSIMKCDVDIRKDLYGNIVLSGGTTMFPGIADRMSKEITALAPSSMKIKVVAPPERKYSVWIGGSILASLSTFQQMWISKAEYDESGPGIVHRKCF

SEQ ID NO: 59692 - protein, 427 aa, Streptococcus pyogenes MGAS10394
MTHSTKQEHSHSQSAVLGLQHVLSMYAGSILVPIMIAGALGYSARELTYLISTDIFMCGVATFLQLKLTKHTGVGLPVVLGCAFQSVAPLSIIGAQQGSGAMFGALIASGIYVILVAGIFSKIARFFPPIVTGSVITVIGLSLVGVAMGNMGDNVKEPTAQSMMLSLLTIVIILLVQKFTKGFVKSISILIGLVAGTLVSAMMGLVDTTPVVEASWIHVPTPFYFGMPTFEITSIVMMCIIATVSMVESTGVYLALSDLTNDQLDEKRLRNGYRSEGIAVFLGGLFNTFPYTGFSQNVGLVQISGIKTRRPIYYAAGILVVIGLLPKFGAMAQTIPSPVLGGAMLVLFGMVALQGMQMLNRVDFQKNEYNFIIAAVSISAGLGFNGTNLFASLPETAQMFLTNGIVIATLTSVVLNLVLNGKDKQDE

SEQ ID NO: 59693 - protein, 521 aa, Zea mays
  misc_feature (184)..(184): Xaa can be any naturally occurring amino acid
  misc_feature (191)..(191): Xaa can be any naturally occurring amino acid
  misc_feature (270)..(270): Xaa can be any naturally occurring amino acid
  misc_feature (286)..(286): Xaa can be any naturally occurring amino acid
MAVHLLLAVAVALLLCPGDASVHDYRGLSFANKGNAFILHAGSEGLYAASHANTTAEDDEDTAAVADAFIRFDKVTFRRPEDTNDSVKETSSAKVHILVFEVEDREMIGGSAYGGQKAICCSSDLAKLGACKEGSVIYRPSQVNPGWPKLFVASFEGSDLIATLPSRTIQITKTGMYNMYFIHXCDPSLAXLEIEGKTIWKNPTGYLPGRMAPLKNFFGLMSFAFVVLGIYWFYQYMKSWKEVLPLQNCITLVITLGMLEMALWYFEYAXEFNETGVRSKGITFWXAVTFGTVKRTAAEVIVLIVSMGYGVVAPTLGGLTSKVVMLGGTFFLATEILELVENLGAVNDLSGKARLFLVYPVAILDAAFVVWIFISLAKTIGKLQARRLMAKLDIYRKFATALIVSVLVSVGWIGYEIYSKSTDVFNERWQHAWIIPAFWHVLSFLLLCVICYLWAPSQNSMRFSYDASEFFDRKDNLSLIRPATSASKNGWSLSSAPEAKATKDVNTVADFEGDDEENKRE

SEQ ID NO: 59694 - protein, 496 aa, Pseudomonas aeruginosa UCBPP-PA14
MFELSDWQRRAATQRFIDQALIGGRQRPAASGATFDAIDPASNRLLARVAACDAADVDAAVAAARRAFDEGPWARLAPVERKRVLLRLAELMLAHREELALLDSLNMGKPVMDAWNIDVPGAAHVFAWYAESLDKLYDQVAPTAQQALATITRVPLGVIGAVVPWNFPLDMAAWKLAPALAAGNSVVLKPAEQSPFSALRLAELALEAGVPEGVLNVVPGLGEQAGKALGLHPEVDALVFTGSTEVGKYFMQYSAQSNLKQVWLECGGKSPNLVFADCRDLDLAAEKAAFGIFFNQGEVCSANSRLLVERSIHDEFVERLLAKARDWQPGDPLDPASRAGAIVDRRQTAGILAAIERAQGEGATLLGGGRQLTINGSDNFIEPTLFGDVRPDMQLAREEIFGPVLAISAFDSEDEAIRLANDSRYGLAASLWSDDLHRAHRVARRLNAGTVSVNTVDALDVAVPFGGGKQSGFGRDLSLHSFDKYTQLKTTWFQLR

SEQ ID NO: 59695 - protein, 499 aa, Legionella pneumophila str. Paris
MIRNSMKSHTELLSWNLLQKEADRVRLNSDSLTCVVPDSNNYESSKQINCIEYDYSRQRVNRTIIDLLIDLANEVKLQEKIDNLINGKKINISENRPALHTALRDLGNKSIMIDGLDIMSAVINTREKIKVISNQIREKKWLGHSGLPITDIVNIGIGGSDLGPRVCINALSNYISKEFNYHFISDVDPASFNDVIAKINPQTTLFIVSSKSFTTKETLLNARKAFALYEDTASIDQHFIAVTAHPERAYQMGIKTVLPIWDWVGGRFSFCSAVNLITAIAIGYEQFVELLAGAHDVDTHVQFTDFKNNIPVLMALIGIWNNNFLNIHNLLILTYSKKLEYFVPYVQQLDMESNGKSIDVNGSMVDYATGPIVWGGLGNQAQHSYFQLLCQGTHRCVGDFITLKTNDEHEINSMCHYKMKVLSEGIQTIENPYGYIPGNMPMNHLILSDCSPYTLGALVALYEHKIFVQSVIWNINPFDQPGIESAKSAHREITLSSES

SEQ ID NO: 59696 - protein, 293 aa, Pseudomonas aeruginosa UCBPP-PA14
MSASIHGIIGYTITPFAADGGLDLPALGRSIERLIDGGVHAIAPLGSTGEGAYLSDPEWDEVVDFTLKTVAHRVPTIVSVSDLTTAKTVRRAQFAESLGAEAVMVLPISYWKLNEAEVFQHYRAVGEAIGVPVMLYNNPGTSGIDMSVELILRIVREVDNVTMVKESTGDIQRMHKLRLLGEGRVPFYNGCNPLALEAFVAGAKGWCSAAPNLIPTLNGQLYQAVLDGDLEKARTLFYRQLPLLDFILRRGLPTTIKAGLGLSGLEVGAPRLPVQALDTEGCRYLQGLLEELR

SEQ ID NO: 59697 - protein, 309 aa, Burkholderia sp. 383
MPMPLDPQIAAILKTLEAAPPMESLSVDALRNSLAYPPLERRTVVGEVVDFDMPLEGRVLAARLYRPKLAQSDGVTVFFHGGGFVIGNLDTHDHVCRDLCAESGAAVIAVDYRLAPEHPFPAAVDDCFDAVRWIAEHADTLSFDPSRIVVAGDSAGGNLAAVTALKIRDEGGPTLRAQVLVYPVTDYHTPPTRSYIENQSGYSLTRAAMIRFWNDYVANEREALHPHACPLRAKSLAGLPRALVITAGFDPLRDEGEAYANRLFDAGVPVTFRRHDDMIHGFFRMGPACAAAQEGLLRAAAWIRDVMAR

SEQ ID NO: 59698 - protein, 217 aa, Streptomyces coelicolor A3(2)
MTHTAVAVGPEAPFKDIIALLDQWKVSALPVLEGEGRVIGLVSEADLLPKEEFRDSDPDRFTQMRRLTDLAKAGGLTAADVMTAPAVTVHPDATLAQAARIMAQRKVKRLPVVNAEGLLEGVVSRADLLKVFLRTDDAIAEEVGQEVVTPLFPSPAETVRVEVSDGLVTLGGRVRDTSLVPVAARLARAVEGVVDVRWDPTDVKTSGEGDQALRSNA

SEQ ID NO: 59699 - protein, 312 aa, Burkholderia sp. 383
MSLDAATRAFMDKLAATPSKPRHLMSPDEARTAFARISTILSPGADVRSTIALDIPVDGGTLRARLFVPDGRPQALLVYFHGGGWVVGGIDAFTPLCREIAAGAGVAVALVEYRKAPEHPFPGPVHDAWQAAQWLASQRVALLGAELPVFVGGDSAGANLAIAVTLLTRREGSMSFAGQLLVYPVTDCVFDRPSYVAAENQLLTTRDAMMGYWNHYAPSDAARHSSLASPLREADLSGLPEAIVVTAEHDVLRDEGEAYAQRLEQAGVPVHHRRALGQMHGFLMMIGVLPGSRDGLEFVCERLRDLVARSSR

SEQ ID NO: 59700 - protein, 879 aa, Yarrowia lipolytica CLIB122
MSFEKDEKETNLGEVHDIEEVEPSLLDWVAQKLGVPPNDIDGTYPAEVHFMAEKFAAMTEDEALVICKENLAYHQVDPNFREEYKIELEELLNSYHGSHDPTQQSVYVDEKEDHDVDPTERAMLLRYWATIFYWWSPYPEVRSVTDPFDDVNQTTLTWRVYVVGTIWVAVAAFVNTFFHPRQPAISLSGSVCQLLLYPSGRLLQYALPDWGFTIRGKRFTLNPGVWSQKEQLLCTIMVTCALGTPYITSNVLTQYMPIYYNQSWAGGFGYSFLMMLVTQYMGFGLAGLLRRVCVYPVKSMWPTLLPTLAVNKALLAPNRKEKINGWSISRYYFFFLVFCGSFLYFWIPNYLWEALSTWNWMTWIAPNNDNLAIITGSVGGLGYNPIPTFDWNIINFGIQPILLPLYTSINMYVGVFISGFFIMGIWYSNNNYTKWIPINTNTLYDNTGKKFKVTKILTDYVFDEEKYKNYSPPYYSAANLVTYGAFFAIYPLSFVYTVLCNYEMMWVAIRDTALAMKNFRRSNYEGLEDPFSRHMKKHKEVPDWWFYVILLIMFGLSIALVEHWPTNTPVWVIVLCLGLVFVFIIPFTLFLSFTGVPLSLNVLAELIVGYALPGKFQALNLAKALSVQIASQAQNYASDQKLVHYSHLAPRDIFATQLWATLVNGLVALGVMQFQMHDVKNICEPDNAMKFTCPSETTFFSASIIWGVIGPKRIFDHQYPTLKWMFLLGAGVGLLFWFIQVMLPKILLKYKPEKTQAILRYQRIVTKFHPVIFCQSCLNWAPYNLSYFTGGLYAAIFFNGYVKTRFLAWWRKYAYVFSAGMDTGIALSGIIIFFAVQYNDYSISWWGNNVPYAGVDTLGVTHPPLPDVGYFGPGPENYP

SEQ ID NO: 59701 - protein, 428 aa, Erythrobacter sp. NAP1
MADKQAKLELGGQTYEFPVLEGSTGPDVVDIRKLYGSTGAFTFDPGYKSTASCESALTYIDGQEGVLLHRGYPIGQLAEHSSFMETAYLLLNGELPSQQEYEDFNYTITRHTMLHDQLNTFYQGFRRDAHPMAIMCGVVGALSAFYHDSTDISDPEHRKISSHRLIAKMPTIAAMAYKYSVGQPFMQPKNDLSYTGNFLRMTFGVPAEEYEVIPAVEKAMDRIFILHADHEQNASTSTVRLAGSSGANPFACIAAGIACLWGPAHGGANEAALNMLREIGTPDRIPHYIERAKDKNDPFRLMGFGHRVYKNYDPRATVMQSTVREVFEALNVKDPVFETALQLEEIALNDPYFKEKKLFPNVDFYSGIILSAIGFPTTMFTALFALARTVGWVAQWNEMISDPAQVIGRPRQLYTGPVERDYVPLSER

SEQ ID NO: 59702 - protein, 242 aa, Oryza sativa
MSSSNGTTTYLPGGEAAGGGGGGNSGCCSTTTLFGALAASFALSFFLITIFICLRALRVARRRRDRPLVMEQEQRRPTPPRFGLDAAAIARLPSFPYVRARDDGEVSDSASSSSVECAVCLSAVDEGETVRQLPACGHVFHRECIDMWLSSRASCPVCRGKAAPADELADAIVARIAVTPDLVGPRVSMSVVVPVEMLKGEMVGASSTSRAASAPPEQLDARAPGPETDLETSLRKCMQLID

SEQ ID NO: 59703 - protein, 455 aa, Campylobacter lari RM2100
MSMAKQYINETLEKIQTISPRQPIFFQAATEVLNSLEPLLESNKTYQDHAILERIVMPEKTTIFRVVYINDAGKAQTHFGYRVQFNSSLGPYKGGLRFHPSVNLDVLKFLGFEQIFKNSLTGLMIGGAKGGANFDPKGKSEAEIMRFCQAFMAELSKIIGANTDVPAGDIGVGAREIGYMFGAYKKISSNFDGTLTGKKIPWGGSLARTEATGYGCVYFTQEMLAKYNNALEGKECAVSGSGNVAIYTIEKLHQLGAKAITISDSDGFVYDKDGIDLDLLKEIKEVKRARVSDYAALKKGAIFTPKSAYKQGCNGVWSIPCDLAFPSATQNELNLEDIKTLYHNGCRMVAEGANMPSTLEAIDFMLNQKDFLFAPAKAANAGGVATSQLEMQQNASMCQWSFEEVDAKLHKIMKNIFENSYECAKAYNHEGNLVVGSNIAGFKKVADAMIDHGYI

SEQ ID NO: 59704 - protein, 534 aa, Shewanella sp. MR-7
MAYDQESQLELGKYSSLIDLIERTSQRFGDKTAYACLGKTSSFNDIERDSRYFAAYLQNNTNLKPGDRIAIQLPNITQFVIAAYGALRAGLILVNTNPLYTERELIHQFNDSGAKALVVLSDLLPTLAKVVATTPIELVISTHPLDLIDPQVQPKTGLKNVEFCHVLKQGSELPFNRVAPAAGDLAALQYTGGTTGLSKGAMLTHGNMLANAAQVKSRIGSVISEGEDIFVAPLPIYHIYAFMVNLVLYFECGGCSVLIPNPRDINGLIKTLAKYPFTGFAGLNTLFVALCHQPEFKALDFSHLKITISGGTALTAAAANIWQQTTGNTISEGYGLSETSPVISLNAPGYQKIGTIGKPVLGTEVKLLDENGNEVAQGEAGELAARGPQVMLGYWNNPQETANVMTADGFFKTGDIAILNEEGFHQIVDRKKDMIIVSGFNVYPNEVENVLASHPNIIECAVVGVKDEHSGEAVKAFVVLKDDSQDHEQMKTAILNFCREQLTAYKLPKLIEFMPQLPKSTVGKILRRELKHQA

SEQ ID NO: 59705 - protein, 84 aa, Zea mays
MAHFERSGPTDILDSFSLLEHNIIFRTRVDDLFPLFKRYGYDVDIFVPRDRRTGDSRGFAFVRYKYADEAQKAIDRLDGRDVDG

SEQ ID NO: 59706 - protein, 317 aa, Oleomonas sagaranensis
MTLDAQAKAILDQIARSPMPKLHQVPASVARQMFEISCKLTEIKNLPIGRVEDRVIPGPDDTELPIRIYTPVAAPPGPLPVLVFFHGGGFVIGSLDSHDAPCRLIANEARCLVVSVDYRLAPENRFPAAVDDCLAAVTWVARNAAEINADPTRIAVGGDSAGGNLSAVVSQQLRDAGGPKIVFQLLIYPATDALHEGLSRTSNAEGYMLDKDLMSWFFAQYLGDGGGVDLADPRFSPLRHANLGNLGTIHVVVAGFDPLRDEGIAYAEALKAAGNKVTLSEFKGQIHGFCSMAGVIEAGRTALVEGAALLKEAFAQA

SEQ ID NO: 59707 - protein, 339 aa, Brassica napus
  misc_feature (252)..(252): Xaa can be any naturally occurring amino acid
MAGGKIKIGINGFGRIGRLVARVVLQRDDVELVAVNDPFITTEYMTYMFKYDSVHGQWKHNELKVKDEKTLLFGEKPVTVFGIRNPEDIPWGEAGADFVVESTGVFTDKDKAAAHLKGGAKKVVISAPSKDAPMFVVGVNEHEYKSDLDIVSNASCTTNCLAPLAKVINDRFGIVEGLMTTVHSITATQKTVDGPSMKDWRGGRAASFNIIPSSTGAAKAVGKVLPQLNGKLTGMSFRVPTVDVSVVDLTVXRLEKAATYDQIKKAIKEESEGKLKGILGYTEDDVVSTDFIGDSRSSIFDAKAGIALSDNFVKLVSWYDNEWGYSTRVVDLIVHMSKA

SEQ ID NO: 59708 - protein, 266 aa, Shewanella oneidensis MR-1
MCILFIALNAHPQYPLIICANRDEFHHRPTAPAQFWPPERNMLAGKDLQAGGTWFGVNTQGQLAGVTNLRVAQKNQEPMRSRGELVIQALNSGSLICPNWLVEHAQDYQPFNLVFGQGTNLYCFNSIRRETVKLTQGFHAISNGAMDDVWPKMAKGQRSLEALIQQSAQLEVESLIKLMQDDSQPQDNELPDTGVGLEWKRRLAAIYIRHPDYGTRSTSILLQNAQGEIQFTEVRYDGKGRRLGQQDFHFTLPPQLPPEPDCLVVF

SEQ ID NO: 59709 - protein, 197 aa, Medicago sativa
YLNISITRNIVPDEIKGREIHHSFPMTLFQPHSVRLNHHNLKLLKYWTWQFVVIRPVCSILMITLQLVGLYPNWLSWTITIILNISVSLALYSLVIFYHVFAKELEPHKPLAKFLCIKGIVFFCFWQGLVLDGLVAVGVIQSRHLKLDVEHTEEAMQNILVCIEMVVFSVLQQYAYHASPYSGEVEKMLKPNNKKNE

SEQ ID NO: 59710 - protein, 356 aa, Streptomyces coelicolor A3(2)
MKGYVFHGPGRSAWEDIPDPELKEPTDAIVRVDAVTICGTDLHILKGDVPEVRPGTVLGHEAVGEIVEVGTDVRTVRPGDRVLVSCITACGRCRYCREGVYGQCLGGGGWILGHLINGTQAEYVRVPYADLSVHSLPGAVTDEDAVLLADIFPTAYEVGVLNGRVSPGDTVVVVGAGPIGLAAVATARLFAPERIVVVDLATARLEAARKLGAEAVADAREDPEQLVADLTGGLGADVVIEAVGVPETFEMCTRVVRPGGHVANVGVHGRPATLHLEDLWSKNVTVTTGLVDTRSTPTLLRMAASGRLPTGQLVTHTFPLERMEEAYEVFSAAADTGALKVVLGGPKREVVAANAV

SEQ ID NO: 59711 - protein, 889 aa, Parvularcula bermudensis HTCC2503
MTQYIYNFGGGSADGRTDMRNLLGGKGANLAEMASLGLPVPPGFTITTEVCTAFYDNNRQYPEGLKDAVDKALERVESIVERKFGDAEKPLLVSVRSGARASMPGMMDTVLNLGLNKETVKGLAALAGDERFAYDSYRRFIQMYSNVVLQMDHHSFEEILDTYKDDRDYVLDTDLTAADWQAVIVKYEAAVQAELGKPFPQDVHEQLWGAIDAVFGSWMNDRSKTYRRLNAIPEDWGTAVNVQAMVFGNMGDTSATGVAFTRDPSTGENHYYGEFLVNAQGEDVVAGIRTPQNLTIAGRQRQGNEDPSLEEVMPETFKELTAIFQTLENHYRDMQDIEFTIQEGKLWMLQTRNGKRTAKAALKIAVDLAEEGKISEEEAVLRVNPAALDQLLHPSLDPKATRDLLTKGLPASPGAASGKVVFTADEAERLANDGQKVILVRTETSPEDIHGMHAAVGIVTARGGMTSHAAVVARGMGRPCVCGAAEVRIDKAGTAFTVSGRTVSAGDQITLDGATGEVFFGAVKTIEPELSGDFAKLMVWADKARRMKVRANAETPLDAKTARGFGAEGIGLCRTEHMFFDAERITVVRQMILARDATERKAALDKLLPFQRDDFRELFTVMRGLPVTVRLLDPPLHEFLPHTDKEIEEVAQGSGIAVDQLKARAKDLAEQNPMLGHRGCRLGVTFPEIYEMQVRAILEAACEVAAETGDAVVPEIMVPLVSMKKELAFLKSRIDAVATEVFADKGRILDYLVGTMVELPRAALIADEIAEEAAFFSFGTNDLTQTTYGLSRDDSGAFMPFYIREGLVETDPFVSLDPKGVGALVEIGAERGRQTRADIKLGICGEHGGDPASISICERIGLDYVSCSPYRVPIARLAAAQASLSGDDD

SEQ ID NO: 59712 - protein, 306 aa, Ipomoea batatas
GDQLYRMDYMDLVQNHIERNSDITLSCATVGDSRASDFGLVKIDRRGRVVQFCEKPKGTDLKAMQVDTTLLGLPPQDARLNPYIASMGVYVFKTDVLFRLLRWRYPTSNDFGSEILPAAVMEHNVQAYIFRDYWEDIGTIKSFYDANLALTEEFPKFEFYDPKTPFYTSPRFLPPTKIDNCKIKDAIISHGCFLRECTVEHSIIGERSRLDCGVELKDTLMMGADNYETESEIASLLADGKVPIGVGENTKIRNAIIDKNVRIGKDVVITNKDGVQESDRPDEGFYIRSGITIIMEKATIRDGTVI

SEQ ID NO: 59713 - protein, 224 aa, Marinobacter sp. ELB17
MNQDELKQAVAKSAIDYISPRLNSSSVIGVGTGSTANCFIDFLAAIRNDFDGAVASSEATAERLKSHGIPVYELNSTADLEFYVDGADEVNEQLELIKGGGGALTREKIVAEVAQTFICIADESKKVDILGEFPLPLEVLPMARSHVGREIVKLGGDPVYRDNFTTDNGNIIIDVYNLDLSRPIQVEERLNQIVGVVTNGLFARRPADLLLLGTKTGVRTLKRG

SEQ ID NO: 59714 - protein, 285 aa, Oryza sativa (indica cultivar-group)
MARHLPAILLLSSALLLALASASASAAAPALAAFVDAASRRYLRDQQHHDQAASMSLDQVSAAVSVLLGFAPPPSLPAQSSSKLDKLLLPNPFDRPRAVFLLQIDGFHDKDDLVIVHSDESPAVDSGSEYFDSDLTDLANWLGGSYEKVDGKLIIPLESGESLTLLITKEADMEFASSLISLRKTIKRGIQVHEDFSGGVMSPAELLVCHFKGIKALEEEYGSTEIVKQGTDVVRTAVTKAFDLLRGAYNGLLAYEYATYQGHPPVFECEDRLDGIRREGERLAH

SEQ ID NO: 59715 - protein, 578 aa, Deinococcus radiodurans R1
MPKSPPVSRYYDVKRDEQGQRYIEVKVTGLALLQNPLLNKTTGFTPEERRELGLEGLIPPHISSFEEQKHRTYLRYLEAPTDLARHEYLRALQDRNEVLYYAILEDHLEEMLPIIYTPTVGEAVKLYSNNYRYPRGFTVSTNDIERVEEMLDNVTVNDVRMIVATDSSAILGIGDQGFGGMAISIGKLSLYTAAGGVGPDKTLPVELDVGTNRQDLIDDPLYLGVHHRRWQGQQYDEFVDAFVEAVSARYPKAIIQWEDFSRGTAFRVLERYRKVVPSFNDDIQGTGAMALAGLLRASRMKGEFLTEQVFVVVGAGAAGIGVASAIRQGLEAEGLAPEEAGRRVYVVDRYGLLMEGQPDLEPQQMPFVRRRGDLEGWTFGGEYPTLHEVLVHARATALLGFTGVPGLFRQEDIEAMLAHTPRPIVFPLSNPSSHVEARPSDIVAWTRGGAIVATGSPFPDVPYDNERIPVGQGNNAFIFPGLGFGAVVSRAREITDNMVMAAALTLAEYTTQHHPHLVYPPISELRELSIHVAVRVAEQAIQDGVCAERRVRNMDREQLAALIRERAWLPRPLPLRRE

SEQ ID NO: 59716 - protein, 327 aa, Glycine max
MTGSADPLVISFGEMLIDFVPDTSGVSLAESCAFIKAPGGAPANVACAISKLGGNAAFVGKMGDDEFGRMLVDILRKNGVNTDGVCFDTEARTALAFVTLRKDGEREFMFYRNPSADMLLKESELNMGLIKQAKVFHYGSISLISEPCRSAHLAAMKVAREGGALLSYDPNVRLPLWPSEEAARSGIKSIWFDADFIKVSDDEVHFLTQGDPEKEDVVMTLWHDKLKMLLVTDGEKGCRYFTKNFRGRVTGFSAKVVDTTGAGDSFVGALLTAVARDPNIFHNEPKLREALTFANACGAMCTTQKGAIPALPTAAEAEKFISNSKAK

SEQ ID NO: 59717 - protein, 927 aa, Nocardia farcinica IFM 10152
MASYLPDIDPEETGEWLESFDEMLDREGPQRARYLMLRLLERAGERRVSIPSLTSTDYVNTIPTENEPWFPGDEEVERRYRAWIRWNAAIMVHRAQRPGIGVGGHISTYASSAALYEVGFNHFFRGKDHPGGGDQIFIQGHASPGIYARAFLEGRLTADQLDGFRQEYSHGGLGHGLPSYPHPRLLNNFWEFPTVSMGLGPMNAIYQARFNHYLHDRGIKDTSDQHVWAFLGDGEMDEPESRGLAHVAAMEGLDNLTFVVNCNLQRLDGPVRGNGKIIQELEAFFRGAGWNVIKVIWGREWDALLGADRDGALVNLMNSTPDGDYQTYKANDGAYVRDHFFGRDPRTKALVQNMSDQEIWNLKRGGHDYRKVYAAYAAAMAHKGQPTVILAKTIKGYTLGKHFEGRNATHQMKKLTLQDLKDFRDLQRIPISDAELEKDPYLPPYYHPGMEAREIQYMLDRRRALGGFLPERRAKAKPLQLPGDEAYRSVRKGSGKQNVATTMALVRLMKELLRDKEIGKRIVPIIPDEARTFGMDSWFPSLKIYNRNGQLYTSVDAELMLAYKESTVGQILHEGINEAGSTASFTAAGTSYATHGEPMIPLYIFYSMFGFQRTGDGLWAAADQLARGFVLGATAGRTTLTGEGLQHNDGHSLLLASTNPAVVTYDPAFAFEIAHIVRDGLRRMYGGGRPPAHQAVLPGTEPVERPDTDTFGGEDVFYYITLYNEPYQQPAEPENLDVEGLLKGIYRYRAAGEGELRAQILVSGVTVPDGLRAQALLAEEWGVQADVWSVTSWGELRKEALAKEIAALRDPGADVGTPYITEVLSAAGGPFVAATDWMRAVPDQVRQWVPGEFITLGTDGFGFSDTRPAARRVFNVDAQSIAVAVLEGLARTGKIDRSKAVEAARKYRIGDVDAAPKAAVSSDEDLA

SEQ ID NO: 59718 - protein, 552 aa, Cryptococcus neoformans var. neoformans JEC21
MPGGPGVLSAPLSPERVEAPVTVKAYLLCVFASFGGIFFGFDSGYMNGVLGMNYFINMMTGLPIPGADADQATKDAFTLPAWEKSLITSILSAGTFFGAIIAGDLADYFGRRITIVSGCCVFIVGCCLQTASTGLGLLVAGRLIAGFGVGFISAIIILYMSEIAPRKVRGAIVSGYQFCITIGLLLSSCVCYATQNRTDSGSYRIPIAIQFAWALILGGGLLLLPESPRWYVKAGKIEQARKALSRVRGQPVDSDYIKDEIAEIVANHEYETELTPNVTYLSSWAACFTGGIRNPGSNLRRTLLGISMQMMQQWTGVNFIFYFGTTFFTDLGTISNPFLISLITTLVNVCSTPVSFWTIERFGRRPLLIYGALGMLICEFIVGIIGVAKPGDTTVVKVQISFICIYVFFFASTWGPGAWVSIGEIFPLPIRARGVGLSTASNWLWNCIIAVITPYLVGTDEANLGSKVFFLWGSTCILCFIYAYLFVWETKGLTLEQVDRMMEECGSPRRSAGWKPHTTFAAEAAQGTHGLDQNEKAKVGPVLSQSEMLEQV

SEQ ID NO: 59719 - protein, 947 aa, Echinochloa frumentacea
MAASVSRAVCGLQGPCLNGRRSREAPSGRRSVAAPRAWRNEAGVLLLASGSGRAQHCAPANAIADAAPVTQATKKRVFLFGKGKSEGNRGMKELLGGKGANLAEMSSIGLSVPPGFTVSTEACEQYQAAGCTLPQGLWDEVLDGLAWVEEYMGAGLGDPQRPLLLSVRSGAAVSMPGMMDTVLNLGLNDEVAAGLAAKSGDRFAYDSYRRFLDMFGNVVLDIPHALFEEKLEHMKEAKGLKNDTDLTASGLKELVEQYKDVYVEAKGEPFPSDPKKQLELSVLAVFNSWDSPRAKKYRSINQITGLRGTAVNVQCMVFGNMGNTSGTGVLFTRNPSTGEKKLYGEFLVNAQGEDVVAGIRTPEDLDAMKDCMPQAYEELVENCNILEGHYKDMMDIEFTVQENRLWMLQCRSGKRTGKGAVKIAVDVVNEGLVDRHAAIKMVEPGHLDQLLHPQFENPSAYKDQVIATGLPASPGAAVGQTVFTAEDAEAWHAQGKAAILVRTETSPEDVGGMHAADGILTARGGMTSHAAVVARGWGKCCVSGCASVRVNDAEKVVAIGDKVLQEGDWLSLNGSTGEVVLGKQPLSPPALSGDLGIFMSWVDEVRKLKVLANADTPEDALAARNNGAEGIGLCRTEHMFFASDERIKAVRQVIMAPTLELRQKALDRLLPYQRSDFEGIFRAMDGLPVTIRLLDPPLHEFLPEGNVEDVVRDLCAETGSNEEEALARIEKLSEVNPMLGFRGCRLGISYPELTEMQARAIFEAAITMTNQGVQVFPEIMVPLVGTPQELGHQVAVIREIANTVFTAMGKTIGYKIGTMIEIPRAALVADEIAEQAEFFSFGTNDLTQMTFGYSRDDVGKFIPIYLDQGILQHDPFEVLDQRGVGELVKFATERGRKTRPNLKVGICGEHGGEPLSVAFFAKTGLDYVSCSPFRVPIARLAAAQVLV

SEQ ID NO: 59720 - protein, 127 aa, Salinibacter ruber DSM 13855
MSDPLLDAADFTDDGLIPAIVQDAETDQVLMMAYMTAETLQETLDTGRMVYWSRSRQERWVKGQTSGHTQTVEEARLDCDGDTLLFRVHQEGGACHTGFRSCFHRRAADDGWTTDGEKVFDPDAVYE

SEQ ID NO: 59721 - protein, 338 aa, Dechloromonas aromatica RCB
MTQQRTLARYLTEEQRNKGVITGDLKLLIEVVSRACQAISIAIGKGGLGGVLGEAGSDNVQGEAQKKLDVLSNDILLDANEWGGHLAAMASEEMDLPHLVPHRFPKGEYLLTFDPLDGSSNIDVNVSIGTIFSVLKCPEGADLSTPEAAEQAFLQPGTAQVAAGYAVYGPTTLLVLTVGDGVAVFTLDREQGQFILTLENVQIPADTKEFAINMSNQRFWEAPVQRYVAEMQVGKEGPLGKDYNMRWVASMVADVHRIMTRGGIFMYPMDSKIKGQGGKLRLMYEANPMAMLIEQAGGAATTGRQRILDIQPEKLHQRVPVILGSKNEVERVTGYHSA

SEQ ID NO: 59722 - protein, 232 aa, Sulfolobus solfataricus P2
MSEVITVKQTNMENIYECEFNDGSFRLCTRNLVPNFNVYGERLIKYEGVEYREWNAFRSKLAGAILKGLKTNPIRKGTKVLYLGAASGTTISHVSDIIELNGKAYGVEFSPRVVRELLLVAQRRPNIFPLLADARFPQSYKSVVENVDVLYVDIAQPDQTDIAIYNAKFFLKVNGDMLLVIKARSIDVTKDPKEIYKTEVEKLENSNFETIQIINLDPYDKDHAIVLSKYKG

SEQ ID NO: 59723 - protein, 294 aa, Solibacter usitatus Ellin6076
MSEVTRRTLLAGAAASGIGLGAQSRILDPHVHVWKHDPAFPFAEGAKVPERDATPETLLDLMKTNGVARTVIIQVIHYRYDNRYLAAVLKKYPGTFQGVCRVDPLDAAAPDHLSKLTAEGFRGVRLSPAGNASGDWFKGPLMPPLWKRCHSLNVPMTVLAPIGRMPEVAALLEKLPELTVVIDHMADCPIDQPAELEKLIALKRYPKVFVKISHTWSISKQPYPWLDAQEYVERLHQAFGPERLMWATDWPIVEGHSTYARALSVVRDEMKFLNAEDKSWILNKTIERVWPFGG

SEQ ID NO: 59724 - protein, 668 aa, Dechloromonas aromatica RCB
MSVSNLPKFSPLTGAIRALAMDAVQQANSGHPGAPMGMAEIAEVLWRRHLRHNPANPHWADRDRFVLSNGHGSMLLYALLHLTGYDLSIDDLKNFRQLHAKTPGHPEYGYTPGIETTTGPLGQGITNAVGFALAEKVLAAEFNKPGHEIVNHHTYVFLGDGCLMEGVSHEACSLAGTLGLGKLIAFWDDNGISIDGHVEGWFTDDTPKRFEAYGWHVVAHVDGHDSDAIERALLAAKAVTDKPSLICCKTTIGAGSPNKQGSHDCHGAPLGKDEIAAARAYIGWNHPAFEIPADIYAAWNRKPAGAVFEENWSTRFAAYRTAFPAEAAEFERRVIKNELPTNWAATKAAYIATCRDKAENIATRKASQNAIAALVPAVPEIFGGSADLAGSNLTFVKGSKGVTRTEGGNYCYYGVREFGMTAIANGIALHGGLVPYTATFLVFSDYARNAIRMAALMKQRQIMVYTHDSIGLGEDGPTHQPVEHIPSMRIIPNLDVWRPADATETAIAWTAAVERKDGPSILALSRQNLPTVTQQAADADIAKGGYVLAEADGEAQITFIATGSEIKLALDAQAALAGEGIKTRVVSMPCSNVFDRQSAEYKASVLGACKKRIAIEAAHPDFWRKYVGLHGAVIGIDRFGESAPAGQLFDLFGFTVANVVKTAKALLS

SEQ ID NO: 59725 - protein, 353 aa, Coxiella burnetii RSA 493
MSQKKFIHRINAALRKAMQIDPSVLCYGLGINDSARIFGTTTGLVEEFGEDRVFDMPTAENAMTGVGIGLAINGFRPVLSHCRLDFALLSLDQIINGAAKWYSLFAGTMPVPLTIRAIVGRGWGQGPTHCQSLQACFAHIPGLKVVMPSLAEDAYGLLLSSIFDDNPVIFIEHRWLHNIHVNEAEDSYRYLPLGQARKVIEGTDITVVAMSYMTIEALHAVKFLKTQGIHCELIDLRTIKPLDWETIYVSIRKTGRLLVLDTGFEFCSVASEIIAKASIDCFSSLLAPPKRLATPDYPVLTSPTLATPMYTYSDGIVRAVAEVLKLPVNVESLQKERDAKPRDVPGDWFGGPF

SEQ ID NO: 59726 - protein, 341 aa, Coxiella burnetii RSA 493
MQDWNQYKELLYKLLRIRMIEEEIVLQYPKGKMRCPTHLSIGQEAIPIMVCENLHNTDLMVSTHRAHAHYLAKGGNLKALIAELHGKVTGATAGRGGSMNLSDLSVGFVASTAIVANTVPIGVGLAFSQKLKKSNVITTIFLGDAAVEEGVVYESLNFAVLKRLPVLFVCENNLYSVNTPLHLRQPANRAIHEMAKGIGAKTQNIDGNDIPTSFHSVCEVMKDLRANGGVWFLEFQTYRFKVHCGPEEETFTDRSKTEFDHWLARDPLSLLQSQLLTAKTVSPEEIDKWRHEIQNEIDEAFTFAESSPYPPPEDRFRYRYADSRNEWLRHQLDKQKDEVLT

SEQ ID NO: 59727 - protein, 342 aa, Dechloromonas aromatica RCB
MAIKVAINGFGRIGRCTLRAIYEQGLQNEFDVVAINAAGDLATNAHLLKYDTTHGRFRTSVETEGENCIIIDGKKIAFYSTKNPKDINWADHGVDIVLECTGAYTSKAKALPLLEQGAKRVLISAPGGDDVDATIVYGVNEGILKSGMTVVSNASCTTNCLAPVAKILSDSIGIKQGLMTTIHAYTNDQVTVDVRHKDLRRARAAAANIIPTKTGAAKAVGLVLPQLVGKVDGFALRVPTINVSLVDLTFTAGRATTKDEINALMTAAANGPLKGVMDVNNEPLVSSDFNHTTVSSTFDATQTRVIQGEDGSTLVKVLAWYDNEWGYSCRMLDAARAWMAAK

SEQ ID NO: 59728 - protein, 101 aa, Glycine max
  misc_feature (12)..(12): Xaa can be any naturally occurring amino acid
  misc_feature (33)..(33): Xaa can be any naturally occurring amino acid
  misc_feature (54)..(54): Xaa can be any naturally occurring amino acid
  misc_feature (79)..(79): Xaa can be any naturally occurring amino acid
GKSAVRIQDHLXRPNAAHRWHNYLKTPNQIQLXEEAAALHYTYATFSDLTSRHXRCGSQPTKENVKRCFMSELGRKAFXIASTSPLKKMMISNTAPVERGG

SEQ ID NO: 59729 - protein, 393 aa, Dechloromonas aromatica RCB
MNVIKLTDLDVSGKRVFIRADLNVPQDEAGNITEDTRIRASLPSIKYCLEKGAAVMVTSHLGRPTEGELNHEDSLMPVAVRLGQMLHTSVRLITDWVDGGFEVKPGEVVLLENCRVNKGEKKNNDELAQKMAKLCDIYVNDAFGTAHRAEATTHGIAKYAPVACAGMLMGAEIDALSKALHEPKRPLVAIVGGSKVSSKLTILKSLASKVDQLIVGGGIANTFLLADGKRIGHSLAEPDLVKEAHTIMDIMKERGAEVPLPTDVVVADEVSALARANKISVDDVHANDRILDVGPKTAAKFAEIIANAGTIVWNGPVGVFELPQFAGGTKMMASAIAHSEAFSIAGGGDTLAAIAKFHIADDVGYISTGGGAFLEFLEGKTLPAIAILEERAA

SEQ ID NO: 59730 - protein, 318 aa, Allium sativum
FLVTTILAFALFKNSYAQQCGSQAGGALCSNRLCCSKFGYCGSTDPYCGTGCQSQCGGGGGGGGGRGGGGGGGGGSGVASIISSSLFNQMLLHRNDAACPANGFYTYDAFIAAANSFGGFGTTGDINAQKRELAAFFAQTSHETTGGYPSAPDGPYAWGYCFKQEQGNPSDYCQASAQYPCAPGKKYYGRGPIQISYNYNYGQCGNAIHQDLLNNPDLVATDPTISFKTAIWFWMTAQSPKPSCHAVATGQWQPSAADQAAGRVPGFGVITNIINGGVECGHGSDTHVADRIGYYKRYCDLLQVGYGDNLDCGNQAHF

SEQ ID NO: 59731 - protein, 66 aa, Brassica napus
  misc_feature (19)..(19): Xaa can be any naturally occurring amino acid
  misc_feature (43)..(43): Xaa can be any naturally occurring amino acid
  misc_feature (46)..(46): Xaa can be any naturally occurring amino acid
  misc_feature (56)..(56): Xaa can be any naturally occurring amino acid
  misc_feature (60)..(61): Xaa can be any naturally occurring amino acid
MSGRGKGGKGLGKGGAKRXRKVLRDNIQGITKPAIRRLARRGXVKXISGLHLPRKXRGVXXNLFWP

SEQ ID NO: 59732 - protein, 394 aa, Parvularcula bermudensis HTCC2503
MADAPRPPRIPRNRDDDYTAEMAADRARFAAAQTGAPLDHVTKGTIDPALLKGNCENFFGVAQVPIGLAGPLEIDGEHAKGPFYIPLATTEGTLVASYNRGMRLLSEVGGVKTTVIERYMQRAPVFHFANARDARAFGEWVADHEADIRTAAEATTTVGQLHHIQRFQVAQMCFLRFNYLTGDAAGQNMSGKATYAACEWIAEHAPGQPWYTLSGAIDTDKKHSHMNMLHSRGARVVAEVTIPDAVMQAMMGPSNAKLFRGRLVSNAGGMLAGTVNNGMHAANGLTALFIATGQDVANISESHAAITFVELLPNGDYYWSITIPSLIVATYGGGTGLPTQRECLEMLGCYGKGKVEKFAEICAATVLAGEISLAAAVQHGDWVSSHDRYGRNRP

SEQ ID NO: 59733 - protein, 284 aa, Pseudomonas aeruginosa UCBPP-PA14
MSAPRSVLAGLIGAGIQASRTPALHEREGDAQGIRYLYRLIDLDPLGKSADDLEFLLAAASDLGFTGLNVTFPCKQAIIPLLDELSAEARGIGAVNTVVLRDGRRIGHNTDCLGFAEGFRRGLADAPRQRVVQMGAGGAGAAVAHALLAEGVERLVLFDVDPARAQALADNLNQHFGAPRALAGSDLAGALGDAQGLVNTTPVGMAKLPGMPVPAELLRADLWVAEVIYFPLETELLRQARALGCRTLDGGTMAVFQAVKAFELFSGVEADAARMQAHFASLGD

SEQ ID NO: 59734 - protein, 321 aa, Bartonella grahamii
TYIDGDKGILLYRGYPIDQLAEKGDFLESCYLLLYGELPTQQEKNEFDRCIMQHTMVHEQFARFFHGFRRDSHPMAVMVACLGAMSAFYHDSIDITDPHQRMIASVRLISKVPTLAAMAYKYSIGQAFVYPRNDLSYAANFLRMCFAVPCEEYKTNPVLARAMDQIFILHADHEQNASTSTVRLAGSSGANPFACIAAGVACLWGPAHGGANEACLKMLQEIGSIERIPEFIARAKDKNDPFRLMGFGHRVYKNYDPRAKIMQKTCHEVLKELNIQDDPLLDIAIELEKIALSDEYFIEKKLYPNVDFYSGITLKALGFPT

SEQ ID NO: 59735 - protein, 319 aa, Alkaliphilus metalliredigenes QYMF
MKTIGVLTSGGDSPGMNAAIRAVVRSGIYNGCKIMGIKQGYSGLINAKIEEMNLSSVADIIHRGGTILRTARCEEFRTEEGRKKALNVLKVLKIDGVVVIGGDGSFQGAKKLSELGIPTVAVPGTIDNDLGYSDYTIGFDTAMNTVLDAISKIRDTSTSHGRANIIEVMGRHCGDIALYTGLAGGAESIIIPEVGLDIDEICRKLLQGKNRGKLHSLIVLAEGVGGAIDLGKIIEEKTGIETRSTVFGHIQRGGSPTAFDRILASKMGARAVDLLIEEKGNRAVGIKGNQIFDMDIEEALNIENKFDQETFELAKILSI

SEQ ID NO: 59736 - protein, 162 aa, Erythrobacter sp. NAP1
MSTATQLLKSFTLWEFLKAHSLTLKYFFKPKVTINYPFEKSPLSPRFRGEHALRRYPNGEERCIACKLCEAVCPAQAITIEAEPREDGSRRTTRYDIDMTKCIYCGFCQEACPVDAIVEGPNFEYATETREELLYDKAKLLANGDKWERAIAANLEADAPYR

SEQ ID NO: 59737 - protein, 307 aa, Bartonella sp. 16/40
YIDGDKGILLYRGYPIDQLAKKGDFLESCYLLLYGELPTKQEKNDFDRCIMQHTMVHEQFARFFHGFRRDSHPMAVMVACLGAMSAFYHDSIDITDPQQRMIASVRLISKVPTLAAMAYKYSIGQAFVYPHNDLSYTENFLRMCFCVPCEEYKINPVLARAMDRIFILHADHEQNASTSTVRLAGSSGANPFACIAAGVACLWGPAHGGANEACLKMLQEIGSVEQIPKFIARAKDKNDPFRLMGFGHRVYKNYDPRAKIMQQTCHEVLKELNIQDDPLLDIAIELEKIALNDEYFVEKKLYPNVDF

SEQ ID NO: 59738 - protein, 468 aa, Burkholderia thailandensis E264
MAMISESSSAAAAAPGGARAPDTLARSLNVRDVVMITVSGVTPASSIFVIAPFAIQQAGSGAVVSFVLGGLLALAFALCYAELSAAHRSAGGEYVMVKRVFGALPGYLTFVAVLAVNVFIPAVLASGAAPYLNAALGTQFRNQSVALAIVLASYALGILNIRTNAWITGAFLVIEILVLALIAYLGFSEPHRSPLALVHPVVANGAALVPATLAAIMPAVGTAIFCYNGFGAAVFLAEDLEGGNRDIAKAVICSLAVILVVELVPLTAIVLGAPSFVELAKSADPIGYVVRALSNPGVSRVVSGGIFLSVFNAIIAIVIMVGRFLYSSGRHALWSRACNGAFTRIHPRLESPWVATLTLAVPSTLLVFVSSLDELTAFTVDLLLLIYLAVGVAALASRVTRRDVDHHYRMPWWPLPPIVAIAGAGYTLYTTIAAATKPTDLYIIAGLAAVSLVTYAMWARRSEAFRAL

SEQ ID NO: 59739 - protein, 404 aa, Oryza sativa (japonica cultivar-group)
MLHLQKHLLLLSLPPRATASTLLSLRHHGLFSLTRFSAAAAAAKSAGHFAVEEYLVATCHLTPDQATKASKSISHLKSPSRPDAVVAFLAGLGLSAADIAAAVAYDPRLLCAEVDRTLAPRLAELAGLGLSPSQIARLVLVDPARFRRPTVISKLQYYVPLFGSFETLLQALKNNSYLLSSDLEKVVKPNVALLRECGLGACDIAKLCIPLPRLLTTSPERVRDMVAQAENVGVRRGSKMFRHAILAVAYISEEKIAAKMQFLMKTLKWSDAEARIAVSKLPVVLRSSEDKLSRVSEFLISEVGLEPAYIAYRPAMLTYSLERRLMPRHCVLKYLKDNGLIESDKSYYSAVQVTEEVFVEKYISPYEDTAPHLAEDYAAVSSVKIPTRFRLKGPKTGHASAQTA

SEQ ID NO: 59740 - protein, 783 aa, Arabidopsis thaliana
MDAIKCSSSFLHHTKLNTLFSNHTFPKISAPNFKPLFRPISISAKDRRSNEAENIAVVEKPLKSDRFFISDGLPSPFGPTVRDDGVNFSVYSTNSVSATICLISLSDLRQNKVTEEIQLDPSRNRTGHVWHVFLRGDFKDMLYGYRFDGKFSPEEGHYYDSSNILLDPYAKAIISRDEFGVLGPDDNCWPQMACMVPTREEEFDWEGDMHLKLPQKDLVIYEMHVRGFTRHESSKIEFPGTYQGVAEKLDHLKELGINCIELMPCHEFNELEYYSYNTILGDHRVNFWGYSTIGFFSPMIRYASASSNNFAGRAINEFKILVKEAHKRGIEVIMDVVLNHTAEGNEKGPIFSFRGVDNSVYYMLAPKGEFYNYSGCGNTFNCNHPVVRQFILDCLRYWVTEMHVDGFRFDLGSIMSRSSSLWDAANVYGADVEGDLLTTGTPISCPPVIDMISNDPILRGVKLIAEAWDAGGLYQVGMFPHWGIWSEWNGKFRDVVRQFIKGTDGFSGAFAECLCGSPNLYQGGRKPWHSINFICAHDGFTLADLVTYNNKNNLANGEENNDGENHNYSWNCGEEGDFASISVKRLRKRQMRNFFVSLMVSQGVPMIYMGDEYGHTKGGNNNTYCHDNYMNYFRWDKKEEAHSDFFRFCRILIKFRDECESLGLNDFPTAKRLQWHGLAPEIPNWSETSRFVAFSLVDSVKKEIYVAFNTSHLATLVSLPNRPGYRWEPFVDTSKPSPYDCITPDLPERETAMKQYRHFLDANVYPMLSYSSIILLLSPIKDP

SEQ ID NO: 59741 - protein, 181 aa, Brassica napus
MPLSLRLAPSPTALAPTTGGFSPAKKQCRIPYSGVATTTTRIGFCSLDYVKRGDSSVVRCSLETVNVSVGQVTEVDKDTFWPIVKAAGEKIVVLDMYTQWCGPCKVIAPKYKALSEKYEDVVFLKLDCKPENRPLAKELGIRVVPTFKILKDNQVVKEVTGAKYDDLVAAIETARSASSSG

SEQ ID NO: 59742 - protein, 228 aa, Enterococcus faecalis V583
MPKLVFSRHGLSEWNALNQFTGWADVDLAPEGVEEAKEGGRKIKEAGIEFDVAYTSVLTRAIKTCNYLLEYSDQLWVPQIKSWRLNERHYGKLQGLNKKETAEKYGDEQVHIWRRSYDTLPPLMEATDEGSAANDRRYAMLDQRDIPGGENLKVTLERALPFWQDEIAPALKDNKTVLVAAHGNSLRALAKHIEGISDEDIMDLEIPTGKPLVYELNDDLTVKEKYYL

SEQ ID NO: 59743 - protein, 177 aa, Pinus taeda
PAQTEAASYYPAAPHHGVEHGHGHEGQLTPEEAEQQKHTGLMGKLHRTNSSSSSSSSDEEGEGGKKKEGGRKKKGSKDKSKEKLPGAGQHSSDQCGGKEEKKTGLLDKIKEKIPGHQEKLSGGGTHSSSDECGGKEEKKTGLLDKIKEKIPGHQEKLPGDGKHSSDEHGGEEEKKLG

SEQ ID NO: 59744 - protein, 226 aa, Enterococcus faecalis V583
MNLKQMVGIEAAKYVEDGMIVGLGTGSTAKFMVDEIGRRVKEEGLSIVGVTTSKETEKQALALGIPLKSIDEVPYVDLTIDGADEISADFQGIKGGGAALLFEKIVATYSKKCIWIVDKSKMVDDLGAFPLPVEVVPYGSRQLVHLFEEKGYHPTLRLNAAGETLITDGGHHIIDLHLEKITDPEALGSYLDNLVGVVEHGLFLNMVSMVIVGYEDGPKTLHVPAR

SEQ ID NO: 59745 - protein, 336 aa, Deinococcus radiodurans R1
MARRRLPSMTHGNSSQSDRPRIISPLAPRADAAEVVRGVDLKGKTAVVTGGASGLGTETARALLLAGAHVILPVRDRAKGERVAAELRQSTGGTVELVDLDLGSLASVRRGAAEIRQLAPRIHILINNAGVMATPQSRTVDGFETQFGTNHLGHFLLTRELLPALMAAAPARVVALTSSGHRRSDIVWDDLNFERRPYDPWDAYGQSKTANALFAVGLTQRYADQGLTANAVHPGGIMTGLQKFVPLEDQRRMGWQDEHGTLNPVFKTPAEGASTSVWAATSPQLYGVGGLFLEDLQHSTPLDESAPNPLFGYKPYALDHESARRLWALSEALVGE

SEQ ID NO: 59746 - protein, 407 aa, Medicago truncatula
MYDTVAGKQEGTSKAKTLIIIFVSITVAVALLSCWVYSYWRKNRLSKGGMLSRTITPISFRNQVQRQDSFNGELPTIPLTIIEQSTDDFSESYKLGEGGFGPVYKGTLPDGREVAVKRLSETSSQGSEEFKNEVIFIAKLQHRNLAKLLGYCIEGDEKILVYEYMPNSSLDFHLFNEEKHKHLDWKLRLSIINGIARGLLYLHEDSRLRVIHRDLKASNVLLDDEMNPKISDFGLARTFDKDQCQTKTKRVFGTYGYMAPEYAMAGLFSVKSDVFSFGVLVLEIIYGKRNGDFFLSEHMQSLLLYTWKLWCEGKCLELIDPFHQKTYIESEVLKCIHIGLLCVQEDAADRPTMSTVVRMLGSDTVDLPKPTQPAFSVGRKSKNEDQISKNSKDNSVDEETITIVSPR

SEQ ID NO: 59747 - protein, 522 aa, Oryza sativa (japonica cultivar-group)
MAISLITSLLFSLPQQWQPVVLTGLLPVIVSLVLLARKGRLKMPPGPEQVPLLGNLHQLAGPQPHRALRDLARVHGPVMRLRLGKASAVVLTSAEAAWEALRGHDLDCCTRPVSAGTRRVTYGMKNVAFAPYGAYWREVRKLLMVELLSARRVKAAWYARHEQVEKLLSTLRRAEGKPVALDEHILSLSDGIIGTVAFGNIYGSDKFSQNKNFQHALDDVMEMLSGEGSSAEDLQLPAAVGRLVDRLTGFAARRERIFRQLDSFFEMVIEQHLDPNRAPPENGGDLVDVLIGHWKKNEPRGTFSFTKDNVKAIIFSTFVAGIDTNAATILWAMSELARKPRVLKKVQAEIRAAVGVNGRVQPDDITKLSYLRKVVKETLRLHPPTPLLLPRETMRHIQISGYDVPAKTRIYVNAWAIGRDPASWPDEPEEFNPERFEANEIDFKGEHPELMPFGTGRRICPGMAMAMANVEFTLANLLFAFQWSLPEGTTPDNVCLEEEGRLVCHRKTPLVLVPTVYRHGLE

SEQ ID NO: 59748 - protein, 661 aa, Medicago truncatula
MTCTTRFLSFILLHHFLFMTLTNAQSPFYMYSYCQNSTEKTVNTSYQSNVNNFLSWTTSDSAKGTVSNHNTIGSNNSNYNDTVYGFYDCLGPNTRSFCQFCINTAFREIAKYCPNSVSAIIWYDVCIMGYTNQNPSGRVFLEPSWNVTGSKNVKDSTELGKAENSMTSLIRKVTTVASLNWATDEFNWSDTDKRYGLVQCNTELSKDGCRQCLEAMLERVPQCCGTKVGWVVLCPSCGLKIDDYNFYEQQTGSPSPLPNPGKQEGASHTKTLIIIVVSVLVAVALLSCYGYYYWKKKGLSEGGLLLRTVTPMSFRDHVQRDDSLHGDLPIIPLSVIQQATDNFSESSKLGEGGFGPVYKGTLPDGTEVAVKRLAEMSGQGSEEFENEVIFIANLQHRNLVKLLGCCMEENEKILVYEYLQNSSLDFHLFDKEKHKHIDWRLRRSIINGIAKGLLYLHEDSRLRVIHRDLKASNVLLDDEMNPKISDFGLARRFEKDQCPTKTERVFGTYGYMAPEYAMAGLFSVKSDVFSFGVLVLEIIYGKRNGEFFLSEHMQSLLLYTWKLWCEGKSLELIDPFHQKMYIESEVLKCIHIGLLCVQEDAADRPTMSTVVSMLGSETVDLPKPTQPAFSVGRKPKNEDQSSKNYKDNSVDEETITIVSPR

SEQ ID NO: 59749 - protein, 266 aa, Arabidopsis thaliana
MSSPVKKMKKKTTTSPILSPTPHSTQILSLPVDLLISILARVSRLDYPILSLVSKSFRSLIASPELYETRSLLGRTESCLYLCLGIPSDFNPRWFTLCRKPKPSGHVMAAISIPNSRPVHCSGLVAVGSDIYNIGGSIINEHSSSVSILDCRYHTWRDAPNMLVERNSHAANVIDGKIYVAGGSRDSNSSNWMEVFDIKTQTWEPVLNPIADGCDRRIRKSAVIEEAICLFGYKGVGVAYNPRIDKWEAIGEVNYLDLGWVWLLVA

SEQ ID NO: 59750 - protein, 257 aa, Sulfolobus solfataricus P2
MSILSLVGLGISKKFITDSAIETLSNSDIIIFDRYTSRSCDINVDVLRRLVKGEREFIEADRSLLENNSKAIIDYLDKGYNVSIASIGDALIATTHVSLLIEAKHRGHEVKVIPGISVHCYLISKSLLSSYKFGKSVTVTFPYNDFIDPTPYNVIKDNKERGLHTILYLDLKNEKAMTANEALQILLRLEERHKKSVLSKSDIIIVGARLGCDDERIIALKVEEATSFDFGNTPHIIIIPGNLHYMEADAIKWILRS

SEQ ID NO: 59751 - protein, 337 aa, Xylella fastidiosa 9a5c
MNAPQAPVLVADIGGTNARFALANPTLTSAPLLNDSLREFAVIEFPSLSEAAQHYLHHIGIHTTKGVFAIAGHVDGDEARITNHPWVITRTRTATMLGFDTLHLINDFVAQAMAISVLGPQDVIQIGSAKWEQVPLSAATRNYGIIGPGTGLGVGGLVIRNGRCYPLETEGGHVSFPPSTPEEIRILEILSQQFGRVSNERLISGPGLVNIHRALSEIDGIDPGPLRPQDITMRAADGDIRATRTINLFCNIFGAITGDLVLIQGAWDGVFLTGGLVPKLLNSIQHSGFRQKFEHKGRFSAIMARIPSLAVIHPHPGLLGAAAYARDTEPVPQDIKA

SEQ ID NO: 59752 - protein, 460 aa, Burkholderia thailandensis E264
MHRFIIVGGGAGGLELATRLGDRYGARGNRPARALVTLVDRYPTHIWKPLLHEVAAGSMDPFTQELEYAAQARWHGFEFHQGELISLDRASRRVTLAPVADNDGAELLPQRELEYDTLVIAIGSTTHYFGVQGAQEHSIALDTVAEAERFRKRLIAACMRAEHQPVEPAVQPAVAAGPADAAAPSASPALAGPRIQVAIVGGGATGVELSAELRNTAQVLSAYGLHKLDPRHDVGIVLIESGPRILPALQERVSTATAELLEKLGVRLMLGERVTEVAPGVVRTASGKSVRADLTVWAAGIKAPSVLARLDGLEVNKLGQLIVRRTLQTETDPNVFALGDCAGCEWPGHERNVPPRAQAAHQQASFMLRALASRLEGRPLPEFTYRDFGSLVSLGHFSAVGNLMGGLIGGNMLIEGLFARFMYMSLYRLHVAALHGYPRMVLDTVAHWLRRSTLPRVKLH

SEQ ID NO: 59753 - protein, 328 aa, Burkholderia thailandensis E264
MHAWSAQHVPPQGGKVAVVTGANSGLGWQIAQTLAAKGAQVVMGCRDTAKGELAAHAIRTRYPRARIEVEALDLADLASVCRFADAVADRHGRVDILCNNAGVMFLPLRRTRDGFEMQMGTNHLGHFALTGLLLPALRASHRARVVTMSSGFNRLGKIRLDNMLAERGYNKYRAYCDSKLANLMFTLELQRRFDHAGLSMRSIAAHPGYAATNLQFAGPVMENSSLGSFAMRLSNRLVAQPADVGALPAIHAATAVDIEGGAYIGPAHLCETRGYPANARIPHQARDVRMGKRLWEKSEQLTGVRYLDTPPPGSRRGASRYDATFRAL

SEQ ID NO: 59754 - protein, 133 aa, Medicago sativa
MASSSDSWLKEYNEAMKLADDISGMISEHNSFPSSGPETQRHASAIRRKITILGTRLDSLQSLLSKLPVKSEKEMNRRKDNLANLRSKVNQMASTLNMSNFANRDSLLGPEIKPDAMSRTVGLDNNGLVGLHG

SEQ ID NO: 59755 - protein, 376 aa, Nerium oleander
MAIDCMFKSKSTVPEMCKDEKKPLVFDASLLQHQTHIPTEFIWPEHEKPCPNPREHPVPLIDLGGFLSGNPVAAMEASRLVGEACQEHGFFLVVNHGVDADLIADAHRYMDYFFELPLCDKQRAQRKLGEHCGYASSFTGKISTKLPWKETLSFRFSAEKRSSHMVEEYFEKTLGDEFAHLGNVYQEYCNAMSTLSLGIMELLGMSLGISRESFKDFFQDNESIMRLNYYPPCQKPELTLGTGPHCDPTSLTILHQDTVGGLQVFVDGEWRSISPNVSAFVVNIGDTFVALSNGRYKSCLHRAVVNNKTPRKSLAFFLCPKEDKVVSPPSELVDSNNPRIYPDFTWAKLLEFTQKHYRADMNTLQIFSNWLQQKNS

SEQ ID NO: 59756 - protein, 403 aa, Erythrobacter sp. NAP1
MSVQIEESPTTDGEVITNYTLNFGPQHPAAHGVLRMVMELDGEVIERVDPHVGLLHRGTEKLIEQKTYLQALPYFDRLDYCSPLCQEHSYVLAIEKLLNIEVPERAQYLRVLFAELTRICNHMLNIGAHVMDVGAMTPNLWVFELREDCLNFFERASGARMHSAWFRPGGVHQDVPEKLLVDIGDWLDNRFFQLFDDAMSLVMDNRIFKQRNVDIAVVSRDDAVAWGFSGPMIRAAGIPWDLRKSQPYDVYDRMEFDIPVGTNSDCYDRFMVRVQEVRESAKIIKQCLRDMPEGPIASTDGKVSPPKRGEMKQSMESLIHHFKLYTEGFHVPAGEVYVATESPKGEFGVYLVSDGTNKPYRCKIRPTAFSHLQAMDMMSKGHMLADATAILGAIDVVFGECDR

SEQ ID NO: 59757 - protein, 848 aa, Gibberella zeae PH-1
MDEPSEKRVAEDEINSAERQDDGISLKDDTVLTKAQLLGATPDEVIEAEEHGRTLDLEEAKKLAETLVYFHEHDPNFSSESVIRLQSFLANEELFQNPEKNEEAISDIKTEISLLTINSPYPEVRAVVSNKDDPSTPAGTIRAWTIGLLFVVLQSFVNQLFSVRQPSIRLQAPVIQLLSYPLGKAWEKWLPVGEFTLFGSQVQLNPGKFNQKEHMLISIMANVSTSLPHSRYIIFTSWLKKYFDLPFAADFGFQICLSLSMNLLGFGLAGLVRRFLVYPSFCIWPRSLATVALNQSLHNESGNSSVLGPFKKIYSMTRYRFFMLSFAAMFVWFWFPDLIVSALSLFNWLAWISPNNFNLAAITGVSKGLGFNPLPTFDWNIATYYIDPLLVPFHVTFNMFLGAVLGGITIIAMYWNNTYNTGYLPINTNTMFDNTGAKYNVSSILDDRGLLDVEKYQAYSQVHIAASSVTYYAVISYAAIYHWNDIKLGFVSLYQSFKKDSKVNQFKDVHTKLMEKYREVPEWWYMILNLTPLEIVGVAFGVASVAAWPTNTSVGTVFFGLALAVIFTVPTGIIFATTGIEVEFNVLAEFIGGAWQPGNALAMNFFKGFGYVTVAHALDFANDLKLGHYLKIPQRQTFWCQTVATIVSAVVCTGVMNFQIRNIPDICESGQKDRFTCPGVESYFTAAVLFGSLAPQRVFGQGGMYTALLAAFPVGLAFPVLYYYATRNLPKTHFLTKLHPVVLFSGGHIWSPYNLAYVWPAVIPGWISWVIVRKRYLAFWAKYNYVLSAAWQTGIALSAVVIFFAVSYHGASVNWIGNHADSGCEANACTRLKLPEGEIFGPQPGTFP

SEQ ID NO: 59758 - protein, 339 aa, Nerium oleander
MVVATPTPVLNEKITRAVELPMIDLMGERAEVSKLMVKACQEFGFFKLVNHGVSQDVIATMEEESWQFFSRPSSEKERAGPPDPYGYGCKNIGFNGDVGEVEYLMLKANPLSVPPHASNDPTKFSSAVSSYVAAVRELACEILDLIGEGLRVPDTSVFSKLIKDVESDSLLRLNHYPPLHRDRDTSPSSLHHHVRHNPPHQSNSRIGFGEHTDPQILTILKSNAVAGLQISVDEGIWVPVTPHPTAFFVNVGDVLQAMTNGRFTSVRHRAMVNSYESRMSMPYFFSPPLRARISPIPEMVTTQNPRLYRSFTWADYKKATYTQRLGESRLNLYKLQSDE

SEQ ID NO: 59759 - protein, 177 aa, Pinus taeda
PAQTEAASYYPAAPHHGVEHGHGHEGQLTPEEAEQQKHTGLMGKLHRTNSSSSSSSSDEEGEGGKKKEGGRKKKGSKDKSKEKLPGAGQHSSDQCGVKEEKKTGLLDKIKEKIPGHQEKLSGGGTHSSSDECGGKEEKKTGLLDKIKEKIPGHQEKLPGDGKHSSDEHGGEEEKKLG

SEQ ID NO: 59760 - protein, 147 aa, Marinobacter sp. ELB17
MEQTPANECQPAWLDTIRWTADGLVPAIAQDADSGDILMMAWMNAESLQLTVTEGQAVYWSRSRGKLWRKGESSGHQQVIKDIRLDCDADVILLKVEQKGGIACHTGRRSCFYQSLQHGQWQSVDPVLKDPSAIYNTAKSAKEPNGE

SEQ ID NO: 59761 - protein, 623 aa, Zea mays
MVRPFPLFFFIVVVLLVRSPAGAAADGGGNATTDSCPLDLGYVRTFPWDPLPCAGGAPNVTACCQTLLSLFGIGLAERLRGTGRFRLPSAAASTACIESFTDLISAASASLSGSSLVAECFPDPSQFAITSSYCAGVSTATEFVAAVGNDSAQALNSSCGPDLASPATCALCYSAGVAATAHLTSAAANDSKSGSCFYLTVLYAAGISNSAGPTYPPTAACALGLGLLSPAPTPSKSSHAAVYAATIPIAFVLLASLFGFFLWRKRTRANSKKKKNHKICEEGSGDRRSHLRPNTGSVFFDIADLAKATGGFAERFLFCRGGFGAVYRGVLADGSVVAVKKMLDPDMEGGDEEFANEVEIISHLRHRNLVPLRGCCITDEDVEEGKQRFLVYDFMPNGALEDFIFRDREAATKLPPLAWAQRRSIIMDVARGLEYLHYGVKPAIYHRDIKSTNILLDSEMRARVADFGLARRSREDKKHLTTRVAGTHVLPGAGIMSGRRVLDMTAPAGPVLITDWAWTLVKAGQAREVLDEALSTAESPRSGVMERFVLVGILCAHVMVALRPTIGDAVRMLEGDMDVPELPDRPLPYGHNAMFSEAGSTFSISPAFSGPLAPFIDNGDMLR

SEQ ID NO: 59762 - protein, 344 aa, Nitrobacter vulgaris
MSQELTLQQRMDGEAGSDPLRQAVKEAVAALARAAVDISDLTCRGALAGITGQAQGRNTDGDIQKDLDVRADQIIRDALGKLPIAALASEEMADLDILNPAAPICVAFDPLDGSSNINTNMSVGTIFSIMPTPSDVNAAFRQAGSAQLAAGFVVYGPQTSLVLTLGRGVDIFTLDRADRVFKLTGSSVQIPTDANEFAINASNRRHWDLPVRAYIDECLAGADGPCGKNFNMRWIGSLVAEAFRILIRGGIFLYPGDARDGYEEGRLVVYEAHPMAFIVEQAGGGASTGRKRVLDIVPDSLHQRVPLIMGSIKNVQRLEHMHTVPDVALEANAPLFGNRGLFRV

SEQ ID NO: 59763 - protein, 255 aa, Arabidopsis thaliana
MAEVVLHIYDVTNSGSEKTNNTIVQINRFFKDGIGLGGIFHSAIQVYGNDEWSYGYCEQGTGVFSCPSGKNPMYTYREKIVLGKTDCTIFMVNQILRELSREWPGHTYDLLSKNCNHFCDVLCDRLGVPKIPGWVNRFAHAGDTALEVAGNTAMRVKQAKTELVSASKVAYRFLSNVTSNITNGSNGSSGSPQRPGTLNNSDNGSFRLQGSWLKGILNTAKPSTSTEIGNKEEDTNHTITNQKKQNRDSDVLLFQ

SEQ ID NO: 59764 - protein, 524 aa, Medicago truncatula
MEVFVFPTGTTIIICVLSVLLAVLPWDLFNNFWLKPKRLEKLLKGQGLQGEPYNLSVLKDKSKQNYMLKLQQEDKSKSIGLSKEVAPSIFSTLHEAVHKYGKNSFLWDGATPSVIITDPDQIKEIFNRMEDFPKSKFISISKYFGVGIAHQEGEKWAKHRKIVNPAFHIEKLKGMLPAFSHSCNEMISKWKGLLSSDGTCELDVWPFLQNLTCDVISRTAFGSSYAEGAKIFQLLKKQGFILMTAPRTNIPLWRLLPTTAERRMKEIERDIRDSLEGIIEKREEALKNGEATNDDLLGILLQSNHAEKQGHGNSKNIGMTTHDVIDECKLFYLAGQETTSSLLVWTMVLLGRYPEWQERARQEVLQVFGNQNPNSEGLSQLKTVTMILYEVLRLYPPVIYFNRAVQKDLKLGKLLLPTGTNVALPIVLIHHDQDLWGDDAKEFKPERFAEGIAKATKGQVSYFPFGWGPRICLGQNFTLLEAKIAISLLLQNFSFELSPNYAHLPTMVLTLMPKNGAIIILHKL

SEQ ID NO: 59765 - protein, 523 aa, Medicago truncatula
MEVFVFPTTTTIIIFVLTVLLAVIPWHLFNNFWLKPKRFEKLLKAQGLQGEPYKLPFFVDNSKQNYMLRLQHEDKSKFIGLSKEAAPSIFSPFHQTLHKYGNNSFLWEGTIPRVIITDPDQIKDVFNKTEDFPKQKLRPIALYLSVGIVHHEGEKWATHRKIVNPAFHIEKLKGMLPAFSHSCNEMISKWNGLLSSDGTCEIDVWPFLQNLTCDVISRTAFGSSYAEGTKLFQLLKKQGVLLMKELQTNTPLWPLPTTNERMMKEIERDIRDLLEGIIRKREKELRNGETTNDDLLGMLLQSNHAENQGHGNSKSIGMTTQEVIDECKLFYLAGQETTSSLLVWTMVLLGRYPEWQERARQEVLQVFGNQNPNFEGLSQLKIVTMILYEVLRLYPPIIGLVRALRKDLKLGNLLLPGGTQVSLPVHLIHQDQDLWGDDAKKFNPERFSEGIAKATKGQVSYIPFGWGPRICLGQNFALLEAKIAISLLLQNFSFELSPNYVHVPITVLTLQPKNGASIILHKL

SEQ ID NO: 59766 - protein, 545 aa, Medicago truncatula
MENGKDVYVSLLNLNDPTTLDISLMTFLHNTTRHNPIPRQKHKMEVFVFPTGTTIIISVLSVLLAVIPWYLLNKLWLKPKRFEKLLKAQGFQGEPYNLSVFKDKSRQNYMLKLQQEDKSKSIGLSKEAAPSIFTPIHQTVHKYGKNSFLWEGTIPRVIITDPDQIKDVFNKIDDFPKPKLRSIAKYLNVGILDHEGKKWAKHRKIANPAFHLEKLKVMLPAFSHSCNEMISKWKGLLSSDGTCEIDVWPSLQNFTCDVISRTAFGSSYAEGTKLFQLLKKQGFLLMTGRHTNNPLWGLLATTTKTKMKEIDREIHDSLEGIIEKREKALKNGETTNDDLLGILLQSNHAEKQGHGNSKNIGMTTQDVIDECKLYPEWQARAREEVLQVFGNQNPNNEGLSQLKIVTMILYEVLRLFPPLIYFNRALRKDLKLGNLLLPEGTQISLPILLIHQDHDLWGDDAKEFKPERFAEGIAKATKGQVSYFPFGWGPRICLGQNFALLEAKIAVSLLLQNFSFELSPNYVHVPTTVLTLQPKNGASIILHKL

SEQ ID NO: 59767 - protein, 1016 aa, Escherichia coli
MQVSRRQFFKICAGGMAGTTAAALGFAPSVALAETRQYKLLRTRETRNTCTYCSVGCGLLMYSLGDGAKNAKASIFHIEGDPDHPVNRGALCPKGAGLVDFIHSESRLKFPEYRAPGSDKWQQISWEEAFDRIAKLMKEDRDANYIAQNAEGVTVNRWLSTGMLCASASSNETGYLTQKFSRALGMLAVDNQARVCHGPTVASLAPTFGRGAMTNHWVDIKNANLVVVMGGNAAEAHPVGFRWAMEAKIHNGAKLIVIDPRFTRTAAVADYYAPIRSGTDIAFLSGVLLYLLNNEKFNREYTEAYTNASLIVREDYGFEDGLFTGYDAEKRKYDKSSWTYELDENGFAKRDTTLQHPRCVWNLLKQHVSRYTPDVVENICGTPKDAFLKVCEYIAETSAHDKTASFLYALGWTQHSVGAQNIRTMAMIQLLLGNMGMAGGGVNALRGHSNIQGLTDLGLLSQSLPGYMTLPSEKQTDLQTYLTANTPKPLLEGQVNYWGNYPKFFVSMMKAFFGDKATAENSWGFDWLPKWDKGYDVLQYFEMMKEGKVNGYICQGFNPVASFPNKNKVIGCLSKLKFLVTIDPLNTETSNFWQNHGELNEVDSSKIQTEVFRLPSTCFAEENGSIVNSGRWLQWHWKGADAPGIALTDGEILSGIFLRLRKMYAEQGGANPDQVLNMTWNYAIPHEPSSEEVAMESNGKALADITDPATGAVIVKKGQQLSSFAQLRDDGTTSCGCWIFAGSWTPEGNQMARRDNADPSGLGNTLGWAWAWPLNRRILYNRASADPQGNPWDPKRQLLKWDGTKWTGWDIPDYSAAPPGSGVGPFIMQQEGMGRLFALDKMAEGPFPEHYEPFETPLGTNPLHPNVISNPAARIFKDDAEALGKADKFPYVGTTYRLTEHFHYWTKHALLNAILQPEQFVEIGESLANKLGIAQGDTVKVSSNRGYIKAKAVVTKRIRTLKANGKDIDTIGIPIHWGYEGVAKKGFIANTLTPFVGDANTQTPEFKSFLVNVEKV

SEQ ID NO: 59768 - protein, 389 aa, Arabidopsis thaliana
MSSKRMDSGSKDIISNLPDALLCHVLSFLPTTEAASTSVLAKRWRFLLAFVPNLDLDNMIYDRPKMGRRKRLELRKSFKLFVDRVMALQGNAPLKKFSLRCKIGSDPSRVNGWVLKVLDRGVEELDLYIASEYEYPLPPKVLMTKTLVSLKVSGTDEFTIDVGEFFLPKLKTLHLSAISFGDEGGPPFAKLISACHALEELVMIKMMWDYWEFCSVSSPSLKRVSIDCENIDENPKSVSFDTPNLVYLEFTDTVAVKYPKVNFDSLVEASIGLRMTPDQVFDARDLVNRHHGYKRCKGANAADFMMGVCNVKTMYLSSEALEVLTFCCKKAIPVFNNLIHLTVETDERVDWESLPILLKNCPNLETLIFEVPSHILFLHDLTHFFSNTG

SEQ ID NO: 59769 - protein, 1360 aa, Mycobacterium bovis AF2122/97
MSFVLVSPETVAAVATDLKRIGASLAHENASAAASTTAVVSAAADEVSTAVAALFSQHAQGYQAAAAQVAAFHSRFVQALTAGAGAYAFAEAANASPLQSAMGAVSASAQTLLSRPLIGNGANATTPGGNGGDGGWLFGSGGNGAPGAAGQSGGNGGSAGLWGNGGAGGAGGSGGAAGGNGGNGGWLFGAGGTGGIGGTGAPGAMGGTGGNGGNGALLIGGGGLGGAGGMGGTGGGTGGTGGNGGNGALLIGAGGVGGAGGIGGQGTGAGGAAGAGGTGGNGGAGGLFMNGGDGGAGGQGGDGAAGDAAASAGGTGGKGGQGGDGGTGGAGGAGPVLFGHGGAGGMGGQGGTGGMGGAGGDGTTVIAAGTGGEGGTGGTGGTGGNGADAAAVVGFGANGDPGFAGGKGGNGGIGGAAVTGGVAGDGGTGGKGGTGGAGGAGNDAGSTGNPGGKGGDGGIGGAGGAGGAAGTGNGGHAGNTGDGGDGGTGGNGGNGTGGVNGADNTLNPDTPGGAGEPGGAGGAGGAGGAAGGPGGTGGTGGNGGNAGNNSTNAPVGGEGGAGGDGGAGGAGGAANGGTAGSQGTGGVGGDGGAGGNGGGGKAGTGNSGNFGVDGEAGFSGGAGGNGGVGGAAGANGGTGGSGGNGGDGGAGGIGGAGGNGIPGTGTEPAGGTGAKGGDGGDGGAGGAGGNAGGAGGNGGAGGQGGNAGQGGAGGAGGNAVIPGDGVGKAPHGGAGGSGGDGGKGGQGGSGGTGGSGAPIGGGAGGTGGSGGHAGKGGAGGIGAQGTTITVPGNGGNAGDGGNGGGGGAGGTGGDGATGTPAGNGGNGGNAGDGGNGGSGDFGGNTTSGASGSGGNGGNAGTAGSGGAGGTGGTGLSGGNGGNGGDGGNGAHGTVGAQFVPATSLPTPNGGAGGNGGTGSNGGAPGPAGAPGPTTGGNAGSQGIGGDGGNGGDGGKGGDGADAVNVVFMPTEPQAATGTAGSAGDPTGGNGGPGTPGSPMVAPPPPTPITQVQQGGDGGAGGTGSTNANDGTATGGKGGEGGVGSILGGPGGNGGTGGNASATGTNGVANAGNGGKGGDGGQFGAGGNGGAGGSVTDGSAGSTAGNGGNGGNATNGTIAGQPAGGNGSAGGKGGDGGNIAAGATGTAGNGGNGGNGNDGAVNAGTGGSGGNGGNAGGGGANGGDGGAGGAGGAGGRGGKGIDGGFGGDGGNGGSNNGTGAGGNGGNGGTGGVGSVGAAGGDGGNGGTGGFAGFGGTAGNGGSGGTGGAGGDGGTGGGGGNGGTGVIAGGGGTGGNGGASGAGGAGGTGGFAGNGNAGGNGGTGGASEDGDNGNAGSGATGGTGGNGGTGGDGGAAGLGGVA

SEQ ID NO: 59770 - protein, 246 aa, Triticum aestivum
MVDPEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFSVPAMYVAIQAVLSLYASGRTTGIVLDSGDGVSHTVPIYEGYALPHAILRLDLAGRDLTDSLMKILTERGYSFTTTAEREIVRDIKEKLAYVALDYEQELETAKSSSSVERSYELPD

SEQ ID NO: 59771 - protein, 898 aa, Streptomyces coelicolor A3(2)
MARYVYDFTEGGRDMAGLLGGKGSNLAEMTRLGLPVPPGFTLTTEACRSVLDTGGEPPGLWEEVAGHLTDLETGSGRLLGQPDNPLLLSVRSGARFSMPGMMETILDIGLDDDSVHGLAKVSGNERFAWDSYRRLVQMFGTTVMGVDPSLFERALAQLKEVRGVPDDVHLDAEDLARLVETYKNVIHQETGERFPQSPVEQLRRAVLAVFASWNGERARLYRRREHIADDLGTAVNVQRMVFGNLGSDSGSGVAFTRDPATGARGLYGDYLPNAQGEDVVAGIRNTVPLTELKRLDPGAYGRLRAHMETLERHYRDLCDIEFTIERGTLWMLQTRVGKRTAEAAFVLGADLADEGLITADEGLARVSGEGLARLMFPRFDTAVTGDVLARGVPASPGAAVGAAVFDSAEAVRRAADGERVVLVRQETTPDDLPGMIAAQAVLTSRGGKTSHAAVVARGMGKVCVCGADELTVDTGARRCTAPDGTIVEEGTVLSVDGTAGTVYAGAVPLVDSAVMRYLEAGAGGRATTGVVDAVARALARADAVRRLEVRANADTPQDAVRARRFGAQGIGLCRTEHMFLGERRKLVEEMILAGTDAGRERALAALLPLQREDFTGILEAMDGLPVTIRLLDPPLHEFLPDRADLAVRIATAEARGEEPDAHDAELLAAVGRMHEENPMLGLRGVRLGLVVPGLVAMQVRALGEAVAQRLTAGGAPRAEIMVPLVGDVRELRLVREEVERVLAEVSDTSGVPVTCPVGTMIELPRAALTAGRIAEDAEFFSFGTNDLTQTTWGFSRDDVEAEFFSAYLDRGVFPVSPFETLDRDGVGRLVGIAVEEGRATRPDLTIGVCGEHGGDPDSVHFFHSAGLDYVSCSPFRVPVARLEAGRAALDLADAGDSR

SEQ ID NO: 59772 - protein, 1460 aa, Mycobacterium bovis AF2122/97
MSFVLIAPEFVTAAAGDLTNLGSSISAANASAASATTQVLAAGADEVSARIAALFGGFGLEYQAISAQVAAYHQRFVQALSTGAGAYASAEAAAAEQIVLGVINAPTQALLGRPLIGDGANATTPGGAGGAGGLLFGNGGAGAAGAPGQAGGPGGPAGLWGNGGPGGAGGSGGGTGGAGGAGGWLFGVGGAGGVGGAGGGTGGAGGPGGLIWGGGGAGGVGGAGGGTGGAGGRAELLFGAGGAGGAGGAGTDGGPGATGGTGGHGGVGGDGGWLAPGGAGGAGGQGGAGGAGSDGGALGGTGGTGGTGGAGGAGGRGALLLGAGGQGGLGGAGGQGGTGGAGGDGVLGGVGGTGGKGGVGGVAGLGGAGGAAGQLFSAGGAAGAVGVGGTGGQGGAGGMGGSGADNASGIGADGGAGGTGGNAGAGGAGGAAGTGGTGGVVGAAGKAGIGGTGGQGGAGGAGSAGTDATATGATGGTGFSGGAGGAGGAGGNTGVGGTNGSGGQGGTGGAGGAGGAGGVGADNPTGIGGAGGTGGAGGTGGTGGAAGAGGAGGAVGTGGTGGVVGDVGNAGIGGTGGKGGAGGTGFAGGAGGAGGQGGSSGAGGTNGSGGAGGTGGQGGAGGAGGAGADNPTGIGGAGGTGGTGGAAGAGGAGGAIGTGGTGGAVGSVGNAGIGGTGGTGGVGGAGGAGAAAAAGSSATGGAGFAGGAGGEGGAGGNSGVGGTNGSGGAGGAGGKGGTGGAGGSGADNPTGAGFAGGAGGTGGAAGAGGAGGATGTGGTGGVVGATGSAGIGGAGGRGGDGGDGASGLGLGLSGFDGGQGGQGGDGGSAGAGGINGAGGAGGDGGDGGDGATGAAGLGDNGGVGGDGGAGGAAGNGGNAGVGLTAKAGDGGAAGNGGNGGAGGAGGAGDNNFNGGQGGAGGQGGQGGLGGASTTSINANGGAGGNGGTGGKGGAGGAGTLGVGGSGGTGGDGGDAGAGGGGGFGGAAGKAGGGGNGGVGGDGGEGATGLGLDLSGFAGGQGGQGGAGGNAGAGGINGAGGTGGTGGAGGDGAPATLIGGPDGGDGGQGGIGGDGGNAGFGAGVPGDGGIGGTGGAGGAGGAGGAGDAGADGDPSIDGGQGGAGGHGGQGGKGGLNSTGLASAASGDGGNGGAGGAGGNGGDGDGFIGGSGGTGGTGGDAGAGGLANTGGTAGNAGIGGAGGRGGDGGAGDSGALSQDGNGFAGGQGGQGGAGGNAGAGGINGAGGTGGTGGAGGDGAPATLIGGPDGGDGGQGGGAGFGSGVAGAAGAGGNGGKGGDGGTGGTGGTNFAGGQGGAGGRGGAGGNGANGVGDNAAGGDGGNGGAGGLGGGGGTGGTNGNGGLGGGGGNGGAGGAGGTPTGSGTEGTGGDGGDAGAGGNGGSATGVGNGGNGGDGGNGGDGGNGAPGGFGGGAGAGGLGGSGAGGGTDGDDGNGGSPGTDGS

SEQ ID NO: 59773 - protein, 395 aa, Bacteroides fragilis YCH46
MDSNHLSPLRKGVVGVQFLFVAFGATVLVPLLVGLDPSTALFTAGIGTLLFHLVTKGKVPIFLGSSFAFIAPIIKATELYGLAGTLSGMVGVAMVYFVMSALVKWQGIRLIERLFPPVVIGPVIILIGLSLAGTGVNMAKENWTLALLSLFTAVIVSIRAKGLLKLIPIFCGIIVGYIAALIFYDVDMSGVRNAAWLGFPQFVFPQFSWEPILFMMPVAIAPVIEHIGDVYVVNTVTGKDYVKDPGLHRTLLGDGLACLCAGLLGGPPVTTYSEVTGAMSLTKVTNPQVIRIAAITAILFSVIGKVSALLKSIPSAVLGGIMLLLFGTIACAGIANLVNNCIDLSRTRNIIIVSLTLTIGIGGAVLAWGEFSLSGIGLAALVGVGLNLVLPREER

SEQ ID NO: 59774 - protein, 1938 aa, Mycobacterium bovis AF2122/97
MSFVLISPEVVSAAAGDLANVGSTISAANKAAAAATTQVLAAGADEVSARIAALFGMYGLEYQAISAQVAAYHQQFVQTLRTGAASYMLAEATNVEQNLLNLINAPTQTLLGRPLIGDGANATTPGGAGGDGGLLFGSGGNGAPGAPGQAGGAGGSAGLLGNGGSGGAGGTGAPGGNGGNAGWLYGRGGVGGAGGIGGGTGGAGGHAWLFGHGGTGGIGGGPGGNGGWLLGNGGHGGAGGIGGGSGGAGGNGGWLLGNGGIGGAGGTGGGAGGTGGNAAWLLGGGGTGGAGGIGGGNGGHGGNGGWLLGNGGNGGLGGDGDGGTGGGHGGNGGNPGWLLGTAGGGGNGGAGSTGTAGGGSGGTGGDGGTGGRGGLLMGAGAGGHGGTGGAGGAGVDGGGAGGAGGAGGNGGAGGQAALLFGRGGTGGAGGYGGDGGGGGDGFDGTMAGLGGTGGSGGTGGDGGAPGNGGAGGAGQLLSHSGVAGASGKGGAGGTGGNGGAGSAGADAPAGSGAMGSTGFAGGAGGDGGNGGGSGASQGNGGNGGNGGTGGKGGTGGAGMNSLDPLLAAQDGGQGGTGGTGGNAGAGGTGFTQGADGNAGNGGDGGVGGNGGNGADNTTTAAAGTTGGAGGAGGAGGTGGTGGAAGTGTGGQQGNGGNGGNGGTGGKGGTGGAGMNSLDPLLAAQDGGQGGTGGTGGNAGAGGTGFTQGADGNAGNGGDGGVGGNGGNGADNTTTAAAGTTGGAGGAGGAGGTGGTGGAAGTGTGGQQGNGGNGGNGGTGGKGGTGGAGMNSLDPLLAAQDGGQGGTGGTGGNAGAGGTGFTQGADGNAGNGGDGGVGGNGGNGADNTTTAAAGTTGGAGGAGGAGGTGGTGGAAGTGTGGQQGNGGNGGNGGTGGKGGTGGDGALAGSSGGAGGKGGNGGDAGKAGTGSAPGTAGTGGDGGKGGNGGIGAAGTTGPVGTGASGGTGGSGGAGGTGGDGGAANGGTAGAGGAGGNGGKGGDGGAGVTSSTAGNSGGAGGSGGKGGDAGAGGAGATPGANGIAGNGGDGGDGAAGAVGISGATGAGDGGHGGTGGAGGNGGTGGAGGSGIDGVGGGTGGTGGNGGNGAIGGAGGDAGGSGNSGGNGGTGGKGGNAGAGGAAGSNGGTVGANGTGGDGGNGGAAGAATAGSNGGAGTGSAGGNGGTGGRGGSGGAGGDGIGGVGGGKGGNGADGEVGGAGGAGGSGPNTSPGGNGGQGGQGGSGGAGGAAGAGGAGGGANGTAGNGGQGGAGGTGGAGAASSATNGGSGGAGGTGGAGGTGGAGGDGVGGAGGGNGGHGGDAGDGGNGANGNNRSSGSFLAAGGTGGAAGDGGQGGQGGAGGGAGGQGGAGGAGGTGGNGGNITGGTAGTAGAAGNGGAAGKGGAGGQGGTGGGTGGQGGAGGDGGAGGTGGDRTVGGGTVPAGSGGQGGNAGGGGAGGQGGADGGSGGDGGDAGTGGNGGNGGNRNSGNGTGGAGGNGGGGANGGAGGAGGSGGGTGGNGGAGGDAGDAGNGGNGNGTGNGGNGGNGGIAGMGGNGGAGTGSGNGGNGGSGGNGGNAGMGGNSGTGSGDGGAGGNGGAAGTGGTGGDGGLTGTGGTGGSGGTGGDGGNGGNGGNGADNTANMTAQAGGDGGNGGDGGFGGGAGAGGGGLTAGANGTGGQGGAGGDGGNGAIGGHGPLTDDPGGNGGTGGNGGTGGTGGAGIGSLGGGTGGDGGNGGTGGNGGTGGEGGEVGGAGGTGGAAGNGGDGGTGGTGGGDGGAGGTGGTGGTGGLGDPRVGGSGGDGGTGGSGGAAGNGGNGGNAGAGGNGNGGTGGAGGIGGTGGNGGDAEPGVPPGAGGAGGAGTTGGKGGTGGNGSGTGSGGTGGDGGTGGGGGNGGTGWNGGKGDTGSGGGAGDGGKAPAGGTGGAGGDGGAGGKGGSGGV

SEQ ID NO: 59775 - protein, 403 aa, Parvularcula bermudensis HTCC2503
MAAFKTLDDLDVGGKRVLVRVDFNVPMDGDRVSDTTRLERAVPTVRELVDRKARVILLSHFGRPKGARVPEMSLRPVADAFAGVLGRPVSFVEESRGEIAERAVAGLADGDVLLLENTRFEAGEEKNAADYADDLAKLGDFYVNDAFSAAHRAHASTEGIAQRLPSAAGRSMQRELDYLALALAAPKRPVMAVVGGAKVSTKLDVLENLIEKADKLVVGGGMANTFLLAKGMDIGKSLAEPDLAATARSIADKAAAQGCALLLPKDVVVAKEFAPNPDTRVCAPDDVAADEMILDVGPESVDQYAAELEGCATLLWNGPLGAFETPPFHTATVELAKFGAKLSVAGALTSIAGGGDTVAALNVAQAAEDFTYVSTAGGAFLEFIEGKTLPGVAALETSAASSA

SEQ ID NO: 59776 - protein, 335 aa, Parvularcula bermudensis HTCC2503
MTVKVGINGFGRIGRLALRSMLEHGRTDIEVVAINDLGPVETNAHLLQYDSVHGRLPMTVSTGDGKLTVDGKSIAVFAERDPKALPWGDHGVDVVMECTGIFTDRDKAAQHLAAGAKRVLISAPGKDADKTIVYGVNHDVLTADDHVVSNASCTTNCLSPVAKVLNDAIGIEKGMMTTIHSYTGDQPTLDTMHKDLYRARAAAMSMIPTSTGAAKAVGLVLPELNGKLDGFAMRVPTPNVSVVDLKFIAARDTSVEEINAAIREAADGPMKGILGYTLVKNVSTDFNHDSHSSIFHMDQTKVMDGSLVSVLSWYDNEWGFSTRMADTALAMAKFI

SEQ ID NO: 59777 - protein, 201 aa, Sinorhizobium meliloti
MSEALNELASYLREARGALIADAEVKYGELTVTAKAENLIALLTFLRDDVQCGFVSFIDVCGVDYPQRPDRFDVVYHLLSPRQNQRVRVKVATGENEPVPSATSVFPGADWFEREAYDMYGILFTGHPDLRRILTDYGFEGYPLRKDFPLTGFVEVRYDNEAKRVVYEPVELKQEFRNFDFLSPWEGTEYVLPGDEKARPR

SEQ ID NO: 59778 - protein, 583 aa, Zea mays
MAVPPLLLVAVAVAALSILVLVVFAFRRCRRRRQRHPLQAAAVAPTPVAVQDEDIDRPLLSENQSDHSRQNISFLGSSVGEPSKIQTNRSNTSPRSHAIADTGRIYPAECCVTQGETHVINVENDTSEEFQLGSTLRRTPPPKWPTPDQKHRRRVSGDDNHNGSVPLKDNTYHSRLDLEVIAGPSHGISCSRQSSRPSMLPITLGRVPPSDLVLKDSEVSGKHAQINWNGKTLKWELVDMGSLNGTFLNSQAVHHPSAGSRHWGEPAELAHGDIITLGTSSKLSVQILLQNQRVPAGVGMASDPMVARRSGKKLPMEDISFCQCPLQGVEHFGLFGIFDGHGGDGAAKAVSKILPENLGYILSHPETKDRVQSCSDASDVLRYAFTLTEDTIDHQYEGCTGTALLIWFDQNKDCFAQCANLGDSACVMSVNGKTIDMTEDHRVTSATERARIARTGQPLRDGEARLSGLNLARMFGDKFLKEQDPRFSSEPYVSQAVRITKACTAFAVIASDGLWDVISTKRAVQLVVEGKERRSSGDATSAAARVASRVLDEARSLRTKDNTSVIFVDFDVLRRDPCISPVD

SEQ ID NO: 59779 - protein, 767 aa, Yarrowia lipolytica CLIB122
MDPGSVWSEIKYNACLFRHWSPYPQVRTVTDPFDDPEEECETLRVYVIGTIWVAIAAFVNQFFQPRQPPIQLSVTVVQLFLYPSGRLWQYIFPDWGFRYKGKRYSLNPGPWTQKEQLLATLMASVSNIPAYIDYNIFVQYLPMYFNQKFALNFGYMFMLMFTSQFMGFGMVGLLRKLAVYPAKAMWPTILPTLAVNRALLAPGRKENINGWTISRYLFFLIVTVGAFLYFWVPNYLFTALSTFNWMTWIKPQDLDLAAITGSISGLGFNPIPTFDWNVANGLVQVLFIPIPSLLNIYGGFAFGGLIIASVWYTNVYWAGYLPINSNAVFDNTGKEFDVSKILTNNLFDEKKYKEYSPPYYSAANLVLYGGFFALYPLSFFHLCFTEWHLMKNSLVDIYKSMRDWKKSNYYGFKDHFSTTMSRYPETPQWWYLAILLITFGMAIALIEHWDTKAPVWLLIVVIIFNFIFLIPFTVILSVSGAQLTLNVIIEMIVGYSIPGKAIAMMILKAYSVQIQSQAQNFISDQKTGHYGRLPPRAMFRAQMWATLCAGLVVIGVMQYQLTGIEHICDQKYQAEHEKFTCPGEMVFFSAAIVWSIIGPKKIFNKQYPMLRWCFLIGFGIAIIFAVIHKWGPDFYRKRRPDKKDQILKVQRRLQTFNPSVFVYGMLNYAPYNLSFMTGGIYAAVFFNMYVRNRWPAWWEKYVYIFGSAMNTGIAVSAIVIFFALQYTNVNLSWWGNNVSTAGIDLTGAGRLSIPKVGFFGPDSANFP

SEQ ID NO: 59780 - protein, 410 aa, Yarrowia lipolytica CLIB122
MSEANDTDTVTAGEFLERQAQLERDAKEAMPYDPSECTFYTQPARQLLFTCLTCSKKSGAPSVICYGCSIQCHSSHDLVELFTKRNMTCDCGTDRMKSFGGCNLRKNFANLDEACDTNKYNHNFDGRFCFCDKPYNEETDIMYQCLMPGCGEDWYHDVCIGVPSKRTHPEGVNVFDSLTEIEHHEEVLPDDHEFVCYKCVEEVPRLKAIWDLPGVVKMRLEPRLEPKATSGAKVSDTADLETKSSETCVVKTESASTAVAGSESTSDETDNVKKEKRNADEANALASHPSSKKLFSSDKPCNMFLSSNFRKIVCECKDPKIFGLTLTYPFLAEEEQVYEPPPDDDAGSSLLDAGTSALHNIPRQQAIDGMAAYNQIKDKLSAFFKPFAEGGKVVTDRDVTGFFEEMKKKS

SEQ ID NO: 59781 - protein, 172 aa, Triticum aestivum
  misc_feature (148)..(148): Xaa can be any naturally occurring amino acid
MHPTRREPSYMVDLQAAGLVISSGRPGGIVSPAELLVCHFTGIKALEDEYGSAEIVKQGVEVVQTALTKAFDQSQGGYNGKIVGLVISTKEASTSLASIIDAPASLHISRRLAEASTTNGTASIAAIYLVRSSLAWIPGIILLASTLXLGARLLMNLPGTRHTRLYPNVAMA

SEQ ID NO: 59782 - protein, 866 aa, Klebsiella oxytoca
MTETRTTCPYCGVGCGVIASRAPHGQVSVRGDEQHPANFGRLCVKGAALGETVGLEGRMLFPEVDGERATWPQALAAAGSRLREIIDRHGPQAVAFYASGQLLTEDYYAANKLMKGFIGAANIDTNSRLCMSSAVTGYKRALGADVVPCSYEDVENSDLVVLVGSNAAWAHPVLYQRLAQAKRDNPQMRVVVIDPRRTATCDIADRHLALAPGSDGGLFVGLLNAIAASGAISDDFNDAQRALTIAQDWDLDKVAQFCGLPRQQIADFYREFIAAPRAITLYTMGINQSASGSDKCNAIINVHLACGKYGRPGCGPFSLTGQPNAMGGREVGGLATMLAAHMNFEPDDLRRLARFWGSERLAQTPGLTGVELFAAIGRGEVKAVWIMGTNPVVSLPDSHAVSEALARCPLVIISDVVADTDTGRFAHIRFPALAWGEKSGTVTNSERRISRQRAFMPPPGEARADWWIVARVAEALGFGSAFAWQHPHEVFSEHAALSGYENDGQRAFDIGGLADLSREAWDALEPVRWPVSRSEAAWSVHKGWHRDGKLRMVPVAPQPTRATTDAFYPLILNSGRIRDQWHTMTRTGAVPRLMQHINEPVVEVAPADAQRYHLLEGELARVRSPKGVMVAKVTIGDGQRPGSLFVPMHWNNQFARQGRVNNLLAAVTDPHSGQPESKQTAVAIATWLPAWKGELFSRQPVPLPASLHWRRRAAQGIIHLSLAGDTRSRDWLVEWCQRQGWQMQVAEGGKVWNLLAWRAGELMLGWWSDASEPAIDADWIHAAFRVPPQNAARRHALLSGRKGGVEMPRGRIICSCFSVGERAIGEAIAGGCRTPGALGGKLKCGTNCGSCIPELKALLAAKLAQA

SEQ ID NO: 59783 - protein, 342 aa, Blastopirellula marina DSM 3645
MSIVSDDNKLAGDDFEDDAVSSEDWNESNLATETKPTAKTKKTRKPRRIEPPIAEKLTDRYKSGFAWIIFGWLAGIHVVALAAPFYFSWSGFAIFVVFYYLTGCVGITLCFHRMLTHTSYQVHYPTRMILAFIGGLAGEGSALDWVAMHRKHHAHSDQPEDPHSPEHGGLWAHMWWLFPFRNREEQRSIHERWAPDLLKEPGMRFLDYAFIPSHLVLGGLMAFAGYCYGGSYYATSWVLWGMFARLVVVLHVTWFVNSASHIWGYTNYETTDKSKNLWWVALTAFGEGWHNNHHAYPRMANHGHKWWEFDLTYNIIRVMKWTGLAWNVVDYKKKSKDGSAIH

SEQ ID NO: 59784 - protein, 524 aa, Medicago truncatula
MEVFMFPTGTTIIISVLSVLLAVIPWYLLNKLWLKPKRFEKLLKAQGFQGEPYNLSVFKDKSRQNYMLKLQQEDKSKFIGLSKEAAPSIFTHVHQTVHKYGKKSFLWEGTTPRVIIADPDQIKEVFNKIEDFPKPILKSIAKYLSVGIIHYEGKKWAKHRKIANPAFHLEKLKGMLPAFSYSCNEMISKWKELLSSDGTCEVDVWPFLQNFTCDVISRTAFGSSYAEGEKLFQLLKKQGFLLMTGRQTNNPLWGLLATTTKTKMKEIDREIHDSLEGIIEKREKALKNGEPTNDDLLGILLQSNHAEKQGHGNSKSNGMTTQDVIDECKLFYIAGQETTSSLLVWTMVLLGRYPEWQARARQEVLQVFGNQNPNIEGLNQLKIVTMILYEVLRLFPPLIYFNRALRKDLKLGNVSLPEGTQISLPILLIHQDHDLWGDDAKEFKPERFAEGIAKATKGKVSYFPFGWGPRICLGQNFALLEAKIAISLLLQNFSFELSPNYVHVPTTVLTLTPKNGASIILHKL

SEQ ID NO: 59785 - protein, 176 aa, Pinus taeda
PAQTEAASYYPAAPHHGVEHGHGHEGQLTPEEAEQQKHTGLMGKLHRTNSSSSSSSSDEEGEGGKKKEGGRKKKGSKDKSKEKLPGAGQHSSDQCGGKEEKKTGLLDKIKEKIPGHQEKLSGGGTHSSDECGGKEEKKTGLLDKIKEKIPGHQEKLPGDGKHSSDEHGGEEEKKLG

SEQ ID NO: 59786 - protein, 390 aa, Arabidopsis thaliana
MERLVSGETTTSSNMKKKKKKVSSTTNPSLPDDLVLVIIARVSILYYPILSLVSKSFRSLLASPELYKVRSLLGRRESRLYVCINMYSYKNGPSWFTLCRKPDRTTTSSNKEEDRSSGYVLARIPIPHSPLTQRYSLAAVGSNIYNIGVTRYHHLTSSSVWVLDCRSHTWRQAPSLPVELFRVSVSVLDQKIYVAGLHQEDGSDSLKNSVTVLDTETQVSDRVAIPCSVSQGKEIFISTSVGGKVNLVTGRKVVDYNPVEGSWEEVGDTMCEFMFSKCFCVVGNVLYSCAIDRVFRWYDTEVRTWRNLECLIGGRLPKLSPRAFVSLADYGGKLAVFWNQGVGDWQMLWCAVIALERRNTCEILGNVEWSDHVLHVPKIRSYYNALSATL

SEQ ID NO: 59787 - protein, 695 aa, Glycine max
  misc_feature (140)..(140): Xaa can be any naturally occurring amino acid
  misc_feature (198)..(198): Xaa can be any naturally occurring amino acid
  misc_feature (212)..(212): Xaa can be any naturally occurring amino acid
RSRPPSLSPGACACSLLHNSGARESSPKKTSEMMKRKLETLVWLTRKRSIQFLIGVFFLYLVLVTLELPFVFRTDFATVTTTRSPRLRSEEDSLRKESPARPLKTVSNADSPSQLAHRPNSSVVSALVLNTNTHFNPQVXTRTNRVFLTATSKVKHAPEVGRSLWEHLESGKPLTRTVAENRPGSCPGSCFGFLGFGXLDGVSQGSRSQLPXCGLTLGSHITVVGKPLAAKPDFEPKITVVTENEPVMVSHFVVELQGLKTVDGEEPPRVFHLNRPTRRDWSGKPVIELNTCYRMQWGSALRCDGWKSKADEDTVDSMAKCEKWIRDDEDHLEGSKATWWLSRLIGHTKKVTIDWPFPFSEGKLFVLSISAGLEGYHVSVDGRHVTSFPYRAGFTLEDATGLSLTGDIDVHSVFAASLPSSHPSFAPQRHLEFSTRWRTQPLPESGVELFIGVLSAGNHFAERMAVRKSWMQHRLIKSGVVVARFFVALHARQEINAELKKEAEFFGDIVIVPYLDNYDLVVLKTVAICEYGVHTVSAKYVMKGDDDTFVRVDAVIDEARKVPDGSSFYIGNINYYHKPLRYGKWAVTYAEWPEEDYPPYANGPGYILSSDIARYIVSEFDMRKLRLFKMEDVSMGMWVEQFNSSKPVHYSHSLKFCQFGCIEDYYTAHYQSPRQMMCLWDKLQRNSRPQCCNMR

SEQ ID NO: 59788 - protein, 387 aa, Glycine max
  misc_feature (242)..(242): Xaa can be any naturally occurring amino acid
MGLITVVKELWRAFFFLCSLQFWRMALLWTFSILYSYYQLFKDSLSHSQYFKPLIPEKCSLFSQKLVSYPRCSPFTTTFRPVCVITGATSGLGLAAAYELSKEGYVVVLVGRSQQLLSETITKIKDRNEHAHLEAFQVDLSSIESVVKFKTSLQQWLLDSDLHCSIQILINNAGILATSPRVTAEGYDQMIGTNYIGAFALTKLLLPLLESSPVSSKIVNVTSFTHRAVTDVQVDEGTVSGXRFFRSIQYPCAHIYEYSKLCLILFSYELHRQLCLMGKSHQIFVTVADPGVVQTNLMREIPAILSWLAIYVLKRLRLLQSPECGVDSIVDAALAPPGTSGAYFFGGNGRTINPSTLSRNAKLARELWESTSKLLSVTPFGAEGNSW

SEQ ID NO: 59789 - protein, 793 aa, Solanum tuberosum
MELLHCPSISTYKPKLSFHNHLFSRRSSNGVDFESIWRKSRSSVVNAAVDSGRGGVVKTAATAVVVEKPTTERCRFEVLSGKPLPFGATATDGGVNFAVFSRNATAATLCLITLSDLPEKRVTEQIFLDPLANKTGDVWHVFLKGDFENMLYGYKFDGKFCPEEGHYFDSSQIVLDPYAKAIVSRGEYGVLGPEDDCWPPMAGMVPSASDQFDWEGDLPLKFPQRDLVIYEMHVRGFTNHESSETKYPGTYLGVVEKLDHLKELGVNCIELMPCHEFNELEYYSYNSVLGDYKFNFWGYSTVNFFSPMGRYSSAGLSNCGLGAINEFKYLVKEAHKRGIEVIMDVVFNHTAEGNENGPILSFRGIDNSVFYTLAPKGEFYNYSGCGNTFNCNNPIVRQFIVDCLRYWVTEMHVDGFRFDLASILTRSSSSWNAVNVYGNSIDGDVITTGTPLTSPPLIDMISNDPILRGVKLIAEAWDCGGLYQVGMFPHWGIWSEWNGKYRDMVRQFIKGTDGFSGAFAECLCGSPNLYQKGGRKPWNSINFVCAHDGFTLADLVTYNNKHNLANGEDNKDGENHNNSWNCGEEGEFASIFVKKLRKRQMRNFFLCLMVSQGVPMIYMGDEYGHTKGGNNNTYCHDNYINYFRWDKKDESSSDFLRFCGLMTKFRHECESLGLDGFPTAERLQWHGHTPRTPDWSETSRFVAFTLVDKVKGELYIAFNASHLPVTITLPDRPGYRWQPFVDTGKPAPFDFLTDDVPERETAAKQYSHFLDANQYPMLSYSSIILLLSSADDA

SEQ ID NO: 59790 - protein, 878 aa, Solanum tuberosum
MATSPIQLAVHSRLLSYGSTESTKLVPSSSGNRGKIVCSLRKLELEDMNFSGIGRNNDQEAPRRAHRRKALSASRISLVPSAKRVPTYLFRTDIGGQVKVLVERTNGKYKVLVEVLPLELSYAHSELVMVWGLFRSDASCFMPLDLNRRGADGKSSTVETPFVQGPSGKVTVELDFEASLAPFYISFYMKSQLVSDMENSEIRSHRNTNFVVPVGLSSGHPAPLGISFQPDGSVNFALFSRSARSVVLCLYDDISVEKPSLEIDLDPYINRSGDIWHAALDCSLPFKTYGYRCKATTSGKGELVLLDPYAKVIRRVIPRQGGSEIRPKYLGELCLEPGYDWSGDVPPSLPMEKLIIYRLNVTQFTKDKSSKLPDDLAGTFSGISEKWHHFKDLGVNAMLLEPIFPFDEQKGPYFPWHFFSPGNMYGPSGDPLSAIKSMKDMVKKLHANGIEVFLEVVFTHTAEDAPLMNVDNFSYCIKGGQYLNIQNALNCNYPIVQQMILDCLRHWVIEFHIDGFVFVNASSLLRGFNGEILSRPPLVEAIAFDPILSKVKMIADNWNPLTNDSKENLFPHWRRWAEINMRFCDDIRDFLRGEGLLSNLATRLCGSGDIFAGGRGPAFSFNYIARNSGLTLVDLVSFSSNEVASELSWNCGQEGATTNNIVLERRLKQVRNFLFILFISLGVPVLNMGDECGQSSGGPPAYDARKSLGWNTLKTGFGTQIAQFISFLSNLRMRRSDLLQKRTFLKEENIQWHGSDQSPPKWDGPSSKFLAMTLKADAEVSQTLVSDIVGDLFVAFNGAGDSEIVILPPPPTDMVWHRLVDTALPFPGFFDEKGTPVEDELVAYEMKSHSCLLFEAQRLAEIDSSKRKKQIRLSSKRQ

SEQ ID NO: 59791 - protein, 520 aa, Streptococcus pyogenes MGAS10394
MTEISILNDVQKIIVLDYGSQYNQLIARRIREFGVFSELKSHKITAQELREINPIGIVLSGGPNSVYADNAFGIDPEIFELGIPILGICYGMQLITHKLGGKVVPAGQAGNREYGQSTLHLRETSKLFSGTPQEQLVLMSHGDAVTEIPEGFHLVGDSNDCPYAAIENTEKNLYGIQFHPEVRHSVYGNDILKNFAISICGARGDWSMDNFIDMEIAKIRETVGDRKVLLGLSGGVDSSVVGVLLQKAIGDQLTCIFVDHGLLRKDEGDQVMGMLGGKFGLNIIRVDASKRFLDLLADVEDPEKKRKIIGNEFVYVFDDEASKLKGVDFLAQGTLYTDIIESGTETAQTIKSHHNVGGLPEDMQFELIEPLNTLFKDEVRALGIALGMPEEIVWRQPFPGPGLAIRVMGPITEEKLETVRESDAILREEIAKAGLDRDVWQYFTVNTGVRSVGVMGDGRTYDYTIAIRAITSIDGMTADFAQLPWDVLKKISTRIVNEVDHVNRIVYDITSKPPATVEWE

SEQ ID NO: 59792 - protein, 766 aa, Solanum tuberosum
MIRGPPQIVQKCPTDIVTVNRTNIVPRTHRHALQDLRQLRRRDSLRLFSSDHRILKFCTSEEAFQPRLVAAAKLQEEAPQMLDTFPSFKVSPGLAHPLGVSETESGINFAIFSQHASAVTLCIILPKSVHDGMIELALDPQKNRTGDIWHICIKELPQGGVLYGYRIDGPRNWHEGHRFDDSIILVDPYAKLIEGRRVFGDESNKMCRFFGTYDFNSLPFDWGENYKLPNIPEKDLVIYEMNVRAFTADETSSLDQDQRGSYLGLIEKIPHLLELGVNAVELLPVFEFDELELQRRPNPRDHMINTWGYSTINFFAPMSRYASCGGGPVRASWEFKEMVKALHGAGIEVILDVVYNHTNEADDENPYTTSFRGIDNKVYYMVDLNNNAQLLNFAGCGNTFNCNHPTVMELILESLRHWVTEYHVDGFRFDLASVLCRGTDGTPINAPPLVKAISKDSVLSRCKIIAEPWDCGGLYLVGKFPNWDRWAEWNGKYRDDIRRFIKGDAGMKGNFATRIAGSADLYRVNKRKPYHSVNFVIAHDGFTLYDLVSYNNKHNDANGEGGNDGCNDNFSWNCGIEGETSDANINALRSRQMKNFHLALMVSQGTPMMLMGDEYGHTRYGNNNSYGHDTAINNFQWGQLEARKNDHFRFFSKMIKFRLSHNVLRKENFIEKNDITWLEDNWYNEESRFLAFMLHDGNGGDIYLAFNAHHFSIKTAIPSPPRNRSWYRVVDTNLKSPDDFVTEGVSGISKTYDVAPYSAILLEAKQ

SEQ ID NO: 59793 - protein, 655 aa, Parvularcula bermudensis HTCC2503
MAAALSVLAADAVEAAKSGHPGMPMGMADVATVLFTKHMVFDAGAPDWPDRDRFVLSAGHGSMLLYGLLHLLGYEDMTLEEIKQFRQIGAKTAGHPEYGHAKGIETTTGPLGQGLANAVGMAIAEAHLAARFGADLVNHYTYVIAGDGCLMEGISQEALSLAGHLRLNKLIVLWDDNGITIDGKVSVADRTDQLARFKASGWATLSCDGHDPDAIDAALTEAKSLDAPVLIACKTTIGRGAPQKAGTAGIHGAPLGADELAGLRKALSWEDDPFVVPDDIVGAWRAAGTKGRAARSEWEARLEANGQKEALTALFSGDTSSAQAAVLDYAARLTTEDAKPVATRKASQNVLEVINETTTLTMGGSADLTGSNNTKTGATSPFTADSPAGRYLHYGIREHAMAAAMNGMALHGGVLPYGGTFLVFSDYMRGAMRLSALMGIQVIYVLTHDSIGLGEDGPTHQPVEHLASLRAMPNMTVLRPADAVETAEAWAVALGHRTGPTALALTRQNLPLLRGEAGGENRTARGGYVLAEAAGAAATIIATGSEVEIAVDAAKQLEAEGHAIRIVSMPSVDLFASQDETYQQQVLGTAPRVAVEAGVAQGWDRWLFAFGGRGAFVGMDSFGASGPYKDLYQHFGLTAERVAETVRALVKREDA

SEQ ID NO: 59794 - protein, 186 aa, Triticum aestivum
  misc_feature (20)..(20): Xaa can be any naturally occurring amino acid
  misc_feature (149)..(149): Xaa can be any naturally occurring amino acid
  misc_feature (156)..(156): Xaa can be any naturally occurring amino acid
QAIYLHSTALAPTVMASSAXSVAPFQGLKSTPGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEXYPDAYVXRIIGFDNMRQVQCVSFIAFKPPGCEESGKA

SEQ ID NO: 59795 - protein, 145 aa, Oryza sativa
  misc_feature (26)..(26): Xaa can be any naturally occurring amino acid
  misc_feature (66)..(66): Xaa can be any naturally occurring amino acid
TGYMEHTGHIMEVSKKIHRGIEDIPXLFVIGKPDMTVVAFGSDSVDIFEVNDIMSSKGWHLNALQXRPNSLHHLCAHCSPTVHICRQFPARHPANRPIFPKDWGQPQPLGLTKKANIPGTSFSGGSQLRISRQPAWPSMPRTSRP

SEQ ID NO: 59796 - protein, 690 aa, Dechloromonas aromatica RCB
MDRNQTEITFRRELANAVRFLAIDAVNQAKSGHPGAPMGMADIAEVLWRDHLKHNPANPQWADRDRFVLSNGHGSMLLYALLHLTGYDLNIDDLKNFRQFGSRTAGHPEVGHTPGVETTTGPLGQGLTNAVGMALAEKLLAQRYNRPGCEIVDHRTWVFVGDGCLMEGISHEACSLAGVWGLDKLTCFYDDNGISIDGHVKGWFRDDTPARFRAYGWHVVGPIDGHDSVALSAAIAEAKAVTSQPTLIVCRTQIGWGSPNKAGSHDVHGAPLGADETAATRAALGWLHPPFEVPDSLRAAWNAQSTGATAEASWLARFAAYRTEYPELAAEFERTQAGGLPEKWPEIKSELLATAGRKEGAVATRKSSQNCLDWLVDRVPELLGGSADLTGSNLTAGKGSVALHEVPQGHFLRGAGERQANYISYGVREFGMTAIMNGVALHGGLIPYGGTFAVFSDYARNAIRMSALMQQRVVHVLTHDSIGLGEDGPTHQPVEHASSLRIIPGLDLWRPCDELETAIAWGAALERQNGPSTLFLSRQNLPQYGGAASRAEGASRGGYVLSEADGPLQAVIIATGSEVAIAMQAQAILKTGGVAVRVVSMPCTRRFDQQPSTWKKLVLPPEVCRVAIEAGQTDFWRKYVGLDGDVLGLDEFGASAPAPVLYEHYGLTADNLAQTVLRTIVSAGGSDGDF

SEQ ID NO: 59797 - protein, 407 aa, Pisum sativum
MAAATASSQLIFSKPYSPSRLCPFQLCVFDAKSVLSSSRRKHVNGSGVRCMAVKEATSETKKRSGYEIITLTSWLLQQEQKGIIDAELTIVLSSISMACKQIASLVQRANISNLTGTQGAVNIQGEDQKKLDVISNEVFSNCLRSSGRTGIIASEEEDVPVAVEESYSGNYIVVFDPLDGSSNLDAAVSTGSIFGIYSPNDECLPDFGDDSDDNTLGTEEQRCIVNVCQPGSNLLAAGYCMYSSSVIFVLTIGKGVFVFTLDPLYGEFVLTQENLQIPKSGKIYSFNEGNYKLWDENLKKYIDDLKEPGPSGKPYSARYIGSLVGDFHRTLLYGGIYGYPRDKKSKNGKLRLLYECAPMSFIVEQAGGKGSDGHQRVLDIQPTEIHQRVPLYIGSTEEVEKVEKYLA

SEQ ID NO: 59798 - protein, 227 aa, Sulfolobus solfataricus P2
MDPKELLATYTLNYLRGKKIIGVGTGKTVKKLIEVLSSEENLKESSLFVASSIDTEIELSKRGFKVLSLFSAIQPEIYVDSFDIVTKDGIMIKGGGGALLREKLLAYFSKYRIFIGESTKLKDTKVIDIPIEVISVGVSYVKYKLEKMGFTVKIREGSGKMGPIISDNGNVILDVSVKTENLCEFDRMIKNIPSIVETGIFCKELYNKIILANEQGRIEEMDAGDGI

SEQ ID NO: 59799 - protein, 175 aa, Zea mays
MSSMVSRAAAAAALRCHVRRPGPTFSRPASTSAATAEHHAGHSRAGGRLPRGDYVPVYVALGLIALSVTLGLHTARQQLAYAPNVWVDKKKRETVPEVAAPELALDEAEQFVDRSLFRKVANVQDDRSLAAGVADPVAEYPTKKAVTLKDVGVETPGIEQGREGLLHKIFKKNHA

SEQ ID NO: 59800 - protein, 404 aa, Sinorhizobium meliloti
MTEVTELMRPEGEALNTKEVLLNLGPQHPSTHGVLRLVLQLDGEYVERVDPHIGYLHRGTEKLAESFTYTQIFPLTDRLDYLCPPSNNLAFALAVEKLLGIEAPIRAQYIRVMMAELARISGHLLITGALPMDLGAMTALLYAMREREMIMDLLEMITGARMHTSYCRVGGVREDLPDGFLPKIREFCEIFPNRIRDYERLIENNRVFLSRTQGVGVISATDAIDLGLSGPNLRASGVDWDIRRDEPYEIYDRLDFDVITREEGDCYSRWLCRVDEMRESIRLIEQCMEQMPEGAFQVDIPTIAFPVDKERVHCSMEALIQHFDLSAYGFDVPAGEVYSVIEAPKGELGFYIISDGSPKPFRMKVRAPSFVNLQALFGVTNARYLADMIAVLGSLDPVMAEVDK

SEQ ID NO: 59801 - protein, 537 aa, Capsicum annuum
MGNACRGSFRAKTFQGSYPQNHSTSKHSKVEEEQQPDPAPLVVKDHSTSTKNMNHRSSANQSCCVLGHKTPNIRDLYALGRKLGQGQFGTTYLCTELSTCIDYACKSIAKRKLISKEDVEDVRREIQIMHHLAGHKNIVSIKGAYEDPLYVHIVMELCGGGELFDRIIQRGHYTERKAADLTKIIVGVVEACHFMHRDLKPENFLLVNKDDDFSLKAIDFGLSVFFKPGQIFTDVVGSPYYVAPEVLLKNYGPEADVWTAGVILYILLSGVPPFWAETQQGIFDAVLKGHIDFDSDPWPLISESAKDLIRKMLCMRPSERLTAHEVLCHPWICENGVAPDRALDPAVLSRLKHFSAMNKLKKMALRVIAESLSEEEIAGLKEMFKAMDTDNSGAITFDELKAGLRKYGSTLKDIEIRELMDAADVDNSGTIDYGEFIAATIHLNKLDREEHLMAAFQYFDKDGSGYITVDELQQACADHNITDVLFEDIIREVDQDTDGRIDYGEFVAMMQKGNPCIGRRTMRNSLNFSMRDAPGAH

SEQ ID NO: 59802 - protein, 664 aa, Vibrio vulnificus
MPSRKHLANAIRALSMDGVQKANSGHPGAPMGMADIAEVLWRGHLNHNPSNPEWADRDRFVLSNGHGSMLIYSLLHLSGYELSIDDLKNFRQLHSKTPGHPEYGYAPGIETTTGPLGQGITNAVGMAMAEKALAAQFNKPGHDIVDHFTYVFMGDGCLMEGISHEACSLAGTLGLGKLIAFWDDNGISIDGHVEGWFSDDTPKRFEAYGWHVIPAVDGHNAEAINAAIEAAKADPRPTLICTKTIIGFGSPNKSGSHDCHGAPLGAEEIAAAREFLGWEHPAFEIPADVYAEWDAKAAGAEKEAAWNAKFDAYAAAYPTEAAELKRRLNGELPAEWEEKANQIIADLQANPANIASRKASQNALEAFGKMLPEFMGGSADLAPSNLTMWSGSKSLEANDFSGNYIHYGVREFGMTAIMNGIALHGGFVPYGATFLMFMEYARNAMRMAALMKVQNIQVYTHDSIGLGEDGPTHQPVEQIASLRLTPNMSTWRPCDQVESAVAWKLAIERKDGPSALIFSRQNLAQQPRSAEQVADIAKGGYILKDSDGKPELILIATGSEVELAVKAAEQLTAEGKKVRVVSMPATDTFDKQDAAYREAVLPSDVTARIAIEAGIADFWYKYVGFDGRIIGMTTFGESAPADQLFEMFGFTVENVVNTAKELLA

SEQ ID NO: 59803 - protein, 479 aa, Helicobacter hepaticus ATCC 51449
MSRVSIDKQAVAEFFRFCDENEVEFIDFRFSDIKGVWHHLSFSRNAINEESFEGIPFDGSSIPAWQPVDKSDMMLIPEPVRYFIDPFTADTTAVVFCDIWDIYNNKPYEKCPRSIVKRAMKYLKESGIGDIAYYGPENEFFVFDSIKIKDSVNCQYYEIDSEEGEWNRAREFEGGVNMGHRPGTKGGYFPVPPVDSMVDLRAEIVKVLNQVGLETFVLHHEVAQGQNEIGVKFGDMLEAADNVQKLKYVVKMVAHLNGKTATFMPKPLYGDNGSGMHVHISIWKDGHNLFAGEAYQGLSEMALHFLGGVLKHARALAAFTNPSTNSYKRLIPGFEAPSILTYSAQNRSASIRIPYNSGEKAKRMEFRFPDSSANPYLAFASLLLAGIDGIKNKIDPGAPMEINLFELTLDEIREKGIKQLPHTLRHAIEEMLVDKAYLKEGGVFSEEFIQTYKAYKFETEIWPWEARPHPFEFLTTYSC

SEQ ID NO: 59804 - protein, 664 aa, Vibrio vulnificus YJ016
MPSRKHLANAIRALSMDGVQKANSGHPGAPMGMADIAEVLWRGHLNHNPSNPEWADRDRFVLSNGHGSMLIYSLLHLSGYELSIDDLKNFRQLHSKTPGHPEYGYAPGIETTTGPLGQGITNAVGMAMAEKALAAQFNKEGHDIVDHFTYVFMGDGCLMEGISHEACSLAGTLGLGKLIAFWDDNGISIDGHVEGWFSDDTPKRFEAYGWHVIPAVDGHNAEAINAAIEAAKADPRPTLICTKTIIGFGSPNKSGSHDCHGAPLGAEEIAAAREFLGWEHPAFEIPADVYAEWDAKAAGAAKEAAWNAKFDAYAAAYPAEAAEFKRRVNGELPAQWEEKANQIIADLQANPANIASRKASQNALEAFGKMLPEFMGGSADLAPSNLTMWSGSKSLEASDFSGNYIHYGVREFGMTAIMNGIALHGGFVPYGATFLMFMEYARNAMRMAALMKVQNIQVYTHDSIGLGEDGPTHQPVEQIASLRLTPNMSTWRPCDQVESAVAWKLAIERKDGPSALIFSRQNLAQQPRSAEQVADIAKGGYILKDSDGKPELILIATGSEVELAVKAAEQLTAEGKKVRVVSMPATDAFDKQDAAYRESVLPSDVTARIAIEAGIADFWYKYVGFDGRIIGMTTFGESAPADQLFEMFGFTVENVVNTAKELLA

SEQ ID NO: 59805 - protein, 366 aa, Candida glabrata CBS 138
MNIEKLTGPEIVKKQVYYGHEVVNGAAKSSEPITISFPATEVVGHGSFGVVFTTVIQETNEKVAIKKVLQDKRFKNRELEIMKMLQHRNIIDLKYYFYEIDEREDVFLNLILDYMPQSLYQRLRHFVHQRTPMPRLEIKIYMYQLFKALNYLHHTANVCHRDIKPQNLLVDPNSWCLRLCDFGSAKQLKPTEPNVSYICSRYYRAPELIFGATNYTNQIDIWSSGCVMAELLLGQPMFPGESGIDQLVEIIKILGTPTKQEICVMNPNYMEHKFPQIKPIPLAKVFKKEDEVTVDFLSNTFKYDPTQRYHSLQCLCTPYFDEIRFGDGKIREIIKDLKLLEFDEQMELAHLGPDERGAVKQKLHIQ

SEQ ID NO: 59806 - protein, 1581 aa, Pneumocystis carinii
MKEIIKLSILGKDSIHIGLHLWPHITNELFTCIFSPTYVIITDSNIETLYIPSFKTYFISMAKQRSINSRLLFFTIPPGEKSKSRKTKALIEDWLLSEKCTRDTVIIAIGGGVIGDLVGYVSATFMRGVRFIQIPTTLLAMVDSSIGGKNSINTSYGKNAIGTIWQPERIFIDFTFLETLTEKEFINGIAELIKTIIIWDESEFASLENISEKIAKTVRSMSLTSNKHSKFNEIIKDLKRYIISSIKIKAHIVSIDEKEKDLRTLLNFGHSIGHAIETVLAPYILHGESISIGMVKEAELSRHLGILNPNVVSRLIKCLNTWGLPTSFKDRRFKEVILGKKHLIEDILEIMSIDKKNDSNNKKIVLLSAIGKTYEKKASSVSDDDIRTILSQNILLYGIPLNAFQKHTTITLPGSKSISNRALILASLSNGICYLKNFLHSDDTYYMLSALEKLNAAEFKWEQDGDVLVVKGKSGYLENPQMELYLGNSGTTARFLTSICTLVQPNSRENHLILTGSNRMKQRPIGPLVDALKNNGCCIEYLELENCLPLLIKPKEIGLYGGNINLSATVSSQYVSSILMCSPYAKTQVTLSLIGGKPISQPYIDMTISMMSSFGIKVTRSHSKENTYYIPKGCYTCPSEYIIEGDATSATYPLAIAAITGGSCTISNVGSASLQGDSKFSEYILKPMGCEVVQSPTTTYIKGPPKGKLKSLGSINMESMTDTFLTAAVLASVAYEESKPYVTKITGISNQRIKECNRINAMVCELKKFGIEAGELPDGIYVKALNTSNLPYSVEGINCYNDHRIAMSFSVLACISSKPTTILDKACVNKTWPYWWDILNSTFKVQMKGIEFDLNPTINSSILHHPSECTIFLIGMRGAGKTTLGQLAANFLGREFIDLDSIIEEDIKTTILEFIQKYSWDVFRRKELHFLKTLLTEKKENYIISCGGGIIETEEARDLLISYIEANGIVIHIHRNIQDIIKYLNTDKTRAPYQDNIMHVWERRKRWYNLCSSHQFHMTSTDPTEFKKNIPLNLKSSFNNFLRTITGKNNIFSLILKKKRSYFLSLAFSDLENIFSLLDIITAGCDAIEIRIDLFQKPEEIDKYPSLEYIAEKIFLLRQKTSLPLIYTLRTTNHGGSFLSSEKKLAKEYILHGAKWGFEFLDIELDIASELFKTINNSWPYTKIIASYHNIEKPISCDDFEWIQKYKEAQHYGHIIKLVGTSSSIEDNFFLEEFKSKFINKKVPSIIINTGIKGQLSRIMNTFMTPVTHPSLPSKIAPGQLSIKEINTALHIMGLLPEKKYFLFGKPIKHSQSPNIHNLGFEILGLPYKYQLFETDSISELKEILHLEEFGGASVTIPLKTNISILLDEISDHAALIGSVNTITRTYNNGQYILKGENTDWQGIIKAIKNFNKFEKSFENFSGFIIGAGGASRAAIYALLSLGISPIYLINRSKDKLNKLYHFFNTNHIIPITEYHELNNINFDIRIGISTIPTDNPIDPSVLEIAKIFFNLKRKSSEGIFLDMAYGSNTTDLTIIAKACNWKIIHGLEILLEQGSEQFLLWTETYIPYNQVKYAILGPNK

SEQ ID NO: 59807 - protein, 279 aa, Kluyveromyces lactis NRRL Y-1140
MTSVEVKKVLTTLLRDPENNRCGDCKVATHPRWASWSLGVFVCIKCAGFHRSMGTHISKVKSVDLDTWTEEHLEAVLEFGNNKKFNEYYENKLGGGTYVPDQSKIGQFIRTKYELKKWVGDDPIVDVKSSKHTAEAKDRVAQKAAAVRNSPSSDSPRSLDLDLGLNLNSVVTDKNVPQISSEKPSATNTNVYRPPDRPDLKKSILSLYANRKSTSPHSQSQSPSQSSLHLPTKNMSTSNSLSSGGKLTSNPWAVPRAVDDSRSGSSLSLDDDLFKNVWS

SEQ ID NO: 59808 - protein, 357 aa, Dechloromonas aromatica RCB
MQFGRTTLSKFVIENTRASHGELGALLIDVAAAVKTISAMVAKGALAGHHGALDSTNVQGEVQKKLDVLTNDAILRHCEWGGQLAGMASEEMDDPYPIPAEYPRGRYLLVFDPLDGSSNSDVNVSVGTIFSIFSRRAAGDAELGDYLRPGSEQVAAGYAIYGPSTMMVLTLGNGTHGFTLDRESGNFILTHANIRVPEDTREFAINTSNERFWEPPVQRYVSECKAGKSGVRGEDFNTRWIASMVAEVHRILIRGGIFMYPKDSKDPSKPGRLRLLYEANPMAMLIEQAGGAASTGRQRILDVVPDSLHQRAPVILGSKNEVERLARYHHEYDTGADRPFVSPLFSERSLFRDESRA

SEQ ID NO: 59809 - protein, 152 aa, Oryza sativa
MKADALWCLGNAQTSHGFFTSDTVKANEFFEKATQCFQKAVDVAPELHMEIHRQMASQASQAASSTSNTRKIWHNFHMVDFKIYVDNDPTFSIPAKNPYPSQARDSEILWQSRKKKKDSDFWYDVFGWVVLGVGMVVWVGLAKSNAPPQAPR

SEQ ID NO: 59810 - protein, 113 aa, Blastopirellula marina DSM 3645
MPNESHILAQLMAVIEDRKANPPEKSYTTKLFAGGVDKIGGKIMEEAAETVEAAGEPGDEGRAHLIYESGDLIYHLFVLLCHQEITLAEVEQELARRFGVSGIDEKASRKADQ

SEQ ID NO: 59811 - protein, 1432 aa, Shewanella sp. MR-7
MIELRIDNQIVTAEPNDNLLRAASKAGIAIPSLCDPTDATRQLGAAPHADKQDCNLCLVQIENTDASLRCVKACETPAEAGMKVITQSAYLTKQRQAALSTILSDHFADCEAPCQQACPAGVDVQSYLYHIAQGDHSQAIKVIKDTLPLPLSIGRVCPAFCETECRRGLVDDPIAIRQLKRHAADLDLADDEQGGSYQPPRLADTGKKIAIIGAGPAGLSAGYYLSNQGHSVEIFEAMPKAGGWLRYGIPEYRLPKAILDKEIELLCRNGLTIHTDTRLGHEIHLAQLVADFDAVCLAIGAQKAVPMNYKGSELAGCYLGVDFLKEHCLDKQLKLGKKVAVIGGGNTAIDCARTAVREGCDVTLIYRRTRAEMPAEAYEVHEAEVEGVKFHFLTNPIENHSDANGQVEAVTFSKMALGDADASGRRAPVDTGETFTEAFDTVIAAVSQAPDLSFMQDPMGQLSHGELALSRWNTLIGCEQTMSSGVEKLFVMGDARRGPATAVAAIGDGRKAAIAIDKMLKIGLSCDLHAHEFNSVKTIPSALIPNALKQTETSSKAGSTLYPHTPRQPRLKMPELTALQRLLNYSEVELGFPADAAMQEAARCLECACQANTDCKLRDYATDYGVEAKSLATENARHFSVDKSAPFIQFDANRCISCGKCVDVCQLQSGHCAIQFSQDSYQALPQEMTQHMERRAPRVGFSASMADSHCVQCGNCVQVCPTGALADARDKRQGDSTELKTASTICTYCGVGCRLDLKIDPKANRIRHIEGNKDSVVNQGMLCVKGRFGFDFIHSDKRLTTPLIRKNGELQPSSWPEAIAYVAKRLTEIKQKDGSNALASLASAKATNEDNFVLQKFVRSVLGTNNIDHCARLCHSSTVTGLQQSIGSGAMTNDIPSIKDSDVIFILGSDTTCAHPIIASKIQQAVMQHGARLLVADPKRVGIAEKAELYVAHRPGTDVMLLNAIMAEIIRHDWQDKAYIAQRTEGIEALYAELAKEDYSLENAALITGVKAEDIARLARTIGTAQKTAVYYAMGITQHTTGHDNVTAISNLQLLCGNIGVSGAGINPLRGQSNVQGACDMGALPNYFTGYQKVTDIHARMRFEDHWQTPLSGEIGVTATHMMHDIAKGKIKALYVMGENPVLSDPDQAHVLNALSKIDFLVVQDIFLTETAELAHVVLPAAAFVEKRGHFTNTERRVQRLEQALASPGEALPDWQIVQAVANAMGANWDYANEEAIWREINELTPQYRGIRWDRLSANAEGQISQGIQWPCPDETHPGTPIMHQSQFTRGLGLFTPVSYRLPAEMPCNEYPLTLSTGRLLEQFHTGTLTRKTPGLDLLGSPKVMISVYDAEQLGIHNGDKLRLTTRRGEIEIDAFVTKRAQAGVLFLPFHFVEAAANKLTINALDPVAYIPEYKVCAVRAEKVTTNVSETA

SEQ ID NO: 59812 - protein, 483 aa, Pseudomonas aeruginosa UCBPP-PA14
MQLKDAKLFRQQAYVDGAWVDADNGQTIKVNNPATGEIIGSVPKMGAAETRRAIEAADKALPAWRALTAKERANKLRRWFDLMIENQDDLARLMTIEQGKPLAEAKGEIAYAASFLEWFGEEAKRIYGDTIPGHQPDKRIIVIKQPIGVTAAITPWNFPSAMITRKAGPALAAGCTMVLKPASQTPYSALALAELAERAGIPKGVFSVVTGSAGEVGGELTSNPIVRKLTFTGSTEIGRQLMAECAQDIKKVSLELGGNAPFIVFDDADLDAAVEGALISKYRNNGQTCVCANRLYVQDGVYDAFVDKLKAAVAKLNIGNGLEAGVTTGPLIDAKAVTKVEEHIADAVSKGAKVVSGGKPHALGGTFFEPTILVDVPKNALVSKDETFGPLAPVFRFKDEAEVIAMSNDTEFGLASYFYARDLARVFRVAEQLEYGMVGINTGLISNEVAPFGGIKASGLGREGSKYGIEDYLEIKYLCLGGI

SEQ ID NO: 59813 - protein, 327 aa, Salinibacter ruber DSM 13855
MATLEFRTALREAMTEEMERDDDIFLIGEEVAEYDGAYKVSKGMLDHFGSDRVIDSPISELGFAGLGIGAAMNGLRPIVEFMTFNFSFVAFDQVINNAPNMRYMSGGQFDVPIVFRGPNGAAGQLGATHSNSTEALYSNIPGLKVVSPSVPDDGKGLLKTAIRDDDPVVFLESELMYGMKREVSEESDYTIPIGSARVAREGDDVTIVAHSKSYHIAMDAAETLEEQGYEAEVIDPRTIKPLDIETIVESVVKTNRLVVIDESTPFTSVASEITHQVQDRAFDYLDAPILRVTAPDTPAPYAPNLMDEYMPGADETVDKCLRVLYAE

SEQ ID NO: 59814 - protein, 426 aa, Pseudomonas aeruginosa UCBPP-PA14
MSKTNESLLKRRQAAVPRGVGQIHPVVAERAENSTVWDVEGREYIDFAGGIAVLNTGHLHPKVIAAVQEQLGKLSHTCFQVLAYEPYIELAEEIAKRVPGDFPKKTLLVTSGSEAVENAVKIARAATGRAGVIAFTGAYHGRTMMTLGLTGKVVPYSAGMGLMPGGIFRALAPCELHGVSEDDSIASIERIFKNDAQPQDIAAIIIEPVQGEGGFYVNSKSFMQRLRALCDQHGILLIADEVQTGAGRTGTFFATEQLGIVPDLTTFAKSVGGGFPISGVAGKAEIMDAIAPGGLGGTYAGSPIACAAALAVLKVFEEEKLLERSQALGERLKAGLREIQAKHKVIGDVRGLGSMVAIELFEGGDTHKPAAELVSKIVVRAREKGLILLSCGTYYNVIRFLMPVTIPDAQLEKGLAILAECFDELA

SEQ ID NO: 59815 - protein, 136 aa, Medicago sativa
MARTKQTARKSTGGKAPRKQLATKAARKSAPATGGVKKPHRFRPGTVALREIRKYQKSTELLIRKLPFQRLVREIAQDFKTDLRFQSSVVSALQEAAEAYLVGLFEDTNLCAIHAKRVTIMPKDIQLARRIRGERA

SEQ ID NO: 59816 - protein, 279 aa, Schizosaccharomyces pombe
MRKRKVITIFDLKIQMEFKGETKDGVEATGSITCPELSYDLGYSDYVFDIDIYSASKEKEPIKELVREKIIPQIRQLFSGFSQVLLQTHGDDVYLSTEEHNGNAARGLPVHSSFKQNNSSQTSSNKGTTTVAAGSGSDGSRVSAVVNTADISENYTFDAPANELYATFLDPARVAAWSRAPPQLDVRPQGAFSLFHGNVVGKFLVLEENKKIVQTWRLSSWPTGHYAEITFTFDQADSYTTLRMIMKGVPIGEEEVVQGNIQDYYIRPIKTVFGFGAVL

SEQ ID NO: 59817 - protein, 632 aa, Erythrobacter sp. NAP1
MCGIAGIFHAETPKPVDPRRIERMCDAMAHRGPDGAGVWTEQGVGLGHRRLSIIDLEGSPQPMLSADGRAVIAFNGEIYNFRELRRELESQGAKFRTSGDTEVILAAWQRWGVDCLEKLHGMFAFALYDLDKRQLFLARDRFGVKPLFMTRLADGGLAFSSELKGLLAHPQMRRRVNPQAVDAYLTWGYVPDTHSILSGVEKLQAGHFLLLEQGRPIPAQRRWWDISFADRAKGSEADLSAELVHLMREAVQSRMVSDVPLGAFLSGGVDSSSVVALMSEASAEPVRTCSIGFDVAALDETNYASRIAQRFSTDHDSRIVASDDFEAVDQISAMFDEPFADASALPTWRVCQLAREKVTVALSGDGADEAFAGYRRQVFHHNEEKVRSLLPAGLRQPLFGALGRFWPKADWAPRPLRAKATLLALAESGESGYARALSVATHDQRASLYDPEFTRKLSGFRAEDELISLMKSAPARSGLDRAQYADLTFWLPGDILTKVDRTSMAVSLEAREPLLDHRLVEFAARLPEGMRVKGTTGKHLLKKCMERYLPNDILYRPKQGLVTPIAQWLREPLNSETRMIASSSTLSGLGWFKPNEIRRLADDHISGRSDHSRVLWQLLMLERSLKHLNVSG

SEQ ID NO: 59818 - protein, 327 aa, Arabidopsis thaliana
MVVMMMNFRVYLMRVNLDNNVVESSSSSSSSCIKREAKVISLGDEVDDISQVFHCDGLLLCISITQAKTRLVVWNPYWGHTRSIEPTHQFNKFDSYSYALGYDKSSKSHKILRCITCLRPHFHEFIIYDFNSNSWRVFHVTPDWQLGTINSGVSLKGNAFWVAEEKYYETSETNEEFFLLSFDFTRETFGPLLPLPFQFVESEDALSVSNVRDEQLAVLYQPWDTLMMEIWVTSKIEPNAVSWNSKVFLSVSIRKLIGPQFQFCLGSFFIDEEKKVAVVFDKGYRIQRYIAYIIGVDGSMKEVDLGESDRRCYPIVWSYVPSLVQLN

SEQ ID NO: 59819 - protein, 431 aa, Lactobacillus reuteri
MSKLNTTRSKAAFKEAQKYMPGGVNSPVRAFKNVGGDPLFIDHGKDEYIYDIDGNKYIDYVLSWGPLILGHADDQVVAELDKAVAKGTSYGAPTLQETELAKIVNKIMPSIEMIRMVSSGTEATMSAIRLARGYTRREKIVKFVGNYHGHSDSLLVDAGSGLATFGINTSPGVPDDLAYDTLTVAYNDVDGVKKLFADHGDEIACAIVEPVAGNMGVIPGTQDFLQTLRDVTKEHGSLLIFDEVMSGFRAAYHGVQSLVNITPDLTTLGKVIGGGLPVGAFGGRREIMEQITPAGSIYHAGTLSGNPLAMTGGISTLKQLTPEDYVEMDKKVTALTDGIKQAADKYGVPMTVHHVGTMWSYFYNSDSINNFDDVKACDQKLFEKCFWELLAHGVYVAPSQFETNFISTKHTDEDIEKTIAAFDAAFNAATK

SEQ ID NO: 59820 - protein, 469 aa, Corynebacterium glutamicum
MTEHYDVVVLGAGPGGYVSAIRAAQLGKKVAVIEKQYWGGVCLNVGCIPSKSLIKNAEVAHTFTHEKKTFGINGEVTFNYEDAHKRSRGVSDKIVGGVHYLMKKNKIIEIHGLGNFKDAKTLEVTDGKDAGKTITFDDCIIATGSVVNTLRGVDFSENVVSFEEQILNPVAPKKMVIVGAGAIGMEFAYVLGNYGVDVTVIEFMDRVLPNEDAEVSKVIAKAYKKMGVKLLPGHATTAVRDNGDFVEVDYQKKGSDKTETLTVDRVMVSVGFRPRVEGFGLENTGVKLTERGAIEIDDYMRTNVDGIYAIGDVTAKLQLAHVAEAQGIVAAETIAGAETQTLGDYMMMPRATFCNPQVSSFGYTEEQAKEKWPDREIKVASLPFSANGKAVGLAETDGFAKIVADAEFGELLGAHLVGANASELINELVLAQNWDLTTEEISRSVHIHPTLSEAVKEAAHGISGHMINF

SEQ ID NO: 59821 - protein, 935 aa, Marinobacter sp. ELB17
MDRRGFLTASGVAVGGLAALSLTSTRVEAATPSTGGGEVVRKKSVCTHCAVGCTVEAEVQNGVWTGQEPAWDSPINLGAHCAKGAAVREHAHNDRRLKYPMKMVNGQWQKIPWDQAINEIGDKMVQIREESGPDSVYWLGSAKFSNEQAYLFRKFAAYWGTNNVDHQARICHSTTVAGVANTWGYGAMTNSFNDIHNSKAIFLIGGNPAEAHPVSLLHILKAKEENNAPLIVCDPRFTRTAAHADEYVRLRPGSDVALVWGILWHIFENRWEDKEFIRTRVYGMDEIREEVARWNPAEVERVTGAPGAQLERVARTLANNRPGTIIWCMGGTQHTNGNNNTRAYCILQLALGNMGVAGGGTNIFRGHDNVQGATDLGVLADTLPGYYGLTAGAWAHWARVWDEDLDWLKGRFPSFDKNGKTLAMMNEKGIPVSRWIDGVLEAKENLDQPDNTRAMVLWGHAPNSQTRMLEMKEAMEKLDLLVVVDPFPTVSAVLHDRKEGAYLLPTTTQFETTGSVTASNRSLQWREKIFEPLFDSKVDHEIMKLFADKFGFTDRMFRNIAIEGDEPVIEDITREFNRGMWTIGYTGQSPERLKKHMAYQHHFDRTSLRAVGGPCDGDTYGLPWPSWGTPEMNHPGTANLYDLSLPVSQGGLTFRARFGVERDGVNLLADGVYSKNSEIKDGYPEFTMQMLMDLGWDKDLTAEERASIDAVAGAETNWKTDLSGGIQRVAIKHECAPFGNAKARAVVWNFPDPVPVHREPLYTTRRDLVKDYPTYADKHFWRVPTLYESIQKKDFSKDFPIILTSGRLVEYEGGGDETRSNRWLAELQQDMFIEVNTRDANNLNIRDGKDVWVSGPEGGRIRVKAMVTERVGEGVAFMPFHFGGHLEGKDLRDKYPKGSDPYVLGESTNTIQTYGYDSVTQMQETKATLCSIMPA

SEQ ID NO: 59822 - protein, 177 aa, Pinus taeda
PAQTETASYYPAAPHHGVEHGHGHEGQLTPEEAEQQKHTGLMGKLHRTNSSSSSSSSDEEGEGGKKKEGGRKKKGSKDKSKEKLPGAGQHSSDQCGGKEEKKTGLLDKIKEKIPGHQEKLSGGGTHSSSDECGGKEEKKTGLLDKIKEKIPGHQEKLPGDGKHSSDEHGGEEEKKLG

SEQ ID NO: 59823 - protein, 394 aa, Glycine max
  misc_feature (68)..(68): Xaa can be any naturally occurring amino acid
MEHKVATTTEGQSIRCKAAICRKAGEPLSIEEIIVAPPMPGEARIRIICSSLCQTDISFRNMQMYLLXLKDHPAIYPRILGHEAIGVVESVGEDVTEVTKGDVVVPIFLPDCGECIDCKSSKSNLCSKFPFEVSPWMPRYATSRFTDLKGEIIHHFLSVSSFSEYTVVDIAHLIKIDPAIPPNRACLISCGISAGIGAAWRAAGVEPGSTVAIFGLGSIGLAVAEGARLCGATKIIGVDVNPERYEIGKRFGLTDFVHSGECENKSVSQVIIEMTGGGADYCFECVGMASLMHEAYASCRKGWGKTIVLGVDKPGSKLNLSCSEVLVSGKSLRGCLFGGLKPKSHVPILLKRYMDKELNLDEFVTHEMEFKDINKAFDLLIEGQCLRCVIWMDK

SEQ ID NO: 59824 - protein, 144 aa, Klebsiella pneumoniae
ESNGKYVDRNGHAVDYQTGPIIWGEPGTNGQHAFYQLIHQGTKMVPCDFIAPAITHNPLSDHHQKLLSNFFAQTEALAFGKSREVVEQEYRDQGKDPATLEHVVPFKVFEGNRPTNSILLREITPFSLGALIALYEHKIFTQGA

SEQ ID NO: 59825 - protein, 554 aa, Shigella flexneri 2a str. 2457T
MCSIFGVFDIKTDAVELRKKALELSRLMRHRGPDWSGIYASDNAILAHERLSIVDVNAGAQPLYNQQKNHVLAVNGEIYNHQALRAEYGDRYQFQTGSDCEVILALYQEKGPEFLDDLQGMFAFALYDSEKDAYLIGRDHLGIIPLYMGYDEHGQLYVASEMKSLVPVCRTIKEFPAGSYLWSQDGEIRSYYHRDWFDFDAVKDNVTDKNELRQALEDSVKSHLMSDVPYGVLLSGGLDSSIISAITKKYAARRVEDQERSEAWWPQLHSFAVGLPGSPDLKAAQEVANHLGTVHHEIHFTVQEGLDAIRDVIYHIETYDVTTIRASTPMYLMSRKIKAMGIKMVLSGEGSDEVFGGYLYFHKAPNVKELHEETVRKLLALHMYDCARANKAMSAWGVEARVPFLDKKFLDVAMRINPQDKMCGNGKMEKHILRECFESYLPASVAWRQKEQFSDGVGYSWIDTLKEVAAQQVSDQQLETARFRFPYNTPTSKEAYLYREIFEELFPLPSAAECVPGGPSVACSSAKAIEWDEAFKKMDDPSGRAVGVHQSAYK

SEQ ID NO: 59826 - protein, 387 aa, Blastopirellula marina DSM 3645
MAVKADYYEVLGVSRTANGDEISKAYRKLAIKFHPDSHPDDENASLKFKQAAEAYEVLSDAEKRGRYDQYGHAGVEGGHRQFSDAEDIFEAFGDIFGGGVFGDLFGGRGRTRSGRRVSKGADIKAQVTLDLEEAARGVEKTITFDRREPCETCKGSGAAAGSQAERCTRCGGHGQVVQQAGILRVQTTCPSCAGAGVKITDPCRSCRGQGFQNRRVELDVNIPAGVDDQMRVRLSGEGQPSPNGGPAGDCYCFISLRRHKLFERDGEHLILKMPISYTQAVLGAQIEVPTLIDGAHMLTVPKGTASGEVFKVRGQGMPDPHGRGKGDLYVQTYIEVPKKLDTRQEELLRELAEFEHTNVSPHRKSFLESIRDYLFSSGDEDEAVKEK

SEQ ID NO: 59827 - protein, 416 aa, Coprinopsis cinerea okayama7#130
MLTFPLAMASAGIIPGMITCAISGLVAAFGLYLLSLCATHTKHRHSSFHAVSQLTFPKAAVFFDAAIAIKCFGVSISYLIIIKGLMPNVVASLFHDLTGPDTNPPDWALDGRNWITIFMIFLIPLSFLRHLDSLRHTSYIALFSVAYLVVIVVKCYFFPLEGMPERGEVHLIKFTPNFVATFPIQVFAFTCAQNLFPLYNEVKDNSQKRMNIIIGGSIGAAVLTYEVVAVIGYLTFGSTVGANIIAMYPSTSLFVALGQLAIVVMVMFSYPLQVHPCRNCLDKILHPDTHHKPKTAVGEGEDDVEDDDDDHAHATMSPLKHTILSSLIIGFGFTIAYLVDDLQLVLSFVGSTGSTTISFILPGLFYWKLTRNNPSLRTTNWLSILLTIYGVCIFVFCLGYNIYQVIHPPILEGNPE

SEQ ID NO: 59828 - protein, 434 aa, Salinibacter ruber DSM 13855
MPFNFDVYERSAYREPAPIDHDSPFQSMMERFDVAAEILELSPGFYEYLCRPARMHVTSIPVEMDSGRVKIFEGYRVIHNNVLGPSKGGIRFAPDVTLNEVKALAGWMTWKCSLVDLPFGGAKGGVACNPEEMSPGELERLTRRYTADLFDVFGPDKDIPAPDMNTNEQIMAWVLDTYSMHARQTENAVVTGKPVGLGGSKGRRQATGRGVMTVTLAAMEQIGLAPGDCTVAVQGFGNVGATAADLLGEQGCTVVAVSDITGGYYNENGLDLKAMKAYTQQNGGTLAGYEEAQHITNEELLTLDVDVLVPAAKEDQINREIAEDLRARIVAEGANGPTHPAADEVLAEKEVLVIPDILANAGGVTASYFEWVQNRQGFFWTEEEVNRRLDRMMGEAFDKVYTAADKYDVSLRIAAYVVGIRRVAEALRMRGIYA

SEQ ID NO: 59829 - protein, 735 aa, Oryza sativa (japonica cultivar-group)
MRLLRVATCNLNQWAMDFDTNLRNVKESIARAKAAGAAVRVGPELELTGYGCEDHFLEQDTAAHAWECLKDILSGGYTDGILCSIGMPVIFKSVRYNCQVFCLNSKIVMIRPKISLANDGNYREFRWFSAWTFKDALVDFQLPLDISEVTSQDTVPFGYGFIQFLDVSLASETCEELFTANAPRIDLALNGVEVFVNASGSHHQLRKLSLRIDSMRNATLACGGVYMYANQQGCDGGRLYYDGCCCIAVNGDVVAQGSQFSLKDVEVLDALVDLDAVSSYRASVSSFREQASHRTKVPFVKVPYKLCKPFQSGMVPTGPVEVMYHRPEEEIAFGPSCWLWDYLRRSRASGFLLPLSGGADSSSVAAIVGCMCQLVVKDIENGDEQVKADAMRIGQYKDGEFPKDSRELAKRLFYTVYMGTENSSEGTRSRAKMLAEEIGSFHLDVPIDSIVSALLSLFERLTGKRPRYKVDGGSNTENLGLQNIQARIRMVLAFMMASLMPWVHNKSGFYLVLGSSNVDEGLRGYLTKYDCSSADINPIGSVSKQDLRAFLRWAAVHLHYSSLAEVEAAPPTAELEPIRADYNQLDEVDMGMTYEELSIYGRLRKIFRCGPVSMFQNLCHRWCGTLSPSEVADKVKHFFKYYAINRHKMTVLTPSYHAESYSPEDNRFDLRQFLYNARWPYQFRKIDELVQDMDKDGKWVNSTEGELRRRKGVRSAEGGGMGVVAVGSANPSAGS

SEQ ID NO: 59830 - protein, 324 aa, Coxiella burnetii RSA 493
MSNNENFYTLGKAVIATELRAIQSLHARIDEKFVTACNTLFNCKGRVVVLGVGKSGHIAKKIAATLASTGTPSFYVHPSEASHGDMGMVTPQDVALAISYSGETPEIINLLPTLKRLGVALIALTGKMQSTLARIADTVIDVSVEQEACPLGLAPTSSTTATLVMGDALAIALLEARGFTADDFARIHPGGSLGRRLLLHIADLMHPKDKMPIVKPDCLLDEALVEITKKSLGMTTVVSDSGQLLGVFTDGDLRRTLDKGYDIHRTPIEKVMTKNSITVPPKLLAAEALKMMQQNKITSLVVVDTDASPVGVIHMHDLLRAGVS

SEQ ID NO: 59831 - protein, 172 aa, Haemophilus somnus 129PT
MSKGKSIILMGVSGTGKTSVGTEVAYRLGLKLIDGDDLHPRANIIKMRQGQPLNDEDRMPWLERIRDAAFSLEQKSEKGIIICSALKKQYRDQIRDGNQNIKFIYLSGSFELVLSRLQKRQGHYMKTEMLRSQFATLEVPQADETDIYHIDIDATFEEVVQRCVEAIKPLLD

SEQ ID NO: 59832 - protein, 390 aa, Schizosaccharomyces pombe
KNQTHIFREMSDDSHLETKVVTDGTTGEKKTISYEPCRVLGSGSFGVVIQAKLVGTPGFIAVKRVLQDKRYKNRELQIMRAISHPNIIKLIAFFHTHNPSKDETHLCLLLEYMPETVFDDMRWYTRRRKSIPNLSIKLYAFQLFRALAYLHSTGVCHRDIKPQNLLVDYKTGILKLCDFGSAKVLVPSEPNVSYICSRYYRAPELVFGATHYTTKIDVWSAACVIAELFIGRPLFPGDSSVEQLVEIIRVLGTPSYHEISVMNPNYVNHSLPNVRPHTLESVMPHNCTKNAMDLLHKMLTYVPSKRISAIEVLTHPFFDELRDPNCMYHCSRDEGTIERHLPPLFNFNLAELSIRPNLNKAILPPHVYESLDVDINNFEPIVVKQADADS

SEQ ID NO: 59833 - protein, 317 aa, Mycobacterium sp. JLS
MSPHALVIGEALIDIVERDGEVQGEHVGGSPLNVAVGLSRLGRRVDFLTHIADDARGRRIVEHLEAAGVHLVAGSRNAARTPTARAMLDDKGSARYEFDIDWNLTGTPEAAPPLVAHTGSIATVLEPGCRATAALLDAYHLSATITFDPNIRPALIDDADAARARIDRLVERADVIKASDEDLRWLDPNRTPKQIARAWLQLGPSIVAVTEGGQGAFAVCAAGSARVAALPVEVVDTVGAGDAFMSGLIDALWTHGLLGAEKRRELRAIRLDALHDVLQTAALSSALTVTRAGADLPDRATRDAAAREPATLIDRRR

SEQ ID NO: 59834 - protein, 325 aa, Arabidopsis thaliana
MANTPLIVSFGEMLIDFVPDTSGVSLAESTGFLKAPGGAPANVACAITKLGGKSAFIGKFGDDEFGHMLVNILKKNGVNSEGVCFDTNARTALAFVTLKKDGEREFMFYRNPSADMLLKESELNKDLIKKAKIFHYGSISLISEPCRTAHMAAMKTAKDAGVLLSYDPNVRLPLWPSTEAAIEGIKSIWNEADIIKVSDDEVTFLTRGDAEKDDVVLSLMHDKLKLLIVTDGEKGCRYYTKKFKGRVPGYAVKAVDTTGAGDSFVGAFLVSLGKDGSILDDEGKLKEALAFANACGAVCTTQKGAIPALPTPADAQKLMKSKSKG

SEQ ID NO: 59835 - protein, 631 aa, Oryza sativa (indica cultivar-group)
MASISGAAAPPSSSAACRLRLRRQLLLRPSHLRLRAPHSIADLSRSSSSSSEQQPSSTPAAPLASRPGQNGSTRGAVEKDPIKLWERYVEWLYQHKELGLFVDVSRIGFTEEFLRRMEPRMQRAFAAMRELEKGAIANPDEGRMVGHYWLRDPGLAPNSFLRTKIETTLDRILAFSQDVVSGKIKPPSSPAGRFTQILSIGIGGSALGPQFVSEALAPDNPPLKIRFIDNTDPAGIDHQIAQLGPELASTLVIVISKSGGTPETRNGLLEVQKAFRDAGLDFSKQGVAVTQENSLLDNTARIEGWLARFPMFDWVGGRTSEMSAVGLLPAALQGIDIKEMLVGAALMDEETRNTVVKENPAALLALCWYWASEGIGNKDMVVLPYKDSLLLLSRYLQQLVMESLGKEFDLDGNRVNQGLTVYGNKGSTDQHAYIQQLREGVHNFFVTFIEVLRDRPPGHDWELEPGVTCGDYLFGMLQVDIQLLRYRTMTFFSMNAMTEERNILQGTRSALYSNDRESISVTVQEVTPRAVGALVALYERAVGIYASLVNINAYHQPGVEAGKKAAGEVLALQKRVLTVLNEARHIEMIYKIIQHMAANDRALIAEGSCGSPRSIKVYLGECNVDEDMLAA

SEQ ID NO: 59836 - protein, 410 aa, Erythrobacter sp. NAP1
MKTKPVGPIPKGYDAIDGELAVGGRTASDLVEAAGRTPLFVYSRSHLDLRTAELRAALPKRIGVNFAVKANPHPAVIAHMAPLVDGFDVASSGELAKLQETGIDPSRVSFAGPGKRDDELEAAIVAGATLNCESEGEGERALAIAQRVGTAPRIAIRVNPDFELKGSGMKMGGGAKPFGVDAERVPALAQTLIDGGAEWRGLHIFTGSQALSADAIIEAQGNVIDLAARISNDIGEGLPKLNMGGGFGIPYFPGDEPLDLPAVGNALKERTADLPESLSDTELCLELGRYLVGEAGVYLCRVIDRKVSHGVTYLVTDGGLHHQLAASGNFGTVVRRNYPVAIANRFGCEGDDVVNVVGCLCTPLDRLADAALLPRAEVGDLVAVFCAGAYGATASPENFLGHGPAAEMLV

SEQ ID NO: 59837 - protein, 66 aa, Oryza sativa
  misc_feature (58)..(58): Xaa can be any naturally occurring amino acid
MGFVVTTLIFAMVGVIASLMVRICCGRGASANLLHLTLVITTIVCCWMMWAIVYVAQXMKPLIVPI

SEQ ID NO: 59838 - protein, 426 aa, Brassica napus
  misc_feature (305)..(305): Xaa can be any naturally occurring amino acid
MSKTTNQNRRPSFTSSTESSMRKRHGPSSSSSAVKPISNTAVMVAKKRAPLGNITNQRKDSRIFPNSSSADSAHCPNKSAKLKLAAPTQPVCVNACETKSTCEEEVVPIERKAFSNLCITPSSDTTTNVMSETENKEEKFMNIDNKDDADPQLYATFACDIYNHLRAAEAKKQPAVDYMETVQKDVNSTMRGILVDWLVEVSEEYRLVPETLYLTVNYIDRYLSGNVISRQKLQLLGVACMMIAAKYEEVCAPQVEEFCYITDNTYLKDEVLDMESAVLNYLKFEMSAPTVKCFLRRLFSGCPRXVHEAPCMQLECMASYIAELSLLEYTMLSHPPSLVAASAIFLAKYTLDPTRRPWNSTLRHYTQYEAMELRGCVMDLQRLCSNAHVSTLPAVRDKYSQHKYKFVAKKFCPSIIPPDFFKNSLY

SEQ ID NO: 59839 - protein, 463 aa, Erythrobacter sp. NAP1
MSNAQVLSAFEMQAAEQRIFDTGTSVFELMEAAAGGAAEWIRRLAAGRSVTVLCGPGNNGGDGYVIAHHLREAGNEVTVIAPVEPKTDAAKQARNLWGGAVQTSGRGRGADVFVDSLFGSGLSRPLSGEHALLLRDLAERHAFKVAIDVPSGTASDTGALLNDKLPDFDVTLALGAWKFAHWLLPGRPKMGARRLVPIGVEPVEGAAQVVTKPRLSPPAVDAHKYRRGLAAIVGGKMPGAAILATEAAMRSGAGYVKLLGTQAQQRTDPGLVVDTSPLADAMADERIDAVLLGPGLGRDEEARDRLSSVLSAGKPVVLDADALVLLRPEMVPENLPVLATPHDGELEALCRAFSVIAESRRDRAIALARSSGMVVLAKGPDSVIAAPDGRIALLPPAPSWLSVAGTGDVLAGIAVSRMASGATSFDAACEAAWLHGRTAERCGAAFTPLELAHAVPGALAECL

SEQ ID NO: 59840 - protein, 208 aa, Campylobacter lari RM2100
MGINEEEFIKSINWQKVNNLIPVIIQDYHSCEVLMQGFMNEQALRESFKHQKVVFYSRTKERLWMKGEQSGNFLHIIDMGLDCDRDCILILVKAQGATCHTGDTSCFETLSKKADFVFLSRLERLINSRKNTCASSSYTAELFSKGTKRIAQKVGEEGVETALAATIKDKDELINEAADLLYHLEVLLADANLSLNDVIAKLKERNTK

SEQ ID NO: 59841 - protein, 237 aa, Enterococcus faecalis V583
MQDITQAEAIHWLATQQKITFLTGAGISTASGVPDYRSLKGVYQGIQQPEYLLSRTCLKTEPEKFYQFVKTLYHPDAQPNIIHQKMAQLEQMKRGKIVSQNIDGLHRKAGSQEVVDFHGNLYECYCQTCGATVPWQDYLLSDRHADCHGQIRPAITLYEEGLSEEAIEKAIQAVASADLIVIVGTSFQVHPFCDLIHYKQPTATILAINQTPLFLQQPYYFLEAKAETIFAELTIKE

SEQ ID NO: 59842 - protein, 176 aa, Pinus taeda
PAQTEAASYYPAAPHHGVEHGHGHEGQLTPEEAEQQKHTGLMGKLHRTNSSSSSSSSDEEGEGGKKKEGGRKKKGSKDKSKEKLPGAGQHSSDQCGGKEEKKTGLLDKIKEKIPGHQEKLSGGGTHSSDECGGKEEKKTGLLDKIKEKIPGHQEKLPGDGKHSSDEHGGEEEKKFG

SEQ ID NO: 59843 - protein, 556 aa, Clostridium cylindrosporum
MKTDVQIAQEAQMKPITEVANYLGIQDDELELYGKYKAKVSLDVLERQKDKEDAKLVLVTAINPTPAGEGKTTTNVGLSMGLNKIGKRTITALREPSLGPCFGVKGGAAGGGYAQVVPMDDINLHFTGDFHAITSAHNLLAALLDNHLHQGNALNINPKKIVWKRVIDMNDRSLRNVIIGLGGNGDGFVRQAQFDITVASEIMAILCLATSMSDLKERLSKMIVAYAKDGSAVTAGQLEATGAMALLLKDAVKPNLVQTLENTPAFIHGGPFANIAHGCNSVLATKVALKLADYVVTEGGFGADLGAEKFFDIKSRFAGLKPNCDVSVATVRALKMNGGVPKTELAAENVEAVKKGVANLERHIENVAKFGVPAVVAINKFPLDTEAELKAVEDACNAKGADVVLSDVWANGGEGGVEMAKKVVEICEKNEANFAPLYDVNLSIPEKIEKIATTIYRADGVDFTSDCKKQIAELEKLGLDKMPICMAKTQYSFSDDPTLLGAPTGFRITVREVRVSAGAGFIVALTGNMMTMPGLPKVPAANGMDILESGEIIGLS

SEQ ID NO: 59844 - protein, 355 aa, Campylobacter lari RM2100
MSAKILFIDRDGTLIDEPKNDFQIDSLEKLEFEKGAINALLKLKNFGFKFVMVSNQDGLGTNSFPRENFDKVHEKMLSVFQSCGIEFEDIFICPHFEHENCACRKPKTAMLENYIKNKLYDKNKSFVIGDRDSDMLLAQNLKIQGLKYDKNDFNWEQIADFILQNYRSAYIERNTKETQIQVKIAFNEKAKANIKTNIAFFDHMLEQIATHANISLEIKCKGDLEVDEHHSVEDVALALGEAIKSALDQKIGIARYGFVLPMDECLASCAIDFCNRPHLVYKAKFKKEKLGELSTEMIEHFFYSLSYAMGASLHLKVKGKNDHHKAEGLFKAFARALKMAIKIENENLASSKGVI

SEQ ID NO: 59845 - protein, 396 aa, Aspergillus nidulans FGSC A4
MSVYRPINALSNASRPCVHKHQRVHELSLQYSQRPMNGNASMRYSRYDESADPDMRDKQAPSEVQSQTKLEIAQKYGLTTRDLRVFDLPSAGFPHVLVREHAILVHLFDLRLLIECDHVLLFHLASKSVEAGSASSNSNGDDDESDFGIGSSVSQVFSHNLERKLLGSANSTTQPYELRVLEAALASATSVLEAEYSLTADEVSQLLRKTHQDAPFISDKEKEYESLIHALLRLSRHLASIDQAARQVRTLTSEVLAEDEDMANMYLTDKAQGKPHLPSDHQDVEYLFEAYFKASDTIVQEATRMMGNITRTEETIRAALSVRRNQIMVLEARIEILMLALAGGTLVAGWYGMNVVNGSEESSTAFGAIVVGSLMGVGLITWGGLRRLKRINKIRV

SEQ ID NO: 59846 - protein, 187 aa, Pinus taeda
PAQTEAASYYPAAPHHGVEHGHGHEGQLTPEEAEQQKHTGLMGKLHRTNSSSSSSSSDEEGEGGKKKEGGRKKKGSKDKSKEKLPGAGQHSSDQCGVKEEKKTGLLDKIKEKIPGHQEKLSGGGTHSSSDECGGKEEKKTGLLDKIKEKIPGHQEKLPGDGKHSSDEHGDGKHSSDEHGGEEEKKLG

SEQ ID NO: 59847 - protein, 473 aa, Synechococcus elongatus PCC 7942
MPETAQEVLQLIQEKGIQLVDLKFIDMPGIWQHLTLHVSQIDENSFVEGVPFDGSSIRGWKAINESDMTMVPDPTTAWIDPFMKEPTLSMICTIYEPRTNTPYERCPRAIAQKAVDYLKASGIGDTAYFGPEAEFFIFDDVRFDQAENKSYYYVDSIEGRWNSGREEEGGNLGYKPRYKEGYFPVAPTDTSQDMRSEMLLTMADCGVPIEKHHHEVATGGQCELGFRFGKLIEAADWLMTYKYVIKNVGRRYGKTITFMPKPLFNDNGSGMHTHQSIWNDGQPLFAGDQYAGLSQMALWYIGGILKHAPALLALTNPTTNSYKRLVPGFEAPVNLAYSQGNRSASVRIPLSGTNPKAKRLEFRCPDATSNPYLAFAAMLCAGIDGIKNQIDPGEPLDVDIYDLSPEELAKIPSTPGSLKDALKALEADHDFLTVGGVFTEDFIQNWIEYKLDNEVIPISLRPHPYEFALYYDC

SEQ ID NO: 59848 - protein, 313 aa, Wolbachia endosymbiont of Drosophila simulans
YSLCVEKLLQCEVPIRAKYLRVLFCELTRILNHLLNVSSQALDVGAMTPLLWLFEEREKILEFYERASGARFHAAYIRPGGIAADVPEDLIEDIAKFIEQFPKYIDDVDELLTENRIWKQRTVGISEISIKQALDWGFSGPMLRAAGLAWDLRKSQPYEIYDQLDFDIPIGQNGDCYDRYLVRMAEIRQSISLVKQCIEKMPEGQIKTEDRKISPPSRAEMKKSMEALIHHFKLYSEGYHVPEGEAYAVVEAPKGEFGVYIVSDGTNRPYRCRIRAPGFAHLQALDFMAKGHMLADVAAIIGSLDIVFGEIDR

SEQ ID NO: 59849 - protein, 416 aa, Triticum aestivum
QVCTKKQAGTGPEFPGYRRPTRPRRRIGDDSSSMVRSTINFASIPGVPKEFDYKDLRKGTGNFDEKMKLGQGGYGVVYRATVVGEHGQSMEVAVKQFSGANTKGQEDFLAELSIINLLRHRNLVKLLGWCHQDGVLLLVYDFMPNGSLDRLLFGGPEAPVLTWGHRYNIVAGVASALNYLHHEYDQRVIHRDIKPSNIMLDAAFNARLGDFGLARALETDKTSYTDKLGVPGTLGYIAPECFHTGRATRESDVFGFGAVILEIVSGRRISCSNAAGCSQLLEAVWQLHGAGEGRILEAVDRRLAPGEFDEGDAERLLLLGLACSHPNPGERPRARAIVQILARSAPPPDVPASKPAFMWPALPVVLGDDDGEMAVSGTSTALTSSSSYYASSAGWTTQNYLLTREHDVADRDMPTA

SEQ ID NO: 59850 - protein, 568 aa, Coprinopsis cinerea okayama7#130
MTEKRVAENVEAGVEDAPQAKRLRTDEAMDEDRNATAATTTQASTETATVITEDSLNDMDEGTESDAGSQVGSTEKRKKKFDTRRRRKDKSNTDGKPKPARNRRRATKEEEEANREKRRLEEEQGLRQPRLPKRQSALLIGFCGSGYSGMQIQPMDSVKTIEGVLFQALVKVGAVSQDNADDPVKVALARAARTDAGVHAAGNVVSMKMISTIPGVPDLVAAVNEQLPPEIRFWGFVRTQNSFNARFRKYTYFFPSYLLIPPKPGSGLDERLKAFNESLGDTVPRPIHPFWADAPGNSTKEEDLIRKRRWRVDSGPIERLRETARRYEGTHNFHNFTVGRDFKDRSNFRFMKSITIEDPVVYGETEWISVLFHGQSFMLHQIRKMMSGLVLSCRTGAPPEVIDQLYNEEQVFVPKMPSLGLLLEEPLFTSYNSRVAKINTNLKPEDADYRPPIDFDLHREKMAEFKEKFIYKNMREIEDRDGLFDAWIRSVDCYSGDDLLYLNSQGTVPDACVIKKGVRRTNPFREKRVFDTTSFPTADRVKKQLEESDGEEVEEEIIDKKMLAETEG

SEQ ID NO: 59851 - protein, 469 aa, Blastopirellula marina DSM 3645
MTPKEVLALCREKDVKAVDFRFMDFPGMWQHTTIPVGKLVEDIFEDGLGFDGSSIRGWQAINESDMLIVPQADTAFIDPFCTLPTLVLICNIQDPITREDYSRDPRNVARKAVNYLRSTGIADRAFFGPEAEFFVFDDVRFDQNSHQGFYFLDSCEGEWNRGRDEGPNLGYKLRHKEGYFPVPPSDQMMDIRNEMMQTMIECGLDVECQHHEVATGGQCEIDLKFQEMVKMADQMLIYKYIVKNVAKKYGKTATFMPKPMFGDNGSGMHTHISFWKDDTLMAGSGYAGLSETALYMIGGILKHAPALLAFTNPTTNSYKRLVPGYEAPVNLAYSQRNRSASCRIPMYSPSPKAKRIEFRCPDPSCNPYLAFAALTMAAIDGIQNKLDPGDPLDKDIYDLPPEEMAAVPKTPGSLEDALVALQDDHDFLLKGDVFTQDVVDTWIHYKKKNEADAIRLRPHPYEFCMYYDI

SEQ ID NO: 59852 - protein, 356 aa, Coccidioides immitis RS
MPSLENFPDIPPFPDDIVTAPLFRLSLEKLLNHDNDEVKRFCTACEDLGFFYLDFRGTTQGDAILAQADELFGVGERLFELDLEEKKKYDFGKKNSYFGYKATGSNVVDRDGNRDRNEFYNVSKDDILDVADHWPAPELLHESRPLLKSFMTSAHSTITLILNLLNEHLQLPASTLANMHRLGHATGDQVRFIKAPPQPVDDRRVALGQHTDFGSVTILFNRVGGLQILPPGKDSEWCYVRPLPGHAIINLGDAMVKFTNGLLRSNIHRVMSPPGAQADITRYSLVYFSRPEEDVPLKRLEGSPRIPPLPKGVVEEDIKSKDWIIRRGLGNRVDLHKQIDYEKSRGTELQSQRLDA

SEQ ID NO: 59853 - protein, 408 aa, Mycobacterium sp. JLS
MLPDTDRRTRSTWLLLGPAFVAAIAYVDPGNVAANVSAGAQFGFLLVWVIVLANVMAGLVQYLSAKLGLVTGRSLPESVAGRTRTPTRIAYWLQAELVAMATDLAEVVGGAIALYLLFDLPLLIGGVITGAVSLALLAVQNRRGQRHFERVISGLLLIIAIGFLTSVFVEPPPVADVAGGLIPLFEGTDSVLLATAMLGATVMPHAVYLHSGLARDRHGHAEPGARRRLLLKATRIDVGLAMLIAGAVNMSMLLVAATNLQGMSDTDTLEGAHAAVQQTLGPAVALCFAIGLLASGLASTSVGAYAGAMIMGGLLRRTYPLLVRRLVTLVPALAILAIGVDPTRALVLSQVVLSFGIPFALIPLIRLTSDRAVMGDDVNHRITTTLGWVVAGLISLLNVVLIYLTVTG

SEQ ID NO: 59854 - protein, 331 aa, Sulfolobus solfataricus P2
MILILGGGFAGVSAYNQNKENSLVVDRKDYFLLTPWIIDFICGMKKLEDIIVKYKKVILGNVQKIDFKNKKVILDNSKELTYDKLIVSLGHHQNLPRLKGAKEYAHKIETLEDAIELKRRLNEVKDITIIGGGATGVELAGNIKGKKITLVQRRNRLLPTMSTASSKKAEDLLRELGVNLMLGVEAIEIKKDSVVTSYGEIKTELTIFAGGLKGPQIVGNLHANKNHRLLVDKNLKSIEYNDVYGAGDCVTFEDKEIPMTADIAVAAGRVVMKNILGNEIEFKPKRLATTIRIRNEFFGDFGENYVEGKFAKILKDISYLESLLLPRRLRE

SEQ ID NO: 59855 - protein, 643 aa, Zea mays
MKSTVFSAAVVSIGYALLGWDFAALSEANNHMEKEFELLNGPSIEGITLAASTFGAIVITIFSGALLDWLGRRVILVYSSLVLFSGGVLMLWSPNIYIVLLASWRIMIGAIFAPSIVYFALLVYYLPESPRWLASDGKISEARVSLQWLRGKKHDVSGEIAAIVEGVDIISDSTVGAARAQSFSGTSASHTWPRSTFYWQLSDPLVDLLGSVHENMSEGGSRRNSFFPVFNSFSFPEHEHMNEHRDGNSDQQTRETYYAGEANNGDGLRASLLSQAANVEVNDTNTSFTSEGSSSYLRRHGTSVLAQEFMASIHDYDIEEEEEEIHRFALPHQSAPRDMESTGRHPFRHQIVRLSETADMKFKWRVLLQPGIRHALCYGMLIQALQQVRLCVIVDYVFNSAWSSVYLRTGYHVYRMLVSLLTRSFLLVSCLLFSKIQSTGISGLLRCAPEIFEQSGVASLFSDIGLSPHSTSILMSTLNALLILPCITAAMLLMDVCGRRVLVLATTPVLILSLSVMSMSTLVNMGPFESAVLFHFALTICFWSYVIGLGPIPNILCSEIFPTKARATCASFCSLSFWFGGLLSAYCFPVMLSTIGLGGACGIYALVCCAPLFLVYYRIPETKMLNLELIAELFKLSRQEYVQ

SEQ ID NO: 59856 - protein, 141 aa, Haemophilus somnus 129PT
MTLEQTLAIIKPDAVERNLIGNIISRLEDKGFQIIAMKMLHLNQEQAEGFYTEHSDKAFFAELIRYMTSAPIVVLVLQKENAVKDYRTFMGTTNPEIAENGTLRYEFAINQTQNSVHGSDSLENAQREIAYFFAEAEIYAR

SEQ ID NO: 59857 - protein, 388 aa, Oryza sativa (indica cultivar-group)
MEVEAATTQRQPCKNAITTKQQQQQQLSTGRLFRSPLLVVNFVLMVVGSACGPLLLRAYFLRGGNRKWLSSLLQTAGWPLLLAPLCFSYSSRRRRREVEDDGAGAGAAATPLFLMTPRLLVASAVVGLMTGVDDLLYAYGLAYLPVSTSSILISTQLAFTAAFALLLVRQRFTAFSVNAVVLLSVGAAMLGMNAGGDRPAGVSRAQYCAGFAMTLAAAALYGLVLPVMELSQAHHAAARGAVTYTLVMEMQLVIGFVATAFSAVGMLVNNDFHAIPGEAHEFGLGQAGYYLLLAGSAAMYQCFFLGTIGAIFYGSALLAGVIMTVLIPVTEVLAVMFFHEPFNGTKGVALALSLWGFVSYFYGEVRAAKAAHRRRHSDEPPKPDHLDP

SEQ ID NO: 59858 - protein, 762 aa, Arabidopsis thaliana
MERVAELKRLPSKGPVSGHLSRRPYLDFETRDAPGMHLESLRERAARYNTGRSVNPTTTLGRELSQVLNVHREDMMMTQFGGNMNDFQEFEPVVSSVRTMKAKYPLLEIEEIGAADDDVTCKGSNDMSEEAGSSSFRGVSHPPEPDDMDLITTVYVPISEKNKPDSVCLMKSMSTTKGPFIEDISLCVPPKKPSPRVLSPAESIVEEPATSLSPFSVARASQNTENSLLPPDSDKECVWDASLPPSTNVSPHSSSVESMNLARAMSIANSSSATSTTQRSDVVLSMDKNYFDRSISMVLDSFESTKTSASRASDSSGLSEESSWSNFTGSLNKPHKGNDPWWNAILAIRTRDGILGMSHFKLLKRLGCGDIGSVYLAELSGTRCHFAVKVMDKASLEDRKKLNRAQTERDILQLLDHPFLPTLYTHFETDRFSCLVMEYCPGGDLHTLRQRQPGKHFSEYAARFYAAEVLLALEYLHMLGVVYRDLKPENVLVRDDGHIMLSDFDLSLRCAVSPTLIKTFDSDPSRRGAFCVQPACMEPTSACIIQPSCFLPRSIFPNKNKKNKSRKTQADFFKSHSGSLPELVAEPNTRSMSFVGTHEYLAPEIIKGEGHGSAVDWWTFGIFVHELLYGKTPFKGSGNRATLFNVVGEQLKFPESPATSYAGRDLIQALLVKDPKNRLGTKRGATEIKQHPFFEGVNWALIRCSTPPEVPRQMETEPPPKYGPIDPVGFGSNSKRMMGPPAVSAAAADTKSGGKFLDFEFF

SEQ ID NO: 59859 - protein, 368 aa, Shewanella oneidensis MR-1
MKKPPIIWLNVILFSLTFLSAVILVPWYGIVYGYGASEWIAFVVLAFASGLSITAGYHRLWSHKAYKTHPAIRFLYALGGALALQNSALHWASDHRVHHKHVDDNDKDPYSAKMGFWYSHIGWMLREYQAQRYHDYQNVRDLQNDRIVMWQHKHYLTLVLLMNIGLPALLGWFTGNIAGMLLMAGLLRLVVVHHCTFFINSLAHVWGCQPYTDKNTARDNGFLAVLTYGEGYHNFHHIFENDYRNGIKWWHYDPTKWLIKSLSWVGLAKDLRTSPQERIESARLQMQLLHAKNKVLNLPNADEIIEKIQQEYELMKQHLLEYYQAQKTLLEAKRKQLVDQQLLQQVEELKTRFLNQQKSWKSLTATYS

SEQ ID NO: 59860 - protein, 358 aa, Haemophilus somnus 129PT
MKSYTIAVLSGDGIGPEIMAEAIKVLDAVQKKYNFKLNYRTFDVGGIAIDNHGTPLPASTLNGCEESDAILFGSVGGPKWEHLPPNQQPERGALLPLRKHFKLFCNLRPATLYQGLEKFCPLRADIATKGFDMMTVRELTGGIYFGQPKGRDGEGMQTRAFDTEVYYKYEIERIAKVAFETAMKRRKHVTSVDKANVLISSVLWRETVNEVAKNYPDVTLDHIYIDNATMQLIKQPEFFDVLLCSNIFGDIISDEAAMITGSMGMLPSASLNEHGFGLYEPAGGSAPDIAGKGIANPIAQILSAAMMLRYSFNLNEAADSIENAVKQVLSQGYRTADLADEHPPISTAEMGDLIVNAI

SEQ ID NO: 59861 - protein, 742 aa, Synechococcus sp. PCC 7002
MDQRKTKTLCPYCGVGCGLEVSEVIKNEQPTLKVMGDRQHPSSLGKVCVKGATIAESLDQDRLLYPMYRRSLQDQFQRISWDDAFELIVEQIKTVKATLGSEGIAMYGSGQLQTEDYYTAQKLLKGCLGTNNFDANSRLCMSSAVAGYIQSFGADGPPPCYEDLELTDCAFIIGSNTAECHPIVFNRLREHHKRSKAKLIVVDPRRTKTAEVADLHLAIKPGTDIDLLNGIAHLLLKWGKIDTLFIDECTKGFSKYAMLIQSYTPETVARRCGIRIDHLEQAAKYWANADNVLSLWSMGMNQSAEGTAKVRTLINLHLMTGEIGKPGAGPFSLTGQPNAMGGREAGGLAHLLPGYRLVKNPEHRATLEKAWQLPPGTISPLPGKDAWAMIEGLDMGTVGLLWVVATNPAVSMPDLERTKAALLKSPFTICQDAYYPTETSNYAHLLLPALQWGEKTGAMTNSERVVTYCPQFRDRPGEAWADWEIFAEVGRRLGFQQQFRAVSSAEVYAEFVQLTGDRPCDMTGLSHQRLATEGPIQWPCPANETKCDPETTADNRGLLQKLFHQDEPLKGKRLYTDRRFHTPDGRARFAAYHSRGLAEPPNTDYPFVLTIGRLYGHWHTMTRTGRIKKIQKMHPNPFLEIHPRDADRLSITDGEMVEVRSPRGMARFPALITKNITPGTVFAPMHWGALWGEDTEANALSHAEACPDSLQPELKACAVNVQKITGPVPQEKATAEPVLQQL

SEQ ID NO: 59862 - protein, 388 aa, Oryza sativa (japonica cultivar-group)
MASSSSSSSSSPPPPPPRRSVFDAAYIRAEFAAAGISPHFIPLIWKYVLQNPRCGDLDAVPSLPAAAYALLRQKFQPTTSTLTTAAESKDRTTTKLLIRLKNGESVEAVIMRYDTRLGKYDGKPRPGGVRSTLCVSSQVGCKMGCRFCATGTMGFKSNLSSGEIVEQLVHASRYSQIRNVVFMGMGEPLNNYTALVEAIQVLIGSPFQLSPKRITVSTVGIIHSINKFNNDLPNINLAVSLHAPDQDIRCHIMPAARAFPLVKLMNALQSYQNESKQTIFIEYIMLDGVNDQEQHAHQLGKLLEMFKAVVNLIPFNPIGSSNNFKTSSEHNVKKFQKILRGIYNIRTTIRQQMGQDIAGACGQLVVSLPDERSAGGATLLSDIEDIRI

SEQ ID NO: 59863 - protein, 473 aa, Parvularcula bermudensis HTCC2503
MTEEMTRELTFRQNVNMMFDRATTYLDIDEGLKHKIKICNSVYTVRFGVKLRGSIHTFTGYRAVHSEHMEPVKGGIRYALSVNQDEVEALAALMTYKCALVRVPFGGSKGGLCIDPTQWDADELERITRRFTYELAKRDLIHPSQNVPAPDMGTGEREMAWMADAYKRMHPTDIDAMACVTGKPPHAGGIRGRVEATGRGCQYALQSFFSFPEDVAACGLDGGIEGKRVIVQGLGNVGYHAAKFLSEEDGAKIVGVIERDGAILHDDGIDIEEIKHFLTRNGGIKGYPHGKYIEDGLSALTADCDILVPAAIEGVINGANAADIKARIILEAANGPVTANADTILREKRVEVIPDLYTNAGGVTVSYFEWVKNLSHMRFGRMQRRAEEKRAMALITELERATGQPLNDQFKARFAQGDQEIDLVRSGLDDTMRTAYARMRQTRVTTKGIEDMRTAAYATALTDIAKSYESLGL

SEQ ID NO: 59864 - protein, 379 aa, Nicotiana tabacum
MAIDCMITNVNSPMLRILEDDKKPLIFDASQMKREYNIPTQFIWPDDEKPRAVARELPVPLIDLGGFLSGDPVAAQQASRLVGEACRNHGFFLVVNHGVNANLISNAHRYMDMFFDLPLSEKQKAQRKLEEHCGYASSFTGRFSSKLPWKETLSFRYSAEEDSSHIVEEYFQNTMGESFSHLGNVYQEYCNSMSTLSLGIMELLGMSLGVGREHFKEFFEENESIMRLNYYPPCQKPDLTLGTGPHCDPTSLTILHQDSVGGLQVFVDNEWRSVSPNFNAFVVNIGDTFMALSNGRYKSCLHRAVVNNKTPRKSLAFFLVPKKDKVVSPPNELVDTNNPRIYPDFTWPTLLEFTQKHYRADMNTLQTFSNWLKQKTAQV

SEQ ID NO: 59865 - protein, 245 aa, Schizosaccharomyces pombe
KSFIKVSSLEQLKATGTVVVSDTGDFESIAKYKPQDATTNPSLILAASKKPQYAALVDAAVDYAKAKGGSINSQIEIAFDRLLIEFGTKILAIVPGRVSTEVDARYSFDTQTTIEKARHLIKLYEAEGIGRERVLIKIASTYEGIQAAKQLEEEGIHCNLTLLFSFVQAVACAEANVTLISPFVGRILDFYKAKNNRDYTAQEDPGVVSVSNIFNYYKNSVTRPLSWVLLSVTSVRSRNSLVLTF

SEQ ID NO: 59866 - protein, 489 aa, Acidobacteria bacterium Ellin345
MCHGSLPCNERMDYTQASASQTLTAANPASNKPEKPTLVRGMSFLDAVLLLVGGIIGSGLFLTSSDVAKTTYTPLIFMSAWIVGGIVSLLACLSVAELGSMFPEAGGQYVYLREAYGDFPAFLYGWMIFSVNVTGSNATIAAGFAAYAGAIIAPLNATRPIFSIGAWTFNMGHATAISAIVFLTWINVVGLRPAVILQNIATWAKFIAIAGFLVLGFLIGHGSWHNATQPIPGHVGFLSLASGFGVALIAVFWVYDGWVYATWVAGEIKDPQRNVPRSLIYGIAIVAAVILAVNVLYLYAMPMQQMAMQDTVGQAAAQILFFPAIGRWFSALVAIACFGAAACSILSGARVYYAMAADGLFFQKLAEVHPRWRTPAFSLIVQCIWSCALVLTGRYDQLFTFVMFISVIAYAAAASSIFVLRRKRPDMPRPYKCPGYPWVPLAYCVICGAWALNALWSKPFESLAGVGIMLIGAPAYIYWHRAKRKPAVL

SEQ ID NO: 59867 - protein, 200 aa, Medicago truncatula
MIHDNNFVVPFKPWMEISNRVHNYVAEFHKQQVMVNRELVTENIRWKTPEIGWIRLNTDGASTRNNVAGCGGVLRDDNGKWICGFSKWLGVCSAYVAELWGVLEGLKMARERGFHKVELHVDSKAVVSNLVDGKGGSAMGLSLLTNIRSLLELNWEVRICHTFREANSRADALANLAYDGDSSLIIYEQCPVQMRLCFFC

SEQ ID NO: 59868 - protein, 213 aa, Porphyra yezoensis
AGGIAEMAGLPSEVRDTTDALDALGNTTAATGKGFSNGSAVLTAYALLTALVQDSGLAPNPLQLVGPAAAAAGVAGAHVTDGGQVVSLVDIYVVVSVFIGIMLPFFFGALTMLAVSRAAQAMIVEVRRQFRDIPGLREGARGVQPQHVRCVNISTRSAIIEMVIPGALAILTPLIVGFGFGQRALIGLLLAAIGSGYMLGIMMSNAGGAWDNA

SEQ ID NO: 59869 - protein, 368 aa, Oryza sativa (japonica cultivar-group)
MAHARSTGSLPVANVQALAETCNDPDQQIPERYIRADANADEVISGDDCTAAIPTVDLSKLLDPLSSDEETEKLGSACQQWGFFQLINHGVSEDVIRDARKDIAEFFRLPMETKKAYSQLPSGIEGYGQAFVVSHEQKLDWADMFYLVLRPGESRNMALWPAHPPSFRNSIDRYSSETARVARCLLEFMAKDMGVRPGSLLERFQDQPQGIRMNDYPPCREAGKVVGLSPHTDAACLTLLLQVNDVPGLQIRSPGGRWLAVGAPPDDGAFIVNVGDILEIMSNGKYRSVEHRAVVRPDRERVSAAVFHQPCQDAVVGPLPELVGEGGGDNARYTSMGYLDFMKRYYSAKLDGRNHLDGLRIKLSSSKG

SEQ ID NO: 59870 - protein, 253 aa, Zea mays
  misc_feature (190)..(190): Xaa can be any naturally occurring amino acid
MAGASRKDLLKKVYNMVPPMLESFHKGQLGRVAVIGGSEDYTGAPYFSAMASAKLGCDMSHVICEPGAGAVIKTYSPNLMVHPYMRQSKNLAQSESAESVSAEVVGMLSRLHVVVIGPGLGRDKLMQDTCAKVIEEARKQGIPFVLDADGLYLAQTRPELVEGCKECILTPNVVEFGRLAKAKGVNVDEXRSFRTLLQAIKGFLGGVTIIQKGAKDYISNGSHTLVSEGEGGLKRSGGQGDTLTGSLATLLTY

SEQ ID NO: 59871 - protein, 394 aa, Photorhabdus luminescens subsp. laumondii TTO1
MANKKSNNNKVFKDETSLYSRYSISTLFLKFFVTLLLTNKITKKISLWMMRFILNKKNKFFIRFLNGVYFGGESIDEAKANVIFLSKNNIHSILDYAIEGKNDEIFFDNALESTLKLIDLASKESNIPYVAIKPSSLGDIHLYEEKMRGWNFFGEKINSWSRILERYEKIFHYAEIKSVKVMIDAEQSWIQAAVDKIVIDSIIKHNKILPIITLTIQSYKKESIDLLMLLHKIAIDNNIKVGIKIVRGAYLEEEIKNKEKSIGTFFLNKEETDLNYNYLVEYISKRIEYFYPFFATHNENSISIILNKNELKNKSFWIGQLYGIGDHISSKLAYNGIRTCKYLPYGPIDKSLPYLLRRINENAVASDTFVTENRKIMKEIILRLKNTGDKNGCL

SEQ ID NO: 59872 - protein, 944 aa, Coprinopsis cinerea okayama7#130
MADPPRTPFSFHSTKTVRDPKSIGLWTVGRTIGKGASGRVRIARHAKTGQYAAIKIISKSTLPPMMSQVSLNRLADVTEHVQLSVEREIVVMKLINHPNIMKLYDVWETSTDLYLVLEYVQGGELFDYLCSKGRLPVHEALLYFQQIISAVDYCHRFNIAHRDLKPENILLDENSNIKIADFGMAAWQSNPDAETLRTSCGSPHYAAPEIINGQPYNGAAADIWSCGIILHALLVGKLPFDDDDCPALLEKILRAKFTMPTDIPASAQNLLGRMLEKDVKKRITMAEIMEHPFFLSQDPPKVDYALPDLESIAQPVPSVSALDPDIFANLRTLWHGTSDAVLIDSLINNERNWQKGIYHLLVDYRSRNPQVYDEDEQAVAKLHKERKRRRQQRKPVQNDGDADDIPPRAAPPTPRSASRHNRLGIDLSFDELLPHAKSSSSSLSERNETSRPTHLQPPPMSTQRSSDSTTSEGTSVSSTTATTTTATSSSLLTPFSPLWETLDLPKLTVPNTQDREMQTFFNHIVTHLNVLQAKTASSEISTWGASSSLGSAASGGGSESGTIKSGRSGLSASSAAVPNARMTSARKTGVDHEDGFFRPSRHSSPRLDSSLIAPIQQKGKGKEKASLHLPEEGDEDDEDSLGEVEGRQQLGASTVEALRYTETQPLSVRSHSRRALYPVTPSRTTNKENEDVPLDAYRSNLTRQALANHAKRNLSTPKAITIVEPQPVSQRKHIRQGSRKPPQTPLSALSPLDNRGVGGLSSSSAYAHGYTSPPPHPSSTATPKRTWIDTVFKPKAPNYTLYSRRGVQETRNECRRLLMDLDLLVSIEENERMGVLKCRSIEIQDPFRVHNVPKAIRFRVEGQRAPYNLVQSGITMSLSFYHEKGSFEAFQDIYHSLRARWDMDKVESVAEGDEDEMEGMTKLASGLSALSTRAIGGRPASQAY

SEQ ID NO: 59873 - protein, 363 aa, Oryza sativa
PNRLASERGGAVHSCSSTLTVVSRAEREGKRAQRAGGEAAMGEEEKVKEEAAAEKGKEAAVAEEKEAAAAGEEKKEDAPPPPPPPEEVVMRVFMHCEGCARKVKKILRGFDGVEDVVADSKAHKVIVKGKKAAADPMKVVHRVQKKTGRKVELLSPMPPPVEEKKEEEKKEEPEPPKPEEKEPTVIAVVLKVHMHCEACAQVIRKKILKMKGVQSAEPDMKASQVTVKGVFEESKLTDYVHKRIGKNAAVVKSEPAPPPENAGDANAKDDKKAAEGGEEKDESKEEKKEGDDEKEKEKEKDDSNAAEVEEKDKEKDPSALAAANLYMHYPRFSNPGGYGVPGYAYPYAPQLFSDENPNACVVM

SEQ ID NO: 59874 - protein, 224 aa, Brassica napus
REDSSLAHITTRCGILAVLGCIDNSQAKRSRIIELSRRLRHRGPDWSGLHSHEDCYLAHERLAIIDPTSGDQPLYNQDKTVVVTVNGEIYNHKILREKLKSHQFWTGSDCEVIAHLYEEHGEEFIDMLDGMFAFVLLDTRDKSFIAARDAIGVIPLYIGWGVDGSVWFASEMKALSDDCEQFMAFPPGHIYSSKQGVLRRWYNPPGYSELVPSTPYDPLVLRKA

SEQ ID NO: 59875 - protein, 446 aa, Salinibacter ruber DSM 13855
MTDHATDAMEVAPSDVDLRTSRRFYERAQHSIPGGVNSPARAFDSVGGTPLFIERAEGAYLEDADANEYLDYVGSWGPMIFGHAHPDVVEAVKDQAEASTSFGAPTEIEIEVADLVCDLVPSVEKVRMVNSGTEATMSAARLARGYTGRDKIIKFEGNYHGHGDFFLISAGSGAMTLGKPDSPGVTDGNAKDTLLAQYNDLSHVQRLVEANQGEVACIIVEPIAGNMGCIPPEPGFLEGLRELCDAHDIVLVFDEVMTGFRVAPGGAQERYGVIPDLTCLGKIIGGGLPVGAYGGKQEIMDYVAPTGPVYQAGTLSGNPLAMRAGHAILSKIAEEKDRIYDQLEDYAEALQKGTEHNLDALGLDYTTHQVGAMGSLFFTDAEVVDQDTAQTADTEAYAAYFHAMLEEGIYLPPSQFEAVFYGTCHGEDELETTLETQRRALKRVHS

SEQ ID NO: 59876 - protein, 657 aa, Sulfolobus solfataricus P2
MEVRKTICPFCGVGCGLDFYVENNFIFRVSPSQEHIVSRGHVCGKGAVASEVIYAWDRLTYPLKRVKDTFVRTTWDEAISDIASKLKEIRSKYGSEAIAFYGGCQNTLEEGYSFMKLARALGTNNVDSCARVCHEPSAMALKELVGIGASSVTVSEILNARNIVISGESVTDSHPVLSQYLVEAKRKGVKIVVIDPRMTGTARIADLFLQISSGTDIYLYNAVANYLISNGLYDSKFVKERVENFDEFREIVKSYTIEEAERITSVSKDKIIEFARIIANKPTILSWGLGLTQSSGVNAVKAYINLALLTGNVGINGGGLLVYRGQTNVQGSGDLIKPDVFPNGPMNEENAKELSKIWGFVPPIKKGLSITEAFLRDSNVKALFLMNYNPAFSLPNRYKVIKFLKSLELLVVMDPFMTETAKYAHYVLPTPLWAEKEGSVTNLDRTVKWRFKVVDPPGEVRSELWIIKRIAEKLGLTGFHDDPKLVFKEIKEVAKLYSNLTLDELMDYSVDSRYPDHESSLYKDRFMTPSGKAKFGLVRYNEISGDSYILITGRVVTRYNSDELIKRVPGYRNFSSDLLINPEDATKLNIKDGDMVKVVSKCGMAVMKAKLTNEVKVGHTFAYMHDYYVNNVVCDDLDDISKTPRYKITFVKIEKLG

SEQ ID NO: 59877 - protein, 1307 aa, Ceratodon purpureus
MSATKKTYSSTTSAKSKHSVRVAQTTADAALEAVYEMSGDSGDSFDYSKSVGQSAESVPAGAVTAYLQRMQREGLIQNFGCMVAVEEPNFCVIAYSENASEFLDLIPQAVPSMGEMDVLGIGTDIRTLFTPSSSAALEKAAATQDISLLNPITVHCRRSGKPLYAIAHRIDIGIVIDFEAVKMIDVPVSAAAGALQSHKLAARAITRLQALPGGDIELLCDTIVEEVRELTGYDRVMAFKFHEDEHGEVVAEIRRMDLEPYMGLHYPATDIPQASRFLLMKNRVRLIADCYASPVKLIQDPDIRQPVSLAGSTLRAPHGCHAQYMGNMGSIASLVMAVIINDNEEYSRGAIQRGRKLWGLVVCQHTSPRTVPFPLRSVCEFLMQVFGMQLNLHVELAAQLREKHILRTQTLLCDMLLRDAPIGIVSQTPNIMDLVKCDGAALYYGKRVWLLGTTPTENQIKEIADWLLEHHNDSTGLSTDSLADANYPGAHLLGDAVCGMAAAKITAKDFLFWFRSHTATEVKWGGAKHDPDEKDDGRKMHPRSSFKAFLEVVNKRSPPWEDVEMDAIHSLQLILRGSFRDIADSDTKTMIHARLNDLKLQGVEERNALANEMSRVLETAAAPILAVDSRGMINAWNAKIAQVTGLPVEEAMHCSLTKDLVLDESVVVVERLLSLALQGEEEQNVEIKLKTFGTQTTERAVILIVNACCSRDASDFVVGVFFVGQDVTEQRMFMDRFTRIQGGEKTTVQDPHPLMRPSFDGDEFGRTFKRNSALGGLKDHATGSVERLDLYLRRAEECMEVMETIPSPKFNNKQCQYLAGKLKAVLQSASLFLRISHHEHHELGASIDMGRHVEIFKLLLALAKEIESFIQGCCKDEWIKAAMTLTNVSEYVSSMGFNLELCKIAFCKSCAASGSLTLDQIEVICKDEAEVVKRNASIDVDTLFAKVIYDLTEKTLSSDQNDLAIYLLQRLKRAKPILPSFSSRPSWWNFYDDWSFSEKFFQWIQITGSLGSGSSATVEKAVWLGTPVAKKTFYGRNNEDFKREVEILAELCHPNITSMFCSPLYRRKCSIIMELMDGDLLALMQRRLDRNEDHDSPPFSILEVVDIILQTSEGMNYLHEKGIIHRDLKSMNILVKSVKVTKSEIGYVHVKVADFGLSKTKDSSTRYSNQTWNRGTNRWMAPEVINLGYESTEGEISFDGKVPKYPLKSDVYSFGMVCYEVLTGDVPFPEEKNPNNVKRMVLEGVRPDLPAHCPIELKALITDCWNQDPLKRPSFAVICQKLKYLKYLLMTGFSSYQDSYPSTEEPS

SEQ ID NO: 59878 - protein, 375 aa, Oryza sativa (japonica cultivar-group)
MMPRTPPPTSPPLDDDDANETRRRVAIAGAASSPPPPRPAMPMFPGDVGPVMLAPPPPLPFFPIAAVQSGLGFMHMSAPPEIVTARSKLNSDAPSFSPRSPAASAAADEVEVRDVWAANLEEELRSIGALLPTYPVVSMDTEFPGTVHDVATPRHLRTPRESYAVVKRNVDELHLLQLGLALSGPAGRCPVAWQFNFAGFDARRDPHSGSSVAMLAAHGVDFTALRRHGIDHGDFARAFGRSKLACGRLTWAAFSGSYDFAYLVKVLTGGRPLPSTLEGFMAKVSKIFGPAVLDVKHLAKFCGGGGGIRGGLEHVAAALGVHRAAGRAHNAGSDSLLTSDVLHAMVDRFFPNSGVLNHAGAIDGLVKCSNLYYKY

SEQ ID NO: 59879 - protein, 382 aa, Parvularcula bermudensis HTCC2503
MTTLISTLPEAAAPQRRRLFGLSRAALQSLFAADLGLAPKAAKMRASQVWQWIYSHGVREFDQMTNIGKALRAQMDALYDLSRPEVAERQVSQDGTRKYLIRFAPGIEAEAVFIPGVGRAGALCVSSQVGCTLNCTFCHTGTQALVRNLTAEEIIAQIIVCKDDLGEWPSSRDDRQLSNIVFMGMGEPLYNLDAVAQAIDIIADGEGISISRRRITVSTSGVVSQMRALGERTEAMLAISLHATHDALRNELVPINKKWPLDALLAACRDYPGTSNAKRITFEYVMLKGINDSDAEARELVRLLRGIPAKINLIPFNPWPDSPYECSSWDRIERFADIVNQAGYASPIRTPRGRDISAACGQLKSESVKERASARRRTETVS

SEQ ID NO: 59880 - protein, 528 aa, Oryza sativa (japonica cultivar-group)
MGNCCPPGSSSEPDPPPASSGSSRPAGSAGAAASPATISPSAAPAPAKPPAPIGPVLGRPMEDVKSIYTVGKELGRGQFGVTSLCTHKATGQRFACKTISKRKLSTKEDVEDVRREVQIMYHLAGQPGVVELKGAYEDKHAVHLVMELCAGGELFDRIIAKGHYTEHAASSLLRTIVEIIHTCHSMGVIHRDLKPENFLLLSKDEHAPLKATDFGLSVFFKEGEVFRDIVGSAYYIAPEVLKRSYGPEADIWSIGVMLYILLCGVPPFWAGKLLLFIAMHGIFNSILRGHVDFSSEPWSRISHGAKDLVRRMLHSDPKQRISAYDVLNHPWIKEDGEAPDTPLDNAVLGRLKQFRAMNQFKKAALRVIAGCLSEEEIRGLKEMFKSMDSDNSGTITVDELRKGLAKKGTKLTEAEVQQLMEAADADGNGTIDYEEFITATMHMNRMDREEHLYTAFQYFDKDNSGYITIEELEQALREKGLMDGREIKDIISEVDADNDGRINYTEFVAMMRKGDPEANPKKRRDVVL

SEQ ID NO: 59881 - protein, 378 aa, Schizosaccharomyces pombe
MSFEGKTITCKAAVAWGAKEPLSIEDIQVAPPKAHEVRVKVDWSAVCHTDAYTLSGVDPEGAFPIVLGHEGAGIVESIGEGVINVRPGDHVILLYTPECKECKFCRSGKTNLCSKIRETQGRGLMPVGTSRFSCRDKTLLHYMGCSSFSQYTVVADISLVAISHSAPLRSICLLGCGVTTGFGAVTHSAKVESGSTVAVVGCGCVSLAAMQGAVAAGASRIIAIDINADKEVYAKKFGATDFIDSSKVKDLVQYVIDVTDGGVDYAFDCTGNVTVMQQELQFCHKGWGKLCVIGVAAAGKTLDFRPFLVVTGRQVLGSAFGGVKGRSELPNFVDEYMQGHFKVDEYITNEEPLKNINKAFDHMHEGKCIRCVVDMNKP

SEQ ID NO: 59882 - protein, 421 aa, Candida glabrata CBS 138
MISLERAKELVEQKQYAEAEQVYLGILNQEVPMDEKKKDEREKAILAMGDMYVEQGDKAKLREFIPHSTEYMMQFAKSKTAKVLKTLIEKFSLVPNSLEDQIYVCKQSIDFAKREKRVFLKHSLEIKLATLHYETKEYKDSLALIENLLREFKKLDDKPSLVDVHLLESKVYHKLRNLAKSKAALTASRTAANSIYCPTVTVAELDLMSGILHCEDKDYKTAYSYFFESFESFHNLSTSNSYDKACQVLKYMLLSKIMLNLIDDVKSILNAKYTKETYQSRGIDAMRAVAEAYNNRSLHEFNTALKQYRTELMSDELTRSHFNALYDTLLESNLCKIIEPFECVEIAHISKMIGLDAQHVEGKLSQMILDKVFSGVLDQGNGWLYIYDTPHQDATYDSALELVGQLNKVVDQLFDKASVLY

SEQ ID NO: 59883 - protein, 298 aa, Glycine max
  misc_feature (119)..(119): Xaa can be any naturally occurring amino acid
MDSQVAVALALSLVGGVSTSIGALFVIVNKAPSLKMLGLLQGFAAGLMLSISFFDLAHNALNSLGFLKGNLWFFAGVIFFAVVASFIPEPTLTPTSDVKGRKKNGDEGGKDIMKKHRRXQVLFSGIVTAVGISLHNFPEGMAVFLGSLKGLRVGINLALAIALHNIPEGVAVALPVYFATQSKWQAFKLASLSGFAEPLGVIIVAYLFPSSLSPEILEGLLGSVGGVMAFLTLHEMLPLAFDYAGQKQSVKAVFLGMAFMSASLYFLSISLPEDLSFTKFLQKGSHRVSKDNNAPPCV

SEQ ID NO: 59884 - protein, 416 aa, Oryza sativa
KKIKIPEKKKGKKHTHIQRENIMALLSPRVPRLPLASASASAAGAGLRCCVSVGGGGGRAGSAAWCHASAAGSVASSSSELEAIRWGTAKLQGARDEMEDEVVLRPGSLLDGFSFAAVFDGHAGFSAVEFLRDELYKECAAALDGGAVLSTKNLDAITDSIQRAFATVDANLSTWLEQMDKEDESGATATAMFLRNDVLVVSHIGDSCLVVSRGGRPQAVTNFHRPYGNKKASLEEVKRIRAAGGWIVDGRICGEISVSRAFGDIRFKTRKNEMLVKGVKEGRWTEKFISRINFKGDLIVSSPDVSLVELGPDVEFVLLATDGLWDYIKSSEAVALVRDQLRQHGDVQVACEALGQIALDRRSQDNISIVIADLGRTNWKELPAQRPNLFLELTQAVATVGAVSLGIYISSLLALQ

SEQ ID NO: 59885 - protein, 196 aa, Ustilago maydis 521
MTPEEYEALSPDQQKQHDAAERAREAAEQAALPYTWKQQLDIVEISVPVPQGTKGRDLTIELKKRKIKVALKGKQAILEGELAKDIKEEDSTWTIEDANLVEIQLEKMNKNEWWPNVVTHHPKIDTTKIVPENSKLSDLDPETRAMVEKMMFDNRQKAMNKPTSDQIQQQELLAKLAAANPNIDFSNTKFNSSTPQ

SEQ ID NO: 59886 - protein, 397 aa, Kluyveromyces lactis NRRL Y-1140
MLFIRQLSVIPKAPAFAKFFHTAGLVRQKLSDPNHLAILLQKNLAQRNSSLYNPELETIRCTIFDRHGNMQKPSIDLRRDELIHTHGLLPRDLRKVEKSRRNDLVPSVLVRENSILVSILNIRALVKSDMLILFDSMGIKLDSVSQQNFIADLQLRLQNRSGFEVPDVVNKDPLPYEFRAVESIFISAISNLNAELKVHLNVSTGILQDLEYSITRDKLRYLLIQNKKLSVFHKKSFLMREMIEELLEQDDVLCEMYLTEKQLGKPREEHDHAEIEMLLETYYNHVDEIVQTVGNTMSNIKTTEEIINIILDSNRNQLMLLGLRFSIGLLSLAGSIFIASIYGMNLENFIEEGNVGFPVVSTLGVILMAYLFAFSVKHLHKLEKVQLMSHGKSSTLK

SEQ ID NO: 59887 - protein, 496 aa, Pseudomonas fluorescens PfO-1
MTTTRNDWEQRFQSLTLESRAFINGEYRPAISGETFECLSPVDGRFLASVASTDEADANLAVEAARQSFNAGVWANKAPAERKRILIRFADLILQHQEELALLETLDMGKPISDSMSIDIPATANAIRWSAEAIDKIYDEVAATPHDQLGLVTREPSGVVAAIVPWNFPLIMASWKFAPALAAGNSFILKPSEKSPLTAIRIAQLALDAGIPKGVFNVLPGFGHTVGKALALHMDVDVLAFTGSTAIAKQLMIYAGQSNMKRVWLEAGGKSPNVVFADAPDLRAAAQAAAGAIAFNQGEVCTAGSRLLVERSIREQFIPLLVEALQAWKPGHALDPATTVGAVVDQRQLDNVLRYISIGREQGAELIAGGRRTLEDTGGTYIEPTIFDGVTNAMTIAKEEIFGPVLSLITFDTVEEALHIANDSIFGLAAGVWTSNLSKAHTFARGLRAGSVWVNQYDGGDMTAPFGGFKQSGNGRDKSLHAFDKYTELKATWIKL

SEQ ID NO: 59888 - protein, 333 aa, Arabidopsis thaliana
MAKSEKISLKLLVDEKKNKVVLAEAGQDFVDVLFGLLTFPMGTIARLLEKHQKLPQILGCYKNLSRSVSDMAVDDFKTEACKSMLLSPKSSMEIHCRRLKLHIDDTQATMFYVCSKKHESDSKDEQVVDSLGNAEDVVFVSCRSSFILTDDLKVMLNSIDEIVKVLNGLGYPNINDLKEMLIDVGSEEVLSLLGNLFTSESALTSTFLMKQCMTTMLTLSPPPMFKTGRVEQGSGCHIKVFVGKLDRKILYAECSEDFIDSLLTFLVLPLESASSFFEDNTIIGCINMNDFEAQSICIYKAELVNILRASLTSSSALTNVLSNLLAKEPKKES

SEQ ID NO: 59889 - protein, 449 aa, Coprinopsis cinerea okayama7#130
MVGKRLLYAVSIFASLGVFLFGYDQGVMSGIITGPQFIGYFEEPNAIQIGTMVAILEIGAFVTSLAAGRVGDIIGRRKTLLTGAIIFTLGGFVQTFAIGYHTMVLGRLISGFGVGLLSTIVPIYQSEISPPTHRGKLACIEFTGNISGYAFSVWVGYFCSFIDSNLAWRTPLFLQCVIGSILAAGTLVIPESPRWLVDSDQDDEGLKVITDLHGDDPDSAAARAEFHDIKRTVLEERSRGEGRSYATMFRKYGRRVLLAMSSQAFAQMNGINVISYYAPRVFEEAGWVGRQAILMTGINAIFYILSTVPPWYLVDRWGRRPILLSGAVVMGFALFATGYFMYLTASWTPNAVVLSVIVFNAAFGYSWGPIPWLYPPEIMPLEMRAKGVSLSTATNWAFNWVLSILSIGVIQSTTLIPKQKECLWKKWIESSVKVNVRLLSFLLYNANNS

SEQ ID NO: 59890 - protein, 735 aa, Oryza sativa (indica cultivar-group)
MGTAHLSHLQYMGRLRGKVRRFDSVRSTTARAQSGNAGRSMTEPRNGGSRVVERRSDEMCDPTTMVQTTQRARGTEDEKGADVVEFVLDQQKNKTGDIWHVIVELQCFIFFKVKLHFTVCSWGLPASGVLYGYRVGGPQGWDQGHRFDSSTVLLDPYAKLVSGRKYFGVAEEKSSQHFGTYDFDSSPFDWGDDYRLPNLPEADLVIYEMNVRAFTADESSGLDSTSRGSYLGLIDKIPHLLELGVNAVELLPVFEYDELEFKRYPNPRDHMVNTWGYSTINFFAPMSRYASAGGGPVAASKELKQMVKELHKAGIEVILDVVYNHTNEADDAHPYMTSFRGIDNKVYYMLDLNKNAELLNFSGCGNTLNCNHPVVKELILDSLRHWVEEYHIDGFRFDLASVLCRGPDGCPLDAPPLIKEIAKDAVLSRCKIIAEPWDCGGLYLVGRFPNWDRWAEWNGKYRDDLRRFIKGDPGMKGVFATRVSGSADLYQVNERKPYHGVNFVIAHDGFTLCDLVSYNLKHNDANGEGGCDGCNDNFSWNCGVEGETNDLNVLSLRSRQMKNFHVALMISQGTPMMLMGDEYGHTRYGNNNSYGHDTCINNFQWEQLEQRRDGHFRFFSEMIKFRHSNPILRRDRFLNKNDVTWHEDCWENQESKFLAFTVHDHNSGGDIYLAFNAHDYFVDAVIPPPPHHKCWNRVVDTNLESPNDIVPEGVPFTGPKYRIAPYSSILLKAKP

SEQ ID NO: 59891 - protein, 475 aa, Haemophilus somnus 129PT
MKTQAYINGEFISAKNHRTFPVINPANQQVICEIACCGKEETELAIKSAKQAQVHWKKYTAKERSKILKKWFELIMQHQESLAYLLSLEQGKPLSESRAEIAYGASFVEWFAEEAKRAYGEIIPQVREDHRLLVIKQPVGVVAAITPWNFPNAMITRKAAPALAAGCAIIIKPAPETPLSALALAALAEQAGIPKGIFNVLPTVYAEEVGSVLTRSTDVRKLTFTGSTKIGKILMQQCADTVKKISLELGGNAPSLIFNDADLDRTVDSVIASKFRNSGQTCICTNRIYVQSEIYRAFADKLKQKVRSFIVGDFQQEAVNIGPLINESAVRKIERHIEDALSKGAILTLGGQRHSLGGTFFEPTILENVSQDMLVCHEETFSPLAALIPFDTEEQAISMANDSEFGLAAYVYTQDFSRIWRLSEELECGLVGVNEGIISNEVSPFGGVKQSGLGREGSRHGLDEFLEMKYLCMKV

SEQ ID NO: 59892 - protein, 555 aa, Bacteroides fragilis YCH46
MKSDIEIARSVELKKIKQVAESIGIPRDEVENYGRYIAKIPEYLIDEEKVKKSNLILVTAITATKAGIGKTTVSIGLALGLNKIGKKAIVALREPSLGPCFGMKGGAAGGGYAQVLPMEKINLHFTGDFHAITSAHNMISALLDNYLYQNQSKGFGLKEILWRRVLDVNDRSLRNIVVGLGPKTNGITQESGFDITPASEIMAILCLSKDVDDLRRRIENILLGYTYDNKPFTVKDLGVAGAITVLLKDAIHPNLVQTTEGTAAFVHGGPFANIAHGCNSILATKMAMTFGDYVITEAGFGADLGAEKFYNIKCRKSGLQPRLTVIVATAQGLKMHGGVSLDRIKEPNLEGLREGLRNLDKHVRNLHSFGQTVIVAFNKFASDTDEEMELLREHCEQLGVGYAINNAFSEGGEGAVDLANLVVETIENKPSEPLQFTYNDEDSVQQKIEKVATNLYGASVVTYSTLTRNKIKLIEEMGIGHYPVCIAKTQYSFSADPKVYGAVDNFELHIKDIVINNGAEMIVAIAGEIMRMPGLPKEPQALHIDIVDGNIEGLS

SEQ ID NO: 59893 - protein, 370 aa, Parvularcula bermudensis HTCC2503
MTMQAASGPLVLGIESSCDDTAAAVVRAGPPGQVEILSSIVVGQEKAHAPYGGVVPEIAARAHAAKLPSVVATALREARVELGELDLIAATAGPGLIGGVVSGLTFAKGLALATGVPLVPVNHLAGHAVSVALEHPIAFPYLLLLVSGGHSQILLVRGAADFLRLGTTIDDAAGEAFDKTAKLLGLPGMGGPAVEAAARGGDPGAYALPQPLAGRPGCDFSFSGLKTAIRQCVVAAGELTETQRADLAAAFQAAAVGHLTKRTHRGLLAARALAPEVTHLVAAGGVAANQALRRALEGVAEQEGWTLVVPSLRYCTDNAAMIALAGAYQLEAVGAGMIDDTLTSVPRSRWPLDMAATGPVVGTGKRGRKV

SEQ ID NO: 59894 - protein, 766 aa, Oryza sativa (japonica cultivar-group)
MNYRFHNLLGAPYRGGDAVFAGDSSVLLSAVGNRVASTDLSASSSLTLPFESSSNVTRLAVSPSGDFLLSVDDAGRALYANLGRRAVLHRIAFKSAPSAVRFSPDGNLIAVAVGKLVQIWRSPAFRKEFFPFHLLRTIPGFAAGVTAFDWSPDSSFLLASCKDLTARLLPVKKGLGGKPFLFVGHRAAVVGAFFATDKKTGRVTGAYTITKDGAIFTWNLVEGSDDSPPPSPGTPEQEAVQDGEAELDGDEPELDGGSRKRKSFGESEEPDTTPLHFTRWELQKKDFFMQSPAKLTACDYHRELDMVVVGFSNGVFGLYQMPDFVCLHLLSISREKITTAIFNSLGNWLVFGCAKLGQLLVWEWRSESYILKQQGHYFDVNCIAYSPDSQLLATGADDNKVKVWTVSSGFCFITFSEHTNAVTAVHFMANNHSLLSASLDGTIRAWDLFRYRNFKTFTTALPRQFVSLTADQSGEVICAGTLDSFEIFVWSMKTGRLLDILSGHQGPVHGLMFSPINAILASSSWDKTVRLWDVFESKGAVETFQHSHDVLTLAYRPDGRQIACSTLDGLIHFWDPFDGLLMYTIEGRRDIAGGRLMTDRRSAANTSIGKYFTTLCYSADGTYILAGGNSKYICMYDVGEQVLLRRFQITRNLSLDGVLDFLNSKKMTDAGALDLIDDEDSDVEEGIDQQTRGNLGLGLPGSMANRGRPIARTKCVKFAPTGRSFAAATTDGVLLYSILTLMLPLRKWKKLLRKTNSKEPFYSASG

SEQ ID NO: 59895 - protein, 210 aa, Candida glabrata
MAFVKRVTQETNIQLALDLDGGSVSVRESILGKEYASGDGQTIHVHTGVGFLDHMLTALAKHGGWSLILECIGDLHIDDHHTVEDCGIALGQAFKEALGSVRGIKRFGHGFAPLDEALSRAVVDFSNRPFAVVELGLKRERIGQLSTEMIPHFLESFATEGRITMHVDCLRGTNDHHRSESGFKALAIAIREARTPTGRDDVPSTKGVLA

SEQ ID NO: 59896 - protein, 299 aa, Zea mays
  misc_feature (75)..(75): Xaa can be any naturally occurring amino acid
MGAPPPRRPGGGRAAGGVSPSPLRRVVGAGRQVPLRGRQFALDPASGEASVVCSTRKAFKDSLKVLEADIQRSNXLDSAADFSRDYDGACLQMRMSYSPAAHFFLFLVQWTDCSLAGALGLLRILIYKVYVDGSTTMSTHERKASIREFYAVIFPSLMQLPKGISDVDDRRQKAACTERYRRRDEDEGKRPVSEADIEREEECGICMEMNGKVVLPSCSHAMCIKCYRQWRSRSQSCPFCRDSLKRVNSGDLWMLTDCRDVVDMATVTRENIRRLFMYVEKLPLVAPDNIFYAYDSHVK

SEQ ID NO: 59897 - protein, 490 aa, Trichodesmium erythraeum IMS101
MVTATKPEQKVKIGPTKLLINNEWVESASGKRFETINPATGEVICNVAEADAPDVDKAVIAARKAFTSGEWPKISAAKRGELLYKLADLIEKNIEELARLETLDNGKPFKDSLNTDLPLAIACYRYYAGWADKVQGKTIPISGPYFCYTRHEPVGVVGQIIPWNFPLLMQAWKLAPALAMGNTLVMKTAEQTPLSALRVGELVIEAGFPPGVVNILSGYGPTAGAAISHHKDIDKVAFTGSTEVGRLIMEAAAKSNLKRVTLELGGKSPNIVFADADMDAAIEGSHFALFFNQGQCCCAGSRLFVEEKCYDEFVNKSVERAKLRMVGDPFTERVEQGPQVDEEQFNKVMSYIESGQQDGAQMLCGGSRVGDRGYFIAPTVFADVQDNMKIAQEEIFGPVMSIIKFKDIDELVERANNSMYGLAAGVWTQDVTKAHTLAHRLRAGTVWVNCYDVFDAAAPFGGFKQSGLGRELGEYGLQQYTEIKTVTMKM

SEQ ID NO: 59898 - protein, 214 aa, Actinobacillus pleuropneumoniae serovar 1 str. 4074
MQIQNINWQKVDQLLPVIIQHFQTSEVLMLGYMNPEALEKTLAEKVVTFYSRTKQHLWTKGETSGHFLNVVDMSLDCDNDTLLILVNPIGPTCHTGEGSCFHQFESQSEGDWTWFAKLEQVLAERKYTDPESSYTAKLYAKGVKKIAQKVGEESVETALAAVSQDKEEVVSEAADLAYHLTVLLHSMNLEWGDVIAKLKERHQGIGLHPEGSNK

SEQ ID NO: 59899 - protein, 181 aa, Hordeum vulgare subsp. vulgare
MASDGRVERIASSIRAIPNFPKPGILFQDITTLLLDPQAFRDTTDLFVERYKDKSITVVAGVEARGFIFGPPIALAIGAKFVPIRKPKKLPGEVISEEYSLEYGTDKIEMHVGAVQPNDRVLIVDDLIATGGTLCAAAKLIERVGAKVVECACVIELPELKGRDKLGDLPVFVLVQADESV

SEQ ID NO: 59900 - protein, 851 aa, Oryza sativa
MARLNPSKPSSRGGKPRSSSADAMAEHKPLPGRPKREGEGASKRKAKSGGFESMGLCEEVYRGVRHKGYRVPTPIQRKAMPLILAGHDIAAMARTGSGKTAAFLVPMIQRLRRHDAGAGIRALILSPTRDLATQTLKFAQQLGKFTDLKISLIVGGDSMESQFEELAENPDIIIATPGRLVHHLAEVEDLNLRTVEYVVFDEADSLFSLGLIQQLHDILHKLSDTRQTLLFSATLPQALADFAKAGLRDPQIVRLDLDKKISPDLKLAFFTLRQEEKLAALLYLVRERISSEEQAIIFVSTKHHVEFLNILFREEGLEPSLSYGAMDQEARNIHISKFRARKTMILIVTDVAARGLDIPLLDNVVNWDFPAKPKLFVHRVGRVARQGRSGTAYTFVTSEDMAYLLDLHLFLSKPLRPAPTEEELLKDMEGMNLKIDRALANGETVYGRFPQTIIDLVSDGIKEVINGCTDLIALEKPCTNAFHLYLKTRPMPSTESIRRVKDLPREGLHPIFRDVLGSDELSALAFSERLKSFRPKQTILEAEGEAARGSNQWLDVMKKKREVHEGIINLVHQKNNVDHEPKEELVENISNWERKDVCGNKRKLQSFRDEEYYISSVPQNQHLEAGLSVRANEGFVENRLDAAVLDLVDDETSGMQAQKTRYHWKKNKFVKLNSGDRVTATGKIKTESGAKLKPTKTGIYKKWQQKTHRSIDTGRKFGGFAEEGASTTGSHQRGNRKHTAVGRGRRYIPNADVPSEIRNPEQIQKSRQQKAMDIARMKNRSTKESKFQKFQKNNRRHDGPLKDGKFQKNRRPDGNGKNRRPDGNGKGRGKGKGNANGFGKGKGKMKGKGTR

SEQ ID NO: 59901 - protein, 363 aa, Actinobacillus pleuropneumoniae serovar 1 str. 4074
MTQPTLFIDRDGTLIDEPKTDFQIDSLEKLKLERNVIPALLKLKDHYRFVMVSNQDGLGTSSFPQETFDKPHNAMMELFRSQGIEFDEVLICPHKPEDNCDCRKPKTKLLQKYIDRELFDPATSFVIGDRATDVQLAENLGIRALQYHPEKLNWDLIAEKLLGEAVTNIGDRQPRYAEVVRKTKETDIKVQVWLDETGVNDIKTGVGFFDHMLDQIATHGGFRMNISCKGDLWIDEHHTVEDTALALGTALKQAIGDKRGIARFGFVLPMDECQAQCAMDLSGRPFIKFKAEFKRDKVGDFSTELTEHFFQSIAFTMLATLHIKAKGDNDHHKIESLFKVFGRTLRQAIRIEGNELPSSKGVL

SEQ ID NO: 59902 - protein, 253 aa, Caulobacter crescentus CB15
MTLSSTTPRPLIAGNWKMNGLSVALDEARAVAAALEAKPPAARVAIFPPATLLHRLSQAVEGAHLLTGGQDCHGKSSGAHTGDVSAEMVADAGGSLVICGHSERRTDHGETSAQVAGKAEAAAAAGLEPIVCVGETLETREAGQAVSFVVSQVRDSLPTSLAGKAFSVAYEPLWAIGTGRTASVDNIVEMHAAIRAELVSRFCEQGRTVLILYGGSVKPENAREILAAPEVGGALVGGASLKAKDFLAIIQAL

SEQ ID NO: 59903 - protein, 386 aa, Escherichia coli O157:H7 EDL933
MTNNPLIPQSKLPQLGTTIFTQMSALAQQHQAINLSQGFPDFDGPRYLQERLAYHVAQGANQYAPMTGVQALREAIAQKTERLYGYQPDADSDITVTAGATEALYAAITALVRNGDEVICFDPSYDSYAPAIALSGGIVKRMALQPPHFRVDWQEFAALLSERTRLVILNTPHNPSATVWQQADFAALWQAIAGHEIFVISDEVYEHINFSQQGHASVLAHPQLRERAVAVSSFGKTYHMTGWKVGYCVAPAPISAEIRKVHQYLTFSVNTPAQLAIADMLRAEPEHYLALPDFYRQKRDILVNALNESRLEILPCEGTYFLLVDYSAVSTLDDVEFCQWLTREHGVAAIPLSVFCADPFPHKLIRLCFAKKESTLLAAAERLRQL

SEQ ID NO: 59904 - protein, 547 aa, Arabidopsis thaliana
MQHNTYIYILTMKLLGFALAILLVVATCKPEEEITCEENVPFTCSQTDRFNKQDFESDFIFGVASSAYQIEGGRGRGLNVWDGFTHRYPEKGGADLGNGDTTCDSYRTWQKDLDVMEELGVKGYRFSFAWSRILPKGKRSRGINEDGINYYSGLIDGLIARNITPFVTLFHWDLPQSLQDEYEGFLDRTIIDDFKDYADLCFERFGDRVKHWITINQLFTVPTRGYALGTDAPGRCSQWVDKRCYGGDSSTEPYIVAHNQLLAHATVVDLYRTRYKYQGGKIGPVMITRWFLPYDDTLESKQATWRAKEFFLGWFMEPLTKGKYPYIMRKLVGNRLPKFNSTEARLLKGSYDFLGPNYYVTQYAHALDPSPPEKLTAMTDSLANLTSLDANGQPPGPPFSKGSYYHPRGMLNVMEHFKTKYGDPLIYVTENGFSTSGGPIPFTEAFHDYNRIDYLCSHLCFLRKAIKEKRVNVKGYFVWSLGDNYEFCNGYTVRFGLSYVDFNNVTADRDLKASGLWYQSFLRDTTKNQDILRSSLPFKNGDRKSLT

SEQ ID NO: 59905 - protein, 127 aa, Zea mays
AEPPGQSPSAGPLRDIKDPEHPYSLEQLNVVTEDSIELNDESNYVRVTFTPTVEHCSMATIIGLCIRVKLVRSLPPRYKVDIRVAPGSHATEAAVNKQLNDKERVAAALENPNLLDMVEECLSPTFD

SEQ ID NO: 59906 - protein, 132 aa, Salinibacter ruber DSM 13855
MSTSTSASRSTVTTPLAPAAIGPYSQGVLVDDRLYVSGQIAIDPDTDSMVDGTIEAETERVLENVGAVLKAASMSFENVVRCEVFMADMNDYAQINEVYARYFNEKPPARQAVEVAKLPRNARVEVSCIAIR

SEQ ID NO: 59907 - protein, 478 aa, Mycobacterium sp. JLS
MREYLKFYIDGQWVDPLRPNALEVDNPTTEEVSGKIAMGSSADVDLAVSAARRAFATWSQTTREERLDVLQAILAEYQKRTDDLADAVTEEMGAPPSLSAGPQVNLGLGHLMTAIDVLKNYEFEEQHGSTLVVKEPVGVCGLITPWNWPINQIACKVFPALATGCTMVLKPSEVAPYSAQIFTEIVDAAGVPAGVYNLVFGDGPGVGVPLSSHPDVDMVSFTGSTRAGIEVARNAAPTVKRVTQELGGKSPNIVLDDDDFAKSVTAGVSVMMMNSGQSCNAPSRMLVPNSRMDEAIEIARQTAGAVKVGDPGDKTAIGPVASKAQFDKIQGLIQKGIDEGATVAVGGTGRPDGLDKGYYVRPTVFANVTNDMTIAREEIFGPVLCILGYDDLDQAIEIANDTEYGLAGYVSAADLDKAREVARRIRAGSVAINHGFDMNAPFGGYKRSGNGREWGQFAFDEFLEIKAALGYAPEAAAK

SEQ ID NO: 59908 - protein, 106 aa, Dechloromonas aromatica RCB
MSDVQQRIHATVTGNPVVLYMKGDARFPQCGFSATAVQILKVCGVNDFVTVNVLADEEIRNGVKEYANWPTIPQLYIKGEFVGGCDIMKEMYQTGELQQMLEGIAA

SEQ ID NO: 59909 - protein, 637 aa, Arabidopsis thaliana
MMMMSNLPNDLVEEILSRVTVTFMRTVRSICKKWNALTKDRSFTNKYIRNIAALGEREFLMIKEFSIYLVGVNLHGIQNNNFDLSIELKGLWFGTRIVRNQDGSNPVIIIGQLTEEKLAMLLKRWDTCEVEIWVTDKIEPDVSWSKFLKVGIKPRFDFANFVVIDVVKKVALVFDKNKAEKFQYSYNIAYIIGEKASPEELSSHRERKKRVESCLKHEKASPQGFVIGFLPKRPHTSCRDCIQSQPYGQASKAHACGNLRSCQDRLYPTISPSNQRPRTWASFLRHILISNLPDELVEEILCRAPVTSLKAMRSTCKKWYVLTKDQRFAKKRGKEFLMIMNRRVYLIGVNLHNNIDLSIKCRGRLISRDETAQGFYVSQVFHCNGLLLSVSGKTIDDTRLVVCNPYGVKPKWINPKDNYGRLDIFSLGFDKLCGSYKILRIYDFDNKLQIYDLSSNSWMIPRDTLGRDIEYMQNGVSSKENTYWCARDKQSQYCFLFCFDFTRERFGPRLPLPFNGAYVSLSAVKEEQLAVLFQPSDKSEIEIWVTNKIEPEEVSWSVFLKVEMKLRVLSWNFLIDKEKKFAVVFDKDKAKGFKTNYDIAYVIGENGYYRRVDLRESPNKPLCRIVSCYVPSCVQIE

SEQ ID NO: 59910 - protein, 472 aa, Haemophilus somnus 129PT
MSNTTAITNVFKLIEENDIKFVLLRFTDVKGKEHGVSLPVSLVDEDLFEDGKMFDGSSVEGWKAINKADMLLMPIAETAVVDPFAQIPTLSIRCSIFEPTTMQSYDRDPRSIAMRAENYMRSTGVADDVFFGPEPEFFLFDDVRFDVSMNGNSYTVDDIEAAWNTNKHYEGGNKAYRPLKKGGYCAVAPNDVAHDIRSEMCLLMEEMGLVIEAHHHEVATAGQNEIATKFNTLTLKADETQIYKYIVQNVAYEHGKTACFMPKPIINDNGSGMHCNMSLSKDGKNIFQGDKYAGLSETALYFIGGIIKHAKALNAFTNPSTNSYKRLVPGFEAPVLLAYSASNRSASIRIPAVTNPKAIRIEARFPDPLANPYLAFSALLMAGLDGIQNKLYPGDAMDKNLYDLPPEELKDIPAVASSLSEALDNLEKDYEFLTHGKVFSKEFIDTFIAMKRKEVERLNMTPHPVEFEMYYA

SEQ ID NO: 59911 - protein, 147 aa, Zea mays
ENDALSSFFKILTTSPDENGKVYVSTVQANNYPITCTQWHPEKAIFEWRKPMIPHSEDAVQVTQHFANHFISQARKSPNRPPADKVLDNLIYNYSPTFTGKKSLSGVFLLDGGLLRSDRRKNDSVDYNGNGNRLRRSTSSPETGLNA

SEQ ID NO: 59912 - protein, 523 aa, Haemophilus somnus 129PT
MTNIHHHKILILDFGSQYTQLIARRVREIGVYCELWAWDVTEEQIREFNPTGIILSGGPESTTEANSPRAPEYVFNAGVPVLGICYGMQTMAMQLGGLTETSTHREFGYAEVSLRNPTALFDHLNDDATTSQTTLDVWMSHGDKVTRLPDNFQITGMTSTCPIAAMSDESRRFYGVQFHPEVTHTKCGQKLLQNFVVDICGCETNWTAENIIEDAVARIKAQVGGDEVILGLSGGVDSSVTALLLHRAIGKNLHCVFVDNGLLRLNEGDQVMEMFGDKFGLNIIRVEAEDRFLEALKGIDEPEAKRKTIGKVFVDVFDDEAKKLTDVKWLAQGTIYPDVIESAASKTGKAHVIKSHHNVGGLPDYMKLGLVEPLRELFKDEVRKIGLALGLPAEMLNRHPFPGPGLGVRVLGEIKKEYCDLLRKADAIFIEELHKADWYYKVSQAFSVFLPVKSVGVMGDGRKYDWVISLRAVETIDFMTAHWANLPYDLLGKISNRIINEVNSISRVVYDISGKPPATIEWE

SEQ ID NO: 59913 - protein, 496 aa, Burkholderia xenovorans LB400
MAGVKELQAFPMVIGGERVPSASGVWLESIDPYTGEPWAKVPRGDATDAEAAVSAARKALTTGAWHQLSATQRGALLRRLADLISRDWERLAEIEIRDNGKVISEVGPQIRYLAQYFHYYAGLADKIEGAVIPVDRPGMLNYTRHEPVGVVVAITPWNSPLMLASWKIAPALAAGCTVILKPSEHTSVSSLVFSDLFDEAGFPPGVVNVVTGFGAEIGNALVSHPDVAKVAFTGGDVAGQAVYERAAAGLKRVTLELGGKSPHIVFDDADLDGALAAAMDGVFSSSGQMCVAGSRLMLHDRIHDEFVARLLDRVRTLKLGAPMNPATSIGPVTTQAQFERILSYIDVAKQEGARCLVGGVASPEAEGGSGWFVAPTVFGDVKNDMRIAREEVFGPVLSIIRFSTDDEAVHLANDSRYGLASGIWTRDVGRAISVADRIQAGTVWVNTYRAVSAASPFGGMKRSGIGRENGQEAIMGFLQTKSIWISTTSRPVAAWS

SEQ ID NO: 59914 - protein, 438 aa, Rhizobium sp. NGR234
MSVTPVQSGSVPGKTAAGTDQTKHRPHVVILGAGFGGLNAAVALHRAPVEVTVIDRRNYHLFQPLLYQVATAGLSPAQIAMPIRRILSRQSNATVLMDKVEALDTAARCVVTVSRRIPYDYLIVATGARHTYFGNDDWADHAPGLKTITDATAIRARILSAFERAEVTDDPCLRHKLLTFIVVGGGPTGVELAGAIAELARRTIVRDFRRIDSSSARVVLVEAGERILPAMPCCLSRKAQRQLEGLGVEVLLGNAVASCDDSGVRLADGTEIGSACILWAAGVMASRAGKWIGAAADRAGRVIVDERLNPPGHSEIFVIGDTASVTGADGRPVPGVAPAAKQMGRYAARMILGDIAGRPSAPFRYRDYGNLATIGRKAAVADFRRARLSGYAAWLVWNFAHLWFLVGFRNRLMVFLDWAVAYLRNDRAARLITGQHEA

SEQ ID NO: 59915 - protein, 520 aa, Sinorhizobium meliloti 1021
MTQTAHPDTVLIVDFGSQVTQLIARRVRESGVYCEIVPFQSAEEGFHRLKPKAVILSGSPASTLDTGSPRAPSVIFDSGLPVFGICYGQQTMCAQLGGKVESGHHREFGRAFLEVEKDCPLFDGLWSLGSRHQVWMSHGDRVTALPEGFEVVATSSNAPFAFIADEKRKYYAVQFHPEVVHTPDGAKLIANFVHKIAGITGDWTMSAYRAKAVEAIRKQVGDKKVICALSGGVDSSVAALLIHEAVGDQLTCILVDHGLMRKDEAANVVAMFKEHYNLHLLHIDASDRFIGELEGVSDPETKRKIIGRLFIEVFEEEAKKLGGADFLAQGTLYPDVIESVSFTGGPSVTIKSHHNVGGLPERMNMQLVEPLRELFKDEVRVLGRELGLPESFIGRHPFPGPGLAIRCPGGITREKLEILREADAIYLDEIRKAGLYDAIWQAFAVLLPVQTVGVMGDGRTYEFVCALRAVTSVDGMTADFYHYDMEFLGRAATRIINEVRGINRVVYDVTSKPPGTIEWE

SEQ ID NO: 59916 - protein, 372 aa, Antirrhinum majus
MSLVNPITTWSTTTTSKSPKNVQTTTRSRSIILPHKISLFPSNPKSKSKTHLRFSISSILTKNPQESSQKTSKDPTFTLDFKTYMLEKASSVNKALEQAVLLKEPLKIHESMRYSLLAGGKRVRPMLCIAACELVGGLESTAMPSACAVEMIHTMSLIHDDLPCMDNDDLRRGKPTNHKIYGEDVAVLAGDALLAFSFEHVAKSTKGVSSDRIVRVIGELAKCIGSEGLVAGQVVDISSEGMTEVGLEHLEFIHVHKTAALLEASVVLGAIVGGADDEDVEKLRKFARCIGLLFQVVDDILDVTKSSQELGKTAGKDLVADKTTYPKLLGIEKSREFAEKLNREAQEQLEGFDSVKAAPLIALANYIAYRDN

SEQ ID NO: 59917 - protein, 486 aa, Streptomyces avermitilis MA-4680
MAAQPSPSTDAVPTDQPRHPVDEKLPLLKMTTSGLQHVAAMYAGVVAPPLIVGAAAGLSGTELTFLTGACLFTAGLATFLQTLGFWKIGARLPFVNGVTFAGVAPMTAIVASTKDRSDALPIIFGAVIVAGALGFVAAPFFSKAVRFFPPVVTGTVITLIGVSLLPVAFGWAQGPDPTADSYGSTTYLGLAAATLVIVLLLRRFTHGFVKQIAVLLGLVIGTLLAIPLGVTDFGPVAGADLIGFPTPFHFGAPRFQLAAILSLSVVMVVSMTESTADMLALGEIVGRPADERTIAAGLRADTLGSALSPLFNGFMCSAFAQNIGLVAMTRIRSRYVVATGGGFLVLMGLCPVAASLIAVVPRPVLGGAGVVLFGSVAASGIQTLVRAGLEKDNNVLIVAVSLAVGIIPITAPEFYHAFPQTAKIVLDSGISTGCVAAVVLNLLFNHLGRRQGDDEVTAPMEPGEEIAGQRGGAGSPAAGPSAVTAH

SEQ ID NO: 59918 - protein, 339 aa, Desulfovibrio vulgaris subsp. vulgaris str. Hildenborough
MEKGCRILAADIGGTRSRFAYFDYAGGELGMGDVVRIPTAEATGFDDLLGRVRAAAPGAWARLTRQTDTGNDAPDTPDASVTAFAAFAVAGPVEEGARCLPPNIGWHIDLATTRGLPCAASLLNDFEAQGWACLLPGAQQCLQLLPGKPDATAPVAVVGAGTGLGKCLLLPGTPHRVLPSEGGHATFAFEGRAEAEYAAFAADRLGVGRLIGDDVLSGPGLSLLYAYHHGETLPPHEVAARLTGSDVVVEWFARFYGRTCRDWALHTLARGGVRIAGGVAAANPMLVQHGAFAEAFFDCPTHTHLLRTIPVSLVTNADAGLWGAAIFALLHAGTRRTPR

SEQ ID NO: 59919 - protein, 412 aa, Escherichia coli O157:H7 EDL933
MKALTYHGPHHVQVENVPDPGIEQADDIILRITATAICGSDLHLYRGKIPQVKHGDIFGHEFMGEVVETGKDVKNLQKGDRVVIPFVIACGDCFFCRLQQYAACENTNAGKGAALNKKQIPAPAALFGYSHLYGGVPGGQAEYVRVPKGNVGPFKVPPLLSDDKALFLSDILPTAWQAAKNAQIQQGSSVAVYGAGPVGLLTIACARLLGAEQIFVVDHHPYRLRFAADRYGAIPINFDEDSDPAQSIIEQTAGHRGVDAVIDAVGFEAKGSTTETVLTNLKLEGSSGKALRQCIAAVRRGGIVSVPGVYAGFIHGFLFGDAFDKGLTFKMGQTHVHAWLGELLPLIEKGLLKPEEIVTHYMPFEEAARGYEIFEKREEECRKVILVPGAQSAEAAQKAVSGLVNAMPGGTI

SEQ ID NO: 59920 - protein, 426 aa, Caulobacter crescentus CB15
MTDKATLTIGDKSYELPILKGSTGPDVIDVRKIYGESDHFTFDPGFTSTASCESKITYIDGDAGILLHRGYPIDQLAEKSSFLEVCYLLLNGELPKADEFAKFEHNITYHTMLHAQFDRFFEGFRRDAHPMAVMTGAVGALSAFYSDSINVDDAREREISAHRLIAKMPTIAARAYKYTVGQPFVSPRNDLSYSENFLRMCFAVPAEDWKPNPVLTRAMDRIFILHADHEQNASTSTVRLAGSSGAHPFACIAAGIACLWGPSHGGANQEALEMLETIGSVDNIKDYVQGVKDRKYKLMGFGHRVYKNFDPRAKVMQKTAHEVLAELGHNNDPLLQVAQELEKVALNDPYFVDRKLYPNIDFYSGITLRAMGFPTNMFTVLFALARTVGWISQWKEMFEDPTRKIGRPRQLYTGATHRDYVTLDKR

SEQ ID NO: 59921 - protein, 307 aa, Mycobacterium avium 104
MSLEPQIAAIIEQLDSGFPPVQQMSGAEARALIRSRLVPPAQPEPVAEVADRLVEGPGGPLRIRVYRPEAAAPLPALVYAHGGGFVFCDLDSHDGLCRNLANLVPAVVVSVDYRLAPENAWPAAAEDVYAATCWARDHADALGADPARLVVGGDSAGGNLAAVTTVMCRDRGGPAPAAQLLIYPVIAADFDTESYRLFGQGYYNPAPALRWYWDCYVPSTRDRAHPYATPLNADLRGLPPAVVVVAGHDPLRDEGLAFGAALEAAGVPTVQLRYEGGIHGFMTMPMLDIAHRARNEAAAALADLLRR

SEQ ID NO: 59922 - protein, 634 aa, Candida glabrata CBS 138
MFSKVKNYGSSSKKESTAEEFTIPEYSRDDGEKYAGNSNDYSQRDSDNTSIESEPRTKLVHRFVDSFKRAQDVPTGRKSKEIGNNGGSKTKGGFEEDSLDLEGSDHDSIITNTHLKKAMKSRHVMMMSLGTGIGTGLLVANAKGLHFGGPAALVIGYVLVSFVTYFMIQAAGEMAVTYPTLPGNFNAYSSIFVSNAFGFATVWIFCIQWLTVLPLELITASLTIKYWNDKINADVFIVIFYVFLLCIHLFGGVIAYGETEFLFNLCKILMVIGFIIMSIVINAGGAGNREYIGGKFWHDPGAFAGKTAGSRFKGICYVLVSGYFSYGGTELFALSVNEQSNPRRSTPQASKSSLYRILIIYLLTMILIGFNVPYDSDELMGSGGSATHASPYVLAASLNGVKIAPHFINAVILISVISVANSSLYAAPRLMCSLAQQGYAPKFLDYVDRQGRPLLALIACLLVGVIGFVAASPKEEEVFTWLAAIAGLSELFTWSSIMLSHVRFRMAMKLQNRSLEELGYKATTGIYGSIYGVCFNLLVFAAQFWTALFPFGGDGKANANSFFANYLAMPIWLVFYFGYMLWTRDFQLLKPLDKIDLDFHRRIYDPELMRQEDEESKERLRNGSFMMRMYHFWC

SEQ ID NO: 59923 - protein, 438 aa, Mycobacterium avium 104
MPAAKAGLTPEQISAIDAAHLWHPYSTIGAESVAPVVAVGARGAWLTLIRDGAEVRALDAMSSWWTAIHGHGHPVLDAALSDQLAAMNHVMFGGLTHEPAARLAQLLVSITPAGLDTVFFSDSGSVSVEVAVKMALQYWRSRHRPAKHRLMTWRGGYHGDTFTPMSVCDPEGGMHSLWTDILARQVFAPQVPRDYDPAYSAAFEAQLARHADELAAVIVEPVVQGAGGMRFHDPRYLRDLREACTRHDVLLIFDEIATGFGRTGELFAADHARVSPDIMCVGKALTGGYLSLAATLCSTDIAQAISAGEAGALMHGPTFMANALACAVSVASVEVLLGQDWRSRVAEISAGLAAGLEPARELPGVTDVRVRGAIGVIECDRPVDLAVATPAALDHGVWLRPFRNLIYAMPPYICPPDEIARIASAMVQVAARLGSRRL

SEQ ID NO: 59924 - protein, 421 aa, Symbiodinium muscatinei
MPSAVENVALLFGGAVATTALSSAFVASGPVAQEAKTGLRAAGYAKSSQSSSQSMGAMAGVGAVAGLAVAGVAGRRAGKNRTSMEAVGVGINGFGRIGRQVARIAMKDPETELKLINASYDSDYLAYMMKYDTIHGKYDGTVEADGDSLIVDGEKIALSHTRDPAEIPFGEHGAEYVCESTGVFLTTEKVQGHLKAGAKKVIFSAPAKDDSHTIVMGVNEDTYDPSMECVSCASCTTNGLAPAVRVLQEKWGIKRGLMTTCHAMTASQPTVDGTSKKDWRGGRAGPGNIIPSSTGAAKAVAKVIPDVKGKLTGMALRVPTIDVSVVDLTVELEKETTYEEICAEMKKRSEGDMKGFLGYTDEALVSTDFETCPISCTFDAKAGIMLDPTFVKVVCWYDNEWGYSSRVVDLIKHMAAEDAKA

SEQ ID NO: 59925 - protein, 1064 aa, Arabidopsis thaliana
MNSNGHEEEKKLGNGVVGILAETVNKWERRTPLTPSHCARLLHGGKDRTGISRIVVQPSAKRIHHDALYEDVGCEISDDLSDCGLILGIKQPELEMILPERAYAFFSHTHKAQKENMPLLDKILSERVTLCDYELIVGDHGKRLLAFGKYAGRAGLVDFLHGLGQRYLSLGYSTPFLSLGASYMYSSLAAAKAAVISVGEEIASQGLPLGICPLVFVFTGTGNVSLGAQEIFKLLPHTFVEPSKLPELFVKDKGISQNGISTKRVYQVYGCIITSQDMVEHKDPSKSFDKADYYAHPEHYNPVFHEKISPYTSVLVNCMYWEKRFPCLLSTKQLQDLTKKGLPLVGICDITCDIGGSIEFVNRATLIDSPFFRFNPSNNSYYDDMDGDGVLCMAVDILPTEFAKEASQHFGDILSGFVGSLASMTEISDLPAHLKRACISYRGELTSLYEYIPRMRKSNPEEAQDNIIANGVSSQRTFNILVSLSGHLFDKFLINEALDMIEAAGGSFHLAKCELGQSADAESYSELEVGADDKRVLDQIIDSLTRLANPNEDYISPHREANKISLKIGKVQQENEIKEKPEMTKKSGVLILGAGRVCRPAADFLASVRTISSQQWYKTYFGADSEEKTDVHVIVASLYLKDAKETVEGISDVEAVRLDVSDSESLLKYVSQVDVVLSLLPASCHAVVAKTCIELKKHLVTASYVDDETSMLHEKAKSAGITILGEMGLDPGIDHMMAMKMINDAHIKKGKVKSFTSYCGGLPSPAAANNPLAYKFSWNPAGAIRAGQNPAKYKSNGDIIHVDGKNLYDSAARFRVPNLPAFALECLPNRDSLVYGEHYGIESEATTIFRGTLRYEGFSMIMATLSKLGFFDSEANQVLSTGKRITFGALLSNILNKDADNESEPLAGEEEISKRIIKLGHSKETAAKAAKTIVFLGFNEEREVPSLCKSVFDATCYLMEEKLAYSGNEQDMVLLHHEVEVEFLESKRIEKHTATLLEFGDIKNGQTTTAMAKTVGIPAAIGALLLIEDKIKTRGVLRPLEAEVYLPALDILQAYGIKLMEKAE

SEQ ID NO: 59926 - protein, 776 aa, Alkalilimnicola ehrlichei MLHE-1
MSDNFRDNALEYHEFPRPGKLQVVPTKPLANQRDLALAYSPGVAAACEEIVNDPQAASKYTARGNMVAVITNGTAVLGLGNIGPLASKPVMEGKGVLFKKFAGIDVFDIEINEQDPDKLTEIIASLEPTFGGINLEDIKAPECFQVESALRKRMNIPVFHDDQHGTAIITAAAVLNGLRVVDKKIEDVKLCCSGAGAAAIACLDILVSMGMNKENIFVADSKGIVYKGRKEYMDERKEGYARETSARTMKEVIEGADIFLGLSAPGVLSQAMVKQMADSPIIMALANPVPEILPELAKEARPDAIIATGRSDYPNQVNNVLCFPFIFRGALDVGATTINEEMKLAAVYAIADLAMAESSDVVTAAYGGKSLRFGPEYLIPRPFDPRLILKIAPAVARAATESGVATRPIEDFDAYHMELSQFVFQSGLVMKPIFERARTNPKRVVYTDGEEERVLRAVQVVVDDGLAKPILVGRRKVVEMRIKRLGLRLEIGKNVDLADPEDDPRYREYWQLYHSIMERRGVTPARARTIVRTRTTVIGALMVRRGEADALVGGSVGRYHRQIGHIENVIGRRAGVRNMAAMNVLILPKGTFFIVDTYVNHDPNAHQIAEMTTLAADEVRRFGITPKVALLSHSSFGTSNAESARKMRDALQLIRDADPGLDVEGEMHGDAAVSEEIRKRIFPNNELKGQANLLVMPTLDAANIAFNLLKVTTDGVSVGPILLGSARPAHILTPSSTVRAIVNMSALAAVEATMAEPEATHDEERDYSGYEDEEDV

SEQ ID NO: 59927 - protein, 268 aa, Trichodesmium erythraeum IMS101
MTMAIKTPTVLALDFDGVLCNGLSEYFQTAWRTYSQFWQISDEIPLNDLMEKFYRLRPVIEIGWEMPLLIRALILGIEEDTIFQEWQAIAEKIVIQENLDPWKIGACLDNTRDEWIVKDLEGWLSLHQFYPGVVEKLKELMVSEVKPIIITTKEGRFARSLLHKVGVNLPEADIIGKESKRPKYETLKILLAKLGARTTIWFIEDRLKTLLSIQKHPDLQEVELFLADWGYNTQKERNSVAQYPSIHLLSSAQFCQDFSKWKFGGKKE

SEQ ID NO: 59928 - protein, 336 aa, Silicibacter sp. TM1040
MNQVMTKTPQGKPHELLAETLAPELEAVNLLIRERMASQHAPRIPEVTAHLVEAGGKRLRPMLTLAAARMCGYEGEHHLKLAATVEFIHTATLLHDDVVDESAQRRGRPTANLLWDNKSSVLVGDYLFARSFQLMVDTGSLRVLDILANASATIAEGEVLQMTAATDLGTTEEIYLQVVRGKTAALFSAATEVGGVIAGASEAQVKALFDYGDALGIAFQIADDLLDYQGDTAKTGKNVGDDFRERKLTLPVIKAIAQAGDEERAFWHRTIAKGRQEEGDLEHALSLMAKYATLEATRADAIGWADKAKSALADLPEHPIRTLLIDLADYVVSRLN

SEQ ID NO: 59929 - protein, 315 aa, Streptomyces avermitilis MA-4680
MTDDSRPGRPVMLGQNQYGKAENRVVKITRDGATHHIKDLNVSVALSGDMDEVHYSGSNANVLPTDTTKNTVYAFAKEHGIESAEQFGIHLARHFVTSQEPIKTARIRIEEYTWERIEASDANSRFIGADEVKHSFVRKGQETRVTQITYDGSSWEVISGLKDLVVMNSTNSEFWGYVKDKYTTLPEAYDRILATQVAARWRFNWSDDERKMPHWEKSYEQTRKHMLQAFAETYSLSLQQTLYQMGSRIINHRSEIDEVRFSLPNKHHFLVDLEPFGLKNDNEVYFAADRPYGLIEATVLRDGCEAKIPVDLTNL

SEQ ID NO: 59930 - protein, 135 aa, Streptomyces avermitilis MA-4680
MSTSTTASVSTHILDTSIGRPAAGVAVQLAARSGRSASYGQGGDWQALGGSATDADGRCKDLPALPAGTTHVRLDFAVEPYFEKKQADAQQDAPANRDSGAFFPEVAITFAVKPGEHYHVPLLLNPFGYSVYRGS

SEQ ID NO: 59931 - protein, 172 aa, Streptomyces avermitilis MA-4680
MTSTSTPPGLARFNDLGEHAALAALHEACASTTWARRLIAARPYATADDLYTASDAAMAELTAADLAQAMAGHPPIGRPKPGDPTSAREQRGMAGASEELKADMLELNLAYQEKFGHVFLICATGRTGEQMRDAVRERIGNAPEREREIVRTELGKINRIRLARLVEEDAHA

SEQ ID NO: 59932 - protein, 232 aa, Oryza sativa (japonica cultivar-group)
MEGSTSQDHVIGIPVSNTAYGIEEPDFAAEETTTPDHAGFVVGSFQFNNDANSPTTTTTTTDRASKYGRKGDKIAQGIKEHVTLGPKLSETVKGKLTLGARILQAGGVEKVFRQWFSVDKNEKLLRASQCYLSTTAGPIAGMLFVSTERVAFRSDRPLAVSAPGGDKVRVPYKVTIPLRKVKAAKPSENKHKPEQKYIEVVTNDGFEFWFMGFVSYHRSLHHLEQAVAQARR

SEQ ID NO: 59933 - protein, 198 aa, Desulfovibrio vulgaris subsp. vulgaris str. Hildenborough
MQTVARKASVERVTNETTIALTLTIEGEGNVRVTTGFGMLDHMLTLTAFWAGFDLDLTCKGDMHIDAHHTAEDVALCLGQALATALDDRKGIARVGFARVPMDEALAEVTLDISGRPWLEWRGDEYLPPVIAGEEKDLWREFHKAFASAARMNLHVSYLYGKNGHHLLESASKGLGLALRQAVRRDRQTVLSTKGSLD

SEQ ID NO: 59934 - protein, 209 aa, Brassica napus
SGSQFAVVYGFMPACVTIFDKKCKPLMELGEGPYNTLRWNPKGRILCVAGFGNLPGDMTFWDVVSKKQLGSNKAEWSVTSEWSPDGRYFLTASTAPRRQIDNGIKIFNYDGKRYFKKMFERLYQVEWKPESPDRFDEISELLKSVESLKLEEGKSQGQGSSQKKPVASIPTIQRPAAYRPPHAKQAAAIQAELLGVNPEGEMSKNALRN

SEQ ID NO: 59935 - protein, 515 aa, Desulfovibrio vulgaris subsp. vulgaris str. Hildenborough
MDAQTKVIIIDYGSQVTQLIARRVREAGVYSEIHPCIVTAEQVRAMKPAAIILSGGPASVGEKDAPALEKGLLDLGVPVLGICYGMQLLGQDLGGELATSETREYGPADLTLTAPCPLWDGLDLGTTSRVWMSHGDKVKTPPPGFKVVGRTATLEVAAMADEARRIYAVQFHPEVHHSEDGARIINNFLFHVAKLKADWTMSSFVERAVKEMAEVVGDRHVVCALSGGIDSTVVAVLLHKAIGKQLHCIFVDNGVLRLNEGQEVVDYLREHFDLNLKYVQAQERFLSKLHGVDDPEQKRKIIGYTFIEVFDEEAKALGHVDFLAQGTLYPDVIESVSHKGPSAVIKSHHNVGGLPEKMNLKLIEPLRELFKDEVRKVAAELGLPDFIIWRHPFPGPGLAIRVIGEITEERLDILRRADKVVQQELMSSGWYRKVWQGFAVLLPLKTVGVMGDGRTYEHVIALRIVDSVDAMTADWARLPSELLERISSRIINEVKGVNRVVYDISSKPPSTIEWE

SEQ ID NO: 59936 - protein, 167 aa, Nicotiana tabacum
VPLEDFGHGHPDPNLTYAKDLVNILYGENGPDFGAASDGDGDRNMILGRRFFVTPSDSVAIIAANAQDAIPYFQSGPKGLARSMPTSGSLDRVAQKLNLPFYEVPTGWKFFGNLMDAGKLSICGEESFGTGSDHIREKDGIWAVLAWLSILAYRNKDKRSGEILVSV

SEQ ID NO: 59937 - protein, 1064 aa, Arabidopsis thaliana
MNSNGHEEEKKLGNGVVGILAETVNKWERRTPLTPSHCARLLHGGKDRTGISRIVVQPSAKRIHHDALYEDVGCEISDDLSDCGLILGIKQPELEMILPERAYAFFSHTHKAQKENMPLLDKILSERVTLCDYELIVGDHGKRLLAFGKYAGRAGLVDFLHGLGQRYLSLGYSTPFLSLGASYMYSSLAAAKAAVISVGEEIASQGLPLGICPLVFVFTGTGNVSLGAQEIFKLLPHTFVEPSKLPELFVKDKGISQNGISTKRVYQVYGCIITSQDMVEHKDPSKSFDKADYYAHPEHYNPVFHEKISPYTSVLVNCMYWEKRFPCLLSTKQLQDLTKKGLPLVGICDITCDIGGSIEFVNRATLIDSPFFRFNPSNNSYYDDMDGDGVLCMAVDILPTEFAKEASQHFGDILSGFVGSLASMTEISDLPAHLKRACISYRGELTSLYEYIPRMRKSNPEEAQDNIIANGVSSQRTFNILVSLSGHLFDKFLINEALDMIEAAGGSFHLAKCELGQSADAESYSELEVGADDKRVLDQIIDSLTRLANPNEDYISPHREANKISLKIGKVQQENEIKEKPEMTKKSGVLILGAGRVCRPAADFLASVRTISSQQWYKTYFGADSEEKTDVHVIVASLYLKDAKETVEGISDVEAVRLDVSDSESLLKYVSQVDVVLSLLPASCHAVVAKTCIELKKHLVTASYVDDETSMLHEKAKSAGITILGEMGLDPGIDHMMAMKMINDAHIKKGKVKSFTSYCGGLPSPAAANNPLAYKFSWNPAGAIRAGQNPAKYKSNGDIIHVDGKNLYDSAARFRVPNLPAFALECLPNRDSLVYGEHYGIESEATTIFRGTLRYEGFSMIMATLSKLGFFDSEANQVLSTGKRITFGALLSNILNKDADNESEPLAGEEEISKRIIKLGHSKETAAKAAKTIVFLGFNEEREVPSLCKSVFDATCYLMEEKLAYSGNEQDMVLLHHEVEVEFLESKRIEKHTATLLEFGDIKNGQTTTAMAKTVGIPAAIGALLLIEDKIKTRGVLRPFEAEVYLPALDILQAYGIKLMEKAE

SEQ ID NO: 59938 - protein, 193 aa, Triticum aestivum
MAAATARQLLVHRITSSCSSGTLPKHSSSSHGRSAYSSMCFNKAEKLPSFRARVSVKPPHAVPGKGGIVPADDDGVSLGTVKLPANIDVARFEGLLFQWGNSLCQGAMLPLPVPIKVDKVEGGIRLGFIGIDDGATSLLAYIDCLVSPATDGSGFVFRAIRNGAMKDMEPPGEPRIMRSLLMALQKSIQIAQV

SEQ ID NO: 59939 - protein, 82 aa, Nicotiana tabacum
SRVETTPFEGQKPGTSGLPKKVKVFIQPHYLQNFVQATFNALGAERVKGATLVVSGDGRYYSKDAIQIITKMAAANGVRRVW

SEQ ID NO: 59940 - protein, 139 aa, Nicotiana tabacum
AETPKTDIDFWKALFPVAVAHTIGHVAATVSMSKVAVSFTHIIKSGEPAFSVLVSSLLLGETSPLPAYLSLLPIIGGCALAAVTELNFNLIGFMGAMVSNLAFVFRNIFSKKGMKGKSVGGMNYYACLSIMSLLILTPF

SEQ ID NO: 59941 - protein, 164 aa, Triticum aestivum
RNLSSYYYKEAAHLFCVRIAQGLVHLGKGLLTLSPYHSDRFLLSPMALGGIVTVLHACLDMKSTILGKYHYILYIIVLAMQPRMLLTVDEDLKPLPVPVRVGQAVDVVGQAGRPKTITGFQTHTTPVLLAAGERAELATDKYIPLTSTLEGFVILKKNPEYHEE

SEQ ID NO: 59942 - protein, 745 aa, Pseudomonas fluorescens PfO-1
MNPQDKEAFEELLANCADEPIRFPGAIQPHGLLLTLSEPDLSIIQISANVETLLARPAQELIGQPLQSLIGDAHAAQVREALQQAALSDAPPLHFRLNGTAFEGLLHRHQDVLILELEIHVENFQPRNVAGTETHLGRMLARLQKAQSLQALYDISVKEIQAMTGYDRVLIYRFEEEGHGQVIAEASDPSMEVFNGLFFPASDIPEQARELYRTNWLRIIPNADYQPVPLVPKLRPDTQTPLDLSFATLRSVSPIHCQYMKNMGVLSSMSISLLKGDKLWGLISCGNRQPLHVPHELRTACQTIGQVLSLQISAMEALEVSRQREEKLEALALLNQAMIDSPQNVFDGLANQPQVLMALANAGGIAIIEDKQLHRYGNCPEPEEIRALHKWLQERGEPVFASHHLASVYPPAAHYQQVASGVLAMSLPKPVDNGVLWFRPEVKENINWSGDPRKPLDLENSDAGLRLRPRTSFEIWKVEMAGISTKWSHGDLFAANDLRRSALENDLARQVRREQEAVRARDELVAVVSHDLRNPMTVISMLCGMMQKAFSSDGPHTSRRISTAIDTMQQAAGRMNTLLEDLLDTSKIDAGRYTIAPQKLDVAQMFEEAQSLLAPLALDKDISISFEADPDLSIHADPERLFQVLSNLVGNAIKFTPRLGTVDVYAKSVGDDIVFTVRDSGEGIPKDHLPHVFDRYWTVKEGNPTGTGLGLYITQGIVEAHGGQIVAESEPGQGSEFRFTVPRLD

SEQ ID NO: 59943 - protein, 505 aa, Aspergillus oryzae
MDPNGPPSTSGLPSPGDLILQQRKDAIQAAAQPTGDGGLFAQLSSNPFFTAGFGLAGLGAGLSFAQKGIRHGAALLRRRMLVDVEISVKDDSYPWFLHWMTLYQRSQLSSAQSAASRSGYMETLLQKMTPGMRHLSIQTQKVEHSNGAIHTHFSLVPGPGRHVLRYKNAFIFVNRMRESKSLDLQTGRPWETITLTTLYSHRHVFEDLFREAHAYAAKSHEGKTSIYNSWGAEWKLFGQPRRKRPLESVILDEGVKERIVDDVKDFLSSGKWYHDRGIPYRRGYLLYGPPGTGKSSFIQALAGELDYDIAILNLSERGLTDDRLNHLLTIVPNRTLVLLEDVDAAFSNRRVQSDADGYRGANVTFSGLLNAMDGVASAEERVIFLTTNHVERLDPALVRPGRVDMTVRLGEVTRYQVACLWDRFYSELDTNGKYRKIFLDRLHEFGLIEDENGREPDQPKATSAAALQGLFLYNKGNMDGAIAMAEALTYSVHEEAMEHDRPNGN

SEQ ID NO: 59944 - protein, 636 aa, Oryza sativa (indica cultivar-group)
MAVAVLDRSFSSEYPASSRTEGRSCSWKRVFVQTENGYVLGIELERGENAHTVKKKLQVALKVPTEESSLTFGDLVLNNDLSSIRNDSPLLLRKNQMHRSSSTPCLSPTAHDVQEQDHSEPIEILGCLSPSSRMKQLAKDVVEAIRNGVDPVPVNSGMGGAYYFKNIYGERVAIVKPTDEEPFAPNNPKGFVGKTLGLPGLKRSVPVGETGLREVAAYLLDHDNFANVPPTMLVKITHSVFNVNDTVSCKSKVFHNKLQAVSKLASLQQFIAHDYDASDHGTSSFPVSAVHRIGILDIRIFNTDRHAGNLLVRKLGPGPDNFGVQTELIPIDHGLCLPESLEDPYFEWIHWPQASIPFTEEELEYIANLDPVKDAEMLRLELPFIRGACLRVLVLSTIFLKEAAAFGLCLSEIGEMMSRQFTGKEEEPSELELLCMEARKWVKKRELFLPEAGVEDDNDGFTQFSIDSEDGSDASELPFFQQVGLDECDEEDGEEEEDDDGDEEDDDEDMFKDDAGNLKNPFSKHIPSVSKLSASFKGLGFIGKARAYHKGVPKNKVTAKTNYSGKGSEHQSGSRSANELLPPSASFVKLSDMGSDEWSAFLDKFQELLPSAFRARKHAAADGPRPLQRLGTSCQF

SEQ ID NO: 59945 - protein, 129 aa, Brassica napus
KEDAVERIREITGGMGVDVAVVALGRPQTFMQCTLSVKDGGKAVMIGLSKAGSVGEIDINRLVRRKIKVIGSYGGRARQDLPKVVKLAESGIFNLTNAVSSKYKFEDAGKAFQDLNEGKIVSRGVVEIL

SEQ ID NO: 59946 - protein, 426 aa, Cryptococcus neoformans var. neoformans JEC21
MDNTPRHLFQTPNNVYILQQPWQFVKELGQGAYGCVSSARNSSTGETCAVKKVTNVFQKKILTKRCLRELRLLHHFRGHKNITCLYDMDIVFDPPGSGQFREVYLYEELMEADLHAIIRSGQPLSDAHFQSFLYQTLCGLKYIHSANVLHRDLKPGNLLVNADCELKICDFGLARGFQPGAVQTDQGQAGFMTEYVATRWYRAPEIMLSFANYTSSIDMWSVGCILAELLGGKPIFKGEDYVDQLNKILNLLGTPTEDTLRRVGSPRAQDYIRSLPIKPRVKFETLYPNASPLALDLLSKLLTFDPAKRYGCEEALEHQYLAVWHDPADEPLCEVPFDFSFEEEDSVSGMRDLILEEVRSFRYLVRQQSMPPARKDSHELPPAPPAPQHPGAGVGPAFHERANSEGDMEEHPGSALEKQLERQKLS

SEQ ID NO: 59947 - protein, 1127 aa, Bifidobacterium longum DJO10A
MPKRTDIKSVMVIGSGPIVIGQAAEFDYSGTQACRVLREEGIRVILVNSNPATIMTDPEMADATYIEPIATPILEQIIAKERPDALLPTLGGQTALNAAMALGEAGVLKKYNVELIGASLEAIDRGEDRELFKKVVDEAGAESARSDIAHSIEEVDKIAEKFGYPLVVRPSFTMGGLGSGIAHNEEELHRIAGAGIHYSPTDEVLIEEGIEGWKEFELELMRDRNDNVVVVCPIENVDPVGVHTGDSITVAPCFTLTDREYQKLRDIGIAIIRGVGVDTGGCNIQFAVHPDTGRIIVIEMNPRVSRSSALASKATGFPIAKIATKLALGYTLDEIRNDITQSTPASFEPTIDYVVTKVPRFAFEKFPGADPTLTTSMKSVGEAMALAGNFQESLGKAMRSIDKRHMGFNWDGEKPSAEEVAELLEAIHTPTEHRYLQLMRAIWGGATLEQVFAATKIDPWFLKQIFLINETAMTVREAETLTPRLLKKAKLAGLSDVQVAHLRGLGDEGENTIRELRWTYGLRPVYKTVDTCAAEFDAATPYYYSCYADETELRPREREAVIILGSGPNRIGQGIEFDYTCVHAVQELGKDYDTIMVNCNPETVSTDYDMSDRLYFEPLTFEDVLEIYEAEKKMGPVKGVIVQLGGQTPLSLAARLKAAGVPILGTTPESIDLAENRELFGEVLKKAEMNAPRYGTALSLEEAKEAAHRIGYPVLVRPSYVLGGRGMEIVYDDKQLNKYVDRALAEAKADTVVSGRLPSPLLIDKFLQDAIEIDVDALFDGEELYIGGIMEHVEEAGVHSGDAACTLPPSTLSDDQIRRLREGTYAIAKGCHVQGLINVQYAFMANTLYVIEANPRASRTVPFASKATGVALAKAAARIMAGETIADQRANGLLLPKGDGGDIHPGQQVAVKESVLPFKRFRTPVGKTVDILLGPEMRSTGEVMGFDRDFPHAFAKSQLAAYDGGLPTHGNVFISVNDTDKRQLPLIAVRLEELGFKLWATEGTASVLRRYGIESNIVDKISTRVDTDPEAPVEVHHAAGSVGKNVVQLIEEGKIDMILNTPNSRGSRSDGYSIRAAAIAADLPQFTTITEFQAALLAIEAVKHNDYQIMSIQEHSKQLFELERREF

SEQ ID NO: 59948 - protein, 501 aa, Mycobacterium avium 104
MTDTTISNGVTEQLVHFDLVIGGESVAAESGRTYDSIDPYTALPWARVPDCGPADVDRAVAAARAALRGPWGQLTGTARGKLLWRLGELIAREAESLAELEVRDGGKLVREMIGQMKALPDYYIYYAGLADKLQGEVVPVDKPNFFVYTRHEPVGVVGAITPWNSPLLLLTWKLAAGLAAGCTFVVKPSDHTPASTLAFAKLFAEAGFPPGVINVVTGWGPQTGAALAAHPDVDKIAFTGSTATGISVGKAAIDNMTRFTLELGGKSAQVVFDDADLDAAANGVIAGVFAATGQTCLAGSRLLVHESVADALVERIVARASTIKLGDPKDPATEMGPVSNQPQYEKVLSHFASAREQGATVAYGGEPAGELGGFFVKPTVLTGVDRSMRAVAEEVFGPVLAVMTFTDEDEAIAAANDTEFGLAAGVWTKDVHRAHRVAARLNAGTVWVNAYRVVSPHVPFGGMGHSGIGRENGIDAVKDFTETKAVWVELSGATRDPFTLG

SEQ ID NO: 59949 - protein, 469 aa, Photorhabdus luminescens subsp. laumondii TTO1
MSVEHVLTMIEEHQVKFIDLRFTDTKGKEQHMTIPAHQVNADFFEDGKMFDGSSISGWKGINESDMVLMPDPSTAMLDPFFDDATLTLRCDILEPGTMQGYDRDPRSISKRAENFLRSSGIADTVLCGPEPEFFLFDDVRFSSAMSHSYYHIDDIEAAWNSGTQYEGGNKGHRPAVKGGYAPLPPVDSSQDLRSAMCLTMEEMGLVVEAHHHEVGTAGQNEIATRFNTMTKKADETQIYKYVVHNVAHNFGKTATFMPKPLVGDNGSGMHCHMSLSKNGTNLFAGDKYGGLSELALFYIGGIIKHARALNAFTNPTTNSYKRLVPGYEAPVMLAYSARNRSASIRIPVVASTKARRIEVRFPDPAANPYLAFAAQLMAGLDGIINKIHPGDAMDKNLYDLPPEEAKEIPTVASSLDEALAALDADREFLTRGGVFTDDAIDAYIDLKNSEIERVRLTPHPLEFELYYSV

SEQ ID NO: 59950 - protein, 109 aa, Arabidopsis thaliana
  misc_feature (29)..(29): Xaa can be any naturally occurring amino acid
GFLLCFSSAAGVTSRAKATRVVQLTGWKXIGGIPGHGKTKKEIISMESKGGRVSGMKVWPQMGKKKLETLFYLPDLRDVEWAKEVDYLLRNKWIPGVEFELEQGLVYRE

SEQ ID NO: 59951 - protein, 279 aa, Oryza sativa
MGPTDPPSPYPIVETCDVCGPRHVQILKRSAAVCGAVAVCRGGAVARRSRWSTLVTAAYYTGTAELVDFNWETLGFQPVPTDFMVYLKVPPTGKGSLYIRPLLIGSGAILGVAPAPEYTFVVFACPVGHYFKAVYAKERAKERGHSDVLYLDPVHKKFVEELSSCNIFMVKDNIISTPLLTGTVLPGITRRSIIEYARSLGFQVEECLITIDELLDADEVFCTGTSVVLSSVGCIVYQGRRVEYGNQKFRTVSQQLYSALTAIQKGLVEDSMGWTVQLN

SEQ ID NO: 59952 - protein, 195 aa, Oceanicola granulosus HTCC2516
MRKATVSRQTSETDISVEIDLDGSGVYDNRTGVGFFDHMLDQLSRHSLIDMTVRCTGDLHIDDHHTVEDVGIALGQALTKALGDKRGIRRYGDCALAMDDTQVRAALDLSARPYLVCELPFPSGRIGSFDTELVREFFQGFSTHGGITLHIDLVRGLNSHHIAEAAFKAVARALRTAIEPDPRKSDAIPSTKGAL

SEQ ID NO: 59953 - protein, 476 aa, Cryptococcus neoformans var. neoformans JEC21
MPSFEPAVSSHIAPLPSASKPLPLTTSTEGLQALADKHITKGLGRLRDHVFKEGKGLRVLTTENQKLLDFTSGIGVTSLGHAHPDVTAAIISQAQSIIHVQCAIGLSEPYVQLVESLLTMMPDPSLDSFFFWNSGSEAIEAAIKVSRTKTKRNNIVVMQGGYHGRTSGAAALTRSKTSFFRGTGPLMPCVYTTPFPYWHAMGLPKDTPEEVLIEQAILGIENLLQQQTAPEDTAAIFLEPVIGEGGYIPAPTAYVKHLRKLCDKYGIMLVIDEIQTGFGRTGKTFAIEHTGVTPDIMVYAKGFANGMPISGIVTRKEIMDVMAPGSLGGTYSGNVVACAAALATTRYMRTHDILGNVQARSEQLFKGLREIQEDEANGGWMIEEVRGKGLMIAIEFKDPNSKLTSSHNRGDISLPGNLNKLVQDACYDRGLLVLTTSIYPVLRLIPALVLSEEEVDEALKIIKESVKEVASVIEGN

SEQ ID NO: 59954 - protein, 527 aa, Zea mays
MAGGGIVNTGGGKDYPGKLTLFVLLTCIVAATGGLIFGYDIGISGGVTSMNPFLEKFFPEVYRKKQEAKTNQYCKYDNQLLQTFTSSLYLAALVASFFAATVTRAVGRKWSMLVGGLTFLVGAALNGAAQNIAMLIVGRILLGVGVGFANQSVPVYLSEMAPARLRGMLNIGFQLMITIGILAAELINYGTNKIKAGYGWRVSLALAAVPAAIITLGSLFLPDTPNSLLERGHPEEARRMLRRIRGTDDIGEEYADLVAASEEARQVRHPWRNILRRRYRAQLTMAVAIPFFQQLTGINVIMFYAPVLFDTLGFKNDASLMSSVITGLVNVFATVVSIVTVDRVGRRKLFLQGGAQMIVCQLIVGTLIAAKFGTSGTGDIAKGYAAVVVVFICAYVAGFAWSWGPLGWLVPSEIFPLEIRPAGQSINVSVNMFFTFCIAQAFLTMLCHFKFGLFYFFAGWVVIMTVFIAFFLPETKNVPIEEMVLVWKSHWFWKRFIADEDVHVGIGNNHPQTTVAKNGSDTKGADA

SEQ ID NO: 59955 - protein, 500 aa, Cryptococcus neoformans var. neoformans JEC21
MPSLTQTKDLASLLSDASHFKQKGYINGEWVSASDGATFPLYNPATGAKLADMPHMPRSQVAEAINAAKAAFPAWAALTAYQRQNYLLKLFKEMEEHSEDLAIILCTENGKPLAESRVEISYGASFLTWNAAEALRTYGQTIPSPFPGTRNTVIKQPIGVCGLITPWNFPNAMITRKMAPALAAGCTVVIKAPAETPLSALAMCVLCERVGIPPGVVNVVTMDKGQREMAAGLELCENVKVSKISFTGSTPVGRLLMKQSSGTLKKLSFELGGNAAFIIFDDADLDLAVNGVILSKFRAAGQTCICANRIFVHSKIYDDFARRLVERVKAFKVGNGIEEGVTIGPLVSQRGVEKVERHVQDAVGLGAKVLVGGKRIDKGEGSCFYEPTVLVDVPRQCAVSNEETFGPLAPLFKFDDEDDVVERANSSEVGLAAYFFTKDLARTHRVAEKLEVGMVAVNTGAIAQSCVPFGGVKQSGFGREGGPSGIDEFMVEKLITIGGL

SEQ ID NO: 59956 - protein, 367 aa, Silicibacter sp. TM1040
MSNPSILILPGDGIGPEVMAEVRKVISWFGAKRDIQFDVSEDLVGGSAYDAHGTPLHDDTMAKAQEVDAVLLGAVGGPKYDALDFSVKPERGLLRLRKEMDLYSNLRPAQCFDALADFSSLKKDVVAGLDIMIVRELTSGIYFGEPRGIIEEGNERVGINTQRYTESEIERVARSAFELAMRRGKKLCSMEKANVMESGILWREVVTEVSKDYPEVELSHMYADAGAMQLCRWPKQFDVIVTDNLFGDLLSDAAAMLTGSLGMLPSASLGAPMANGRPKALYEPVHGSAPDIAGQGKANPIACILSFAMALRYSFDMGTEADRLEAAVEKVLADGVRTADLLGEEGVTPVSTSEMGDAVVEALNASL

SEQ ID NO: 59957 - protein, 477 aa, Phaeodactylum tricornutum
MGKGGDARASKGSTAARKISWQEVKTHASPEDAWIIHSNKVYDVSNWHEHPGGAVIFTHAGDDMTDIFAAFHAPGSQSLMKKFYIGELLPETTGKEPQQIAFEKGYRDLRSKLIMMGMFKSNKWFYVYKCLSNMAIWAAACALVFYSDRFWVHLASAVMLGTFFQQSGWLAHDFLHHQVFTKRKHGDLGGLFWGNLMQGYSVQWWKNKHNGHHAVPNLHCSSAVAQDGDPDIDTMPLLAWSVQQAQSYRELQADGKDSGLVKFMIRNQSYFYFPILLLARLSWLNESFKCAFGLGAASENAALELKAKGLQYPLLEKAGILLHYAWMLTVSSGFGRFSFAYTAFYFLTATASCGFLLAIVFGLGHNGMATYNADARPDFWKLQVTTTRNVTGGHGFPQAFVDWFCGGLQYQVDHHLFPSLPRHNLAKTHALVESFCKEWGVQYHEADLVDGTMEVLHHLGSVAGEFVVDFVRDGPAM

SEQ ID NO: 59958 - protein, 364 aa, Oryza sativa (japonica cultivar-group)
MFPTAGGRRLLVLIRRASAAAAAGANPNHHHHHATLFTHRYSSSPLARTPEAESAAAASYLVASVGLSPAAAARISRKARFRSNADAEAVVSLLRGHGFSDANIAQVLPKIPGLLILNPDKILRPKLEYFASLGVVPSALSRAPLLARSLEKHLVPCVEFIRGVVGTDANLCAAISRNPWALWCDINSSMRPAVESLRRHGLAEANISRLVVINLSALTMSPDRIDGIFGDLEALELPISHSRFVYGFWALSRLKRGAWEERMSVFMRFGVSRSELLKAFREQPGILVFTAKTIQRKLSFYQEKLKVAPADVIAHPLLLTFSLEKNIIPKCAVLNVLLREGKIKRYGREMDLLRTFGSVAYKFL

SEQ ID NO: 59959 - protein, 895 aa, Alkalilimnicola ehrlichei MLHE-1
MAAVEPLPEGDVDPLETREWLEALEAVIEEEGPERAQYLLEQLVEKTRRRGGVAPFKATTAYENTIPRHLEARSPGDHQLEWRLRSIMRWNAMAMVVQANKEHDGIGGHIASYASAATLYETGFNHFWHAPSDEHGGDMVFIQGHSAPGIYARAFLEGRLTEDQLHNFRQDVGGEGVTSYPHPWLMPEFWQFPTVSMGLGPIMAIYQARFMKYMHDREVIDTEGRKVWAFMGDGEMDEPESLGAIGLAAREKLDNLVFVVNCNLQRLDGPVRGNAKIIQELEGEFRGAGWNVIKLIWGSGWDALLERDRTGLLRKRMEECVDGEYQNFKAKGGAYTREHFFGKYPELKDMVAHMSDEEIARLNRGGHDPHKVYAAYHAAANHKGQPTVILVKTVKGYGMGEAGEGQNITHQQKKMGEAALKAFRDRFDIPIPDDKIAEAPFYKPDDDSPEIKYLHERRQALGGYLPSRRTEAAPLKAPALSAFDVLLKDSGDREMSTTMAFVRALTILTRDKDLKKHIVPIVPDEARTFGMEGLFRQLGIYSSVGQLYTPQDADQLMYYKEDKKGQILQEGINEAGAFSSWIAAGTSYSNHGVNMVPFYAYYSMFGFQRIGDLAWAAGDMQARGFLMGGTAGRTTLNGEGLQHEDGHSHLLASTIPNCRAYDPTFAYEMAVLIQDGLRRMYVDQENCFYYITMLNENYRQPAMPKGAEEGIVKGMYLFREGKKSSGRKKAPRVQLMGSGSILREVIEAADLLQQDFGVEADIWSVTSFTEVRREGMSAERYNTLNPETKKPRVPYLQECLKGRAGPAIAATDYMRTFADQIRPWMDRTYRVLGTDGYGRSDTREKLRQFFEVDRYHVAVAALKALADDGVVPVAKVSEAIRKYGVDPERPDPWTA

SEQ ID NO: 59960 - protein, 593 aa, Alkalilimnicola ehrlichei MLHE-1
MADLVEVKVPDIGDFDAVDVIEVLVSPGDEIEVEQSLITLESDKASMEVPSSHAGVVKEVKVKVGDKVSEGDVVCTLEAAEATAGGEAPATGGGRAEKPAEPEPPAAATRPAPAAAPQGDAPVDADCDVLVLGAGPGGYTAAFRAADLGLKTVLVERYPTLGGVCLNVGCIPSKALLHAAKVIDEAEQFADHGITFGKPKIDIRKLADWKSSVVKKLTGGLAGLAKQRKVEVVTGKGAFKDAYHLEVDGKEGKRTISFRHCIIAAGSRPVVPPPLAVDDPRVMDSTGALELEEVPERLLVVGGGIIGLEMACVYDALGSKVTVVELADRLMPGADADLVKVLRKRIDKRYDAIHLNTLVKELKPNKKSITVKFEGKDAPESDRFDRVLLSVGRRPNTDLIGLEATGLKPNDQGYIDVDEYMRTGVSHIHAIGDIVGQPMLAHKASHEGKVAAEVIAGEKSAWDARAIPSVAYTDPEVAWVGITEEEAKAQGIAYEKGAFPWAANGRSLSLNYQDGISKLLFDEQSGQLIGAGIVGPNAGDLIAEAALALEMGAEAADIGLTVHPHPTLSETVAMAAEAAEGTLTDLYIPKKKK

SEQ ID NO: 59961 - protein, 575 aa, Haemophilus influenzae 86-028NP
MISGILASPGIAFGKALVLKEEKIVLDTQKITDDQIDEEVARFYEGRAAAVEQLNSIRERALISLGEEKAAIFEGHLMILEDEELEEEILDYLRSNKVNAGVAASKILDQQVTMLSEIDDEYLKERAGDIRDIANRLVKNILGMHIVDLGDIQEESILVAYDLTPSETAQLNLEKVLGVVTDIGGRTSHTSIMARSLELPAIVGTNKVTKLVNTGDYLILDAINNQVYINPTASQIDELKALEAKISEEKAELAKLKDLPAITLDGHKVDIVANIGTIRDCDGAERNGAEGIGLYRTEFLFMDREQLPTEEEQFIAYKQVVEAMNGRLTVLRTMDIGGDKELSYLDLPKEMNPFLGWRAIRIALDRREILNAQLRAVLRASAFGKLAVMFPMIISVEEIRELKAVIETLKAELREEGRVFDNNIQVGVMVETPSAAVNAKFLAKEVDFFSIGTNDLTQYTLAVDRGNEFISHLYNPMHPSVLGLIKQVIDASHTEGKWTGMCGELAGDERATLLLLGMGLDEFSMSAISVPRIKKLIRNVNFQDAKALADAALQKPTAAEIDQLIEEFLLENSLN

SEQ ID NO: 59962 - protein, 671 aa, Triticum aestivum
MSSLVRLILTISLGLNLAALITTANDQFIYSGFSGSNLAVDDTATITPDGLLELTNGTAYQKGHAFHPAPFRLRDSTANGVGDGKVRSFSVAFVFGIVSAYPDFSAHGMAFVIAPRRNFSDALPAKYLGLTNVQNDGNASNSIFAVELDTIQSVEFKDINANHVGIDINGLQSLRSYNAGYYDDESGDFRGMKLISREAMQVWIDYHGERKEINVTLAPFDMAKPARPLLSASYDLSTVLTELVYLGFSAATGRVNSRHFVLGWSLGVSRQAPAIDMAKLPKLPRVGPKPRSKVLDIVLPIVTATFVLGLGGILVLVMRRRSRYAELREDWEVEFGPHRFLYKDLFRATDGFKDKHLLGAGGFGRVYRGVLETSKLEVAVKRVSHESRQGMREFIAEITSIGRIRHRNLVELLGYCRRKGELLLVYAYMPNGSLDKHLYNTREDQPTLNWALRFQTVKDVASGLLYLHERWEKVVIHRDIKASNVLLDKDMNAQLGDFGLARLYDHGADSQTTHVVGTMGYLAPELIRTGRASPLTDMFAFGIFLLEVACGQKPIKENAQGGQIALVDWVLEHWRDGTLMETVDARLQGEFDIDQAGLVLTLALMCSHLLASARPGIGQVMRYLTGVTPLPELTPTDVLTLMQNKGFDESAMSYPDLVSSFGTISTLSGGR

SEQ ID NO: 59963 - protein, 1107 aa, Synechococcus sp. WH 7805
MPRRNDLHRILLLGSGPIVIGQACEFDYSGTQACKALKAEGYEVVLVNSNPASIMTDPEMADRTYVEPLTPEVVTRVIERERPDALLPTMGGQTALNLAVALAEDGTLDRFGIELIGADLKAIRKAEDRQLFKEAMERIGVKVCPSGIASSMDEAKDVGASIGTFPRIIRPAFTLGGSGGGIAYNPEEFDAICKSGLDASPVSQILIEKSLLGWKEFELEVMRDLADNVVIVCSIENLDPMGVHTGDSITVAPAQTLTDREYQRLRDQSIAIIREIGVATGGSNIQFAINPQDGDVVVIEMNPRVSRSSALASKATGFPIAKIAAKLAVGYTLDEILNDITGKTPACFEPTIDYVVTKVPRFAFEKFRGSPAVLTTAMKSVGEAMAIGRCFEESFQKALRSLETGLSGWGGDRPEPTLEPAELERSLRTPSPERILSVRYAMVAGRTDAEIHSLSSIDPWFLAKLRRLIDAEERLLRGKRLDQLSSDTMLELKQLGFSDRQIAWQTGSKELEVRARRNTLAIQPVFKTVDTCAAEFASSTPYHYSTYERPVGRINIKGDLVFQAPTSEVSTDTRRKLMILGGGPNRIGQGIEFDYCCCHASFSAQNQGYCTVMVNSNPETVSTDYDSSDRLYFEPLTFEDVLNVIEAERPAGVIVQFGGQTPLKLALPLLRWFETSQGQTTGTQIWGTSPESIDLAEDREQFEAILRELEIRQPRNGLARSDGEARAVAETVGYPVVVRPSYVLGGRAMEVVYDESELNRYMNEAVQVEPDHPVLIDQYLQNAIEVDVDALCDQEGTVVIGGLMEHIEPAGIHSGDSACCLPSISLGAEALNTIKAWTKALALRLNVRGLINLQFAVQRAENGEERVFIIEANPRASRTVPFVAKATGVPLARIATRVMAGESLATIGLLHEPSPPLQAVKEAVLPFRRFPGADSLLGPEMRSTGEVMGWAPDFGMAYAKAEIAAGDALPTEGTVFLSTHDRDKPALIPVAQRLIALGFDLIATSGTAQTLSAAGLSVTPVLKVHEGRPNIEDQIRSGGVQLVINTPIGRQAAHDDRYLRRAALDYSVPTVTTLAGARSAVEGIEALQSKSIEIHALQDVHAGAESR

SEQ ID NO: 59964 - protein, 398 aa, Aspergillus oryzae
MSSEGEKARTSGEVSRPEPTLPTVNPAAERAEPPKPAFHPAVYVTVWITLSSSVILFNKHILDYAQFPIILTTWHLAFATFMTQVLARTTTLLDGRKTVKMTGRVYLRAIVPIGLFFSLSLICGNVTYLYLSVAFIQMLKATTPVAVLFATWGMGMAPVNYKVLMNVSLIVIGVIIASFGEIKFVLTGFLFQIGGIIFEATRLVMVQRLLSSAEYKMDPLVSLYYFAPVCAVMNGVTALFMEVPYVTMDHVYRVGVWTLLLNAVVAFLLNVSVVFLIGKTSSLVMTLCGVLKDILLVVASMMIWQTPVTLTQFFGYSIALVGLVYYKLGGDKIKEYTSQANRAWAEYGANHPAKRKSIIIGAIVLIFFLLAGSMAPSYAGGSVDRVKGLLGGATAGNA

SEQ ID NO: 59965 - protein, 238 aa, Oryza sativa
RRSRLHPPNPESAASSFVVELARSPNPSAGPYQPPKAPESAWQHDMYSDVAAGGGGGSGGGGRVSAIETGTKLYISNLDFGVSTEDIKELFSELGDLKKYVIHYDRSGRSKGTAEVVFARRGDAVAAVKKYNNVQLDGKPMKIEILGTNTPTAAAALPANNGGYVRNVAKSAPRGGPAGLPQGRPRPRGGGRRRGGGGGSGGPGGSGGRRGKERSQPKSAEELDADLEKYHADAMQTN

SEQ ID NO: 59966 - protein, 571 aa, Gibberella zeae PH-1
MSDPRRDAPPSLTATVNANAVTTTTATVLPTSNGHAKGDDAPDAGLRSLDHYKRALPKWRYDLRQQLLPLIRWETPYLAWMQEKMRTPALDSYFAITANLGTHTFFMIGLPICFWCGYAAFGKGLVHILALGVFWTGFIKDFYSLPRPLSPPLHRITMSGSAALEYGFPSTHSANAVSVAVYALLILRSPENTLPPTTKFALECLSYFYAASIIFGRLYCGMHGFLDVIIGSIMGAAISLLEFYYGPPLDEYMHSSSWIAPFVAALIILVLVRIHPEPADDCPCYDDSVAFAGVLIGLEFGTWTYGKISIDPWETHAHGGGAVDITHLGLIANVARIVFGVLVVFLWRETMKPLLLGLLPHLFRIIEQVGMNMPRRFFTPASKYKTVPAGSRIDTLFPSPSDFPRMVESIRNPTTRGRSVSIGPQSAADAYETLAYRERKRRESVSSNHSLNSKSSNVELQNTHEDHSGKGAQTSGSQPNRIVEYEQMMGTGEVVMTPSVEDDRVGIFVTSPEDRLGEREMFSQLIKPRVRYDVEVVTKLVVYTGIAWFAVAIIPIMFELVGLGTNQLREQ

SEQ ID NO: 59967 - protein, 163 aa, Caulobacter crescentus CB15
MFQRITQAVKGAALLDFAGAFGLAMKYMVAPKKTVIYPNERNPQSPRFRGEHALRRYPSGEERCIACKLCEAICPAQAITIEAEPREDGSRRTTRYDIDMVKCIYCGLCQEACPVDAIVEGPNTEFATETREELYYDKERLLDNGDRWERLIAKNLELDAPYR

SEQ ID NO: 59968 - protein, 527 aa, Triticum aestivum
  misc_feature (167)..(167): Xaa can be any naturally occurring amino acid
MADTAAAPLLTSHKTRPAKAPSIDDTIETYMGATGALQLLKAVLLAFAWAFDAQQVFISVFTDAEPQWHCTGADASCSAAVASPCALPPGAWAWDRPAVTSVVSEWSLKCAGPALVSLPASSFFAGCLAGGFLLTTLADSLLGRRKMLLVSIVSMSVAGVLTAFSPXVWVYAALRFMSGFGRSMVGTCTLVLSTELVGKRWRDTVCVAGFFCFTLGFLSLPALAYTFREESWRNMCLWASVPSLCYSILFYFLVHESPRWLLVRGRKQDAIETLQQIASLNGNSITSSFSMLHACTMNNDTAEESGGDSVFATLHSMWERPWALRRLAAIMTASFGVGMVYYGMPLNVGNLGSNLYLSVTYNALAELPSSILSWLLMGRINRRSSVIALTGAAGVWSLACVVIPQGAARMAAELLSFFATCTAFNVIMMYSIELFPTSVRNSAVGLVRQALVLGGVAAPVLVALGRERSFLSFGVFGLVVGCFGMFAACLPETRGKGMSDTMDEEEHKEAAVAACTVDDADCNSDLV

SEQ ID NO: 59969 - protein, 341 aa, Beta vulgaris
MDHAADATRTDLMTITRFVLNEQSKRPESRGDFTILMSHIVLGCKFVCSAVNKAGLAKLIGLAGETNIQGEEQKKLDVLSNEVFIKALISSGRTCILVSEEDEEATFVEPSLRGKYCVVFDPLDGCSNIDCGVSIGTIFGIYMVKDLNNATLDDVLQPGKNMVAAGYCMYGSSCTLVMSTGSGVNGFTHDPSLGEFILTHPDIKIPKKGKIYSVNEGNAKNWDGPTTKYVEKCKFPKDGSSPKSLRYIGSMVADVHRTLLYGGIFMYPGDKKSPNGKLRVLYEVFPMSFLMEQAGGQAFTGEQRALDLVPKNIHDRSPVFLGSYDDVEDIKALYAAEQKNA

SEQ ID NO: 59970 - protein, 542 aa, Oryza sativa
MGNQCQNGTLGSDYHNRFPREHAVGYVQGDSYLDLKKFDDTWPEVNNFKPTAASILRRGLDPTSINVLGRKTADLREHYIIGRKLGQGQFGTTYLCTEINTGCEYACKTIPKRKLITKEDVEDVRREIQIMHHLSGHKNVVAIKDVYEDGQAVHIVMEPCAGGELFDRIQEKGHYSERKAAELIRIIVSIVAMCHSLGVMHRDLKPENFLLLDKDDDLSIKAIDFGLSVFFKPGQVFTELVGSPYYVAPEVWHKRYGPESDVWSAGVILYVLLSGVPPFWAETQQGIFDAVLKGHIDFQSDPWPKISDSAKDLIRKMLSHCPSERLKAHEVLRHPWICENGVATDQALDPSVISRLKQFSAMNKLKKLALRVIAERLSEEEIAGLREMFKAVDTKNRGVITFGELREGLRRFGAEFKDTEIGDIMEAAHNDNNVTIHYEEFIAATLPLNKIEREEHLLAAFTYFDKDGSGYITVDKLQRACGEHNMEDSLLEEIISEVDQNNDGQIDYAEFVAMMQGSNVGLGWQTMESSLNVALRDAPQVH

SEQ ID NO: 59971 - protein, 105 aa, Methylobacillus flagellatus KT
MDTQALIKNQVTSNPVVLYMKGSPKFPQCGFSGLAVQILQACGLKDFVAVDVLADPAIREGIKTYANWPTIPQLYIKGEFIGGADIMRDLYQQGELQKLLQEAQA

SEQ ID NO: 59972 - protein, 424 aa, Brachyspira murdochii
HAGTWAAKTLKATDPNCQVVTYDRNDNISFLACGIALWVGGVVKDPKGLFYASPESLKAEGIDVYMGHDVTKIDWANKKLHVKELKTGKEFDDNYDKLILATGSWPVTPPIEGLMQEGTEYGLKKGIFFSKLFQQGQEIIDEIAKPEVKKVMVVGAGYIGVELIEAFKNHGKEVILMEAMPRVMANYFDKEITDEAEKRIKEAGIEMHLGETVKKFEGDDRVKRVVTDKGSYDVDMVVMSVGFRPNSELYKDYLETLPNGAIKVDTTMKTTKDPNVFAIGDCATVYSRASGKEEYIALATNAVRMGIVAANNALGKHVEYCGTQGSNAICVFGYNMASTGWSEETAKKKGLKVKSNFFKDAERPEFMPSYEDVLVKIIYEEDTRRMVGAQIASKHNHAEAIHAFSLAIQNGMTVDQFALSDFFF

SEQ ID NO: 59973 - protein, 192 aa, Triticum aestivum
EPRLACHLVFSNPKGPPLMGSSATSFAPFQGFKLAAGLPVNPRSNRAGLNSVRNGGRIRCIQVWPIEGIKKFETLFYLPPLSTEALLKQVDYLIRSKWVPCLEFSKVGFVFREHNSSPGYYDGRYWTMWKPPMFGCTDATQVLNEVEEVKKEYPDAYVRVIGFDNLRQVQCVSFIAFRPPGCEEFGKASTSS

SEQ ID NO: 59974 - protein, 243 aa, Synechococcus sp. WH 7805
MRKPVIAGNWKMHMTCAQTRDWMGTFLPLIAETPDDRHLVVAPPFTAISTLATVGAGSRVEISSQNVHWEGHGAYTGEISPAMLQEHGVSYAIVGHSEPRKYFSESDEQINHRARSAQAHDLIPIVCVGESDEQRSRGEAERVIRRQVEQGLEGLDPARLVVAYEPIWAIGTGKTCESAEANRICGLIRSWVGSPDLIIQYGGSVKPANIDELMGMSDIDGVLVGGASLDPEGFARIANYQKA

SEQ ID NO: 59975 - protein, 198 aa, Methylobacillus flagellatus KT
MTAMRNAEVSRNTLETKIAVAINLDGTGISRLNSGVGFFDHMLDQIARHGMMDISVECQGDLHIDAHHTVEDVGIALGQAFSKALGDKKGIRRYAHAYVPLDEALSRVVLDISGRPGLEFNVEFTRARIGEFDVDLVSEFFQGFVNHAAITLHIDNLRGKNAHHQAETIFKAFGRALRAAVELDPRMVGIMPSTKGSL

SEQ ID NO: 59976 - protein, 462 aa, Streptomyces seoulensis
MANDASTVFDLVILGGGSGGYAAALRGAQLGLDVALIEKDKVGGTCLHKGCIPTKALLHAGEIADQARESEQFGVKATFEGIDVPAVQKYKDDVISGLYKGLQGLIASRKVTYIEGEGRLSSPTSVDVNGQRIEGRHVLLATGSVPKSLPGLQIDGDRIISSDHALVLDRVPKSAIILGGGVIGVEFASAWKSFGADVTVIEGLKHLVPVEDENSSKLLERAFRKRGIKFSLGTFFEKAEYTQDGVKVTLADGKEFEAEVLLVAVGRGPVSQNLGYEEQGVNIDRGYVLVDEYMRTNVPTISAVGDLVPTLQLAHVGFAEGILVAERLAGLKTVPIDYDGVPRVTYCHPEVASVGITEAKAKEIYGADKVVALKYSLAGNGKSKILKTAGEIKLVQVKDGAVVGVHMVGDRMGEQVGEAQLIYNWEALPAEVAQLIHAHPTQNEALGEAHLALAGKPLHAHD

SEQ ID NO: 59977 - protein, 274 aa, Pseudomonas syringae pv. tomato str. DC3000
MDQYVVFGNPIGHSKSPLIHRLFAEQTGQALNYQTALAPLDDFTAFAQAFFQTGRGANVTVPFKEEAFRLADSLTERGQRAGAVNTLSKLDDGTLLGDNTDGAGLVRDLTVNCACSLRGQRVLLLGAGGAVRGALEPLLAEKPAVLVIANRTVEKAERLAQEFADLGPVFASSFDWLEEPVDLIINATSASLAGELPPISPSLIQPGATFCYDMMYSKAPTAFCRWATEQGAAQSVDGLGMLVEQAAEAFLLWRGVRPDSAPVLAELRRLLAAG

SEQ ID NO: 59978 - protein, 352 aa, Mycoplasma penetrans HF-2
MLMNSIYSFTLQELKKELTKNNIKAFVAEQIFDWIYSKHVDSFDEMKNISKENIEKLKQLFSFENMVVDKLQVDKHDGTVKFLLKLEDGNFIETVIMKFNYGYSVCVTSQIGCNMACKFCASGLIRKKRNITVGEFIKQFIIAKEYVEKNFNDKLTHMVVMGIGEPFDNFENLIQFFEVIKQQKGLCISPRKITVSTCGLVEKIKEFADLKNQVNLAILLHAPNNEIRNKIMPINKVYSLDKVIEAMDYYIKVTKRRVTIEYILIKDVNDSDENAVELAKLLKGKLCYVNLIPYNKVVENNYFRSVRGKQFFDVLKKNNIQATIRLERGSSIDAACGQLRIKKILELRNAKV

SEQ ID NO: 59979 - protein, 420 aa, Agrobacterium tumefaciens
MSEKRVQPLARDAMAYVLAGGRGSRLKELTDRRAKPAVYFGGKARIIDFALSNALNSGIRRIGVATQYKAHSLIRHLQRGWDFFRPERNESFDILPASQRVSETQWYEGTADAVYQNIDIIEPYAPEYMVILAGDHIYKMDYEYMLQQHVDSGADVTIGCLEVPRMEATGFGVMHVNEKDEIIDFIEKPADPPGIPGNEGFALASMGIYVFHTKFLMEAVRRDAADPTSSRDFGKDIIPYIVEHGKAVAHRFADSCVRSDFEHEPYWRDVGTIDAYWQANIDLTDVVPDLDIYDKSWPIWTYAEITPPAKFVHDDEDRRGSAVSSVVSGDCIISGAALNRSLLFTGVRANSYSRLENAVVLPSVKIGRHAQLSNVVIDHGVVIPEGLIVGEDPELDAKRFRRTESGICLITQSMIDKLDL

SEQ ID NO: 59980 - protein, 275 aa, Mortierella alpina
MVSNNYIDITSEDDFAQVFQPSSSTVYALNFWAAWAPPCVQMNEVFEELAAKNANVNFLKIEAEKFPDISEDYEIAAVPSFVIVKEGTVVDRVEGANAPELAKVIAKYSKSTSSPLPTQSSTMAAAGHAAPSVAPPTMSPEEMNARLKELTSSSSVMAFIKGTPTAPRCQFSRQLLEILTAQNIRFSSFNILADDEVRQAMKTFSDWPTFPQVYVKGEFVGGLDVVKELVASGEFQALVPAEKDLKTRMDELIRKAPVMIFIKGSPETPRCGFSK

SEQ ID NO: 59981 - protein, 286 aa, Rhizobium sp. NGR234
MHDKKFLVGLIGADIQMSKSPALHETEARHQGVDYRYELLDLAERGLPPSALPDLLDEQERRGFAGSNITHPCKQTVIAHLNRLSDDAEMLGAVNTVVFRDGERIGHNTDWYGFYENFQRGLPHVAKSHGVLLGAGGAGVAVAHAAIKLGIETLSIFDQDSKRAETLARQLNHRFSRDCARATTDVGSTLRSADGLIHATPTGMKSHPGLPIDPEWLLPRHWVADIVYMPLVTELLALAEGKGCRTLRGGGMTVYQAAAAFELFTGIAPDAERMSRHFTDLCRLSA

SEQ ID NO: 59982 - protein, 283 aa, Oryza sativa (japonica cultivar-group)
HNGAVLSGDIPVSILWYGRFTPAQKAVVTDFVLSLAAPLQAAPAPSVSQWWGSIHRLYLSKAVAVGKNGGAHGGGGGGRAKNARVVLSGQVSDEGCSLGKSLKLSQLPTLAARARPGKGGVALVLTAQDVAVEGFCMSRCGTHGPVSRAGAAYAWVGNSATQCPGQCAWPFHQPVYGPQAAPLVPPSGDVGMDGMVINVASMVAGAVTNPFGDGFYQGERGAALEAATACTGVYGKGAYPGYAGALLVDKATGASYNAHGAHGRKYLLPALFDPDTSACSTLV

SEQ ID NO: 59983 - protein, 398 aa, Caulobacter crescentus CB15
MVPAIPETPVRKFNINFGPQHPAAHGVLRLVLELDGEIVERVDPHIGLLHRGTEKLMEARTYLQNIPYFDRLDYVAPMNQEHAFCLAIEKLLGVEVPIRGQIIRVLYSEIGRILNHLLNVTTQAMDVGALTPPLWGFEEREKLMVFYERACGARLHSNYFRPGGVHQDLPPELVEDIDTWAKAFPKICDDIEGLITDNRIFKQRNVDIGVVSKEEAISWGFSGVMVRGSGIAWDLRRSQPYENYNDFEFDIPLGKNGDCYDRYLCRMQEMRESTKIIRQACEMLRKTHGPVLSEDNKVAPPRRAEMKRSMEALIHHFKLYTEGFKTPAGEVYACVEAPKGEFGVFVVSDGTNKPYRCKIRAPGFPHLAAMDWMNRGHQLADVSAILGSLDIVFGEIDR

SEQ ID NO: 59984 - protein, 76 aa, Magnetospirillum magnetotacticum MS-1
MLLPVRTVGVMGDSRSYDYACALRAVTSTDGMTADFYPFDMAFIGRVANRIINEVKGINRVTYDITSKPPGTIEWE

SEQ ID NO: 59985 - protein, 197 aa, Caulobacter crescentus CB15
MSEALELLGQDIVARAPGVLGHSVAFGELTIVARAASVIDTLTFLRDDAACRFHQLIDLTGVDYPERAARFDVVYHLLSLVKNHRIRLKVSTDEDTPVPSVTPVFPVADWFEREAFDMYGIFFDGHPDLRRILTDYGFHGHPLRKDFPMTGYVEVRYDDELKRVVYEPVKITEFRAFDFLSPWEGAKYALPGDEKAQ

SEQ ID NO: 59986 - protein, 554 aa, Escherichia coli O157:H7 EDL933
MCSIFGVFDIKTDAVELRKKALELSRLMRHRGPDWSGIYASDKAILAHERLSIVDVNAGAQPLYNQQKTHVLAVNGEIYNHQALRAEYGDRYQFQTGSDCEVILALYQEKGPEFLDDLQGMFAFALYDSEKDAYLIGRDHLGIIPLYMGYDEHGQLYVASEMKALVPVCRTIKEFPAGSYLWSQDGEIRSYYHRDWFDFDAVKDNVTDKNELRQALEDSVKSHLMSDVPYGVLLSGGLDSSIISAITKKYAARRVEDQERSEAWWPQLHSFAVGLPGSPDLKAAQEVANHLGTVHHEIHFTVQEGLDAIRDVIYHIETYDVTTIRASTPMYLMSRKIKAMGIKMVLSGEGSDEVFGGYLYFHKAPNAKELHEETVRKLLALHMYDCARANKAMSAWGVEARVPFLDKKFLDVAMRINPQDKMCGNGKMEKHILRECFESYLPASVAWRQKEQFSDGVGYSWIDTLKEVAAQQVSDQQLETARFRFPYNTPTSKEAYLYREIFEELFPLPSAAECVPGGPSVACSSAKAIEWDEAFKKMDDPSGRAVGVHQSAYK

SEQ ID NO: 59987 - protein, 357 aa, Glycine max
MASFLSLSLPKLNLIKASSAANTNTTTTLPTAETLNEKFGRKGIKFLESDNIPIVELTVRNGSSLRLRIPDAHVTSYKPKVNWKDDGFQEVLYTIPATETGPYKAKGGVGLVMNELLQPGAKGLLPSTLEWTVNDVDSDSIDALQLELSCTSRFFDITYIVTLYPVSMATAVVAKNIGPKPATLTNAILSHFRFKKRGETAIQGLRSCSYIPHAPPSSPFQILTPSEATISEPPRWLSFGNEPEAKPGTWGQQALSITLLENKMSRVYAAPPKERLKAFYNTPPSKYETIDQGRGLCFRVIRMGFEDIYLSSPGSLSEKYGKDYFICTGPASILVPVTVNPGEEWRGAQVIEHDNLT

SEQ ID NO: 59988 - protein, 553 aa, Alkalilimnicola ehrlichei MLHE-1
MSDSAVPRLTESAAWQALGARAGDLRGWRPPLKGTQGEQRFRRFSLQLDGLFFDYARQPVDETTRDLLLELARERRLPERIRALFAGEPVNATEGRPALHTLLRAPEGSAFPVHGADARAAVRTELARMTRFVDRVHRGLVHGWDDRPFTDVVNLGIGGSELGAAMAVQALSRFHQREAPRMHFASGSDGVQLEDLIRRLDPATTLFIVASKSFTTSETLLNARAALHWLEACAPEGAHLARHWVGVSANEEGMARFGIPEEQRFRIWDWVGGRYSVASAMGLPVALAVGMRHFQDFLAGMHAMDRHFEEAPLPVNLPVIAGLLQVWSINFLGAHTHCVLPYHQRLARLPAWLQQLEMESLGKRVDSGGRPVDYHTGAVVFGETGFHAQHSFAQLLFQGSCPVAVDFLISREDASGLAVFHGVAQAQALGQGRALMTGRDRATLAGEMIRAGVDEEQRQALLAHREIPGGRPSNTLVFPRLDPYNLGRLIAFYEHRTFVQASIWDINPFDQWGVELGKQLTRALLPAVTGETDPAADLDASSCGLIRILRGAD

SEQ ID NO: 59989 - protein, 130 aa, Methylobacillus flagellatus KT
MSDTWLDKVHWTPDGLVPVIAQEAGTNKVLMFAWMNRESLRLTAETGQAVYWSRSRNRLWHKGEESGHVQKVHEIRLDCDEDVILILVEQVGGIACHTGRHNCFFQKLEQDGWVTDQAIIKNPEDIYHHE

SEQ ID NO: 59990 - protein, 486 aa, Vibrio angustum S14
MDMKSLYIDGNYVAASSDIQFTTINPANGQSIATIGQASQADLELAISAAKKGFAIWSAMTATERSRILLRAVALLRERNDELAVLEVTDTGKPLQEAIAVDIETGADVIEYFAGLAPGLQGEQQPLSENQFFYTRREPLGICAGIGAWNYPIQIAMWKSAPALAAGNAMIFKPSEETPLSVLKLAEIFTEAGLPDGVFNVVQGDYRVGQMLTVHPEIAKVSFTGETGTGKAVMADSAQTLKSVTMELGGKSPMIIFDDANVDHAVSAAMVANFYTQGEVCTHGTRVYVHEAIYDTFIEQLKRRTELLIVGDPMNMETQIGALISTSHLSKVLSAIDAAKQSGATLLTGGYQCTDNGLAHGNFVQPTVFIDCDESMSHVQNEIFGPVMSVIKFSDENDVIARANNTHYGLAAGVFTQNLAKAHRVIHQLQAGICWVNTWGDSPAQMPVGGYKQSGIGRENGIETLQHYTQTKSVLIELGDYQSPYA

SEQ ID NO: 59991 - protein, 106 aa, Methylobacillus flagellatus KT
MSDVLDRLAELLEQRKSADPQSSYVAKLYAKGTDAILKKIGEEATEAIIAAKDGDAEQIVYETADLWFHSLVMLANAGLGPQDVLRELARREGLSGLEEKASRPVE

SEQ ID NO: 59992 - protein, 114 aa, Methylobacillus flagellatus KT
MSMSADCIFCKIVTNDIPARKFHEDEEVIAFHDIRPIAPVHFLLVPKEHVASLADCDATHQALLGKILLLAPRLASQLGLKGFRTMINTGREGGQEVFHLHVHVFGGGDTLPKV

SEQ ID NO: 59993 - protein, 195 aa, Guillardia theta
MIRSLKLATVAALLVLATVGAEAKKKGPKVTTKVFFDITIDGKDAGRIVMGLYGKSVPQTAENFRALSTGEKGFGYEGSIFHRVIKNFMIQGGDFTRGDGTGGKSIYGERFADENFKFKHTKGGLLSMANAGKDTNGSQFFITTVPTPWLDGKHVVFGEVLEGMDLVHKIENSKTDGRDKPEKEVKIAKSGELKE

SEQ ID NO: 59994 - protein, 448 aa, Pseudomonas syringae pv. tomato str. DC3000
MNPRLAAAKALAAVLSGKASLNSSLPTQLDKVELRDRGLTQDLAFGTARWQPRLSALAAKLLQKPFKAADADVEALLLVGLYQLFYSRIPAHAAIGETVGCADKLKKPWAKGLLNAVLRNAQRDGEALLIELEHDPVVRTAHPRWLQKALKAAWPEQWEAICAANNAHPPMILRVNRRHQRRDQYLELLKTAGLEASACTFSQDGIVLAEPCDVRSLPGFAEGWISVQDEAAQLAADLLELAPGQRVLDACCAPGGKTCHLLEVQPQLSGVVAVDLEAKRLVRVRENLERLGLDAELIAADARETAQWWDGKPFQRILLDAPCSATGVIRRHPDIKLTRQLDDIAALATLQGELLDALWPTLQVGGMLVYATCSTLPTENTDVIEAFLARTSGARELDIAGQAGQPPAGIKQPHGRQLLAQQGGHDGFYYAKLIKIAAQDRGGAGVTS

SEQ ID NO: 59995 - protein, 767 aa, Arabidopsis thaliana
MSNQNKPQPPKPLMKQQSLPPDINREEAWLRMKKKHPSARLHRSKSCVTNDDIEELRGCFDLGFGFEPDSLDFNPSLSKTIPALDLYSAIHRQYSNHLSRTWSSTSERDVNSSTTTIVNKDDDGKTMKKKLKQWAKVVACSTRQSSEKQLDPLHCSRAHLFPRQKWPHVSNLLPTPSSAIIMTSFSLTFTSPLLPSSSTKPKRSVLVAAAQTTAPAESTASVDADRLEPRVELKDGFFILKEKFRKGINPQEKVKIEREPMKLFMENGIEELAKKSMEELDSEKSSKDDIDVRLKWLGLFHRRKHQYGKFMMRLKLPNGVTTSAQTRYLASVIRKYGEDGCADVTTRQNWQIRGVVLPDVPEILKGLASVGLTSLQSGMDNVRNPVGNPIAGIDPEEIVDTRPYTNLLSQFITANSQGNPDFTNLPRKWNVCVVGTHDLYEHPHINDLAYMPANKDGRFGFNLLVGGFFSPKRCEEAIPLDAWVPADDVLPLCKAVLEAYRDLGTRGNRQKTRMMWLIDELGVEGFRTEVEKRMPNGKLERGSSEDLVNKQWERRDYFGVNPQKQEGLSFVGLHVPVGRLQADDMDELARLADTYGSGELRLTVEQNIIIPNVETSKTEALLQEPFLKNRFSPEPSILMKGLVACTGSQFCGQAIIETKLRALKVTEEVERLVSVPRPIRMHWTGCPNTCGQVQVADIGFMGCLTRGEEGKPVEGADVYVGGRIGSDSHIGEIYKKGVRVTELVPLVAEILIKEFGAVPREREENED

SEQ ID NO: 59996 - protein, 172 aa, Synechococcus sp. WH 7805
MDLRQYVRDIPDFPKPGILFRDIAPLLREPTGWAEVIRRLIAVCERWQPDLIVGIESRGFIVGTALATQLQKGFVPVRKPGKLPGEVIGIDYTLEYGSDRLEIHADALTDHPRVMLVDDLLATGGTASASAELVTKAGGVLVGCGFVIELAELDGRRKLPAGVPVESLIIYE

SEQ ID NO: 59997 - protein, 305 aa, Oryza sativa (japonica cultivar-group)
MVAALVVMSLAGVSMAARRVPALLKSHVGDGISYHGGAVLGGDIPVTLVWYGKFKPAQKAIVVDFLLSLTATPPNATTPSAAQWWGAIAAGYLSSNATNVTTAARVVLANQTSDEEYSLGKSLTLVEVFQLAAGVVPDRGDLVVVLTDRDVAVEGFCSARCGVHGSDAGAGYAYAWAGDAERQCPGQCAWPFAKPPYGPKGEAALVPPNGDVGADGVVATLAGVLAGAVTNPFGDGYYLGDKDAALEACSACAGAYGSDSYPGYAGKVLVDETTGGSYNAVGAHGRKYLLPAVYDPATSRCTTLV

SEQ ID NO: 59998 - protein, 172 aa, Brassica napus
  misc_feature (46)..(46): Xaa can be any naturally occurring amino acid
MIRILQISILCFFLVAGISISSSEEEEETIYKILQDNGLPSGIFPXKGVTEFTFDGETGRFSVYLNQSCDAKYETELRYDTNITGTLSSANVTDLSGISAQDLFLWFPVKGIRVDVPSSGLIYFDVGVVRKQYSLSVFETPRDCVAVRRENEVESSVLSLHRVDETLGRNVI

SEQ ID NO: 59999 - protein, 493 aa, Oryza sativa (indica cultivar-group)
MPSSSLSSSLVSRQTPAPPRLEVGRRTVTGQAHPASHIMRAFLARPEHTVPLTKRNFDELRFKSGFSKFELEFFRRFLRDDDNNCGSGRLAVGEVLVPIASGTEPMEAVITVDVLRRAGADVSVASVDPGSAQVGGAWGVKLAADALLDDLADAEFDLISLPGGMPGSSNLRDCKLLENMVKKHAGKGKLYAAICAAPAVALGSWGLLNGLKATCYPSFMDKLPSEVNTVESRVQIDGNCVTSRGPGTAMEYSVVLVEQLYGKEKADEVAGPMLMLAFNLVLTSFKVMRPQHGVEFSLKELNSTSWNVGETPQILVPIANGTEEMEATMIIDILRRAKANVVVASLEETLEIVASRKVKMVADVLLDDALKQQYDLILLPGGLGGAQAYAKSDKLIGLIKKQAEANKLYGAICASPAIALEPHGLLKGKKATSFPGMWNKLSDQSECKNRVVVDGNLITSQGPGTSMEFSLAIVEKLFGRERAVELAKTMVFM

SEQ ID NO: 60000 - protein, 323 aa, Rubrobacter xylanophilus DSM 9941
MSSEGRVMSRIASATVCVVASYAVGLSMAVDRFPRPGETRIGHGFVQGPGGKGSNQAIQAARLGARVELVACVGDDAYGREALDLWCREGISTEHVVQVGDHPTGVGFILVDESGQNSIAIDPGANDALGPRMIDAAQGAFDRSAVCLVQLEISLESAAHALRKAKEAGCITVLNPAPARRIPDEVWGYVDVITPNEGEAAVVLGEEGNEENLGKLLLERVNLAAVVTLGEKGALVLEKSGAVQRVPAFPVPTRDTTGAGDAFSGALGLRLAQGSDVVEAARWGAAAGALTCTVPGVVPALPDRKALLRLLSGNEELAVRGGA

SEQ ID NO: 60001 - protein, 213 aa, Cryptococcus neoformans var. neoformans B-3501A
MSNPQTPSSADFSSASTPLKKFKLVFLGEQSVGKTSLITRFMYDTFDNTYQATIGIDFLSKTMYLEDRTVRLQLWDTAGQERFRSLIPSYIRDSSVAVIVYDITNRTSFQNTSKWVDDVRNERGQDVIIVLVGNKTDLNDKRQVTPEDLDKRAKELGVMSIETSAKAGHNVKTLFKKIAMALPGGSEAKDNGTTKIDVSSSPQEVPQASGCSC

SEQ ID NO: 60002 - protein, 453 aa, Prochlorococcus marinus str. NATL2A
MKSSFDLIVIGAGSGGLAAAKKAASYGASVAIVEGDLVGGTCVIRGCVPKKLLVCGSSLLESFLSATSYGFDFDNIKIKSEVLLANIRKEVQRLNELHENFLNKANVELFKGWGEFRNSNCVEVKDRKNGETLNELYGERILIAVGGRPKRPSIEGASLGWTSDDMFLLKSFPKKITIVGAGYIACEFACILHGLGVEVTQLVRGDRILRGFDFELSSALTEAMKNKGVNISFGEQISSLKGTPGSLIIKTNAGKEFDSNGLLFATGREPFLDGLKLEQVGIEILENKIKVDSEGKTNISNIFAIGDVTDRINLTPVAIDEGRKFADRNYGESDHKVNYNFVPYAVFSQPEIASVGMTEEKAIQSMGKDNIKVYRSIFRPLSKSLPKTGSKCILKLIVDKNNNKVLGCHMIGDNASEIIQMASISLMLGAKKSDFDNTMALHPTIAEEFVTMR

SEQ ID NO: 60003 - protein, 456 aa, Zea mays
RASVGSLGNVTAPTSSAKLNPTVPLKKPSLATSARSVSSSIRGSADKPASIKPAPPVARHGSATQRHNNVPPPKVPTIADVPSRAPALVSCTGLVSPGRSGDSVSSDETMSTCDSMKSPDFEYVDNQDTSMLASLQRRTSEHLRISEDRDVEENKRKKNAVAPMEIDRICDVDSEYEDPQLCATLASDIYMHLREAETKKRPSTDFMEMIQKDVNPSMRAILIDWLVEVAEEYRLVPDTLYLTVNYIDRYLSGNEIRRKRLQLLGVACMLIAAKYEEICAPQVEEFCYITDNTYFRDEVLDMEASVLNYLKFEMTAPTAKCFLRRFARAAQACDEDPALHLEFLANYIAELSLLEYSLLSYPPSLIAASAIFLARFILQPTKYPWNSTLAHYTQYKPSKLSECVKALHRLCSVGSGSNLPAIREKYSQHKYKFVAKKQCPPQIPSLEFFRDATCLD

SEQ ID NO: 60004 - protein, 445 aa, Zea mays
MATRNHRAAAAPQPANRGAARVAGKQKAAAAGTRRALGDIGNVVSDALDRAIKLPEGIHRPITRSFGAQLMKAALANKNADAAVAPAQPVAARAVTKPARKVTTKNVPRPGAGQAPKENKKPSAEGAAAASGRSVQKNRRKKPACTLSTVLSARSKAACPVTEKPKEPIEDIDKFDGDNQLALVDYVEDIYTFYRPPMHESRPIDYMGQTSPELSPRMRSILADWLIESHRRFQLMPETLYLTIYIVDRYLSLQPTPRRELQLVGVAALLIACKYEEIWAPEVNDLIHIADGAFNRSQILAAEKAILNSMEWNLTVPTPYHFLLRFAKAAGSADEQLQHTINFFGELALMDYGMVMTNPSTAAACAVYAARLTLGRSPLWTETLKHHTGPQRAADTGRAKTLVGSHAASASPDARLKAVYQKYATEQFGRVALHPPAPAALPDLV

SEQ ID NO: 60005 - protein, 420 aa, Zea mays
PMNRRAPLGDIGNLVSVRPAEGSLSCRSRSIAPITRSFGAQLVKNVQANAAIKNAAILPARHAPRQERKAPAKQPPPEDVIVLSSDSEQSRTQLESSASSVRSRKKVINTLSSVLSARSKAACGITDKRRQVVVIEDIDKLDVNNELAVVEYIEDIYTFYKIAQHDRRPCDYIDTQVEINPKMRAILADWIIEVHHKFALMPETLYLTMYIIDQYLSLQPVLRRELQLVGVSAMLIACKIEEIWAPEVNDFILISDSAYSREQILSMEKGILNNLEWNLTVPTVYMFLVRFLKAATLGNIVEKEMENMVFFFAELALMQYGLVTRLPSLVAASVVYAARLTLKRAPLWTDTLKHHTGFRESEAELIECTRCWSAHTRRPHADSKLRAVYKKYSSEQFRTRARVRPPAAAVEINETKITCC

SEQ ID NO: 60006 - protein, 429 aa, Candida glabrata CBS 138
MSTLEELDVEDGLDQEILGLSAQELQTRSKLLDNEIRIFRSELQRLSHENNVMLEKIKDNKEKIKNNRKLPYLVANIVEVMDMDEIEDKENSESATQGGNVNLDNTANGKAAVIKTSSRQTVFLPMVGLVDPDKLKPNDLVGVNKDSYLILDTLPSEFDSRVKAMEVDEKPTETYSDVGGLDKQIEELVEAIVLPMKRADKFKELGIRAPKGALMYGPPGTGKTLLARACAAQTNATFLKLAAPQLVQMFIGEGAKLVRDAFALAKEKAPAIIFIDELDAIGTKRFDSEKSGDREVQRTMLELLNQLDGFSSDDRVKVLAATNRVDVLDPALLRSGRLDRKIEFPLPTEDSRAQILQIHSRKMTTDDDINWQELARSTDEFNGAQLKAVTVEAGMLALRNGQSSVKHEDFVEAIGEVQARKSKSVSFYA

SEQ ID NO: 60007 - protein, 491 aa, Bifidobacterium longum DJO10A
MSTTDAPKKPRETDDVPVPATLRKSLKNRHIQLIALGGAIGTGLFYGSSESIALAGPSILLAYLVGGFAIFMIVRALSEMSVEDPKAGAFSYYATRYWSKRAGFISGWNYWFNYILVSMVELSVVGSFVNYWFPAIPTWVSAAVFLVIICAANLLGVSKFGEFEFWFAIIKIVAVIAMIIGGLAVIIFVLPTASGVRASFANWFTVGNGFFPNGLMGQNSDGSWTGLLMALVVVMFSFGGTELIGITAGETEDPKTTIPRATNDIIWRILVFYIGALGVIMAVVPWNTIDGKSSPFVQIFDSVGIHAAAGILNFVCLTAVMSVYNSGLYANSRMLYSLAKQGNAPAYLGKLNSRGVPVAGVLTSAAITAIAVVVVFVWPEFAFNYLMSIATIAGIINWTMIMLTEMKFRKVVAAGGAPEDSELAGLSGQEALDAIHFKLPFAKVTPWVVLAFLALVVVLMCFSTSYRIAVIAGVIWLAILFAAYQLTQAKK

SEQ ID NO: 60008 - protein, 450 aa, Oryza sativa
MATRSQNVAAAPQPPQNRGNVAALGKQKAVVAGRPDAKNRRALGEIGNVMNVRLPEGKPLQQAPAWPAPANFGAQLLKNAQASAVANKQNAVAPAAVARPAQRQARKAPVKPAPPPPEHVIEISSDSDQSMRQQSEGSASSVRKCSRKKVINTLTSVLTARSKVACGITDKPREVIEDIDKLDGDNELAVVDYIEDIYKFYKVAENECRPCDYIDTQVEINSKMRAILADWIIEVHHKFELMPETLYLSMYVIDRYLSMQQVQRRELQLVGVSAMLIACKYEEIWAPEVNDFILISDSAYTREQILAMEKGILNKLQWNLTVPTAYVFIMRYLKAGASADNKSDKEMEHMAFFFAELALMQYGLVASLPSKVAASAVYAARLTLKKSPLWTDTLQHHTGFTESQLLDSAKLLVTSHSTAPESKLRVVYKKYSSEQLGGVALRSPAVELCK

SEQ ID NO: 60009 - protein, 596 aa, Oryza sativa (japonica cultivar-group)
MTNQDVVMPDIAAAAAMPGSSGRAPLFACRGAAAVSASSMLGGGGAAYQAAVVAHVAPVPAIRPCASWVVEAMRASSPTRPAAAAVDAEYDAWTQRKHPSALGSFEQVAAAASGKRVVVFLDYDGTLSPIVADPDMAFMSDEMRAAVRDVAEHFPAAIVTGRCVDKVQSFVGLPELYYAGSHGMDIKGPSSNEEEDTKILLQPAREFLPVINKAYKALMEKTKSTPGARVENNKFCLSVHFRCVDEKRWNPLAEQVKAVLRDYPELKLTQGRKVLEIRPSIMWDKGKAVEFLLKSLGFDDDRRDVLPVYIGDDRTDEDAFKVLRKRGQGLGILVSKCAKETDASYSLQDPAEKYTNAGAHVFVTMLLTVVFTAAVALALVNAVNSHDFAAHLAGVDCRMGLAGPVRCPASGFVELLVLALHVMRARHLRSPACLPNVALATAFDCISMYVRRWQRGEVTNVHEVYVLSRIEFVPYMASTGEQRSTGETAVGAAAAGMYRMVPLHAAKWGDKWRMSGERMAAGVDCRRREDLPSSGDGYRQEEIDGGHGVPCSIGAVEASAIIVSDAPEGLISTLTTDHIYYMTVFPAKLALTSEEV

SEQ ID NO: 60010 - protein, 295 aa, Glycine max
MDGGNRPEAERWLYTANKLLSARDLHGARSFAIRARESDPTYDASEHLLTVIDTLLAGESRINDHHRDWYGILQILRYATNMDHIAAQYRRLALLLDPHRNMFAFASHAFSLVNDAWSVLSNSAKKAMYDSELRLLTAPAPPQHHPLPPQPQPTPRRNPRSRDEPNPNRPESAESSRQTRTVETDTGTSFWTSCPYCYVLYEYPKVYEECTLRCQSCRRGFHAVVIRSPPPLSGKDGSYCSWGFFPLGFSGNSKDVNGHASNWNPFSPLFPCPLKGSSKRRPQRNWAYYDDDAAA

SEQ ID NO: 60011 - protein, 73 aa, Glycine max
  misc_feature (34)..(34): Xaa can be any naturally occurring amino acid
ICPVQAITIEAEEREDGRRRTTSDDIDMTKCMYXGSWQDACPVEAIAEGPNIELATETHDELLYDKEKLLEQA

SEQ ID NO: 60012 - protein, 337 aa, Aeropyrum pernix
MGFNEIVDFFYRLAEAGDKLREEGVWLAYGPEKLPEALEKPVNGTVAVKLGFPIYQKGGVVMDVTNVEQAGIAEDAGAVAVMVLDKLPYDVRKAGGVARMADVKVIEQVMSSITIPVMAKVRIGHYYEAMILESIGVDMIDESEVLTPVDEKHHINKWLFKVPFVNGARSLAEALRRIAEGASMIRTKGEAGTGNVAEAVRHMKLIMGDIWRLRGLSAEERLRVAREYGVPHQLVDLTARLGRLPVVNFAAGGIATPADAALMMWLGADGVFVGSGIFKSSDPSERAAAIVLATSMWDDPEAVAEAQRMVSEAKSMMGIDIRKLSPEELLQVRGAEA

SEQ ID NO: 60013 - protein, 334 aa, Anabaena variabilis
MLAKLKVGINGFGRIGRLVLRAGINNPNIEFVGINDLVPPDNLAYLLKYDSTHGKLRSQVEAKDDGIVIDGHFIPCVSVRNPAELPWGKLGADYVVESTGLFTDSEGASKHLQAGAKRVIISAPTKDPDRVRTLLVGVNHDLFDPSKDVIVSNASCTTNCLAPIAKVINDNFGLTEGLMTTVHAMTATQPTVDGPSKKDWRGGRGAAQNIIPSSTGAAKAVALVLPELKGKLTGMAFRVPIPDVSVVDLTFKTAKATSYKEICAAMKQASEGSLAGILGYTDEEVVSTDFQGDTHSSIFDAGAGIELNSNFFKVVAWYDNEWGYSNRVVDLMLS

SEQ ID NO: 60014 - protein, 226 aa, Zea mays
MATEQEAENYTVEDLVALNPYNPDILNDLEKFVNEQVASQTYNLDANLSLLRLYQFEPGRMSIHIVAHILIKALMAMPAPDFSLCLFLIPEHVQMEEQFKALIVLSHYLETARFRQFWDDAANNRHILEAVPGFEQAIQSYAIHVLSLTYQKVPRHILAEAINIEGLALDKFLEYHAANSGWVIEKGGQSQVIVLPRNEFNHPQLKKNTADTVPFEHLTRIFPVLS

SEQ ID NO: 60015 - protein, 123 aa, Prochlorococcus marinus str. NATL2A
MKKNTNFFFIKLRVFFLISICCTFFYLSLPKELNAIEADSGRTLFNHNCAGCHINGGNIIRRSKNLKISSLKRNGIDNPEAIAKIARQGVGIMSGYEDELGDNGDQIVANWVWEQAQKAWVQE

SEQ ID NO: 60016 - protein, 469 aa, Triticum aestivum
MARTGLADATAPEADAMPAASKDAADVRMISTKELQAHAAADDLWISISGDVYDVTPWLRHHPGGEVPLITLAGQDATDAFMAYHPPSVRPLLRRFFVGRLTDYTVPPASADFRRLLAQLSSAGLFERVGHTPKFLLVAMSVLFCIALYCVLACSSTGAHMFAGGLIGFIWIQSGWIGHDSGHHQITRHPALNRLLQVVSGNCLTGLGIAWWKFNHNTHHISCNSLDHDPDLQHLPLFAVSTKLFNNLWSVCYERTLAFDAISKFFVSYQHWTFYPVMGFARINLLVQSIVFLITQKKVRQRWLEIAGVAAFWVWYPLLVSCLPNWWERVAFVLASFVITGIQHVQFCLNHFSSAVYVGPPKGNDWFERQTAGTLDIKCSPWMDWFHGGLQFQVEHHLFPRLPRCHYRMVAPIVRDLCKKHGLSYGAATFWEANVMTWKTLRAAALQAREATTGAAPKNLVWEALNTHG

SEQ ID NO: 60017 - protein, 214 aa, Prochlorococcus marinus str. NATL2A
MFFIDNLHFDQNGLIPAIAQDWVDGAVLMMAWMNKESITKTLESGEVHYWSRSRKELWHKGKTSGHFQKLKGIRTDCDSDTILLSIEQIGSIACHTGKRSCFFKDLETNKDVLHPPSNACSELFNVIESRKSNPEEGSYTNTLLKEGDNKILKKIGEETAEFIMACKDKNPISVANEAADLLFHMQVSLAHQNVSWEEVLKVLVKRRGAPRRNQ

SEQ ID NO: 60018 - protein, 322 aa, Mycoplasma penetrans HF-2
MKKIAILTSGGDASTMNKCLSTFITYASKYNCEVVFVKNGYKGIYDNEFVKPDYTETKSWWSLPGTKIYSSRFPEILDEQVRKQMVDNLHKNSIDTLVVIGGDGSYKGARLLSKSGIKVIGLPGTIDNDIASTSYSIGFDTSLNAIVNSIKEIKSCMDSHANVAMIEIMGRHCIDLTVFAGIATEADIIITPESFYTPQQLLAKINEKRKTNSRGIIILYVELLLGTENIPTVEEYIKYIQANSKESVKKNILGYLQRGGNPTAMDMIRASLMTEHALKMISENQYNKIIGVDEFKVVSYDLETAINMKNPSRKDLIDKFFN

SEQ ID NO: 60019 - protein, 293 aa, Hyphomonas neptunium ATCC 15444
MFHGSIPALVTPFKNGAVDEAAFAALVERQIAAGSAALVPVGTTGETSTLSTEEHKRVVSLCVEVAAGRVPVIAGAGSNSTDEAIDLVAHAKAAGADAALVVSPYYNNPNQDGLFEHFRAINDAVALPVVLYNVPSRTVVDLKPETVARLARLPNIVGIKDATGDMDRVSYHSALIGDEEQFVQLSGDDPSALGFLAMGGAGCISVTANVAPELCAAMHLAFEDGDLESARAIERRLINLHRAMFCSPSPGPAKYALSRMGLCGPEVRLPLTAPDAAAEAMIDAAMALAGLNT

SEQ ID NO: 60020 - protein, 137 aa, Conocephalum conicum
MARTKQTARKSTGGKAPRKQLASKAARKSAPSTGGVKKPHRYKPGTVALREIRRYQKSTELLIRKLPFQRLVREIAQDFKSDLRFQSSAIGALQESVESYLVSLFEDTNLCAIHAKRVTIQSVKGIQLARRLRGERN

SEQ ID NO: 60021 - protein, 136 aa, Conocephalum conicum
MARTKQTSRKSTGGKAPRKQLASKAARKSAPSTGGVKKPHRYKPGTVALREIRRYQKSTELLIRKLPFQRLVREIAQDFKSDLRFQSSAIGALQESVESYLVSLFEDTNLCAIHAKRVTIQSKDIQLARRLRGERN

SEQ ID NO: 60022 - protein, 136 aa, Conocephalum conicum
MARTKQTARKSTGGKAPRKQLASKAARKSAPSTGGVKKPHRYKPGTVALREIRRYQKSTELLIRKLPFQRLVREIAQDFKSDLRFQSSAIGALQESVESYLVSLFEDTNLCAIHAKGVTIQPKDIQLARRLRGERN

SEQ ID NO: 60023 - protein, 206 aa, Candidatus Protochlamydia amoebophila UWE25
MKKAVQAKFIKTAILNKDYPIIRSPSGDILPEVAVVGRSNVGKSSLLNHLFEAKHLVKTSATPGKTQALNFFSLNDQIAFADLPGYGYAKVPPSVRKEWGPMVRSYLESRESLKLILFLLDIRRIPNEEDIQFLEWVLYHEKALILVLTKIDKVNQKELRLNTTKILDTLSLMNLHHLYYSVPKNRGRKELMIMIQDALNDEDKQE

SEQ ID NO: 60024 - protein, 150 aa, Arabidopsis thaliana; identical to SEQ ID NO: 1029

SEQ ID NO: 60025 - protein, 354 aa, Zea mays
  misc_feature (105)..(105): Xaa can be any naturally occurring amino acid
MHPKARIHADPVREVDHFDCLPDSLVLLILNKVEDVRSLGRCYAVSKRLCGLVPLVHDVYVKIDRVVAVDGDAEDALNLSSPKPRNIFSHFLKLMLFTIIKPFHXMRNPYGTGRSLFPQLSHHSPAQVLRNFTHIRNLRIELPSGDVGTEEGVLLKWRAEYGSTLQSCVILGGTRVDRKPVGGEHEQSLEDNGSMPESFYTNGGLKLRVVWTISSLIAASTRHYLLRSIINDHPTLLSLVLTDADGQGTLCMGAEQLKEFRENQLSASACSNRTQVPACNMKLKYAPYLELPGGMALQGATLVAIKPSPDGSNGSHPNRKEADAFVFGAFDGPFKAAVKALMKRRTYLLEMNGF

SEQ ID NO: 60026 - protein, 83 aa, Zea mays
  misc_feature (11)..(11): Xaa can be any naturally occurring amino acid
KTDTASFLQEXASGYIKFLHQQLEVLSSPYMRAPPAAGAAPEDPQRYSLRSRGLCLVPVDLTLQLTQSNGADLWAPAHTARRR

SEQ ID NO: 60027 - protein, 273 aa, Oryza sativa (indica cultivar-group)
MAVAVRSVWADNFAAESAILRAVAPRAVYAAINVQYPGCVVSAAGGAGDHRCYYDLTAEERYQVVRANADELKPLQLGLVVRTADGGRFAWEFNLNEFDLAADGDMCEPGSVDYLRHRGMDFNALPWSGVGAASLGRLLWSSGLLAARPSWATFAGAYHVAYFARILMLAVAVAGTGGGGAARRLLADVGGFEEMVRSLLGHHVYDVRLLAGELRGPLADVARQLGAAVPADAAAAGLAGAGALMALQAFEALREQCRGVMPHRGLLCGIQAS

SEQ ID NO: 60028 - protein, 813 aa, Gibberella zeae PH-1
MFALRGIGKLIFGSSAQETLIELPQGQLYLVRPLSPKGYSELIFRDSAIRIRRTNQEFQYQLVVQRVFEEGEAELLAEEEGEDAEIDALASEKDEKTFLLDEALCFRFEIRETGDKVLAWKDLSGDTGDLFQFVCDSTVTSAQVQQFVRVAQECQYERKYRKSNSTATEADLQQFEFEEEDPIPPASPLHSPTLARSIESVDDMLSKNAANSAAKRAPEVIPEVVPEQEIEPQVLTGPDANNPPEAIEIYAAVTAELHVFDPQPGHFALVDDSIIAQVSEVGKWEYWLQIESGDKAYLGTPVVADFNPVFDFEYLSFVFNHFSSDGTARSWLLRFKDQSTLEKFQEAIMQAIWERLNETKWQKMQDKEREYVLDAFGDLTMEDAPETEEEEEEEEEEEELEDDRARDEEYDSDEENDSTFPKNADGEVNSQLAVGYKHDRSFVVRGSKIGVFKHTPNNHLEFSTNISKVTTPSGKLMNPKKVMLHSEDRDLILQNEIDPNKLYRMDLEYGKVVDEWHVHDDIPVVTFAPENKFAQMTSEQTFLGVSNNALYRVDPRLSGNKLVDADMKQYASKNDFSALATTEKGYIAVASNKGDIRLFDRLGIRAKTQLPALGDPISGIDVSADGRWILGTTKNYILLVDAQQKSGKNEGKLGFEKAFAATDKPHPRRLALTPEHVAQFYHETGKPVDFTPAKFNTGEGAEETSIITATGPYIIEWNLKRILRGMKASYKIKRYEEEVKADDFKFGSDKNVIVALPNEVNMVAKQSLKKPTRESIVGNIRLGGGSRRDSGRIGNQESGRYKLGRDDIVNAPY

SEQ ID NO: 60029 - protein, 539 aa, Hypocrea jecorina
MGFLNKKADAPAQEPKRDPSPSSGGSETTPSQQERVTLLACALGAIAAIGGFIFGYVSGQISGFFLMKDYARRFGELQSDGSYDFSAARQGTIVGLLCVGALIGSLVAGKMADTVGRRLSISMFAFFACVGTIIEISSSTHWVQFAVGRLVTGLSIGALSVVVPMYQSESTPAVIRGVIVSSYQLLITMGIWTAEMVNWGTETRPNSAAWRIPNGLTFAWALVLGAGILFLPESPRFAYSRGRVDEARQTIARLHGLSTDSDIVNNQIADIQAKIDEESENTAAFSWTEIFTGPRMFYRTVLGVVLQAGQQLTGANFFFYFGTTVFAATGISNSYVTQIILGSVNVFATIIGLFIIDRFGRRVILMAGASWMMMCFLVYAFVGHFALDHENPMLTPKAGSALVTFSCLAIAAFAVSWGPLVWTVNAELYPIRYRSFCMGIATASNWFWNFLISFFTRFITDKIDYFYGLIFAGCCAALVVIVFFFLIESKDRTLEEIDTMYVQHVNPITSSRWNAAQFRDEMRETQTNDVREHAHEDEK

SEQ ID NO: 60030 - protein, 412 aa, Pseudomonas syringae pv. tomato str. DC3000
MKTLADSQLSRLADQYGTPLWVYDGQLIKKRVQQLAAFDTVRFAQKACSNLHILRLLRDAGAAVDAVSLGELERALHAGFSAQTTQGAAGVVFTADVFDRATLQRVVEAQVEVNVGSIDMLHQLGALSPGHRVWLRINPGFGHGHSRKTNTGGENSKHGIWHTHLQDALTLVHYYRLHLVGLHMHIGSGVDYQHLQQVCSTMAELVVEMDHDIEAISAGGGLSVPYRAGELPINTSHYFAQWDHARKRIEAHLGHPIRLEIEPGRFLVAQAGVLVSEVRATKHMGGKHFTLVDAGFNDLMRPSLYGSYHEMSLITSRDEPLPMQETVVAGPLCESGDVFTQAEGGIVESRLLPVAQVGDYLVFHDAGAYGASMSSNYNSRTHAAEVLVDDGQERLIRRRQPLDDLLRLEEDC

SEQ ID NO: 60031 - protein, 591 aa, Bacillus subtilis
MTDTLSKRGPDDSNVWGEHHVLFGHKRLAVVDIEGGRQPMACTYKGDTYTIIYNGELYNTEDLRKELRARGHQFERTSDTEVLLHSYIEWQEDCVDHLNGIFAFAVWDEKRNLLFAARDRLGVKPFFYTKEGSSFLFGSEIKAILAHPDIKARVDRTGLSEIFGLGPSRTPGTGIFKGIKEIRPAHALTFSKDGLNIWRYWNVESEKHTDSFDDTVANVRSLFQDAVTRQLVSDVPVCTFLSGGLDSSAITAIAAGHFEKEGKAPLHTYSIDYEENDKYFQASAFQPNDDGPWIEKMTEAFGTTHHKCVISQKDLVDHLEEAVLVKDLPGMADVDSSLLWFCREIKKDFVVSLSGECADEIFGGYPWFHTADVESGFPWMRSTEERIKLLSDSWQKKLNLKEYVNAKYEETLAETPLLDGETGVDKARRQLFYLNMLWFMTNLLDRKDRMSMGASLEVRVPFADHRLVEYVWNIPWEMKMHDNREKGILRKALEGILPDDILYRKKSPYPKTHHPEYTKGVSEWLKTIRSQKDSVLHTLLDRKQLDQLLETEGSSFKVPWFGQLMKGPQLIAHLAQIHTWFEAYRIDIDER

SEQ ID NO: 60032 - protein, 350 aa, Agrobacterium tumefaciens str. C58
MKALVLEEKGKLSLRDFDIPGGAGSGELGPKDVRIRTHTVGICGSDVHYYTHGKIGHFVVNAPMVLGHEASGTVIETGSDVTHLKIGDRVCMEPGIPDPTSRASKLGIYNVDPAVRFWATPPIHGCLTPEVIHPAAFTYKLPDNVSFAEGAMVEPFAIGMQAALRARIQPGDIAVVTGAGPIGMMVALAALAGGCAKVIVADLAQPKLDIIAAYDGIETINIRERNLAEAVSAATDGWGCDIVFECSGAAPAILGMAKLARPGGAIVLVGMPVDPVPVDIVGLQAKELRVETVFRYANVYDRAVALIASGKVDLKPLISATIPFEDSIAGFDRAVEARETDVKLQIVMPQ

SEQ ID NO: 60033 - protein, 313 aa, Aspergillus oryzae
MSVILCTVSAKILHGSFWEALSGICSRTIQHPDSQVNRLCITPDKRYLAAAGHNNVKLYDIKSTNPNPVMTFDGHTNNITGVAFHCEGKWMVTSSEDGTVKVWDTRTGSLQRNYAHKAPVNDVVIHPNQGELISGDRAGIVRVWDLGESVCTHQLIPEDDVAVQSVSVASDGSLLCAGNKKGNVYIWRMVQDAELTRIVPMCTFQAHKDYLTRILLSPDVKHLATCSADHTAKEDGPPVDPNTNTLYLETTLANHQRWVWDCAFSADSAYLVTVSSDHYARLWELASGQVIRQYSGHHRGAVCVALNDYSEPR

SEQ ID NO: 60034 - protein, 364 aa, Candidatus Blochmannia floridanus
MNNNTYHIAILPGDGIGPEIMQQAYKILNTVKNKFKINIITTEYKVGGNALDLEGSPLPKDTIKNCEKSNAILFGAVGGPKWNNINETSRPEFGALLTLRKHFNLFINLRPIYLPIELINLSPLKPEIISQGLDMICIRELIGGIYFGKPQGKSGIRSQEHAFDTAIYHRFEIERIAHFAFKLAQKRRKHVTSIDKANVLHTSMLWRKVVSEVASNYPNVHLQHLYVDNASMQLIRNPSAFDVILCPNLFGDILSDECAEINGSIGILPSASLNEHNFGLYEPAGGSAPDIAGKNIANPIAQILSTALLFRYSLKLNHVAITIEKAVYKALTLGYRTQDIAYNKQKSVNTDDMGDIIASLIYKL

SEQ ID NO: 60035 - protein, 359 aa, Cryptococcus neoformans var. neoformans JEC21
MPSNSRQHNIAVIPGDGIGIEVTASTLKVLRAVQKKVGGFELSFDELDYGSARYKAQGSYTPAGWLDHLRKSDAIFFGAVGDPDVPDHISLWELILPMRQTFQQYVNIRPSSILPGIPSRIVGTKPGDLDWIIVRENTEGEYAGQGGRTHVGTEWEVATELAVFTRKGVERVMRFAFETAQSRPKKFLTVVSKSNAQRYGLLLWDEVAEIVSKDFPDVKWDKMLVDAMTVRMVAKPTSLDTIVTTNLHGDILSDLAAGLSGSIGIAHSASLDPTRTSPSLFEPVHGAAFDIMGKDLANPIAAIMSAAEMLRWLGENEAADLVEKACKQSIADGQTTGDLGGKLKTSQVTEAVCKILETL

SEQ ID NO: 60036 - protein, 522 aa, Oryza sativa (indica cultivar-group)
MAPPVPTAAARLVLRRLLSTAVAEAEAAAVAPAAEKAAAKGAKTAAAAGEEKDARSLYRRLSALGGAGEGSVSRVMNKWVREGREARAADLAKYVKELRKYKRHAHALELMEWMVNTKGMNMSYTNHAIRLDLIYKVRGIEAAELYFAGLPDPGKNHKTYGALLNCYCSAKMEDKATDIYRKMDELGISSSTLPINNLMSLYVKIGQHRKVTSLFEEMKVKNVKPDNLTCCLLMSSYAALNKIDTVGEVLKEMEEKKVALGWSAYSTLASLYVNANMVEEAESALKKLESLIDVQAGRQPFDFLMSLYASVGNLSEVNRVWNLIKANFQKVTNTSYLGMLQALYKLNDDDRMKQIYEDWESNYENYDARLTNMMTRAHLRNGLTKEAELLWEKVKEKGAEFDSKTCELFLEHYMGKGDMTSALNWVENMTKLPRKKSKLDQEKISCFLKYFEEHKDVEGAERFLNCLRTSGCIDGKAYESLLRTYLAAGKTSRSIRQMIKEDKIEICYGIGKLLKRIADKGR

SEQ ID NO: 60037 - protein, 299 aa, Candidatus Protochlamydia amoebophila UWE25
MGQFNQTEKGSFEIKVALAEMLKGGVIMDVTNSEQAKIAEDAGAVAVMALERIPSDIRVQGGIARMSNPELIQKIQETVSIPVMAKCRIGHFVEAQILESLQVDFIDESEVLTPADEENHIDKHIFKVPFVCGCRDLGEALRRIGEGAAMIRTKGEAGTGNVVEAVRHMRAINREIRHLMLMDSSELMAEAKRLGAPFHLVQMVAKSGVLPVPNFAAGGIATPADAALMMQLGAQSVFVGSGIFKSEDPAKRARAIVGATTFFQNPEKLAQFSMDLLDAMKGIDIRQLKREDLMAQRGW

SEQ ID NO: 60038 - protein, 303 aa, Oryza sativa (japonica cultivar-group)
MEKYEKLEKVGEGTYGKVYKAQDRATGQLVALKKTRLEMDEEGIPPTALREISILRLLSQSLYVVRLLSVEQATKNGKPVLYLVFEFLDTDLKKFVDAYRKGPNPRPLPTNVIKSFLYQLCKGVAHCHGHGVLHRDLKPQNLLVDKEKGILKIADLGLGRAFTVPMKSYTHEIVTLWYRAPEVLLGSTHYSTGVDIWSVGCIFAEMVRRQALFPGDSELQQLLHIFRLLGTPTEEQWPGVTDLRDWHEFPQWKPQILERQVPSLEPEGVDLLSKMLQYNPANRISAKAAMEHPYFDSLDKSQF

SEQ ID NO: 60039 - protein, 392 aa, Synechococcus sp. WH 7805
MSRPLSLSSRAEALQPSLTLAISARAKALQQEGRDICSLSAGEPDFDTPEFIVEASVEALRNGMTRYGPAAGDPTLRELIASKISKENGIPTSAAEVLVTNGGKQAIYNLFQVLLNPGDEVLIPAPYWLSYPEMARLAGARPVAVPSSADDGFRLDLNALEAAITPASRVLIINSPGNPTGRVLSRDELLAIAELVRRHPRLVVMSDEIYEYLLDDGVTHDSFASLAPDLQDRCFMVNGFAKGWAMTGWRLGYLSGPESVIKAASALQSQSTSNVCSFAQQGAIAALTAPRDCVQTMAESYNRRRSFLVAGLQAMSGITLVPPQGAFYAFPQLPEGCGDSMSFCRRALEDEGLAIVPGVAFGDDRCVRVSCAVSRETITDGLARLARLLAVN

SEQ ID NO: 60040 - protein, 136 aa, Conocephalum conicum
MARTKQTARKSTGGKAPRKQLASKAARKTAPSTGGVKKPHRYKPGTVALREIRRYQKSTELLIRKLPFQRLVREIAQDFKSDFRFQSSAIGALQESVESYLVSLFEDTNLCAIHAKRVTIQSKDIQLARRLRGERN

SEQ ID NO: 60041 - protein, 346 aa, Hyphomonas neptunium ATCC 15444
MSLQRMIAKAIASLPGGMIVKMSGGEPKTIEGRTLEPQLQLVAWNGRNAPPMSTLPAEAVQQGVKAQLALFQDKLPGGVGVEEFTIPGPDANQIPVRLYMPASQDPRHPLIVYFHMGGGVIGDMDTCHAFCGMLAQGAQAPVLSVDYRLAPQHIYPAGLNDCFAAYKWGVENAAKYGAPAGKASVGGDSMGGNFSAIISQRMKREGGPLPALQLLIYPAIDISKHYPSKTAFANTFSLSQDTMDWFMQQYLPEGFDYTDLNVSPGQAADLAGLPPAVVVTAGHDPLVDEGDEYAERLKAAGVTVKHKRYDSLAHAFTAFTFLSPGSRTACTEIARMVHDMYAARKA

SEQ ID NO: 60042 - protein, 402 aa, Candidatus Protochlamydia amoebophila UWE25
MRVKDKLSIRDLNLKDKKALIRVDFNVPLEKGLITDDSRIQASLPTIQYVLDQEGAVILMSHLGRPKGLFDSKFSLAPCAKRLSELLNKPVKMAADCCGLDVEQMVRQLKSGEVLLLENLRFHKGEERPDDEPNFTSALSELGDVYINDAFGTAHRAHASTTKIAKFFPNRAAAGLLLEKEISYLGCALTNPKRPFCAVLGGAKISTKFKVIEALQSKADVLLIGGAMAFTFFKSEGIPIGDSLYESEFVAVARELLGVETQSRCRLLLPIDLVIAKKMDESFTETRIISVKEGIPDGYQGVDIGPDTIKLYQEELNRAATIFWNGPLGVFEVPAFSKGTQTIAQTLAVVNAITIVGGGDSLAAIEQAGVSKQINHLSTGGGASLEYIEFGQLPGIEALSDK

SEQ ID NO: 60043 - protein, 322 aa, Zea mays
MAKKRKHTDAQAETAGAEKPDDSAPARPERTLFGFKDPAPDAVPDSAASRAAVAPFRNREKVLITCSRRITYRYRHLMQDVLSMLPHAKKDSKVESKQSKGNALNEMLELRSCSSCLFFECRKQKDLYLWMVKSPGGPSVKFLVNAVHTMEELKLTGNHLKGSRPLLTFSTNFDEQPHWKLVKEIITHIFATPKDHRKAKPFHDHVFVFSIVDGHVWFRNYQISVPHNEIDKVDKGGMDKMTLIEVGPRFCLNPIKIFGGSFGGPTWYENPYYISPNQIRALEKRQKAGKYAKKVKAKVRRKMHEMENTLEPDEFAELWKGE

SEQ ID NO: 60044 - protein, 349 aa, Streptococcus mutans UA159
MKTAVFVKAGQMAIETIEKPSVIEVDDAIIRVVRACVCGSDLWSYRGDDDKATHSANSGHEIIGIVDEVGSAINTVKKGDFVIAPFTHGCGHCAACRAGFEGGCQGHDRSTNFSSGYQAEYVRYAHADWSLVKIPGQPSDYSEGMIASLLALADVMPTGYHAARVANVQKGDTVAVVGDGAVGLCAVIAAKMRGAKRIIIMSRHKDRQELALEFGATDIVEERGEEGVAKVLELTNGDGVDAALECVGTQLSTETALAIARPGASIGRVGVPHTKDINLSDYFFQNAIIAGGPASVTTYDKSVLLKAVLDGEINPGKVFTQSYSLDDIDQAYKDMQERKTIKSMVVVSK

SEQ ID NO: 60045 - protein, 457 aa, Candida glabrata CBS 138
MNSGNGQSTLPPDAPTTGADTIGNELTSTLASGEKGTIRSLIDSAMQNNPYFAAGGGLMLLGTGLALAKSGMVKASRLAYKQMIVDLEIQSRDKSYSWFLSWMSKHPQRISKHLSVRTSYIQHDNGSVSTKFSLVPGPGNHWIRYKGAFIRIKRERSAKMVDISNGTPFETVTLTTLYRDRHLFQDILNEAKDIALKTTAGKTVIYTSFGPEWRKFGQPKAKRLLPSVVLDKGIKEDIIEDVHDFMKNGKWYSDRGIPYRRGYLLYGPPGSGKTSFIQALAGELDYNICILNLSENNLTDDRLNHLMNNMPERSILLLEDIDAAFNKREQTGEQGFHSAVTFSGLLNALDGVTSSEETITFMTTNHPEKLDKAIMRPGRIDYKVFIGNATSYQIEKMFLKFYPGEVNNCKKFVEAVESLGSSVSTAQLQGLFVMNKDDPESAIKMVHTMKTNEEFVV

SEQ ID NO: 60046 - protein, 136 aa, Conocephalum conicum
MARTKQTARKSTGGKAPRKQLASKAARKSAPSTGGVKKPHRYKPGTVALREIRRYQKSTELLIRKLPFQRFVREIAQDFKSDLRFQSSAIGALQESVESYLVSLFEDTNLCAIHAKGVTIQSKDIQLARRLRGERN

SEQ ID NO: 60047 - protein, 136 aa, Conocephalum conicum
MARTKQTARKSTGGKAPRKQLASKGARKSAPSTGGVKKPHHYKPGTVALREIRRYQKSTELLIRKLPFQRLVREIAQDFKSDLRFQSSAIGALQESVESYLVSLFEDTNLCAIHAKRVTIQSKDIQLARRLRGERN

SEQ ID NO: 60048 - protein, 449 aa, Bradyrhizobium japonicum USDA 110
MSTRTSRVLHRSLRETPPKAIGGEGIYLFAEDGRRVIDASGGAAVSCLGHQHPRVIAAMAKQASTLAYAHTAFFSSEPAEALAETLVGHEPGGLAYAYFVSGGSEAIEASIKLARQYFIERGEPQRQHFIARRQSYHGNTLGALAAGGNAWRRAPYAPLLSAAFSHVTPAFAYHEKHDGESDAQFVARLAAELEAEFQRLGPNSVAAFLAEPVVGATAGAVTAPDGYFRAVREICDRHGALLILDEVMCGMGRTGTTHAWEQEGVAPDIQAIAKGLGGGYQPIGAMLASGRIIDTIRSGSGAFQHGHTYLAHPLACAAALAVQDVIREDGLLDRVKERGKQLEQRLTERFGNHRHVGDIRGRGLFWAIELVADRASRTSFDPALKLNQKIKAEAFANGLGCYPGGGTVDGVRGDHVLLAPPYIASVAEIDLIVDKLGTAVDNVLRSVNH

SEQ ID NO: 60049 - protein, 137 aa, Conocephalum conicum
MARTKQTARKSTGGKAPRKQLASKAARKTAPTTTGGVKKPHRFSPGTVALREIRRYQKSTELLIRKLPFQRLVREIAQDFKTDLRFQSSAVMALQEAAEAYLVSLFEDTNLAAIHAKRVTIQPKDLALARRLRGERN

SEQ ID NO: 60050 - protein, 322 aa, Xanthomonas axonopodis pv. citri str. 306
MTASPSKLAQLRELSVVVADTGDYDAIKRLKPVDCTTNPTLVKKALDLPVYADLIERELAWGREHGGDDRTATVNEVADRLTIGVGVKLAELVPGRVSTEVDADLAHDTQATIAKARKFIAMYAERGVSKDKILIKIAATWEGIEAARQLQKEGIDCNLTLIFNRSQALACAEAGVFLISPFVGRILDYYVAQGQTPASIDEDPGVVFVRTVYNEFKQRGSSTVVMGASFRSTAQIEALAGCDRLTISPDLLEKLDAEHGELPRKLSPAQADNAQFTPIDSDSFASGLAADPMATEKLAGGIDTFAKDLHALRKTIADKLAG

SEQ ID NO: 60051 - protein, 525 aa, Gibberella zeae PH-1
MSKTDQKACLIVIDGWGIPSADSPKDGDAITNAKTPVMDALYKDSKGYTELEASSLAVGLPEGLMGNSEVGHLNIGAGRVVWQDVVRIDQTIKNGELSQNDVIKKTFQSAAGGNGRLHLCGLVSHGGVHAKQTHLYALLKAAKEYGVPKVIIHFFGDGRDTDPKSGAGYMQELVDNIKEIGVGEIGTVVGRYFAMDRDKRWDRLEIALKGLILGEGEASEDPVATVKARYEQGGDMNKDEFLTPIIVGGDDRRIKDDDTVFFFNYRSDRVRQITQLLGDVDRSPLPDFQYPKIKPLVTMTQYKVDYPFEIAFKPQHMGNVLAEWLGKQNVEQVHIAETEKYAHVTFFFNGGVEKVFPLETRDQSQDLVPSNKSVATYDLAPEMSADGVADQVVKRLGEQKFPFVMNNFAPPDMVGHTGVYDAAVIGCEATDKAIGKILEGCKKAGYVLFITADHGNAEEMKFADGKPKTSHTTNKVPLLMANYPEGWSLKKTTEGVLGDVAPTVLAAMGLPQPEEMTGKSLLEKA

SEQ ID NO: 60052 - protein, 357 aa, Bradyrhizobium japonicum USDA 110
MSKKQYRIAVIPGDGIGKEVMPEGLRVLEAAAKKHGVSLHFDHFDFSSWDYYEKHGQMMPDDWKEKIGKHDAIYFGAVGWPAKIPDHVSLWGSLIKFRREFDQYVNLRPVRLMPGVPSPLANRKPGDIDFWVVRENTEGEYSSVGGRMFPDTDREFVTQQTVMTRTGVDRILKFAFELAQSRPKKHLTSATKSNGISITMPYWDERVEAMAKKFPGVKWDKYHIDILTANFVLHPDWFDVVVGSNLFGDILSDLGPACTGTIGIAPSGNINPEGDFPSVFEPVHGSAPDIAGQGIANPIGAIWSGAMMFEHLGEKEAGRSIVEAIERTLAERTLRTRDLGGNADTTACGKAVADMVD

SEQ ID NO: 60053 - protein, 506 aa, Ehrlichia ruminantium str. Welgevonden
MRNIYVTTPIYYVNDVPHIGHVYTTLISDIIARFKRLDGYNVKFITGTDEHGQKIEKAAAKANKSLVEFTDHASAIFQHLTGVMNFSHDDFIRTTEIRHKKAVTGLWRRLYNYGKIYLGNYAGWYAVRDETFYQEKELIDGKAPTGAEVEWVEEPSYFFRLSHFQERLLDFYDKHPNFIIPKHRYNEVISFVKSGLKDISISRQNISWGISVPEDDNHIIYVWIDALTNYLTTLGFPEINSSEYKNYWVDENSTVVHVVGKDILRFHAVYWPAILMAAELPLPKQILAHGWWTNEGQKISKSLGNVINPFELIEEFGVDQVRYFLIKEMPVGNDGDYKRSSIINCINCDLANNIGNLVQRTVSLLHKECRGTIPNVASSLFQDEDALPNYQEILENVRICINQYNLNGMIHIVEELSSIANEYIAFRAPWKLSKTDPIVMQAVLYKLLEYIRCVGLLLQPIMPYLSSKILDQIALSEYKRSFNNFAVPIDTGIILPKPEPIFTKII

SEQ ID NO: 60054 - protein, 235 aa, Alkalilimnicola ehrlichei MLHE-1
MATPLRPTTPEYIQHNQQVLEDRHSDFQHIVIAEDPDYGRLLYLDDDLQISEADQPYNQAMVDPLARHGSLGRVLILGGGDGGVLREAISRGAREAILVDIDRAVIDLCRRYLPQLCGDAFDAPQARVVVDDALAWLHREDEYDGIIYDLTMEPFSPDQSRTRFIDQVLAHAGRRLRPGGTFSMQCCGANEPALREEIRQGLARRFRTWEDTTVSIPSYDVDWVFAWARHPRLGA

SEQ ID NO: 60055 - protein, 341 aa, Prochlorococcus marinus str. NATL2A
MNLLAGDLGGTKTILAIYSNEKYPKKLFEKYYISSEWKSFYSLFEDFIKHLPDHISLPQNGSIGVAGPIQNQEVKITNLGWDIESKKLSLLSKINNIELINDFSVLIYGIPFFNRNQYEVIQGTLNSDYKNNQKLIAIIGAGTGLGMSRGLITPKSISIFPSEGGHREFSPRTENEWALVKWLKKKLNIQRISIERIVSGTGLGMIARWKLDDPINESHPLQVILKNMDSDKSDSTDLPALVWEKAKNGDKLMTEALQLWLNAYGSAAGDLALQELCSSGLWIAGGTAAKNLDGINSSNFLSAFSNKGRFQSYLKEIPLVVLKDKEATLFSSACRARLIAE

SEQ ID NO: 60056 - protein, 219 aa, Actinidia deliciosa
ETGRHVRMLTHEIRSTLDRHTILKTTLVELGRTLALEECALWMPTRTGLELQLSYTLRHQKPVGFTVPIQLPVINQVFSTNRAAKISPNCPVARLRPLAGKYMPGEVVAVRVPLLHLSNFQINDWPELSTKRYALMVLMLPSDSARQWHVHELELVEVVADQVAVALSHAAILEESMRARDLLMEQNVALDLARREAETAIRARNDFLAVMNHEMRTPM

SEQ ID NO: 60057 - protein, 464 aa, Salmonella typhimurium LT2
MKNASTASGASVSDAASKNEPTLQRGLQNRHIQLIALGGAIGTGLFLGIGPAIQMAGPAVLLGYGVAGIIAFLIMRQLGEMVVEEPVSGSFAHFAWKYWGPFAGFLSGWNYWVMFVLVGMAELTAAGIYMQYWLPDVPTWVWAAAFFIIINAVNLVNVRLYGETEFWFALIKVLAIIGMIGFGLWLLFSGHGGEHASIDNLWRYNGFFATGWHGLLLSLAVIMFSFGGLELIGITAAEARDPQKSIPKAVNQVVYRILLFYIGSLVVLLALYPWVEVKSNSSPFVMIFHNLDSNVVASALNFVILVASLSVYNSGVYSNSRMLFGLSVQGNAPKFLTRVSHRGVPVNSLILSGAITSLVVLINYLLPQKAFSLLMALVVATLLLNWIMICLAHLRFRAAMRRKGRETQFKALFYPAGNYLCIAFLALILVLMCTMDDMRLSAILLPVWIVFLFIAFTVLRRKAH

SEQ ID NO: 60058 - protein, 415 aa, Pseudomonas syringae pv. tomato str. DC3000
MDAFNYRDGELFAEGVALSAIAERFGTPTYVYSRAHIEAQYRAFADALSGMPHMVCFAVKANSNLGVLNVLARLGAGFDIVSRGELERVLAAGGKAERIVFSGVGKTREDMRRALEVGVHCFNVESTDELERLQEVAAELNVRAPISLRVNPDVDAGTHPYISTGLKENKFGIAIAAAEDVYIRASQLPNLEVIGVDCHIGSQLTTLEPFIDALDRLLDLVDRLGDCGIHLHHIDLGGGLGVRYRHEEPPLAGDYIKAVRERLAGRDLGLLFEPGRFIVANAGVLLTQVEYLKHTEHKDFAIVDAAMNDLIRPALYQAWMDVTAVRPRDSEPRAYDIVGPICETGDFLAKGRELALAEGDLLAVHSAGAYGFVMSSNYNTRGRAAEVLVDGTQAFEVRRRETVAELFAGESLLPE

SEQ ID NO: 60059 - protein, 589 aa, Helianthus annuus
MCGILALLGCSDDSQAKRFRVLELSRRLKHRGPDWSGLYQHGDNYLSHQRLAVIDPASGDQPLYNEDETVVVTVNGEIYNHMELREKLMGHKFKTGSDCDVIAHLYEEHGENFVDMLDGMFSFVLLGTRDNSYLVARDAIGITSLYIGWGLDGSVLISSGLKGLNDDCEHFEVFLAGHLYSSKIRGFRRWYNLPWFSESIPSTPYDPLVLRCAFENAVIKRLMTDVPFGVLLSGGLDSSLVASVTARHLAGSKAAKQWGAQLHSFCVGLEGSPDLKAAREVADYLGTLHHEFHFTVQDGIDAIEDVIYHIETYDVTTIRASTPMFLMSRKIKSLGVKMVISGEGSDEIFGGYLYFHKAPNKEEFHQETCRKIKALHQYDCLRANKSTSAWGLEARVPFLDKEFINVAMSIDPEAKMINMDQKRIEKWILRRAFDDEEKPYLPKHILYRQKEQFSDGVGYSWIDGLKSHAEQHVTNKMMLNAERIFPHNTPVTKEAYYYRMIFERFFPQNSAKLTVPGGASVACSTAKAIEWDASWSNNLDPSGRAALGVHNAAYKKNSGSISSANLAPSIADNVPRMMDITGPELVIRS

SEQ ID NO: 60060 - protein, 194 aa, Aspergillus oryzae
MTSRLVLVIGDLFIPDRAPFRKLLTPNKIGQILCLGNLTDRSTFEFLRGIAPDLQLVKGDFDVDSPNLPLSKVVTHGSLRIGLTHGHTIIPPGDAEALLIAARQMDVDILLWGGAHRFDAFEMEGRFFITPGSATGALSTGYWPEGEEPTPSFCLMDIQGDVLVLYVYQLKTDANGVETVAVEKVSFRKNTVQS

SEQ ID NO: 60061 - protein, 357 aa, Vibrio vulnificus YJ016
MSKQQKILFIDRDGTLIVEPPVDFQVDRLDKLKLEPFVIPSLLSLQDAGYRLVMVTNQDGLGTDSYPQEDFDAPHNMMMEIFESQGVKFDDVLICPHFEKDNCSCRKPKLGLVKEYLQAGKVDFQNSFVIGDRQTDLQLAENMAIRGIQYNPETMGWKQILKDLTVKARVAEVVRTTKETDIKVFVNLDEQGGNAISTGLGFFDHMLDQIATHGGFQMVCKVEGDLHIDDHHTVEDTALALGQALKEALGDKRGIGRFGFSLPMDECLAQCALDLSGRPYLKFDAQFSREQVGDLSTEMVVHFFRSLTDTLACTLHLSSAGNNDHHIIESLFKAFGRTLRQAIKVEGTELPSSKGVL

SEQ ID NO: 60062 - protein, 584 aa, Cryptococcus neoformans var. neoformans JEC21
MPSATLIRLSKSLSMSSSNSTVRVALRGGAILNNPRFNKGSAFTHQERSEFALRGRLPYAVDSLEIQVKRAYEQYKSRETNILKNSFLQSMKAQNWTLFYALLQAHLVEMFPIVYTPTEADAIADYSHLFRRSEGLYLTPPGEKNMEEDFLDACEGRELELIVVSDGEAILGIGDQGSGGIGISGAKAVIYSLIAGVDPAKCLAITLDVGTNNQDLLNDPLYIGYREKRLRDDRYDQFVDKFVGLVKKHQPECLLHFEDLVSPMLNDSSEDIGARFNDDIQGTGAVTLAAVQAAISVTKSSLKDQRIVIYGSGSAGLGIARQLRDAIALDSSGSPSEAAKQFWLIDKHGLIKKSLGKDKIRSEIEDEFIRDEGDWGEGETGLKEVVKKIKPTILVGTSTQAGAFTEEVVKEMSKHVDRPIIFPLSNPTRLCEAQPKDVSEWSKGKALMSTGSPFDPVDISDSGEKYIVAECNNALIYPGLGLGSILAKSSKMTDKMIIAGAQRLGQLAPALVKKNANKSLLPDFGDAQKVNFEVALAVLEQAMEDGVARAKDIPEDKDERRKWAENNRWSPGYPNFKYDPEGLK

SEQ ID NO: 60063 - protein, 330 aa, Zea mays
  misc_feature (242)..(242): Xaa can be any naturally occurring amino acid
MVASTASRLSPPRFSTPSPSLHPPNRRSRFSPVRAAKLEAVLSIGAHLIPHPRKAASGGEDAFFANSDAGGVFAIADGVSGWAEKNVNPALFSRELMRNSSNFLNDEAVSHDPQILLMKAHAATSSIGSATVIIAMLEKTGTLKIASVGDCGLKVIRKGQVMFSISPQEHYFDCPYQISSEAEGQTYKDALVCSVNLMEGDIIVSGSDGLFDNIFDQEIVSIISESPSVDEAAKALAELARXKHSVDVRFDSPYSMEARSRGFDVPWWKKLLGGKLIGGKMDDITVVVAQVKTVVVPEDEVQGGDTEEQKGNEQGAAAVVAYKMNDEEVA

SEQ ID NO: 60064 - protein, 535 aa, Zea mays
MVAATATAMATAASPLLNGTRIPARLRHRGLSVRCAAVAGGAAEAPASTGARLSADCVVVGGGISGLCTAQALATRHGVGDVLVTEARARPGGNITTVERPEEGYLWEEGPNSFQPSDPVLTMAVDSGLKDDLVFGDPNAPRFVLWEGKLRPVPSKPADLPFFDLMSIPGKLRAGLGALGIRPPPPGREESVEEFVRRNLGAEVFERLIEPFCSGVYAGDPSKLSMKAAFGKVWRLEETGGSIIGGTIKTIQERSKNPKPPRDARLPKPKGQTVASFRKGLAMLPNAITSSLGSKVKLSWKLTSITKSDDKGYVLEYETPEGVVSVQAKSVIMTIPSYVASNILRPLSSDAADALSRFYYPPVAAVTVSYPKEAIRKECLIDGELQGFGQLHPRSQGVETLGTIYSSSLFPNRAPDGRVLLLNYIGGATNTGIVSKTESELVEAVDRDLRKMLINSTAVDPLVLGVRVWPQAIPQFLVGHLDLLEAAKAALDRGGYDGLFLGGNYVAGVALGRCVEGAYESASQISDFLTKYAYK

SEQ ID NO: 60065 - protein, 136 aa, Conocephalum conicum
MARTKQTARKSTGGKAPRKQLATKAARKSAPSTGGVKKPHRYRPGTVALREIRRYQKSTELLIRKLPFQRLVREIAQDFKTDLRFQSAAIGALQEASEAYLVGLFEDTNLCAIHAKRVTIMPKDIQLARRIRGERN

SEQ ID NO: 60066 - protein, 1008 aa, Oryza sativa (japonica cultivar-group)
MIQFRRRILTLLLQPASPRPIAGIFLPPCSLRRLLSTTAPVSPKPFAVEDYLVAGCGLTRAEAAKASAKISHLSSPSNPDAVIAFLSDLGLPRPQIAAAIAADPRLLCADVEKNLAKRVGELGDLGFSRSQIARLLPLAGWCFRSSSLATNLAFWLPVFGSFDKILKALRMNKNLLSPGVQKSAKPILAFLEQCGINASDVARSSTMYSSRLLTANPEYLRDAVARVEELGLDRSSRRFHRGLVAVALVSKETAARKIRLMEELGFSQDDLLVIMRKLPNFLALSEKKIRRAVEFLKRDVGLEGRYIVQRPVLLSYSLERRLLPRHCLLKVLRTKGLLNTAARPKMQAFAQRATIAAQQLLRPYRNCSICTLVSTSRSLRFHGGGGAASSSSSTATAAAAMIHHLQRRIVSLLLLHPASPHPVAAISLGRLLSTTAPVSSKPFAAEDYLVAACGLTRAQAARASERISHLRSPSKPDAVLAFLAGLGIPRPDIATAVAADPRLLCAGVEGNLAKRVAELGDLGIPRSQIARLVPLAKIPFRSSSLATNLAFWLPVFGSLDSILRALRKNSSLLSANLDKVVKPNLAFLKQCGIDARDVASNPNLYSSRLFTSNPMKLRDAVARVEELGMVRGSRVFHRGLVAVAFLSKEAVATKTRLLVELGFSQDDVSVIFRKMPSFLTASEKRIRRAVGFLKGDVGLEERYIARRPVLLLYSLERRLLPRYYLLKVLRTKGLLDCKLCYYSTAALGEKKFIERVGSKDGLKGETNVRTGRPRPFSKLSPGVDVGNVEKAHLQYTHRLSRKSGSKRSSGFKRRSAAAGNRRDAMIHLRRCVLSRLLQPPCLTAATHANSLLSLHLRRLLSGAAEPFAVEDYLVESCGLTRARAEKVSGKLSHLRSPSKPDAVLAILSGLGLTRPDIAAAVASDPRLLCARVDRTLDARVAELGGIGLSRSQIARLIPLARGGFRIKSLGSKLAFLVTVFGSFDRCLEVVRMNCGQLSREHVYLLSQL

SEQ ID NO: 60067 - protein, 475 aa, Bordetella bronchiseptica RB50
MSTQYRSFVAGQWQDGGEPVALYNPSDLQEEAGVYMHAPVEMVNQAVRAAEEALDAWRGLHAMARSRLLDGIADGLVRRRDELAMAIAREQGKPLRDALAEATRAADIFRYFASETIRQKGYTYASIRPGVRVEVQRNPVGVVALVTPWNFPVVIPAWKAAAALAYGNTVVMKPSEIAPCGAWILADVMREAGLPAGVFNLVLGAGQAGAALVAHEAVAAVSFTGSVATGKRIAAAAAGKRIQLEMGGKNPLIVLDDADLDTAVACAIDGAFLYAGQRCTASSRIIVTEGIHAAFVKRLLAQTASLAVGHALDEATVIGPVVNAEQFEKNRRYADLARQEGGTVAGGRALSRPTRGHYFEPCLVTGLDNSATVCREEVFGPFACVLTARDYEHALAIANDTPFGLSSGLCTTSMKHAQHFKAHTKSGLASINTSTSGVDFHVPFGGNGASSYGPREQGEFAIEFFTTLRTVYIGD

SEQ ID NO: 60068 - protein, 514 aa, Staphylococcus aureus subsp. aureus Mu50
MVVEFKNEPGYDFSVQENVDMFKKALKDVEKELGQDIPLVINGEKIFKDDKIKSINPADTSQVIANASKATKQDVEDAFKAANEAYKSWKTWSANDRAELMLRVSAIIRRRKAEIAAIMVYEAGKPWDEAVGDAAEGIDFIEYYARSMMDLAQGKPVLDREGEHNKYFYKSIGTGVTIPPWNFPFAIMAGTTLAPVVAGNTVLLKPAEDTPYIAYKLMEILEEAGLPKGVVNFVPGDPKEIGDYLVDHKDTHFVTFTGSRATGTRIYERSAVVQEGQNFLKRVIAEMGGKDAIVVDENIDTDMAAEAIVTSAFGFSGQKCSACSRAIVHKDVYDEVLEKSIKLTKELTLGNTVDNTYMGPVINKKQFDKIKNYIEIGKEEGKLEQGGGTDDSKGYFVEPTIISGLKSKDRIMQEEIFGPVVGFVKVNDFDEAIEVANDTDYGLTGAVITNNREHWIKAVNEFDVGNLYLNRGCTSAVVGYHPFGGFKMSGTDAKTGSPDYLLHFLEQKVVSEMF

SEQ ID NO: 60069 - protein, 233 aa, Hyphomonas neptunium ATCC 15444
MLDPSAALFLDFDGTMAPLQSDPDTVFLPEGGAEILLRTAENLHGALVILSGRDIRDLASRIPDGLWRAGGHGAYVCPPGHAPPGELPEAPENLVAEISALIEEIPGVRMESKGPVLAVHYREIPEAAGPLEAGLTTLLEAFPEYTLQSGKMVMEARPASAHKGKCVRELMKQAPFSGRAPIMVGDDTTDEDAMRASLDFGGTAIKVGAGATAAPYRLADPAAVWDWLKRGLT

SEQ ID NO: 60070 - protein, 412 aa, Oryza sativa (japonica cultivar-group)
MIRLRERILSLLLQPASPRPIAGIFPPPCPLRRLLSTTAPVSPKPFAVDEYLVATCGLTRAQAAKASEKLSNLRSPSNPDAVLAFLSDLGLSRPDGIAAAVAADPRLLCADVGSSLARRVDELGGLGLSRSQIARLLPLAGRCFRSSSLATRLAFWHPVFGSFENILKALKMNAALLGSDLDKVAKPNLAFLAQCGINASDVTRTTLSLYSCRLFTVNPRFLQDAVARVEELGVARGWRTFHRVLSTVAFLSRETIASKMQLLDDLGFSQDDFLVIVRRAPQVLRLSDGRIRRSVEFLIRDVGLEQSYIAQRPTLLAYSLERRLLPRHCLLKVLKAKGLLNCDLSYYCIAAMSEEKFVQRCTSGTGSGLRAFLQLPTTAALTPGGIRRHTAFPFHPFPIDFVAKIIVVGCDL

SEQ ID NO: 60071 - protein, 357 aa, Kineococcus radiotolerans SRS30216
MTTLSTEEPTSRPRRSTPYAMLTAAVQEAGLMRRRTGHYWWRIAFTTVAFAVVVAGTVLLRDSWLVLLTAVPLALVLTQFAFLGHDGAHKQIFASHRGNEWAARIFAALLTGLSYGWWMGKHTKHHQAPNARGIDTDIESEVVSFHEEAAASRRGLLRWATSKQGYWFYPLLLLAGLNLHADSTKSLITGRRTKKRWIDASLIVVHWAVYLSALVLLLGPARGAAFFAVHMGAFGVSMGGAFAPNHVGMPIVARETKVDFIRRQVLMSRNISGGWFVDLFMGGLNFQVEHHLFPSLPRPNLRAVQPFVRRFCAEHGIDYTETSLPQALRDITTYLNEVGLAARDPFRCPLVSQLRSN

SEQ ID NO: 60072 - protein, 392 aa, Oryza sativa (japonica cultivar-group)
SSPAASNPSAAAAAMNHLRNQILLLRVRSSSTSLSPLSPLHRLFSSSTAAASIAAEPFAVEDYLVTTCGLTGDQARKAAKTLSRLRSPSKPDAAVAFLSGLGLSRSGIAAAVAADPRLLCADVEKNLAKRVAELGELGISRSQIARLIPLARQSFRSSSLATNLGFWLPVLGSFENVLMALKANGAILGSDVEKVVKPNLALLQQCGIHVCDFPHTRLPTVLCRPPNHVQEAVARIGEFGVPQYSPVFRNALVPFAYQNKEKLAAKIGVLEMFGWSEDDLSMTMRKGPVVMNMSVERLRKNVEFLTRDVKLETRYIARRPIMISYSLERRLLPRHRLLRFLSAKGLLDGELDFYSAVALTEKKFLDKFVHSCKCSIADPANAYASSFVGDVL

SEQ ID NO: 60073 - protein, 101 aa, Triticum aestivum
MAKLMCLCFIILTIGVAVSADECEGDRQAMIKECAMYQKWPANPKIDPSDACCAVWQKANIPCLCAGVTKEKEKIYCMEKVGYVANFCKKPFPHGYKCGSK

SEQ ID NO: 60074 - protein, 191 aa, Triticum aestivum
MESSSSSLLLSSYAGNNKRARDADLEVGSSAEAEAAKRMRPEDLLDLLADDTDAAAAGDLASVMRSLEEEICADELMPPQPELGFLLEASDDELGLPPAAGASSSSDDAGGWEPEEAAGLFGEQIWGFEDEIDGAYAFGGVAYSPEAAVAAAAAAAEWGDDGFDAGLFGFGDESFGPSDLDVLRQETMPAV

SEQ ID NO: 60075 - protein, 667 aa, uncultured bacterium 441
MNFDQNLIAPALGVLGLLIVVIIYQWITKQDGGSGAVKKIGEQIHIGAIVFMKREYKMLSIFALVLLVLLYIFLGAASALCFVVGALTSATAGYIGMNTATIANVRTAQAAHDSGSSAALTVAFFGGSVMGLSVAALGLLGLGGLYYFFGAEHSEALHGFAMGGSVVALFSRVGGGIFTKSADVGADLVGKIEAGIPEDDPRNPAVIADNVGDNVGDIAGMGSDIFESYCGSMIATIAIASTLSAMALDMLGGNRSELMFLPLALASLGLVCSIIGIIFVKLSSNKSPESALRMGTIGSAVLFIVTSYFLISSLDVSNNIWAAVLMGSIGGIIIGLVTEYYTAGKPIRDIAEAGQTGSATVMIKGLSVGMQSVVVPVLMICLIIYVSNLFVGLYGVGIAAIGMLATVGMTMAIDAYGPIADNAGGIAEMAGLGEDTRNITDSLDELGNTTAAIGKGFAIGAAALAALAIITAYTETVAANSSDFLLQLNSAEVLIGLFIGGTIPFLIASLTMTAVGDAAFEMIEEVRRQFKEIKGLLDGKAEPDTAKCVDIATTAALKKMILPGVIAVAAPVLVGFLISPEALGGMLGGALLGCVLMALMMANAGGAWDNAKKHVEKGNFGGKGTDVHAATVVGDTVGDPFKDTSGPSMNILINVMAIVSLVIAPLL

SEQ ID NO: 60076 - protein, 211 aa, Vibrio vulnificus YJ016
MSVKAAEVSSLAERINWEKVDGLVPAIVQDFQSSQVLMMGYMNQDALAKTGETGQVTFFSRTKERLWTKGETSGNVLQLVNMSLDCDNDTLLVKVNPIGPTCHTGTTTCWDGDPQEESQMVWLHQLEQLLAARKSADPDSSYTASLYARGTKRISQKVGEEGVEVALAATSGDKAELVCESADLIYHLLVLLQDQGLSMNDVINKLKERHK

SEQ ID NO: 60077 - protein, 613 aa, Heliobacillus mobilis
MYAAIAGVIGLLFAGYLAMSVLKEDQGTQRMKELSQAIFEGAMAFLNRQYRTLIPFAVIIFGALLYGNWGNQKLAWGQAISFLVGASFSAVAGYVGMTIATKSNARTTAAAMRGLNEALSVAFRGGAVMGMSVAGLGLLGVSVLYIVYQDAVIINSFAFGASVIALFARVGGGIYTKAADVGADLVGKVEAGIPEDDPRNPAVIADNVGDNVGDTAGMGADLYESYAATTIAAMLIGVTVFPGRLEGIFYPLLIGAAGLIAAIIASFFVRTTEDGNPQMALNKGLWGTNVLTAVATYFIAQSLFADIPASSAFPSGVPLGLTISVIAGLLVNVAIGWITEYYTSYNYKPAQHIASSSLTGPATNIIAGIGVGLKSTALPIIVIVIAIAVSYNYAGIYGIAMAAMGMLCTAGMVVAIDSFGPVADNAGGIAEMAELGPEVRKKTDKLDAVGNTTAAVAKGFAIGSAALTALALFTAFAEEVIKSPGVSSALHGGHLVLNLLEPKIIIGLFIGGTVPFLFCAFAMEAVGKAAFEMIGEVRRQFREIPGLMEGKAKPDYARCVDISTRAAIRQMIAPGLLAVITPLIVGFGFGAQALGGMLAGVTVAGVLLAIFMG

SEQ ID NO: 60078 - protein, 538 aa, Heliobacillus mobilis
MSSPQTPVMLIVLDGWGLRDDMEGNALKLANLPNFHRLWETYPHTSIQASGEYVGLPKGQIGNSEVGHLNIGAGRVVYQELTRISKAVETGELEKNPVLAAAMDRLSGTGKALHLMGLLSDGGVHSHIDHLFALLDMAVAHGVDKIFVHAFLDGRDVPPANAKEYVEALDKKLAQIGVGQLATISGRYYAMDRDKRWERVKRAWDAIVYGEGEKAPLGSAAVETAYHARLTDEFVLPTVIIDEKGEPRGTVADGDSVIFFNFRADRARQLSHVFTDQNFDGFDRGPKLPQVHFVCMTQYDITLDAPVAFLPQNLENTFGEVVSRAGMRQLRIAETEKYAHVTFFFNGGVEEPNEGEDRVLVPSPKVATYNLQPEMSANEVTDRVVEKINSKEYPVIVLNLANPDMVGHTGILPAAIQAVETVDGCLGRIVPAVLDQDGVVIITADHGNVEQMIDPDDGGPQTAHTTNPVPVILVSDRHKDKQLRSGGALEDIAPTMIELLRLEKPLEMTGESRSLCPKQNSYIWWYICGKSGCNDSAR

SEQ ID NO: 60079 - protein, 501 aa, Glycine max
MFGYAAAIIAAILFFQYFFHRRRCCKHPILTEYPILGMLPQLLFNLWRAHDFFTEILKRHGGTGEFIGPWFTNMDYLVTCDPINVHHMLSKNFHNYVKGPEFRHIFQAFGDGIFAADSEAWKYNRDLFHSLFKQKSFEVFVAKTIHNKVHNGLLPILDHVQQQGRVVDLQDVFNRFTFDNICSIVLGNDPNCLSIDFSEVAIEKAFNEVEESIFYRHVVPRCVWKIQRWLQIGQEKKMTEACKTLDQFIHACIASKREKLSKYNENEMGEAHHVDFLTALMREETAHDDKFLRDAVFNLFVAGRDTITSALTWFFWLVATNPSVEAKILDEMKEKLGTKEKTLGVLSVEEVKRLVYLHGAICEALRLFPPIPFETKQAIKADMLPSGHRVNSGTKILFILYAMGRSEETWGKDCLEFKPERWISEKGGIIYVPSYKFIAFNAGPRTCLGKEISFIQMKMVAAAILHKYRVRVVEGFVATPSPSIVLLMKDGLKVQIAKREI

SEQ ID NO: 60080 - protein, 291 aa, Agrobacterium tumefaciens str. C58
MTFYLRRTTMPHDFLAEITGSFAMPAGENPTVAMIEAAYQHHGLNWRYINLEVSPENLKDAVAGARAMGWAGFNCSIPHKVAVIQHLDGLGESAEIIGAVNTIVRRGDRLIGENTDGKGFVKALRDVIDPKDKKVVLFGAGGAARAVCVEVALAGAAHITVVNRNRERGETVARLIDEKTPATATFAAWEDAFAIPEETDIVIHATSVGLYPDIDGLPDIDLKTLRPSMVVADGIHNPPRTRLIRAAEAAGSKTADGLGMLVNQGVIGIKYWTGVDVDAYVMRQALVDLNL

SEQ ID NO: 60081 - protein, 892 aa, Candidatus Blochmannia floridanus
MILSYSYKDVDFIETQDWIESISSVIQKEGIERAYFLIKQIIKKVQTDGFNISPENLLNNDYINTISVQDEPTYPGNLAIEQRIYHAICWNAIMMVLRASKKNLELGGHISSFQSSATLYEVCFNHFFRARNKIDEGDLIYFQGHISPGIYARAFLEGRLHEEQINNFRQELKNKGLPSYPHPKLMPEFWQFPTVSMGLTAISSIYQAKFLKYLNNRKLKNTTLQTVYAFLGDGEMDEPESKGALNIASREKLDNLIFIVNCNLQRLDGPVVGNGKIINDLEKIFVGSGWEVIKVIWGSKWDSLFNQDTTGKLIQLMNETVDGDYQTFKSKDGAYIRKHFFGKYAETKDLVKNMTDTEIWELNRGGHDPIKIFAALNKAKNNSKKKPVAILAHTVKGYGMGSEIEGVNTAHQIKKIDKKRIQYLRNKFNLNTIITDDQIESLPYLTFKENSEEYLYLHKRRQLLFGYLPNRLTNSTHSLNLPNLEYFQSMLKKQNKHISTTLAFVRILNILLQYQPIKNHLVPIIADEARTFGMEDLFRKIGIYNPSGQQYTPQDHNLFSYYREDKQGQILEEGINELGASASWLAAGTSYSTNNFPMIPFYIFYSMFGFQRTGDFLWAAADQQARGFLIGATSGRTTLNGEGLQHADGHSHIQSLTIPNCISYDPAYAYEITIIIYDGLIRMYGKNPENIYYYITTVNEKYYMPPMPTGVEEGIKKGIYKLESLPGLIGKVQLMGSGSILRLVREAAQILSNEYNISSDVYSVTSFTELARNGQDCARWNMLHPTQTPKIPYVTSVLNNFPTIAATDYMKLFAEQIRGFIPSNYFYVLGTDGFGRSDSRENLRHYFEVNSGYIVIAALSILIKQGYIQSDIMSKAIKIFNINPDIINPSLI

SEQ ID NO: 60082 - protein, 251 aa, Heliobacillus mobilis
MRTPVLAGNWKMYMTPEEGRQMVQALIPLVADCREREIVLCPPYISLDSLAKALKGTNIALGAQNMHPAKEGAYTGEVAPGMLKALDCKYVILGHSERRQYFGETDATVAEKVKAALAANLIPIVCVGETLAQREQVITEPVVDIQVRLGLAGLSPEELAGIIIAYEPVWAIGTGKTASSADAQKVCRFIRSVLSSWHGDTAEKVRILYGGSVKPDNIRELMEQPDIDGALVGGASLKADSFARIVRFEEQ

SEQ ID NO: 60083 - protein, 459 aa, Oryza sativa (japonica cultivar-group)
MSTSNNGGPTVAVKLYIDKEKKKVLFAESDKEFVDVLFSFLTLPLGTIVRLLGKQSQIGCLDELYKSVEALSEDYFQTKACKAMLLRPRNAAGSHCDRLKVKVDDTNERLIYVCPTSSCDARSFSSFWGVCNSCTVTTTLILREKPVDCRTVESNDDGVFVKSDLKFIIFDDLHVAPASTSTMFPLLGKFGLLEQRNIEEKVLELNSHKEVIAIGLSCDARSFSSFWGVCNSCTVTTTLILREKPVDCRTVESNDDGVFVKSDLKFIIFDDLHVAPASTSTMFPLLGKFGLLEQRNIEEKVLELNSHKIINLLKRALVGYDFVDLVFGLLSLPLGSTIKAYGQVTSGGSSGLDNLYRSINGSGIGCVKQECQSLLLSPMLAPFFGCGSSVLLQVQESPIKSCSLRVIRAAKIPNEMLVKKELTLDRTQVFHLLLQVLKLLRAALVTRNALSSVLLPPKK

SEQ ID NO: 60084 - protein, 356 aa, Arabidopsis thaliana
MKNGLIIINCIILTIGTCGGPLLTRLYFTNGGKRIWFMSFLSTAGFPIILIPLLVSFLSRRRGNRNPNNAENKRKTKLFLMETPLFIASIVIGLLTGLDNYLYSYGLAYLPVSTSSLIIGTQLAFNALFAFLLVKQKFTPFSINAVVLLTVGIGILALHSDGDKPAKESKKEYVVGFLMTVVAALLYAFILPLVELTYKKARQEITFPLVLEIQMVMCLAATFFCVIGMFIVGDFKVIAREAREFKIGGSVFYYALIVITGIIWQGFFLGAIGIVFCASSLASGVLISVLLPVTEVFAVVCFREKFQAEKGVSLLLSLWGFVSYFYGEFKSGKKVVDKPQPPETELPILPVSDYVA

SEQ ID NO: 60085 - protein, 439 aa, Oryza sativa (japonica cultivar-group)
PLVPGSPPFPPLSPPPPLPPRPSPSPSPSPLQPPAMLHLQKHLLLLSLPPRATASTLLSLRHHGLFSLTRFSAAAAAAKSAGHFAVEEYLVATCHLTPDQATKASKSISHLKSPSRPDAVVAFLAGLGLSAADIAAAVAYDPRLLCAEVDRTLAPRLAELAGLGLSPSQIARLVLVDPARFRRPTVISKLQYYVPLFGSFETLLQALKNNSYLLSSDLEKVVKPNVALLRECGLGACDIAKLCIPLPRLLTTSPERVRDMVAQAENVGVRRGSKMFRHAILAVAYISEEKIAAKMQFLMKTLKWSDAEARIAVSKLPVVLRSSEDKLSRVSEFLISEVGLEPAYIAYRPAMLTYSLERRLMPRHCVLKYLKDNGLIESDKSYYSAVQVTEEVFVEKYISPYEDTAPHLAEDYAAVSSVKIPTRFRLKGPKTGHASAQTA

SEQ ID NO: 60086 - protein, 384 aa, Staphylococcus aureus subsp. aureus Mu50
MISNKLANIPDSYFGKTMGRKIEHGPLPLINMAVGIPDGPTPQGIIDHFQKALTIPENQKYGAFHGKEAFKQAIVDFYQRQYNVTLDKEDEVCILYGTKNGLVAVPTCVINPGDYVLLPDPGYTDYLAGVLLADGKPVPLNLEPPHYLPDWSTVDSQIIDKTKLIYLTYPNNPTGSTATKEVFDEAIAKFKGTDTKIVHDFAYGAFGFDAKNPSILASENGKDVAIEIYSLSKGYNMSGFRVGFAVGNKDMIQALKKYQTHTNAGMFGALQDAAIYALNHYDDFLEEQSNVFKTRRDRFEAMLAKADLPFVHAKGGIYVWLETPPGYDSEQFEQFLVQEKSILVAPGKPFGENGNRYVRISLALDDQKLDEAAIRLTELAYLYE

SEQ ID NO: 60087 - protein, 306 aa, Colwellia psychrerythraea 34H
MKRLKAASLMTAIKTPYTDKGEVCLKTYDFLIEQQISAGVDGIIVGGTTGEGHLLSWEEHLMLIAHCVNNFGDKLIIVGNTGSNNTREAIKATENGFAMGMDAALQINPYYGRTSIRGVSEHFKRVLDIGPAFIYNVPGRTGQDLTPEIIEPLSTHKNFIGVKECSGNDRIAYYEKRGISCWSGNDDECYVGRHVHGSHGVISVASNIIPGFMRQLMDKDNVEESAKLNDKLQGLMKWLFCEPNPIAINTAMIMTDAVPNNFRLPYIALTKEQREVGLELLKAIETKDLVGDSLSLLEDSDFNYCI

SEQ ID NO: 60088 - protein, 466 aa, Glycine max
  misc_feature (295)..(295): Xaa can be any naturally occurring amino acid
  misc_feature (314)..(314): Xaa can be any naturally occurring amino acid
PNNPSPNRVTRIQSLRDGLLIGASPRRRQKRDHRGGAGSRSRARASTRFLPIRNERENRRRHLKNLHPGKKLKKFLHIIEDSPVFPVIYDSKRTVLSLPPIINGAHSAITLETKNVFIECTATDLTKAKIVLNTMVTAFSEYCENKFVIEPVEVISSDGKSNIYPDLSVYNMEVSLSYINGLIGVSLEAEEVTKYLNRMQLHAKQSASHNKQCNIVVSVPPSRSDVLHPCDVMEDVAIAYGFNAIKDKAVVDNKGSKRLAASLTLLPLNELSDLIRKEVALIGFTEGLDIYTSAXKENFAMLNRKEDKSKAVIXGNPRSSDFEAVRTSLMPGILKTVAHNKDHPKPIKIFEVGDIAVLDDKRDVGAKNLRQLAALYCGANAGFEIIHGLVDRVMEKNGVPFVSPGDKSGYYIEQSDEPEFLAGRQARIIYKGKHIGTFGIVHPEVLNNFDIPDPCSFVELNIESFL

SEQ ID NO: 60089 - protein, 516 aa, Hyphomonas neptunium ATCC 15444
MRNELKVHAARLSRQPLKALSAARAGTEPLSAAGWKISLARHFLDTEAEQSLLDFGAEARLTKAAEALFGEAIVNPSEGRPALHWALRAPARLMGEAESVRQSVIDALEFAGKVQTGEVRTAGGEAFTAVLHIGIGGSDFGPRLIADAFEDLAHPAIKLRFAANVDPYDLDRAMAGLKPENTLVVGVSKSFGTEETLYNLGRARRWLEEKLGDDASKHLALVTANPDKAKAWLGGRAAYTFDMPISVGGRFSLWSAASLACMIYLGPENFRSILNGANEMDEHVRTAPLAQNAAMRLALLDFWNTSIREKPMRVLLAYANRLRLLPTYLQQLEMESNGKSVDSQGNSVAPPTAPALWGGEGSVGQHSYHQWLHQGSQDVPCEFILAPDYNRDSEGLDALTAHALAQAEVLANGRSIAEVRAEEPGISDAVAPQKVHAGGRPSTLFSHASFGPEAFGALVALYEHRTYFAGQLWGLNPFDQWGVERGKTMAGRIKAVLKTPEIAADPVTAALLKQIF

SEQ ID NO: 60090 - protein, 797 aa, Pseudomonas syringae pv. phaseolicola
MNVGCRWSDSPYHSFNGSCLKTFRFSRSNCLNSGDTVPNQNQRDAFQAAMENCAREPIRIPGSIQPQGFLLVIEEPGMIVRQFSENLPVWLGVSPDDLIGARFEDVITEGAELIEQLGEFEEDETHPYHVADVRFLIGNHCGTQLPLMLHRHDQVLIAEFERTDAGTVTHNRLYPIVRSFISSAPEIETITALCERAVRVVKRLSGFGRVKAYQFDDQGNGLVNAESLDDGYQSYLGLCFPASDIPAQARELYCTNRIRVIEDANYTPAKLIPEFNPITNQPLDLSFAALRSVSPVHLQYMRNMQTLSSMSISIVVEGRLWGLLSCHHQTPHAVSFQTRTACELLGRVLSLQIESRETHIKTTRMLEIRNRMVRLLSAIADCDSVLLGLRAEPDIFMGFVGAAGAAVVSGAGCDIYGQTPSKVQVQALAEWLYRRPDRDLFETDNAGTTISDLPAIGRASSGVLAVAISELHPHYLIWFKPELTQVVHWAGKPDKVIDDSGSLNPRVSFEQWQQTVRGFSTPWLPSETEGVLELRQAVLGIVLRKAEELAQMSEDLKVSNKELEAFSYSVSHDLRAPLRHIAGYAELLGDMEGENLTVRGQRFLGNIGDSARFAGTLVDNLLSFSQMGRSAIHLAPVDLNAMIDTIRLEMAPEYEGRQVEWKYENLPQLVADPAFMHLAMRNLISNALKYSRNRVVSVIEIDGLQREDDVVITVRDNGVGFDMQYVGKLFGVFQRLHRVEEFEGTGIGLANVRRIVERHDGTVWARGVVDQGSEFSFSLPNKMLPVLERREGKNTHA

SEQ ID NO: 60091 - protein, 470 aa, Oryza sativa (japonica cultivar-group)
MASRRQWGAGAGAVDVPAQERKGGKAATDHLLRAFFAVFFVLEGLSWRRRRRRDGEGVFLLRYVACLLCLQAAKIARRPKTTTVVAQQPPRIRRALADVSNLVNGRAALPVVNRQKAAAAAADKCRKPIKQRNENNKAAKPEVIVISSDSEKHKKNPAQRAASRRAPIQTLTSILTKCSRASDGVISPKKELIYDIDASDSHNELAVVDYVEDIYRFYRNTENTYRPLCTYMVSQTEINERMRAILTDWLIEVHYRLMLMPETLYLTVYIIDQYLSLENVPRKELQLVGVSAMLIACKYEETWAPLVKDFLVISDNSFSRQQVLSTEKSILNKLQWNLTVPTMYMFILRYLKAALGDEELEHMTFFYAELALVQYSMLFFAPSVIAAAAVYAARCTLGLSPLWSDLLEYHTGLAEPQLLECARRLVSLHAAAPESRQKVVYKKYASPKLGAVSLHSPAKKLLPPPSPVAA

SEQ ID NO: 60092 - protein, 361 aa, Xanthomonas axonopodis pv. citri str. 306
MSVSFASTRSPSPRSADELSVILAAPGFGLHFTDHMVAISWNNEQGWHDAQVRAYGPLQLDPAASVLHYGQEIFEGIKAYRHADGSIWTFRPQANGERLQRSARRLALPELPVDLFVESLRQLVAVDGGWVPSAPETSLYFRPFMIADEAFLGVRAAHKASYYVIASPAGPYFAKGVAPVSIWLSTEYARAAKGGTGAAKCGGNYAASLLPQQKAYAQGCSQVLFLDPVEGKYIEELGGMNVFLVYKDGTLVTPELSGSILEGITRDSILQLARDRGMQVIERKVAIDEWKQGVASGEITEVFACGTAAVVTPIGELKGEGFAVGDLSAPAGQVTMSLRQELTDIQYGRVPDRHGWLVRLS

SEQ ID NO: 60093 - protein, 448 aa, Magnetospirillum magnetotacticum MS-1
MEAVMDQVRPAPPGQASAEASLGALNASVPVRMDGSWLRRLVAFLGPGYMISVGYMDPGNWATDIAGGAQFGYTLLAVILLSNLMAIVLQALAARLGIATGLDLAQACRERTSRPVAIALWLICEAAIIACDLAEVIGTAIALKLLFGIPLTLGAIITALDVFVVLLLLRRGFRALEAFVIGLLTIIFVCFGLQIAMAAPPLQAVLGGFIPSREIVTNPAALYIAIGIIGATVMPHNLYLHSSIVQTRAYPRTEEGRREALRFAVTDSTVALMLALFVNAAILIMAAAVFHAGGRTDVEEIEQAYELLSPLLGVGLASTLFAVALLASGLNSTVTATLAGQIVMEGFLRLRLPNWARRLITRGIAIVPVVIVTALYGDQGTAKLLVLSQVVLSMQLPFAVIPLVRFVSDRKLMGSFVVPGWLKGLSWAIAAIIVVLNLKLLAETLLPG

SEQ ID NO: 60094 - protein, 490 aa, Xylella fastidiosa Ann-1
MLVSGVWLCLVWAAIFCRVSCCIANAIRWDVSLLIHRSMSSSMSSVQPTSPVSDSPSLGEMHASVAVSRRGHWGFRLLAFLGPGYMVSVGYMDPGNWATGLAGGSRFGYMLLSVILLSNVMAIVLQALAARLGIASDMDLAQACRARYSRGTTLVLWAVCELAIIACDLAEVIGTAIALNLLLGVPIIWGVVITAVDVVLVLLLMHRGFRALEAFVIALLLVIFGCFVVQIVLAAPPLQEVLGGFVPRWQVVADPQALYLAIGIVGATVMPHNLYLHSSIVQTRAYPRTPVGRRSALRWAVADSTLALMLALFINASILILAAAVFHAQHHFDVEEIEQAYQLLAPVLGVGVAATLFATALLASGINSTVTATLAGQIVMEGFLRLRLRPWLRRVLTRGLAIVPVIVVVALYGEQGTGRLLLLSQVILSMQLPFAVIPLLRCVADRKVMGALVAPRWLMVVAWLIAGVIVVLNVKLLGDYAVHLMVGVSD

SEQ ID NO: 60095 - protein, 447 aa, Candidatus Blochmannia floridanus
MPEIVNIISREIVDSRGNPTVESEVHTKSGFFGLASVPSGSSLGSQEALELRDNDHARFFGKGVKKSVNIINSTIRVSLLNIDVTKQSVIDEIMINLDGTNNKSQLGANSILSVSLAIAKAAASFMGMPLYQYIARLYGMSSNVYSMPVPMMNIMNGGKHADNNLDIQEFMIVPVGAKNIKQAIQMGSEISYSLKNVLNNLGISIALGDEGGYAPNLKSHSYALELINKSIEQSNYVLGKDVVLAIDCAASELFEVSTGKYVINSEKVSFTSEEFVDYLSSLARKYCIFSIEDGQSEHDWHGFSYLTKKLGDIMQLVGDDLFVTNPNLLKMGINKNVANSILVKPNQIGSLTETLNVIKLAKESGYSTIVSHRSGETEDTSIADIAVGTSAGQIKTGPVRCSERTSKYNRLIRIEEFLKDNSKFYGVNEIKNLSAQLWMYQNKNMNI

SEQ ID NO: 60096 - protein, 1383 aa, Methylobacillus flagellatus KT
MATQVKSVCPYCGVGCGIVMEVEHARIIKVMGDKQHPSNYGRLCTKGSTCAQAVTASGRLEHAYLRTERNAEPARIGMDKAIKESARRLRAILDEHGPDAVALYVSGQMSIESQYLANKLIKGYIGSNNIESNSRLCMASAGSGYKLSLGADGPPGSYQDFDNTDLFFVIGANMADCHPILFLRMMDRVKAGARLIVVDPRRNATADKAHLFMQIKPGTDMALLNGLLHLLHKNGHTDPDFIARFTEGWEAMPEFLEDYSPEAVSEITGIPEADIRQAAEWIGKASNWMSCWTMGLNQSTHGTWHTNAICNLHLATGAICRPGSGPFSLTGQPNAMGGREMGYMGPGLPGQRSVLSAQDRAFIENLWGVPAGTLHTSSAGGTIAMFEQMAAGKIKACWIICTNPVASVANRQNVIAGLERAELVITQDAYLDTETNRYADILLPGALWAEAEGVMINSERNMTLTQQAVPPPGDAMPDWQIIASIACEMGYAEAFSYASAAEVFEEIKRTSNPKTGYDIRGVSHDRLRATPVQWPCPPDDPQDRHPIRYLNDGISQQLKIREDGERPRIAFATESGKGVFFARPWLPPAEMPDHDFPFVLNTGRLQHQWHTLTKTGKIPTLNKLNPGPFVELHPEDAASLGIRDKDQVEIRSRRGRAVLPAVITARVLPGHCFAPFHWNDVFGDDLAINAITSDAVDPLSQQPEFKFSAVALARVEGTPQRMRNAAPEGHHKDEETHTDNAREIAMKDIDALAQLLGLKDTPAIKLEPAEQLYLQGYLAGLRSDASRQAGGVPILPPTAPLPPDKKTLVDGILAGLFSRTWIGAGSLPTQGHEDTATQPVVHILWASQTGNAETFASQCAAKLQAEGWQTVLSSMDEVQPAELANASRALLLASTFGDGDPPDNGSQFWAALQSDHLTLSGLQYAVLAFGDSNYDQFCGFGRKLDARLAALGATALTARTDCEPDYETAAQVWLGQVVSALASRKSPHPSTTTDRQPELILAGDMPADMTCPGTTAPSYTRHHPLHAQLVVNQRLSGNGAEKEVRQFAFDLGGSDFQYEAGDALGVWPRNDPALVGEMLTALQFSPATVVDVHEHGEMTLVEALSNHYEIARITPEMLQFIAARSGSADLADRIGKQGELKPWLWGKQPVDLLHAYPIKVEVSEWLGVLKRLQPRLYSISSSPKTVTDQVHLTVSIVRYGERGGVCSTFLADRAKGLPVPIFLQKSPHFRVPRNPETPLIMVGPGTGIAPFRAFLQERQAAGASGKNWLFFGEQHVDTDFYYRDELAAMQQAGILHRLDTAFSRDQQEKIYVQHRMLEHGAELWRWLEQGAHFCVCGDAARMSRDVDAALKQVVQTHGNMSAEAAAQYVAKMAQDKRYVRDVY

SEQ ID NO: 60097 - protein, 569 aa, Candidatus Blochmannia floridanus
MIMLKYNNKLLSDNERIKKNSNFLRGTIEKDLDNNLTGGFNVDNAQLIRFHGMYQQDDRDVRLERMNQKLEPLINMMLRCRLPGGVITSQQWLNIDNFSEEQTLYSSIRLTTRQTFQLHGILKPKLKGIHQLLNKLGLDSIATAGDVNRNVICTANPMESKVHYQIWELSKKISEHLLPKSKAYAEIWLNEKKIESIDSEPILSSVYLPRKFKIAIAVPPVNDVDVYANDLGLVAIKDNTGNLIGFNVLIGGGLAMTYGDKSTYPRMASEFGYINLQDILKIVESVITVQRDWGDRYNRRHAKTKYTLVKVGIDILKKEIENRSGLKFSPMYPYKFTERGDKFGWIRGINQDYWHLTLFIENGRVCNTSNILIKKGLSEIAKVHSGFFRITTNQNLIISEIHQDKKDIIEDLLKQYGLLGDFVTSQRKSSMACVAFPTCPLAMAEAERFLPAFVTKVEHVMSKYNLQRDAIILRVTGCPNGCARAMLAEIGLTGRGIGRYNLYLGGNKNGTRIPRLYKENITEDEILHVLDITIGDWAKNRKTQESYGDYVVRAGIVRAVINSEEDFYL

SEQ ID NO: 60098 - protein, 207 aa, Glycine max
MFSINHFSDPDATSPGSGGSSRPALSDEDFFLAASNPKKRAGRKKFRETRHPVYRGVRRRDSGKWVCEVREPNKKSRIWLGTFPTAEMAARAHDVAAIALRGRSACLNFADSASRLPVPATAEARDIQKAAAEAAEAFRPGKDDDAVAERVAATATEREEEQEEGMVPEYLRNMVLMSPTHCFGSDEYGSADVEFDDAEVSLWSYSI

SEQ ID NO: 60099 - protein, 854 aa, Methylobacillus flagellatus KT
MNEYTRIVVVGNGMVGHYFVQELVKRHPDLAAAKLQVTVLGEEPRPAYDRVHLSSFFSGSTAENLSLVEPGFYDRPGLELRLNARATHIDRHQRCLSLADGTVLPYDKLVLATGSVPFVPPVPGRDREHCFVYRTIEDLEAMTAAGATAKSGVVVGGGLLGLECAKALRDMGLDTHVVEFAPRLMAVQVDDIGGRVLRTKIEELGVHVHTSRNTVNITDGATARHRMVFFDETWLETDMIVFSAGIRPRDELARESGLVIGARGGIAIDEFCRSSDHDIYAIGECANWNGQLYGLVAPGYDMARIACAHLSGDAAMTFQGADMSTKLKLMGVDVASVGDAHGETPGARSYQYLDEVRNIYKKIVVSEDGKKLLGAVLIGNADEYGTLQQMTVNDMPLPENPEFLILPASDGKEKPGLGVDALPDQAIMCSCNNVTKGQIGEAVANGACSIGEIKACTKAGTACGGCVPLVTQVMKAQMLKLGMTVNNHLCEHFPYSRQELYHLVRVGQIKTFDELLDKHGKGLGCDICKPTAASILASCWNDFILKKDLAPLQDSNDYFLGNIQKDGSYSVVPRMPGGEVTPDGLIAIGQIAKKYGLYTKVTGGARVDMFGARVEQLPQIWEELIAAGFESGHAYGKSLRTVKSCVGSTWCRYGVDDSVGLAVQLENRYKGLRAPHKIKFGVSGCTRECAEAQGKDVGVIATEHGWNLYVCGNGGMKPRHAELLASDLSKEELIRMIDRFLMFYIRTADRLQRTSTWRDNLEGGLDYLKDVIIHDSLGLGAELEAQMQHVVDTYQDEWKTAVTDPEVRKRFRSFVNSMAGDDNIVFVKEREQMRPATPQEKQQAKVIPIMALAE

SEQ ID NO: 60100 - protein, 323 aa, Prochlorococcus marinus str. NATL2A
MTTATEILQPVELDLEALLLDLRSLIGAGHPILQAAAEHLFSAGGKRLRPGIVLLISRALTSEKELPLKHRKLAQITEMIHTASLVHDDVVDEADTRRGVETVHSRFDPRIAVLAGDFLFAQASWHLANLENLEVVKLLSRVIMDLAEGEIKQGLNRFDSSQSFESYLEKSYCKTASLIANSSKAIGVLSNVDQESLNSLYFFGRQLGLAFQVVDDILDFTGNDEQLGKPAASDLQSGYLTAPVFYALEENPSLSELINGKFSQKDDLDQALSLVRDSSAIKKSRELAEQFASESKDSISWLPDSPSKKALLELPEFVISRLY

SEQ ID NO: 60101 - protein, 340 aa, Ustilago maydis 521
MPLFKSSDIPDLTGRVAIVTGGNSGLGEVSCLELARNGAKVYMASRTESKAQEAIQKIKQAIPKADIHFLQLNLTELAAVRKAAEDFLSREQRLDILLNNAGVMATPYTFTKDGIELQVGTNVVGHYLFTMLLLPTLYKTSKLPEYSAPDSPSVRIVQVSSLGHVASPSDTSFKDLEAVNKQHWPEVKGTWDRYGKSKLGNILIANELSKLLPKDARITSLSIHPGVVRTGLLRGPNESYGKIIGSVNSLLSRFFTAAEDGALTQLYACTSPEVDRLNLNGAYLVPVAKLGQKSKLAQDTDGRLGQELFSFCNSFIKEKLDLDLPAHLKEIGVQLPQSHL

SEQ ID NO: 60102 - protein, 244 aa, Prochlorococcus marinus str. NATL2A
MSTFKRISDVSCQWPSRPVGLIELIGGSYISIKPEVTYKRLISCLLKKNFAVHSWGYIPNFDHQLQANQAWKQFRQSRKILEKRIGLIPKSIRLGHSLGCKLHLLAPDGGRNCDGLVAISFNNFRADKSIPLLRKMSKKLNFQTEFSPSPSETLNLVREHYEQINNLLIKFKNDNLDQNDFLLKSLKERSADKSKIMNLDGNHLTPVSVGLREKLLKANLQNSLKYENINLIVDQIIHWEILTS

SEQ ID NO: 60103 - protein, 265 aa, Zymomonas mobilis subsp. mobilis ZM4
MIPRPDHGEKSYRGSGKLQGRKALITGGDSGIGRATAIAYAREGADIVINYLPQEEPDAREVVALLQGEGHKVFALPGDLRNENFCVQLVQEASKRLGGLDILANIAGHQHYNESILTLSTADFDDTLKTNVYAMFWLCKEALKIMPAGSAIVNTSSTQGYRPSAILLDYATSKAAIANFTRALAIQLAPRGIRVNAVAPGPFWTPLQVSGGQPASAYSQFGANTPVKRPGQPVEIAPVYVFLACAENSYVTGEVYGETGCAQIF

SEQ ID NO: 60104 - protein, 334 aa, Candida albicans SC5314
MDDTLTISIDFIDDQIQQYDFNEPLIIGISGPQGSGKSYLTNQLYNYLQTKYHPNLKTIQFSMDDFYLCKSDQDKLNDSTENPLLKGRGLPGTHELSLLVDTFNKLINNYKQFKKSHLESESESESDWEVIKIPSYDKGAFNGIGDRSNDKYHTLIESPIDIIIFEGWFNGFYSLDPTILQLKYLTSSPSPSPTPTPENNNNHISLQSFKLYDLQEINKNLQNYESLIWSFFRISIIFQTDQINNVYPWRLQQEHELIAKQQQQQQQQKSVEGTCDQVGMKNDDEIIKFIDRYMPIYLLYYENLCDYGIKHCKNLIISIDSNRRVIKNRVLNNV

SEQ ID NO: 60105 - protein, 142 aa, Oryza sativa (japonica cultivar-group)
MATDGGKMVELISSDEEHFEVEEAVARLDHHAGDNGIPIPNVADNVIAKRYCMKHATLSSGTGDMKAMHEDELKKFDRVFIKVDNDTLRRLISAANVMGVKGLIDLACQRVADMLKAKRLKKMRQTSGINNHVREGEDPQVG

SEQ ID NO: 60106 - protein, 404 aa, Hyphomonas neptunium ATCC 15444
MNTDFHKIRRLPPYVFEQVNRTKAALRAKGADIIDLGMGNPDLPTPKHIVDKLVETARKPDVNGYSASRGIPGLRRALTDYYKRRFDVVLDRDREVIVTLGSKEGFANLAQAISAPGDVILAPDPSYPLHHFGFIIAGASIRGVPAHTPEQYLSSLGRAVKYSVPPPTAMVLCFPSNPTAAVCDLDFYKEAVKFAKKHDLWVLSDLAYNEIYFEEPTPSILQVDGAKDIAVEFTTMSKTYSMAGWRMGFVAGNEKLVGALARVKSYLDYGAYTPIQVAAVAALDGPQECVAETRAIYKGRRDVLVDSFTRAGWPVPSPKASMFAWAPIPEQLRHLGSLEFALQLINEAHVAVAPGAGFGEHGDDYVRIALVENEQRIRQAGRNIRKFLAARGVKEIKPAVAAAE

SEQ ID NO: 60107 - protein, 350 aa, Triticum aestivum
  misc_feature (184)..(184): Xaa can be any naturally occurring amino acid
  misc_feature (205)..(205): Xaa can be any naturally occurring amino acid
  misc_feature (239)..(239): Xaa can be any naturally occurring amino acid
MKLICDFPSPKSLPDKYVLPPERRPCNHELQGDLSVALPVIDLQGALGDGRRQVIGEIMEAGKEYGFFQAVNHGVGEDVIQGFREAAAEFFRMPAEAKLKHYSNEHNKHCRVFSGSVTSHTDTNDIRYWRDCLKLRCYPVDKLMDHWPSQPETFRERLAKYAVAVQELAQRLLRLIAEGLGLDXSFFEGDLTGGETMMNVNYYPXAPTPSLTLGIRPHSDRYILTVLSQGDVTGLQVSXKGRWIGVQPMRNAFVVNFGLQLEMVTNGVLTSVEHRVVTNSAKARMSVATLIRPNMGCRIRPAPMMVNGETNHRPKYRDFTGSELIEAYEATAGNREALLALFRIHHTKLL

SEQ ID NO: 60108 - protein, 763 aa, Glycine max
  misc_feature (292)..(292): Xaa can be any naturally occurring amino acid
MERVAEPKVLPRSLPVLVEVSNGHTAAIREAGQRLNGQDVSSVCGIPAREGNQFSKSRDGPMARLASIREVAQLSNARIVLVREDMGFDTRCQEPPSPVPVPTRTWKGKGSLPEAVELVSDIEKLKGSNDSFVETGPSSFAGASHPPEPVDTDLMRTVFVPIGQTKSEAGCLMKSVSLKGPFLEDLSIRVLAKKPSLAVVSPAEIMAEESNEMGNLSSPFSGARASQNTENSPLAPDSDEKECVWDASLPPSGNVSPHSSIDSTSVVGSRSIVNSCASTYRSDAVTSDGMLXLDRNCDSTKGSVRGDSLESAKTSVSRPSDSSGLSDDSNWSNITGSANKPHKGNDPRWKAILAIRLRDGILGMSHFRLLKRLGCGDIGSVYLSELSATRCYFAMKVMDKASLASRKKLTRVQTEREILQLLDHPFLPTLYTHFETDRFSCLVMEYCPGGDLHTLRQRQPGKHFSEYAARFYAAEVLLALEYLHMLGVVYRDLKPENVLVRDDGHIMLSDFDLSLRCAVSPTLIRTSYDGDPSKRAGGAFCVQPACIEPSSMCIQPACFIPRLFPQKNKKSRKPRADPGLPSSTLPELVAEPTQARSMSFVGTHEYLAPEIIKGEGHGSAVDWWTFGIFLHELLYGKTPFKGSGNRATLFNVVGQQLRFPESPATSYASRDLIRGLLVKEPQHRLGVKRGATEIKQHPFFEGVNWALIRCSTPPEVPRPMENEVPAGKVVGPVDPVGVGSTSKRIAGTDNMKSGGKYLDFEFF

SEQ ID NO: 60109 - protein, 472 aa, Pasteurella multocida subsp. multocida str. Pm70
MSDTTAIANVFKLIEEYDIKFVLLRFTDIKGKEHGVSLPVNLVDEDLFEDGKMFDGSSVEGWKAINKADMLLMPMPETAVVDPFAQIPTLSLRCSIYEPSTMQSYDRDPRSIAIRAENYMRSTGIADEALFGPEPEFFLFDDVRFDVSMNRSSYSVDDIEAAWNTNKKYEDGNNAYRPLKKGGYCAVAPIDSAHDIRSEMCLILEEMGLVIEAHHHEVATAGQNEIATRFNTLTTKADETQIYKYVVQNVAYEHGKTACFMPKPITGDNGSGMHCNMSLSKDGKNVFQGDKYAGLSETALYYIGGIIKHAKALNAFTNPSTNSYKRLVPGFEAPVLLAYSASNRSASIRIPAVTNPKAIRIEARFPDPLANPYLAFAALLMAGLDGIINKIHPGDAMDKNLYDLPPEELQNIPAVASSLEEALNALEQDYEFLTKGNVFTQAFIDAFITIKRKEVERLNMTPHPVEFEMYYA

SEQ ID NO: 60110 - protein, 238 aa, Thlaspi caerulescens
MSSQICRSASKAARSLLSSARNVRFFSEGRAIGAAAAVSASGKIPLYASNFARSSGSGAASKNWLTGLIALPAAALMLQDQEVLAAEMERTFIAIKPDGVQRGLISEIVSRFERKGFKLVGIKVVVPSKDFAQKHYHDLKERTFFNGLCDFLSSGPVIAMVWEGEGVIRYGRKLIGATDPQKSEPGTIRGDLAVVVGRNIIHGSDGPETAKDEINLWFKPQELVSYTNNAEKWIYGDN

SEQ ID NO: 60111 - protein, 218 aa, Brassica napus
  misc_feature (202)..(202): Xaa can be any naturally occurring amino acid
MLYCLILLLLLCLSSTYLCLSLNHDATILRQAKLGLSDPAQSLSSWSENDVTPCHWRGITCDATSAVFSVNLSSFMLVGPFPSVLCRLPSLSFLSLYNNSINGSLSGDEFTSCRNLSQLDLSENLLVGSIPESLPFTLPNLRHFEVSGNNLSDTIPASFGEFRKLEKVNLAGNLLYGTIPALLWNVSTLRELKLAYNLFSPXRIPRQLGNLTEPSCSL

SEQ ID NO: 60112 - protein, 238 aa, Glycine max
HAVRYINVVPFPTLFFHPPLHVSLNPLRVYIIDFFIFVCIKFSSFNPSVEELVLQDESLSWDHKHLNLNNQCLIKDNHGSEHFWDFSVQSDETVMGLVGRESEHLPHVGYLKRLLSGDLDLSVRKEALDWIWKAHAYFDFGPCSLCLSVNYLDRFLSVYELPRGKSWSMQLLAVACLSIAAKMEEIKVPPCVDLQFAFEAKDIQRMELLVLSTLRWKMQASTPFSFLDYFLRKITCDQ

SEQ ID NO: 60113 - protein, 574 aa, Vibrio parahaemolyticus RIMD 2210633
MISGILASPGIAIGKALLLQEDEIVLNTNTISDDQVEAEVARFFDARNKSAAQLETIKQKALETFGEEKEAIFEGHIMLLEDEELEEEILALIKNDKMTADHAIHSVIEEQACALESLDDEYLKERATDIRDIGSRFVKNALGINIVSLSDINEEVILVAYDLTPSETAQINLDYVLGFACDIGGRTSHTSIMARSLELPAIVGTNDITKKVKNGDMLILDAMNNKIVVNPSEAEVEEAKAVKAAFLAEKEELAKLKDLHAETTDGHRVEVCGNIGTVKDCDGIIRNGGEGVGLYRTEFLFMDRTALPTEEEQYQAYKEVAEAMNGQAVIIRTMDIGGDKDLPYMDLPQEMNPFLGWRAVRISLDRREILRDQLRGILRASAHGKLRIMFPMIISVEEIRELKNAIEEYKAELRAEGLAFDENIEIGVMVETPAAAAIAHHLAKEVSFFSIGTNDLTQYTLAVDRGNEMISHLYNPLSPAVLTVIKQVIDASHAEGKWTGMCGELAGDERATLLLLGMGLDEFSMSGISIPKVKKVIRNSNFAEVKAMAEEALSLPTAAEIEAVVEKFIAEKTQ

SEQ ID NO: 60114 - protein, 198 aa, Cryptococcus neoformans var. neoformans B-3501A
MAMQSIKCVVVGDGAVGKTCLLISYTTNSFPGEYVPTVFDNYSASVLVDGRPVSLGLWDTAGQEDYDRLRPLSYPQTDVFLVCFSIVSPPSFENVKTWIPEIRHHAPTTPILLIGTKLDLRDDPVTLSRLKERRFQPIGFEMGVRCAREIGAVRYLEASSRTQKGLKNVFDEAIRAVLSPSTRDAREKKKKKQQCLIL

SEQ ID NO: 60115 - protein, 461 aa, uncultured bacterium 442
MARWECIVCGLIYDEKEGWPDDGIPAGTKWSDVPDDWLCPDCGVGKDDFELIAGSEDEPVGETDTTTSADESSVATNNRHIVIVGSGLAGYGLVSALRKLDPEVAITLITRDGGESYSKPMISTGYTKNLSAEKLAAQSSEAMAEQLAVTMLTRKTVVSIDPSSNQLNLDDETVIAYSELVLTLGAELIRPPMGGDAAGDVMGVNDLDDYRSFRDTLEAKGVRKVAVIGAGLIGCEFSNDLLNGGFEVEAVDPMSWCIPTLLPEPAGRAVQAALEAKGARFHFGPLATEVNRSATGYQVQLNNGEHIEADAVLSAVGVRPRTQLASSAGLDVGRGIKTNRLLETSSPGIYALGDCAEVAGHVLVYVAPLLAAGRALAATLTGNPTEVSYPAMPVTIKTPACPVCVSPVAKDTEGSWTLSGEGSDIKGLFHSPNGQLLGFALTGAAVKERMALTKELPPILN

SEQ ID NO: 60116 - protein, 502 aa, Zea mays
MSTHAASRRSSSSSAVAKRPAIAEGATKAAGPGPTAAQAKKRTALVNITNVAAPGARVAAVGKVAPPVTGAKLNPATSGAPLKKPSLANARTIRGSAAKSASIKPAPPVSRHDSSSEQKHNVPVPTTVHVPSRAPALVPYSSFVSPGRSGDSVSTDETMSTCDSMKSPDFEYIDNGGCSMLASLQRRADEHLRTSEDRDVEENKWKKNGPAPMEIDSICEVDSNFEDPQLCAALASDIYMHLREAEMKKRPSTDFMETIQKDVNPSMRAILIDWLVEVAEEYRLAPDTLYLTVNYIDRYLSGNEINRQRLQLLGVACMLIAAKYEEICAPQVEEFCYITDNTYFRDEVLEMEASVLNYLKFEMTAPTAKCFLRRFARSAQACDEDPALHLEFLANYIAELSLLEYSLLSYPPSLIAASAIFLARFVLQPTKYPWNSTLAHYTQYKPSELSECVKALHRLSSVGPGSNLPAIREKYSQHKYKFVAKKQSPPQIPAEFFRDAAC

SEQ ID NO: 60117 - protein, 372 aa, Mycobacterium smegmatis str. MC2 155
MKQQLVFEAPRRAMPPQHLADLDETARAAAVTELGLPAFRAKQLANQYYGRLIADPQQMTDLPAAVRDQVAEKLFPTLINPVREIQCDAGETRKTLWRAIDGSTFESVLMRYPQRNTVCISSQAGCGMACPFCATGQGGLQRNLTTAEILEQVRAASSTMRAEHFGRTAGTAGGGRLSNIVFMGMGEPLANYNRVLGAVRRIIAAPPNGFGISARSVTVSTVGLAPAIRKLADERLGVTLALSLHAPDDELRDTLVPVNNRWKVSEVLDAARYYADTTGRRVSIEYALIRDVNDQPWRADLLGKKLHGALGPLAHVNVIPLNPTPGSEWDASPKPAEREFVKRVRERGVSCTVRDTRGREIAAACGQLAAEG

SEQ ID NO: 60118 - protein, 613 aa, Mycobacterium smegmatis str. MC2 155
MTQTTAAPLATLSPQERVDAWLADFESALAARDIERVVSKFAVDSFWRDLVAFTWNIKTVEGHEGIADMLSARLADTDPSGFKTTEPPTEDVDGNTVITSAFIEFETATGRGNGHLRLRSDDTGDRAWTLLTTLQELKGHEEPKGPKRVLGAVHGSDPDRRSWAEKRLDEQLTLGYSEQPYIVVIGGGQGGIALGARLRQLGVPAIVVDKHERPGDQWRKRYKSLCLHDPVWYDHLPYLPFPPNWPVFAPKDKIGDWLEFYTKVMEVPYWSSTTCLSASFDENEKRWTVEVDRNGEKVTLRPTQLVLATGMSGKPNIPTLPGQDIFRGDQHHSSQHPGPDRYVGKRAVVIGSNNSAHDICKALVENDVDVTMVQRSSTHIVKSDSLMDLGLGDLYSERAVAAGMTTEKADLTFASLPYRIMADFQKPIYDAIRERDKEFYARLEAAGFELDFGDDDSGLFMKYLRRGSGYYIDVGASDLIADGTIKLAHGQVERLTEDSVILADGTELPADVVVYATGFGSMNGWAADLIGQDVADKVGKVWGLGSGTTKDPGPWEGEQRNMWKPTQQENLWFHGGNLHQSRHYSLYLALQLKARYEGMDTPVYGLQEVHHLS

SEQ ID NO: 60119 - protein, 601 aa, Mycobacterium smegmatis str. MC2 155
MCGATGEVRLDGRTPDIGAVSAMAETMSSRGPDAAGVWSQGRVALGHRRLKIIDLTEAGAQPMIDPELGLAVCWNGCIYNYKELRAELSGHGYRFFSHSDTEVLIKAYHHWGDRFVEHLKGMFAFAIAERDTGRVLLGRDRLGIKPLYLSETGDRIRFASSLPALLAGGGVDTGIDSVALHHYLTFHSVVPPPRTILRGVKKVPPASIVAIEPDGTQRTTVYWSPDFSRRAERADWSERDWEDAVLQSLREAVERRLVADVPVGCLLSGGVDSSLIVGLLAEAGQHGLKTFSIGFESVNGVAGDEFKYSDIVAQHFGTDHHQIRIDTARMLPALDGAIAAMSEPMVSHDCVAFYLLSQEVAKHVKVVQSGQGADEVFAGYHWYPPMAEPAAASLDGAVNSYRGAFFDRDSAGVASLISDAYRVDGDPSGVFVTDHFGAPGAETGVDRALRLDTTVMLVDDPVKRVDNMTMAWGLEGRVPFLDHELVELAATCPPELKTAHGGKGVLKEAARRVIPAAVIDRPKGYFPVPALTHLEGPYLNMVRDALYAPEAKERGLFRPEAVERLLADPNGRLTPLRGNELWQIGLLELWLQRHGITGSAA

SEQ ID NO: 60120 - protein, 117 aa, Candidatus Blochmannia floridanus
MNEKIRNFESNQMKKDIPPLHPGDVVEISLWIIEGNKKRFQIFEGMIIAIKNRGLNSAFTVRKISSGEGVERVFQIHSPVIKEINIKKIGVVRRAKLYYLRNLKGKSARIKTRLHVN

SEQ ID NO: 60121 - protein, 485 aa, Pseudomonas syringae pv. tomato str. DC3000; identical to SEQ ID NO: 1190

SEQ ID NO: 60122 - protein, 156 aa, Haemophilus influenzae
NRTNTPVLVDGKDVMPEVNAVLAKMKDFCQRIISGEWKGYTGKAISDVVNIGIGGSDLGPYMVTEALRPYKNHLNMHFVSNVDGTHIAETLKKVNPQTTLFLVASKTFTTQETMTNAQSARDWLLKAAKNESAVAKHFAALSTNAKDVEKFGIDTN

SEQ ID NO: 60123 - protein, 228 aa, Brassica napus
  misc_feature (78)..(78): Xaa can be any naturally occurring amino acid
AFFWIRVVNWVWLTPKKLESYLRRQGLPGTPYTPLVGVVKRNVNMLMEARSKPITLTDDITPRLLPLALKMFNSHGTXRTFFIWLGPVSTIMITNPEHIKEVFSKVFDFEMNASFPLVRLLVGGLASYKGDKWARHRRIINPAFHLEKIKNTVPAFYHCCSEVVAKWDHLVLDKGLSCEVDVGPWLVIMTADVISHAALGSSYREGQRIFELQGELSSLIAQELKKPY

SEQ ID NO: 60124 - protein, 306 aa, Oryza sativa
NDCIGEEVQKLAATLPDGGVLLLENVRFYKGAGKNDPEFANKLASVADLYVNDAFGTAHRAHASTEGVTKYLRPSVAGFLMQKELDYLVGAVANPKKPFAAIDGGSKVSTKIGVIESLLAKVDILILGGGMIYTFYKAQGYAVGKSLVEEDKLELATSLIEKAKSKGVSLLLPTDIVVADKFAADAESKAGPAPAIPDGWMGLDIGPDSIKTFSETLDTTKTVIWNGPMGVFEFEKFAAGTDAIAKKLADITAKGVTTIIGGGDFVAAVEKAGLADKMSHISTGGGASLELLEGKTLPGVLAFNDA

SEQ ID NO: 60125 - protein, 208 aa, Oryza sativa
VCISVHLELFDSHKYLANLLFLAKAEERVGVQVRTFSWAPISTDELYGQIVSCAQGENILPRVRESSSGSDNATAIPGSGRQQQQRPARRKAVLVVSLGGQRSEERMHNQKALAEMMLLSFSDVALTSAASTFGYVSHGLAGLRPWVLMVPVRKKAPNPPCRLAATVEPCFHTPPHYDCQARTKGDNGKTVRHVRHCEDLKDGVQLVD

SEQ ID NO: 60126 - protein, 224 aa, Listeria innocua Clip11262
MINQKKIAGEKACEWIEDGMVVGLGTGSTVYYTIEKLGEMVQKGLNITGVSTSIETEQQARTLGIPLKSLNDVTKIDVTIDGADEINQAFQGIKGGGGALLREKMVAQASSKNIWVVGEEKLVTELGKFPLPLEVIPFGWKQIKRMLENDGVETTLRKQSSGEIYETNNGNYILDIINQTFTNPEAWHEKLAGIPGVLEHGLFLHYVDIIICGKASGEIEIIKK

SEQ ID NO: 60127 - protein, 339 aa, Listeria innocua Clip11262
MSKDIDWSNLGFSYIKTDKRYISHWKDGAWDEGTLTEDNTLHISEGSTALHYGQQCFEGLKAYRCKDGSINLFRPDRNAARIQKSCERLLMPHIPTEKFIDACMQVVRANEEFVPPYGTGATLYLRPFVIGVGDNIGVHAAPEYIFSVFCSPVGPYFKGGMAPTNFIVSDFDRAAPNGTGAAKVGGNYAASLLPGQNAKDRNFGDCIYLDPATHTKIEEVGSANFFGITKDDKFITPYSPSILPSITKYSLLYLAEHRLGLKAEEGDVFIDKLDEFKEAGACGTAAVITPIGGIQTKDDFHVFYSETEVGPVTKRLFDELCGIQFGDVEAPEGWIYKVK

SEQ ID NO: 60128 - protein, 434 aa, Pseudomonas syringae pv. tomato str. DC3000
MNSKVDETPHLLRQRDQFVPRGIVTAHPLVIDRAQGSELWDVDGKRYLDFVGGIGVLNIGHNHPNVVKAIQAQLSKVTHACFQVASYQPYLDLAKRLSLMIAGQSGIDHKAVFFTSGAEAVENAVKIARARTNRPAIISFRGGFHGRTLLGTTLTGMSQPYKQNFGPMAPEVFHTPYPNEYRGVTTEVALAALHELLATQVAPDRVAAILIEPIQGDGGFLTAPVEFLKALRALTEQHGIVLILDEIQTGFGRTGKWFGFEHAGIQPDLVTVAKSLAGGMPLSGVVGRAEIMDAPLPGGLGGTYGGNALSCAAALAVIDTYEQDNLLARGEQLGEHLRAGLLRLKDRYACIGDVRGTGFMLAMELTKNDAARSPDADLNQKVIDQARIGGLLVIKCGVYRNVLRFLAPLVTTEQQIDEALSILDAALARVLKSS

SEQ ID NO: 60129 - protein, 386 aa, Salmonella typhimurium LT2
MRNNPLIPKSKLPNLGTTIFTQMSALAQKHQAINLSQGFPDFDGPRYLHERLAYHVAQGANQYAPMTGAQALREAIADKTAEIYGYRPDDVSDITVTAGATEALYAAITALVRAGDEVICFDPSYDSYAPAVALSGGVLKRIALTPPHFRVDWQAFSALLSERTRLVILNTPHNPTATVWRQADIEALWQAIGEREIYVLSDEVYEHICFAAEGHASVLAHPQLRERAVAVSSFGKTFHMTGWKIGYCVAPAAISAEIRKVHQYLTFCVNTPAQLALADMLRAAPEHYRALPDFYRKKRDVLVNALAQSRLKVLPCEGTYFLLIDYSAVSTLNDVEFCQWLTEEVGVAAIPLSVFCAAPFPHQLIRLCFAKQESTLLAAAERLCKL

SEQ ID NO: 60130 - protein, 303 aa, Methylobacillus flagellatus KT
MQSVHELNARYGVGHKIHFSADLNGLVTLEIENPHASAKVALQGGHVMQWNPRHAEAPVLWLSDQARFVAGRSIRGGVPVCWPWFGPHATDETLCPHGFARVVPWDVVDARPEADNTTSLVLKLVESRQVEKQWPYDCELTLTVNIGPTLKMALTTTNKGHEPFVIGEALHTYFQVSDIEVVRVLGLDHTEYEDKVEDYALKRQSGDISFNDEVDRVYLNTDSTCVLEDPGLRRKIIIEKSGSHSTVVWTPWERKAAEIGDLGSHHGWRHMVCVETSNVRGNVVTVEPGSAHTLSVQYSTESL

SEQ ID NO: 60131 - protein, 231 aa, Triticum aestivum
  misc_feature (50)..(50): Xaa can be any naturally occurring amino acid
  misc_feature (83)..(83): Xaa can be any naturally occurring amino acid
GEGNTIVVKTSTGEEFHGGKCIITVGAWASKLVKSITGADLPVQPVHTLXVCYWRVKPGHEEELTTEAGFPTFATYGEPGFYXGTPSMEYPGLIQVCRNGGPPCDPDGRDWATGTGAGGIAEIVARWIDEFMPGVVDTTGGPVLRQPCMCCMTPDEDFVIDFLGGEEFGKDVVVGAGFSGHGFKMGPAVGKILAELALDGESGTAAEAGLELEHYLIGRFEGNPMGKATSH

SEQ ID NO: 60132 - protein, 471 aa, Candida glabrata CBS 138
MLPRTIDILKKFATFVGPGIMVSVAYMDPGNYSTSVSGGAQYKYKLLFSIFVSNIFAVLLQCLCVKLGTVTGYDLAENCRRNLPKKVNYVLYFFAEIAIIATDLAEVVGTAIALQILFNIPLTLGVILTVLDVLLILMFYRPDGQSMKKVRMFELFVGVLVICTVLCFVLELFKINIPNKRELFEGFMPTSIIFKEKQALYISLGILGATVMPHSLYLGSSLVKPRLYDYDIKKYGKVGSSPSLSAIKYSLNYSYAELIISLFLIATFVNSAILIVAGATLAGQPEAEDADLLSIYNLLVHYISPAAGLIFAAAMLFSGQSAGIICTLAGQIVSEGFLEWSLPPWATRLCTRLIAIIPCLFVTLTLGERGISNILNFSQVVLSLILPIVSAPLIYFTANRSIMTVEDHHLHVADINDVDESTPLNSSAQRKKKDFTNSKLLTGAAVFVWALIGGLNCYLVGSWLNGADVHF

SEQ ID NO: 60133 - protein, 462 aa, Glycine max
MQPPRRKNNNLPNSETSTTMKGKRNSSISISIVVVVFSIFLFGVFMYNEDVKSMAEFTFLRPKAQEIQEETVSNNNSRTQPERNRVEDSEESQEPIDLKAVVAEEKIVEEYEEENEEVVLPPEECDLFTGEWVFDNLTHPLYKEDQCEFLTSQVTCMRNGRSDSLYQNWRWQPRDCSLPKGRRLMFVGDSLNRNQWESMICLVQSVVPQGKKSLSKNGSLSIFTIEDYNATVEFYWAPFLVESNSDDPKMHSILNRIIMPESIEKHAVNWKNVDYLIFNTYIWWMNTATMKVLRGSFDEGSTEYDEVPRPIAYGRVLNTWSKWVEDNINPNRTKVFFSSMSPLHIKSEAWNNPDGIKCAKETIPILNMSTTLQVGTDRRLFVVANNVTQSMKVVPVNFLNITTLSEFRKDAHTSVYTIRQGKMLTPEQQADPATYADCIHWCLPGLPDTWNEFLYTRIISQS

SEQ ID NO: 60134 - protein, 346 aa, Oryza sativa (indica cultivar-group)
MASPPSLLPSAGEDDESQREVFEQLRQLVSTYPTVPSGLDTPYYRHPDGWYTFLPAMVSVMVAQRHFTARDTDIIIATFPKCGTTWLKALLFATVHRDGGGAGGVEDDAALAQLRARNPHQLVPFLEIQVYVRDRAPDLSSLPAPRLLATHIPRPSLPASVAISGCKVVYMCRDPKDCLVSLWHFLDAQRREPRGDVGEDFRLFCDGVSLVGPYWDHVLAYWRWHVERPGQVLFMTYEELSGDTLGQLRRLAEFVGRPFTGEERAARVDEAIVKACSFESLAGAEVNRSGTIELMEEPMRNAEFFRRGVVGGWPNYLSPEMATRIDEITESKFRGSGLVLPTMMTM

SEQ ID NO: 60135 - protein, 462 aa, Bacillus thuringiensis serovar konkukian str. 97-27
MTFSKSTTDKPSYTYEELSEKNKAYVWHPFTQMKDYLEEDPVIIERGEGRKLYDVNGNEYWDGVSSIWLNVHGHQVPELDEAIREQLNKIAHSTMLGLANVPSILLAEKIIEVVPEGLKKVFYSDSGSSAVEIAIKMAFQYWQHKGKPKKQRFVTLKEAYHGDTIGAVSVGAIDLFHQVYSSLLFEAIKMPYPYTYRSPYGNDKAEIVKKHLEEMEELLKDKHEEIAAIIVEPLMQGAGGMITMPKGYLRGLRNLCTKYNVLFITDEVATGFGRTGKMFACEHENVTPDILTAGKGLTGGYLPVAITVTTDEIYNAFLGSYEEQKTFFHGHSYTGNPLGCAVAIANLELYEKTNLIEEVARKTEYVATQLEELFACKHVGDIRQCGLMVGIELVKNKETKEAFEWTERVGVQVCKRSRELGMILRPLGNTIVFMPPLASTIDEIDEMLRILYKAISDITEGE

SEQ ID NO: 60136 - protein, 272 aa, Zea mays
MSYYERRGGDRGSGRIQGSGGRGGHVLRGRSGLAPRGPLGVNSRPSARTIAKSFSRTKDMTWRPDLFSDSMAASGIETGTKLYISNLDYGVSNEDIKELFSEVGHLKRFAVHYDGYGRPNGTAEVVFTRRSDAIAALKRYNNVLLDGKAMKIEVIGNDLGLPMTPRINVVGASNGRATRTVVMTPEFSQRGRGSSSRPLSNPSNRFNNRGGFQAGRGRGQFQSWGRGRGQFQSRGRGRAQFQGRGRGRKPEKTADELDKDLESYHAEAMKTD

SEQ ID NO: 60137 - protein, 473 aa, Zymomonas mobilis
MSSESSQGLVTRLALIAAIGGLLFGYDSAVIAAIGTPVDIHFIAPRHLSATAAASLSGMVVVAVLVGCVTGSLLSGWIGIRFGRRGGLLMSSICFVAAGFGAALTEKLFGTGGSALQIFCFFRFLAGLGIGVVSTLTPTYIAEIRPPDKRGQMVSGQQMAIVTGALTGYIFTWLLAHFGSIDWVNASGWCWSPASEGLIGIAFLLLLLTAPDTPHWLVMKGRHSEASKILARLEPQADPNLTIQKIKAGFDKAMDKSSAGLFAFGITVVFAGVSVAAFQQLVGINAVLYYAPQMFQNLGFGADTALLQTISIGVVNFIFTMIASRVVDRFGRKPLLIWGALGMAAMMAVLGCCFWFKVGGVLPLASVLLYIAVFGMSWGPVCWVVLSEMFPSSIKGAAMPIAVTGQWLANILVNFLFKVADGSPALNQTFNHGFSYLVFAALSILGGLIVARFVPETKGRSLDEIEEMWRSQK

SEQ ID NO: 60138 - protein, 327 aa, Zymomonas mobilis
MEIVAIDIGGTHARFSIAEVSNGRVLSLGEETTFKTAEHASLQLAWERFGEKLGRPLPRAAAIAWAGPVHGEVLKLTNNPWVLRPATLNEKLDIDTHVLINDFGAVAHAVAHMDSSYLDHICGPDEALPSDGVITILGPGTGLGVAHLLRTEGRYFVIETEGGHIDFAPLDRLEDKILARLRERFRRVSIERIISGPGLGNIYEALAAIEGVPFSLLDDIKLWQMALEGKDNLAEAALDRFCLSLGAIAGDLALAQGRTSVVIGGGVGLRIASHLPESGFRQRFVSKGRFERVMSKIPVKLITYPQPGLLGAQLPMPTNILKLNNIF

SEQ ID NO: 60139 - protein, 304 aa, Rubrobacter xylanophilus DSM 9941
MEARLREVGGAAPGGLARPALEALTSGGKRLRPLLLLLSAGIGAPVWEEALRAAAATEVLHTATLIHDDIVDKAKSRRGAPTTVARYGREVAVATGDYLFAEAFAALSSIGDPRVIREFAEASRGLAAGELEQFRASGGPVDVEDYLEHIKLKTAGLFRAACVAGGTLGGLSLPQIDALATYGQALGLAFQMSDDVMDLVGKPGIMGKGIGTDLAEGTVTLPIIFALREGDAETIRRVLATPRPDPELLEAGIEAVLDTDAVARTEAWAREEIGTALRGLEALPACPERAFLEVIAAEVVGRDV

SEQ ID NO: 60140 - protein, 349 aa, Zea mays
MGGLTMDQAFVQAPEHRPKPIVTEATGIPLIDLSPLAASGGAVDALAAEVGAASRDWGFFVVVGHGVPAETVARATEAQRAFFALPAERKAAVRRNEAEPLGYYESEHTKNVRDWKEVYDLAPREPPPPAAVADGELVFENKWPQDLPGFREALEEYAKAMEELAFKLLELIARSLKLRPDRLHGFFKDQTTFIRLNHYPPCPSPDLALGVGRHKDAGALTILYQDDVGGLDVRRRSDGEWVRVRPVPDSFIINVGDLIQVWSNDRYESAEHRVSVNSARERFSMPYFFNPATYTMVEPVEELVSEDDPPRYDAYNWGDFFSTRKNSNFKKLNVENIQIAHFKKSLVLA

SEQ ID NO: 60141 - protein, 363 aa, Pasteurella multocida subsp. multocida str. Pm70
MTQQSILFIDRDGTLIDEPKTDFQIDSLEKLQFEPNVIPALLKLKPYYRFVMVSNQDGLGTASFPQENFDKPHNAMMALFKSQGIEFDEVLICPHKPEDECDCRKPKIKLLKKYIDKKLFDPTTSFVIGDRATDVQLAENLGIRALQYDREKLNWDLIVEKLLPKQTALLDRKPRYAEVVRTTKETDIKVQVWLDETGMNDIKTGVGFFDHMLDQIATHGGFRMNVYCKGDLWIDEHHTVEDTALALGTALKQALGDKRGIQRFGFVLPMDECKAECTMDLSGRPYFKFKAKFKRDKVGDFSTEMTEHFFQSLAYTLMATLHLKTKGDNDHHKIESLFKVFGRTLRQCIKVEGNELPSSKGVL

SEQ ID NO: 60142 - protein, 208 aa, Glycine max
  misc_feature (17)..(17): Xaa can be any naturally occurring amino acid
  misc_feature (47)..(47): Xaa can be any naturally occurring amino acid
  misc_feature (102)..(102): Xaa can be any naturally occurring amino acid
  misc_feature (109)..(109): Xaa can be any naturally occurring amino acid
  misc_feature (174)..(174): Xaa can be any naturally occurring amino acid
  misc_feature (188)..(188): Xaa can be any naturally occurring amino acid
PHTRLMRRYRSAPHAEXYIIVADNIALIISISEYYNESLQIPWRGVXIACAIDIFFTLTSGLINATTNQQPGLDIITEYIIAYMYTDRTVDNMCLKVYSLHXALASTHXLSFCQELLNIATHIVKIPPRTMDIAHVVRTILSAYIYTVSVWRMMRTIPHLCDTTMLDPDRRLTXPRDNVFYEASDIWXLIGPRVTVRDLGEYAKVNSF

SEQ ID NO: 60143 - protein, 268 aa, Staphylococcus aureus subsp. aureus COL
MKFAVIGNPISHSLSPVMHRANFNSLGLDDTYEALNIPIEDFHLIKEIISKKELEGFNITIPHKERIIPYLDYVDEQAINAGAVNTVLIKDGKWIGYNTDGIGYVKGLHSVYPDLENAYILILGAGGASKGIAYELAKFVKPKLTVANRTMARFESWNLNINQISLADAEKYLAEFDIVINTTPAGMAGNNESIINLKHLSPNTLMSDIVYIPYKTPILEEAERKGNHIYNGLDMFVYQGAESFKIWTNKDADINSMKTAVLQQLKGE

SEQ ID NO: 60144 - protein, 439 aa, Rubrobacter xylanophilus DSM 9941
MSGLQEARLRLARDRSARLMERAVRRMPGGVNSPVRAFRSVGGDPLFMERGEGPRIFDADGNAYIDYVMSYGPLLLGHAPPEVVGAVERAARRGTTFGAPTRLEVELAELVCEAVPSVEVVRMVNSGTEATMSAVRLARGYTGREKILKFDGNYHGHGDALLVSAGSGVATLGLPDSPGVTPGAARDTAVLPYNDLEAVRELFEERGEEFAAVILEPVAGNMGCIPPEEGFLEGLREITAACGALLIFDEVMTGFRVSRGGAQERYGVVPDLTCLGKVIGGGLPVGAYGGRREIMERVAPAGPVYQAGTLSGNPLAMSAGLATLRRTGEPGFYERLEELGARWERGMREAASGSAVPVTVNRVGSMVSLFFASGPVRDFASAAASDAELFKDFFWHMLSRGVYLAPSQYEAGFISLAHSEEEIDRTVEAAAEWFAGRRA

SEQ ID NO: 60145 - protein, 512 aa, Bradyrhizobium japonicum USDA 110
MDKPTPKADVFQANRDRVAPLLKTLRADGIGHMIDGKIVPSISGETFETKSPVDGAVLASVARGNAEDIDRAATAAALAFKSWREMGPAMRKKLLHRVADAIEDNADDIAVLECIDTGQAYRFMAKAAIRAAENFRFFADKCAEARDGQNTPSDEHWNVSTRVPIGPVGVITPWNTPFMLSTWKIAPALAAGCTVVHKPAEWSPATAAILARLVKEAGVPDGVLNTVHGFGEEAGKALTEHPAIKAIGFVGESATGSAIMVQGAPTLKRVHFELGGKNPVIVFDDADLDRALDAVVFMIYSLNGERCTSSSRLLIQQSIAEKFVEKLTARVKALKVGHPLDPSTEIGPLIHERHLAKVCSYFDVARKDGATIAVGGKAYDGPGGGHYVEPTLVTGAHGKMRVAQEEVFGPFLTVLPFKDEADAIEVANDIRYGLTGYVWTNDVGRALRVADALEAGMIWLNSENVRHLPTPFGGMKASGIGRDGGDYSFDFYMETKHVSLARGTHKIQKLGI

SEQ ID NO: 60146 - protein, 382 aa, Arabidopsis thaliana
MYNLPRDLPEEVLCRIPLTSLRPVRSTCKKWSTLSKCGSFAKKHLAQAKVLADAKEFMVVLMMNFRVYLMRVNLQNNVVESSSSSSSSSSSCIKREAKLISLGDEEADISQVFHCDGLLLCISITESKTRLVVWNPYWGHTRLFEPTHQFNKFDSYSYALGYDKSRKSHKILRGITCLDPFKIYDFNSDLWRDLDVTPEWHLWQMLHGVSLKGNAYWFARENYTETMDTDHFFLLCFDFTSETFGPPLPLPFEFAVSEDTMSVSSVREEQLVVLYQPWDYLQLDIWVTSKIEPNAVSWNSKVFLSVSLKQLVSPQFQLTFGSFFIDEEKKVAVVFDKDYDNKRNIAYIFGVDGSFKAVDLGDSDRKCFPLVCSYVPSLVQLN

SEQ ID NO: 60147 - protein, 299 aa, Arabidopsis thaliana
  misc_feature (134)..(134): Xaa can be any naturally occurring amino acid
  misc_feature (149)..(149): Xaa can be any naturally occurring amino acid
MENKTQEEASTINVSSLACIDLANSNLHRSAASLKQACLDCGFFYVTNHGISEELKDEAFEQSKKFFALPLDEKMKVLKNEKHQGYSPVLSQISDNQIHGDYKESFFIGIEGSNDTPFCRANIWPNPDVLSGWXGDHGEISSRSIEGLXAIARVLALALNVDGDYFDTPEMLGNPLTFMRLLHYEGMSDPSKGIYGCGPHSDFGMMTLLGTDSVMGLQICKDRDVKPRKWEYILSIKGAYIVNIGDLLERWSNGIFKSTLHRVLGNGQDRYSIAFFLQPSHDCIVECLPTCQSENNPPK

SEQ ID NO: 60148 - protein, 412 aa, Salmonella typhimurium LT2
MKALTYHGPHHVKVENVPDPGIEQPDDIILRVTATAICGSDLHLYRGKIPQVKHGDIFGHEFMGEVVETGHDVKNIRKGDRVVIPFVIACGDCFFCRLQQYSACENTNDGHGAAMNKKQIPPPAALFGYSHLYGGVPGGQAEYVRVPKGNVGPFKVPPLLSDDKALFLSDILPTAWQAAKNAQIQQGFSVAVFGAGPVGLLTIACARLLGAEQIFVVDHHAWRLRFAEERYGAIPINFDDENDPAEKIIEQTAGHRGVDAVIDAVGFEAKGSLTETVLTNLKLEGSSGKALRQCIAAVRRGGVVSVPGVYAGFIHGFLFGDAFDKGLTFKMGQTHVHAWLGELLPLIEKGLLKPEEIVTHYMPFEEAARGYEIFEKREEECRKVILVPGATSAQAAQKQATGVVNPMPGGVV

SEQ ID NO: 60149 - protein, 199 aa, Aspergillus nidulans FGSC A4
MATGPATQSLKCVVTGDGAVGKTCLLISYTTNAFPGEYIPTVFDNYTASVMVDGRPISLGLWDTAGQEDYDRLRPLSYPQTDVFLICFSIVSPPSFDNVKSKWFPEIEHHAPNVPIILVGTKLDLRDDPAQLESLRMRKQEPVTYEQALAVAKEIRAHKYLECSALTQRNLKSVFDEAIRAVLNPRPATKQRNKKCTIL

SEQ ID NO: 60150 - protein, 400 aa, Zymomonas mobilis subsp. mobilis ZM4
MVHISAALSRIQPSPTIAVTSRVIELKSKGVDIITLGAGEPDFETPEFIKEAAIQAIHDGKTRYTNVDGTAELKEAIVGKFRRDNHLEYRTDQISVGSGGKHVLFNALTATIDQGDEVIIPAPYWVSYPDIVRFCGGTPVFIQATIDQDYKITAEQLEKAITPKTRWFIFNSPSNPTGAAYSADEIKSLAEVLRRHPHVWILSDDIYEHIVFDNFRFATIAEVAPDLFDRTLTANGCSKAYAMTGWRIGFAGGPTPLIKAMAKLQSQSTSNPCSISQAAAVAALNGPQDFLQGWSDDFARRRNLVVDGLNAIEGISCPKPQGAFYVYPGISELIGKKTPSGKVIEKDLDFSSYLIDEAKVAVVHGEAFGLSPAFRISYATSTELLKKALERISDAVARLK

SEQ ID NO: 60151 - protein, 439 aa, Bacillus thuringiensis serovar konkukian str. 97-27
MAVENITMPQLGESVTEGTISKWLVNVGDHVNKYDPLAEVMTDKVNAEVPSSFTGIVKELIAGEGDTLAVGEVVCVIQVEGADEVAATAVEEKTKEEPKAEVATPEKAPKAKQPTDGKPRFSPAVLKLAGEHNVDLDLVEGTGANGRITRKDILKLVESGNIPQAGAVKKEEAVAAVVEARPEAPKAAPVAQKVEAAKPVSVPTMPGDIEIPVTGVRKAIAANMLRSKHEAPHAWMMIEVDVTNLVSYRNSIKGDFKKREGFNLTFFAFFVKAVAQALKEYPQINSMWAGDKIVQKKDINLSIAVATEDELFVPVIKHADEKTIKGIAREITELAGKVRTKSLKADEMQGGTFTINNTGSFGSVQSMGIINYPQAAILQVESIVKRPVIMENGMFGARDMVNLCLSLDHRVLDGLICGKFLGRVKEILENTSENNTSVY

SEQ ID NO: 60152 - protein, 145 aa, Hyphomonas neptunium ATCC 15444
MNPTLCSALLGALLLTGCVTAPEAAPPAVPAGKTVLVPGNALYSAAVGYGDTVYLAGVIGRSETGDVSEAARQAMDAVKGNIEKAGGTMGDLLKCTIFMTDIEQYGPVNEVYADYFEADPPARTAIAVSALPFGALVEVECIAAR

SEQ ID NO: 60153 - protein, 482 aa, Staphylococcus aureus subsp. aureus Mu50
MGSFFNKIARKEDPAIYQNKDGHLKRTLRVRDFLALGVGTIVSTSIFTLPGIVAAEHAGPAVALSFLLAAIVAGLVAFTYAEMAAAMPFAGSAYSWVNVLFGEFFGWVAGWALLAEYFIAVAFVASGFSANLRGLVKPIGIELPAALSNPFGTNGGFIDIIAAIVILLTALLLSRGMSEAARMENILVILKVLAIILFVIVGLTAINVSNYVPFIPEHKVTATGDFGGWQGIYAGVSMIFLAYIGFDSIAANSAEALDPQKTMPRGILGSLSVAIVLFIAVALVLVGMFHYSQYANNAEPVGWALRQSGHGVVAAIVQAISVIGMFTALIGMMLAGSRLLYSFGRDGLLPSWLSHLNDKHLPNRALVILTIIGVLIGSMFPFAFLAQLISAGTLVAFMFVSLAMYRLRKREGKDLPIPAFKLPLYPVLPAITFVLVLLVFWGLGFEAKLYTLIWFIVGIILYLSYGLRHSKKNDVAEYHPPK

SEQ ID NO: 60154 - protein, 457 aa, Staphylococcus aureus subsp. aureus Mu50
MHINTVNGRGMYMSKAHQLIQEDEHYFAKSGRIKYYPLVIDHGYGATLVDIEGKTYIDLLSSASSQNVGHAPREVTEAIKAQVDKFIHYTPAYMYHEPLVRLAKKLCELAPGDFEKRVTFGLTGSDANDGIIKFARAYTGRPYIISFTNAYHGSTFGSLSMSAISLNMRKHYGPLLNGFYHIPFPDKYRGMYEQPQANSVEEYLAPLKEMFAKYVPADEVACIVIETIQGDGGLLEPVPGYFEALEKICREHGILIAVDDIQQGFGRTGTWSSVSHFNFTPDLITFGKSLAGGMPMSAIVGRKEIMNCLEAPAHLFTTGANPVSCEAALATIQMIEDQSLLQASAEKGEYVRKRMDQWVSKYNSVGDVRGKGLSIGIDIVSDKKLKTRDASAALKICNYCFEHGVVIIAVAGNVLRFQPPLVITYEQLDTALNTIEDALTALEAGNLDQYDISGQGW

SEQ ID NO: 60155 - protein, 296 aa, Staphylococcus aureus subsp. aureus Mu50
MNKEQLEKMKNGKGFIAALDQSGGSTPKALKEYGVNEDQYSNEDEMFQLVHDMRTRVVTSPSFSPDKILGAILFEQTMDREVEGKYTADYLADKGVVPFLKVDKGLAEEQNGVQLMKPIDNLDSLLDRANERHIFGTKMRSNILELNEQGIKDVVEQQFEVAKQIIAKGLVPIIEPEVNINAKDKAEIEKVLKAELKKGLDSLNADQLVMLKLTIPTEPNLYKELAEHPNVVRVVVLSGGYSREKANELLKDNDELIASFSRALASDLRADQSKEEFDKALGDAVESIYDASVNKN

SEQ ID NO: 60156 - protein, 201 aa, Pasteurella multocida subsp. multocida str. Pm70
MKINWQKVDNLLPVIIQNVATCEVLMLGYMNQEALEKTLAEKRVTFFSRTKNRLWTKGETSGHFLNVVDMSLDCDNDTLLILVNPIGETCHTGAESCFYQFEKTTQPDWIFLSKLERLIASRKGADPESSYTAQLYAKGTKRIAQKVGEEGVETALAATVKDKAETICEAADLVYHLTVLLQDADLSWSDVIHKLKERHTK

SEQ ID NO: 60157 - protein, 200 aa, Brassica napus
GLREDNDFIWETAMKSCIGGGKGHNGDILAVAFAKKSFSFFVSGSGDRTLKVWSLDGISEDSEEPINLKTRSVVAAHDKDINSVAVARNDSLVCTGSEDRTASIWRLPDLVHVVTLKGHKRRIFSVEFSPVDQCVMTASGDKTVKIWAISDGSCLKTFEGHTSSVLRASFITDGTQFVSCGADGLLKLWNVNTSGCIATY

SEQ ID NO: 60158 - protein, 618 aa, Thermus thermophilus HB27 [sequence omitted]

SEQ ID NO: 60159 - protein, 178 aa, Glycine max
EKTNKKRRKKMSMACSIPCIKIPTRSSSPSCTSSSTSSYSLRFSSSKPHSVTIRNSQAEGPIRRPVAPPIREPSSSSSSSSAPQLQKPTLPSQPPPSPSPPQKPATVVGDDKNVITLEFQRQKAKELQEYFKQKKLEQADQGPFFGFIGKNEISNGRWAMFGFAVGLLTRVCNRFKTL

SEQ ID NO: 60160 - protein, 227 aa, Thermus thermophilus HB27
MERPLESYKKEAAHAAIAYVQDGMVVGLGTGSTARYAVLELARRLREGELKGVVGVPTSRATEELAKREGIPLVDLPPEGVDLAIDGADEIAPGLALIKGMGGALLREKIVERAAKEFIVIADHTKKVPVLGRGPVPVEIVPFGYRATLKAIADLGGEPELRMDGDEFYFTDGGHLIADCRFGPIGDPLGLHRALLEIPGVVETGLFVGMATRALVAGPFGVEELLP

SEQ ID NO: 60161 - protein, 503 aa, Arabidopsis thaliana
MAIVIGLLEIFTAFVFFIFFQCLLLHKKTPKPLLTNWPALGMLPGLLLQVPRIYDWITEVLEATDMTFCFKGPCLSGMDILLTVDPVNIHYILSSNFANYPKGMEFKKIFEVVGDSIFNVDSGLWEDMRNSSHAIFSNQDFQMFWVSTSVRKLRQGLVPILENAADKNILVDLQDLFQRFLFDTSLILMTGYDPKCLSVEMPKVEFGDAVDGVSDGVFYRHVKPVFLWRLQYLIGVGVEKRLKRGLAVFDQLLEKIITAKREEINSHGTHHPSRGEAIDVLTYYMTMDTTKYKYLEPSDDRFIKDTILGFLIAARDTTSSALTWFFWLMSKNPEAINKIRQEVNKKMPRFDPADLEKLVYLHGAVCETLRLYPPVPFNHKSPAKPDVLPSGHRVDEKWKIVISMYALGRMKSVWGDDAEDFRPERWISDSGRLKHEPSYKFLAFNAGPRACLGKKLTFLQMKTVAAEIIRNYDIKVVEGHKTEPVPSVLFRMQHGLKVNITRI

SEQ ID NO: 60162 - protein, 426 aa, Cryptococcus neoformans var. neoformans JEC21
MPLHNPIWEVIEPHLVRHNLYTVKDPTYGRYLLPHHPPHLELVNDPAVSHNYRRVFLRPFNSFRSYHEAYDTTQIIHAENISLIPEELDSGVKRGGRWVAYSTWEMHEPPEGGWEGGGRGKGKDLVLVHGLGDYGLRYAPHIKFFLKAGFRVIIPDLPSYGRSTGINSYLPSLLLLTAAVHVVLTDVVQNDLSQGREQRKVFLNGSSMGGWTVLYYLLKYPPTAQPEKVASQGQKPDIAPPEEGSGQGYDQLERSRRDEKVRIHVAGAFVLCPMIEVSKESRPNILLEYLGRGVNSFAGSLPLAKAVRGNVSDDPRVEEDFFADPLCYHGMLRVGTGLACLEGMTELQERAEEVNVPIRLVHGNKDRATSHKGTLRLFDRLPNEDKEIEIYDGYEHVMLKLGVDAMDDEKRQRVLADWRSWLVQRC

SEQ ID NO: 60163 - protein, 165 aa, Triticum aestivum
MAVLVARQGRELQRYSASTGGRIVVGCIPYRMRDGGDSDGEGELEVLVISSQKGHGMMFPKGGWELDESMDDAARREALEEAGVRGEMGKVLGCWHYQSRRYQTTYEGIMYPLRVTDELQQWPEMASRKRTWATVQQVMEGCQHCWMREALEELVARHAKPQSAL

SEQ ID NO: 60164 - protein, 410 aa, Arabidopsis thaliana
MAMSNLPRDLLEEVLSRVPVKSIAAVRSTCKNWNSLTYGQSFTKKLYGKTMATKEKEFLVVMTMDLEVYLMRVNLHGIHKDDNNVKSSIMQKAKLIRLNDDRVRVDDICKVFHCDGLLLCITIGIRLVVCNPYCGQTRCIKTRRDYHITDNYALGHEKMKNSPLRNYKILVFHDKSFLQNSWFEIYNFNSDSWKVLYFTCDWKLPFSQLVVSLKGNTYWFAREMYIHGPRIDLPDFLICFDFTTERFGPRLHLPFHSRCVDTVTLASVREEQLAVLFQDSKTLILEVWITTKIEPNAVSWSSKVFLEVNMSPLTGFQFNRSFGSFFIVEEKNVVVVPIKGGHFKRNLAYIIGKDEYFKEVDLGVPSSYIYFSPHVCSYVPSLVQIKKDAQVMLQHHNVSAEKHHEFCASL

SEQ ID NO: 60165 - protein, 435 aa, Burkholderia sp. 383
MIPVTSKPAGGFALPGLSTAHTDGAARAALEGRRTGVAALLPFVGPAVIASIGYMDPGNFATNIQAGAAYGYRLLWVVLAANTIAMLFQAMSAKLGIVTGRNLAELCRDRFPAPVVWGMWVASEIAAMATDLAEFLGGALAFGLLCHLSLFTGMIATALATCAILALEKRGFRPLEAAIAALVGVIGACYLGELLIAPQDWHAAAFHLVVPQIPDHTALTIAVGIIGATIMPHTLYLHSGLTQDRTAPRDDAERRRLVRFSNREVVVALGLAGFVNLAMVMMASSAFHASAPGLTDIGDAYHTLIPVLGPAAGALFLVALLTSGVSSSVVGTMAGQVVMQGFIHRRMPVWVRRAVTIVPAFAVVAFGCDVTRAMVASQVVLSFVLPLPMVALLMLSARADVMGAYAMRLPLRIVAGAATVVIVGLNAYLVWAAFN

SEQ ID NO: 60166 - protein, 254 aa, Colwellia psychrerythraea 34H
MCILFIAIEQHPKYPLIICANRDEFHQRPTQAMHVWQESNILAGKDLQAGGTWLGLSSTGKFAALTNFRKLPLSEAPKKSRGDLVLQALADTKINMTAELAQQASQYHGFNLIYGSLKQLYCYDSVNNQSHQLSDGVHSICNGALDDIWPKMARGEKLLSETIRSQKNLSIEALFDLMTNDKQALPHLLPETGLDEEWEQLLSAIFIKSPTYGTRTTTIITQDVEGNVETYDRSYAPSGECITKQQFNLATVFD

SEQ ID NO: 60167 - protein, 398 aa, Colwellia psychrerythraea 34H
MCSNHGNRGVVYTGPGSVEIQDIAYPKLAIGNRKCEHGVILKVVTTNICGSDQHMVRGRTTAEPGLVLGHEITGMIIEKGSDVEFLDIGDIVSVPFNIACGRCRNCREGNTGICLNVNPGRAGAAFGYVDMGGWVGGQSEYVMVPYADFNLLKFPDKDQALEKIRDLTMLSDIFPTGYHGAVTAGVVPGATVYIAGAGPVGLAAAASSQLLGAACVIVGDMNPERLAQARSFGCETIDLRQDATVPDMIEQILGVPEVDAAVDCVGFEAHSHGCSHHKEQPAIVLNTMMEVTRAGGGIGIPGLYVTGDPGASTEAAKTGQLSMNFGLGWAKSHYFVTGQCPVMKYHRNLMQAILWDKVQIAKAVNVKVISLDGAPEGYNAFDKGAAQKFVIDPHSMVV

SEQ ID NO: 60168 - protein, 220 aa, Brassica napus
MILSKRPHLMIRKLSEMLVPRSRSAIKPDDYSASPRSPLDMKFPSPVNSKRYGSGGVGLGIVAALEESRIGINRYDPVCFSGRFRCPEIDLSEEEYTCVTSRDGTTKVYHSDDGFENGSEYDDRGRHKPVVPPPVIKRRVNRDNPTEFLSSCCLCKKRLQGKDIYMYKGEMGFCSAECRSVQIMNDERKEQSRQQVLRNVDVSSSLYAGEQSFSAGIFVF

SEQ ID NO: 60169 - protein, 245 aa, Glycine max
KTGPPHNQLRRPPPSHHFEELHNFVFLDMGSLALETEDVISDIYLSLGLKESDKGVGGPRVLSLLSSLLERSVQRNETSLEAKHIKDVVTVFHGLRAPTLSVRKYIDRIFKYSGCSPSCFVVAHIYVDRFIQHTEIKLTSLNVHRLLITSIMLAAKFIDDAFYNNAYYAKVGGVSTSELNRFEMSFLFGIDFRLQVGVETFGRYCRQLEKEAAEVVQIERPMQACRIKESWSNKDDPTCASTIAR

SEQ ID NO: 60170 - protein, 507 aa, Bradyrhizobium japonicum USDA 110
MTMSEESKPSGPDLTEGVALTAFRDGKLLGHVGAEDVLLVQAGGEVFAIEPACSHYHGPLAEGLVVDDTIRCPWHHACFSLRSGEATRPPALSALAVWEVTRDQDRIIVQRKREAPKPTARSAPAPEKFVIVGGGAAGFAAAEMLRREGFAGAITMLSDDGAMPVDRPNLSKDYLAGNAPEDWLPLRGEDYYRDAGIDLRLNTNVSAIDAKTRSVTLGNGDRLPFDRLLLATGAEPVKLQIPGADQPHVHTLRSVADSRAIIKAAGSATRVLVIGASFIGLEVAASLRARKLEVHVVAPEERPMQRVLGPEMGDFVRALHEENGVNFHLGDTVERLDGTRATLKSGGVIEADLVVVGIGVKPRLALAEKAGLAADRGVSVSEYLETSIAGIFAAGDIARWPDPHSRQTIRVEHWVVAERQGQTAARNMLGRRERFDAVPFFWSQHYDVPINYVGHAESFDDIVIDGSIAGRDCLLKYRKAGRVLAVASIYRDLDSLKAELDMERRGL

SEQ ID NO: 60171 - protein, 251 aa, Vibrio sp. ANT-300
MRQALVMGNWKLNATKGSVEALINGLVDAAKDNATVEVAVCPPAVFIPQVEALTADTAITYGAQDCDVNTSGAFTGENSAVMLKEFGCKYTLVGHSERRVIHGESSEVVADKFAVTPENGLVPVLCIGETLEQFEAGETKAVVEAQLQAVVTKSGITSLNNAVIGYEPVWAIGTGKTATPEIAQEIPAHIRSWLAEQDAAVANKVQILYGGSVKPANSAELFGQADIDGGLVGGASLDAVEFSKVISGASA

SEQ ID NO: 60172 - protein, 572 aa, Listeria innocua Clip11262
MAKELKGIAASDGIAIAKAYLLVEPDLSYEKTEVTDVESEVKRFESALEVSRTELSTIREKAAKDLGEDKAQIFDAHLLVLNDPELTGPIEESIKNAKTNAETALQETTDMFIGMFESMDNEYMRERAADIKDVRKRVLSHLLGVTIPNPALIDEEVVVVAADLTPSDTAQLNRKFVKGFVTDIGGRTSHSAIMARSLEIPAVVGTKEVTASVAKNDIVIIDGLEGNVIIHPTEEQIAHYEKIKSDFALQQAEWEKLKNEKTVSKDGVHVELAANIGTPNDLEGVISNGGEAVGLYRTEFLYMGRDNFPTEEEQFEAYKAVVSGMDGKSVVVRTLDIGGDKTLPYLELPEEMNPFLGFRAIRLCFANEELFRTQLRALLRASVYGNLKIMFPMIATVNEFRQARDILLDEKAKLKAAGTEVSDSIELGIMIEIPAAAVLADQFAKEVDFFSIGTNDLIQYTMAADRMNERVSYLYQPYNPSILRLVKMVIDASHKEGKWTGMCGEMAGDQTAVPLLLGLGLDEFSMSASSILKSRSLIKRLDQSEMVKLAEEALNKSTAEEVVELVEKYTAE

SEQ ID NO: 60173 - protein, 332 aa, Gibberella zeae PH-1
MVMTVISSVYGISSTLYSNLFVTLPYPETKHDLSDKVMIVSGSNTGLGFEASQHLLRLGLGKLIMAVRSLDKGEEARRELLKLTKREPESIEVWFLDMADYESIKAFAKRASTLPSLDVVLANAGLATSDEFTTAEDNERTITVNVISTFLLFFLLLPKLRKSSFPGKFIIPNSATHYWAPTKELVPDEKAGPIFSRLNDPVKSNMAARYYVSKLMVLYLTREIASRLDTSEKNSVIINTPNPSYCKSGLMREKEDVAPPDFLARSGEMGSRALVAGVLAGPESNGKYMNNCQIHEPACHVTNKMGTKIQGALYKELLGKLEVIAPGATKTL

SEQ ID NO: 60174 - protein, 218 aa, Solibacter usitatus Ellin6076
MTPRLVEVRKNVLKRNDELARALRMRFAEAGVYVASLVSSPGTGKTALLERLLTAMKTRCRVAALVGDLATENDAARLARSGAPVRQIITGTVCHLEAQMVEKALEGWRLEDLDYLFIENVGNLVCPSSYDLGENLRLVLLSVTEGEDKPLKYPGIFNTSDVAVVTKCDLADAVEFDWAAAERNILAVRPGMRIVKTSSKTGQGLNELLDLFSPVSSY

SEQ ID NO: 60175 - protein, 321 aa, Bartonella bacilliformis
YIDGDEGILLYHGYSIDQLAENGDFLETCYLLLYGELPNKQQKIDFDRCIMRHTMVHEQFARFFHGFRRDSHPMAVMVACLGAMSAFYHDSINITDPQQRMIASIRLISKVPTLAAMAYKYSIGQPFVYPRNDLNYATNFLHMCFSVPCEEHKISPVIARAMDRIFTLHADHEQNASTSTVRLAGSSGANPYACIAAGVACLWGPAHGGANEACLKMLQEIGSVKKIPEFIARAKDKNDPFRLMGFGHRVYKNYDPRAKIMQKTCHEVLQELNIQDDPLLDIAMELEHIALNDEYFINKKLYPNVDFYSGITLKALGFPTE

SEQ ID NO: 60176 - protein, 321 aa, Bartonella elizabethae
YIDGDKGILLYRGYPIDQLAEKGDFLESCYLLLYGELPTQQEKNDFDRCIMQHTMVHEQFSRFFHGFRRDSHPMAVMVACLGAMSAFYHDSIDITDPHQRMIASVRLISKVPTLAAMAYKYSIGQAFVYPRNDLSYAANFLRMCFAVPCEEYKINPVLARAMDQIFILHADHEQNASTSTVRLAGSSGANPFACIAAGVACLWGPAHGGANEACLKMLQEIGSIKRIPEFIARAKDKNDPFRLMGFGHRVYKNYDPRAKIMQKTCHEVLKELNIQDDPLLDIAIELEKIALSDEYFIEKKLYPNVDFYSGITLKALGFPTE

SEQ ID NO: 60177 - protein, 255 aa, Enterobacter cloacae
MRHPLVMGNWKLNGSRHMVNELVANLRKELAGVTGCAVAIAPPDMYLDLAKHAADGSHIILGAQNVDVNLSGAFTGETSAEMLKDIGAKYIIIGHSERRTYHKESDEFIAKKFAVLKEQGLIPVLCIGETEAENEAGKTEEVCARQIDAVLKTQGAAAFEGAVIAYEPVWAIGTGKSATPAQAQAVHKFIRDHIAKADAKVAEQVIIQYGGSVNASNAAELFTQPDIDGALVGGASLKADAFAVIVKAAEAAKQA

SEQ ID NO: 60178 - protein, 407 aa, Coprinopsis cinerea okayama7#130
MASLVSTRLAGRRLTTLPRNLQLRRGFSVKTTADTTQLTGKPSDPATEPYTLRLHEDSFKTYKCDAPSLDVSITKSELLQMYSEMQVMRRMEMASDALYKAKLIRGFCHLATGQEAVSVGLEHGIKKDDRVITGYRCHPFAVLRGGTVEGVIAELLGRQAGMSHGKGGSMHIFTPTFFGGNGIVGAQVPVGAGAAFAQKYKGEKHCTFALYGDGASNQGQVFEAFNMAKLWNLPCVFVCENNKYGMGTSAERSSSNTEYYTRGDKIPGIQVNGMDIIATKQAVEYARNWTVNDDKGPLILEFITYRYGGHSMSDPGTTYRTREEVQRMRSTQDPIRGLQRYLEEWGVATEQELKALDKDAKAVVDKAVEIAKASPEPEIKDLWTDIYYKGTEPPFMRGREREEVHYY

SEQ ID NO: 60179 - protein, 378 aa, Taxodium distichum
FSIKGNGIGNGNGHCNGYSNGHGHCINGYSNGISASVSSNGVSHLPYSNGNTVHHSNGNSHTSPSFGDGRRRCFWYEEEIEDDLRWCFALNRIIHTGVSEYQDIALIDTRPFGKALVIDGKMQSTEVDEFIYHESLVHPALVYHSHPKSAFIMGGGEGSTAREILRHKCVKKVVMCDIDKEVVDFCKKYLVVNREAFSNSRLELVINDARTELQSRQERFDVIIGDLADPVEGGPCYQLYTKSFYELVIKPKLNHQGIFVTQAGPAGVLTHTQVFSSIYNTLRQVFKHVMPYSAHVPSFADTWGWVMASDHPLTLKAEEIDDRIKQRIKGELQFLDGQTFLVAATLNKSVRKSLSKETHVYTEETARFIHGHGKASYQ

SEQ ID NO: 60180 - protein, 816 aa, Clostridium thermocellum ATCC 27405
MKAIIMAGGEGSRLRPLTCDLPKPMVPIMNIPIMEHIINLLKKHGITEIGVTLMYLPQKIKDYFGNGSNFGVNITYFTEDTPLGTAGSVKNAEDFLDETFIVISGDSLTNMNITKAIEFHRMKNSKATLVLTRVDVPLEYGVVITDKSGAITGFLEKPSWGEVFSDTVNTGAYILEPEILKYLEKGKKVDFSQDLFPYLLLKKEPMYGYVMDDYWCDIGDLQAYLQAHYDVLEGKIQLDINGTEIQKGVWVGSGAIIEPGAILNPPCVIGDNCRIESGAVIDSLSVIGNNNVIERDSSVKRSVIWDGNYIEYGSKIRGAILCSKTNLKRYVHIFENAIVGDNCLINERVVIKPNIKIWPQKTVEPFAIVDRNIIWGSKHSKSIFGENGLSGIINVDISPEFATRLGAAYGSIFKKGSKVVVSSTTANSARMFKHAFISGILSVGVEVFNLSSLLTPLARHAINFLSVEGGIHIKLSEDNPNKLKVDFMDSKGASISRVTERKIENSFAREDFKRCSGDEVSRLNNITDFKNYYVRSILNEVNVEAIKNNPPKLCIVSPSDFVISIVVPMLTDLGCKVASFSSTNVSEVDTIVDEIKDNNASFAAFIDSNGETLVLIDKNGNVVKDDLFLCLTSLITFKSVPNSKVVVPITAPSIIETLAERYNGKVVRTKTSPQAVMEQMLNHNLFKNRENMYQFLLNFDAIAGLVKIIEFLCLQNTTLTETIKEIPDFYVSKKKIFCPWELKGRVMRTLITEKDQEKVELLDGVKFILENGWALVLPDADMPLCRVYSEGVTPEVAETISDKYIDKIKAIINDKK

SEQ ID NO: 60181 - protein, 157 aa, Triticum aestivum
  misc_feature (42)..(42): Xaa can be any naturally occurring amino acid
  misc_feature (50)..(50): Xaa can be any naturally occurring amino acid
  misc_feature (66)..(66): Xaa can be any naturally occurring amino acid
  misc_feature (101)..(101): Xaa can be any naturally occurring amino acid
  misc_feature (109)..(109): Xaa can be any naturally occurring amino acid
  misc_feature (143)..(143): Xaa can be any naturally occurring amino acid
FLPAIFHPAIARLCINLKKHLITTSYLYDSISKSQQTAQITXLTILSKMXLYPCIDHMLSMKIIDXTHPLNSKIKSFTSFSGGLPSPAAANNPLTYNFNLXPASSIRTXRNPPVYKFLKKIIYVNGSNLYQSPKNLILPQLPXFCSPTLPNRNSLMY

SEQ ID NO: 60182 - protein, 353 aa, Nicotiana tabacum
MMTRGATRMTRTVLGHMGPRYFSTAIFRNDAGTGVMSGAAGFMHGVPANPSEKAVVTWVRHFPVMGSRSASSMALNDKQHDKKAENGSAAATGGGDGGDEKSVVSYWGVQPSKVTKEDGTEWKWNCFRPWETYKADLSIDLTKHHAPTTFLDKFAYWTVKSLRYPTDIFFQRRYGCRAMMLETVAAVPGMVGGMLLHCKSLRRFEQSGGWIKTLLDEAENERMHLMTFMEVAKPNWYERALVFAVQGVFFNAYFVTYLLSPKLAHRIVGYLEEEAIHSYTEFLKELDKGNIENVPAPAIAIDYWRLPKDSTLRDVVLVVRADEAHHRDVNHFASDIHYQGQQLKDSPAPIGYH

SEQ ID NO: 60183 - protein, 657 aa, Hyphomonas neptunium ATCC 15444
MAVTNRDMANAVRALSMDAVEAAKSGHVGLPLGMADAATVLFRKFLKFDPKDPNWADRDRFVLSAGHGSMLIYSLLHLTGYASVSRDDIRNFRQMGASTPGHPENFVTTGVETTTGPLGQGIATAVGMAIAERHLNARFGNDLVDHRTWVVAGDGCLMEGLSQEAITLAGHMKLNKLIVLFDDNAVTIDGSTDLSDSTDQCARFEASGWISRRVDGHDEKDVEAALKWATKQKKPVFLAVKTIIGFGAPKLAGTGKAHGGPYGAEEIDGIRKSLNWPHAPFEVPEAIEKAWAKAGERSVAEHAAWKKRLAASPHKGEFNAAIAGRLPKNLGKAIIKHKKAVAEGGASKATRVWSGEALEVITGLVPEMVGGSADLSGSNNTKTSHTAPMTPKSWSGRYIHYGVREHAMAAAMNGMALHGGIIPYSGTFLVFADYSRAAIRLGALMGTQVIHVMTHDSIGLGEDGPTHQPVEHVASLRAMPNMVVFRPADGVETAECWELALHRNDGPATMALTRQNVAPARKTHTDENLSAKGGYVLSPAGKGKERGVLIATGSEVEIALKAQAMLAEEGIAVRVVSMPSMELFGQQDAAYRAETLGKELPKVAIEAGVRFGWDRWIGADGGFVGMDSFGASAPYQKLYQHFGITAEAAVAAIKERV

SEQ ID NO: 60184 - protein, 517 aa, Oryza sativa (japonica cultivar-group)
MAGGGFPVAGGAPPGDYGGGITFSVVVTCLMAASGGLIFGYDIGISGGVTAMESFLAAFFPGVLRRMAAARRDEYCVYDSHVLTAFTSSLYLAGLAASLAAGRVTRAVGRQAVMLAGGALFFAGAAVNAAAVNIAMLIVGRMLLGFGIGFTNQAAPVYLAETAPAKWRGAFTTGFQLFLGIGNLTANLTNYGAARIPRWGWRLSLGLAAAPASVILVGTLLISDTPSSLLVRGRVEQARAALRRVRGAKADVDAELEGVARAVEAARANEEGAYRRILWRQHRPHLVMAVAVPLLQQLTGVIVIAFFSPVLFQTAGFGSNASLMGAVILGAVNLGSTLVSIATVDRYGRRVLFLTGGLVMIACQVAVAWIMGSQIGRDGESAMARRYSVAVLALTCVFSAAFGWSWGPLTWVIPGEIFPVEIRSAGQGISVAVNLGATFVLTQTFLAMLCSFKYATFLYYAAWVAVMTAFVWAFLPETKGVPLEAMGAVWARHWYWRRFVQPPPAAKDAMLPEVLVN

SEQ ID NO: 60185 - protein, 215 aa, Triticum aestivum
MLPYATAGEAEAALGRALTWAEAAWLRYSASVPDRYLHWPNIAITLVVYTLAPLPLALFDLAAPAAAAPYKLQPKVQHPPATFFRCYMDAVRVSLLIIGPYQLISYPAAKIMDIRTGLPLPSMGEIMAQLTVYFLVEDYLNYWLHRLLHTKWGYEKIHHVHHEFTAPMAYAAWYGHWAEMLILAVPSLGGPALVPCHVTTLWIWFAARLVESLNI

SEQ ID NO: 60186 - protein, 319 aa, Bartonella vinsonii
DGNKGILLYRGYPIEQLAEKGDFLESCYLLLYGELPTQQEKSDFDRCIMQHTMVHEQFARFFHGFRRDSHPMAVMVACLGAMSAFYHDSIDITDPQQRMIASVRLISKVPTLAAMAYKYSIGQAFVYPRNDLSYAANFLRMCFSVPCEEYKTNPVLTRAMDRIFILHADHEQNASTSTVRLAGSSGANPFACIAAGVACLWGPAHGGANEACLKMLQEIGSVKRIPEFIARAKDKNDPFRLMGFGHRVYKNYDPRAKIMQKTCHEVLKELNIQDDPLLDIAIELEKIALNDEYFVEKKLYPNVDFYSGITLKALGFPTE

SEQ ID NO: 60187 - protein, 411 aa, Rickettsia australis
DSEFAELKIRGKIFKLPILKASIGEDVIDISRVSAEADCFTYDPGFMSTASCQSTITYIDGDKGILRHRGYNIKDLAEKSDFLEVAYLLIYGELPTIEQYNNFTTQVAHHSLVNERLHYLFQAFCSSSHPMAIMLAAVGSLSAFYPDLLNFKEADYELTAIRMIAKIPTIAAMSYKYSIGQPFIYPDNSLDFTENFLHMMFATPCTKYKVNPIIKNALNKIFILHADHEQNASTSTVRIAGSSGANAFACISTGIASLWGPAHGGANEAVINMLKEIGSSENIPKFIAKAKDKNDPFRLMGFGHRVYKNYDPRAAVLKETCKAVLKELGQLENNPLLQIAIELEAIALKDEYFIERKLYPNVDFYSGIIYKAMGIPSQMFTVLFAIARTVGWMAQWKEMHEDPEQKISRPR

SEQ ID NO: 60188 - protein, 411 aa, Rickettsia canadensis
DSEFVELKIRGKIFKLPILKASIGEDVIDISRVSSEADCFTYDPGFMSTASCRSTITYIDGDKGILRYRGYDIKDLADKSDFLEVAYLLIYGELPSSEQYNNFTKKVAVHSLVNERLHYLFQTFCSSSHPMAIMLAAVGSLSAFYPDLLNFKEADYELTAIRMIAKIPTMAAMSYKYSIGQPFIYPDNSLDFTENFLHMMFATPCMKYEVNPVIKNALNKIFILHADHEQNASTSTVRIAGSSGANPFACISTGIASLWGPAHGGANEAVINMLKEIGSSENIPKYIAKAKDKDDPFRLMGFGHRVYKNYDPRAAVLKETCNEVLKELGQLENNPLLQIAIELEAIALKDEYFIERKLYPNVDFYSGIIYKAMGIPSQMFTVLFAIARTVGWMAQWKEMHEDPEQKISRPR

SEQ ID NO: 60189 - protein, 295 aa, Pasteurella multocida subsp. multocida str. Pm70
MNTILGSDTVKRGMAQMQKGGVIMDVVNAEQARIAEAAGAVAVMALERVPSDIRAAGGVARMANPKIVKEVMNAVSIPVMAKARIGHITEARVLEAMGVDYIDESEVLTPADDEFHLLKCEFTVPFVCGCRDLGEALRRIGEGASMLRTKGEPGTGNIVEAVRHIRKVNAQIRKVVAMNHDELMTEAKNLSAPFELLLQIKALGKLPVVNFAAGGVATPADAALMMELGADGVFVGSGIFKSEHPEKFAKAIVQATTHYQDYDLIARLSEELGEPMKGIEISRLQQHERMQERGW

SEQ ID NO: 60190 - protein, 316 aa, Cryptococcus neoformans var. neoformans JEC21
MNGQVVKINLPDRLVIMANHQAYLDWIYIWILACYAGHSAGLIILLKASLKNIPVIGWGMRFFNFIFLRRSWVADRDNLTLALRQLGQEAQSGQENSETATLLPLRKRSPLWLLIFPEGTIISDEERVKSIKYAKKEGVDDFATLLHPRSTGLLFCLRTLLPQIPDLNLLDITIGYPGVPFGNYPQNWYGLFSVFLKSVPPPTVYLHLHVYSHLGEPECKIPSLVPRRSSNVSGLSTDSGLANAEEARAFELWLRNLWTAKERRMEQFYESQRFGGPCDIVPIQQIKWYHWISAIGGGGLGTVVLLAFCIWFAVCR

SEQ ID NO: 60191 - protein, 446 aa, Nocardia farcinica IFM 10152
MDRQKEFVLRTLEERDIRFVRLWFTDVLGYLKSVAIAPAELEGAFEEGIGFDGSAIEGFARVSEADMVARPDPSTFQVLPWATSKGHQHSARMFCDITMPDGSPSWADPRHVLRRQLNKAGDVGFSCYVHPEIEFFLLENGPQDGSPPRPADSGGFFDQAVHDAAPNFRRHAIDALESMGISVEFSHHEGAPGQQEIDLRYADALSMADNVMTFRYLIKEVAIDEGVRATFMPKPFAEWPGSAMHTHMSLFEGETNAFADPDDPDNLSATARAFIAGILEHASEISAITNQWVNSYKRLIHGGEAPTAASWGRSNRSALVRVPMYTPNKASSRRVEIRSPDSACNPYLTFAVLLAAGMRGIEKGYTLPPEAEDDVWSLTSAERRAMGFRELPGTLDEALQAMERSELVAETLGEHVFDFFLRNKRREWADYRSQVTPFELREYLGL

SEQ ID NO: 60192 - protein, 419 aa, Cryptococcus neoformans var. neoformans JEC21
MAQKPLYTIPINDRPPHGPWTSKILFPVIFTLAQLSINSAQFLLVPLLLVPFVGKRLFSRAIGWTKDGYGRLLIAITVLFGPTQFAITTDTPPPHGQTLVERDMNGQVVKINLPDRLVIMANHQAYLDWIYIWILACYAGHSAGLIILLKASLKNIPVIGWGMRFFNFIFLRRSWVADRDNLTLALRQLGQEAQSGQENSETATLLPLRKRSPLWLLIFPEGTIISDEERVKSIKYAKKEGVDDFATLLHPRSTGLLFCLRTLLPQIPDLNLLDITIGYPGVPFGNYPQNWYGLFSVFLKSVPPPTVYLHLHVYSHLGEPECKIPSLVPRRSSNVSGLSTDSGLANAEEARAFELWLRNLWTAKERRMEQFYESQRFGGPCDIVPIQQIKWYHWISAIGGGGLGTVVLLAFCIWFAVCR

SEQ ID NO: 60193 - protein, 385 aa, Triticum aestivum
MEGGGARNVSAAAAQTEGSGDDGSRKPLPPCCVKAQAAVAESEAKCHATVVSGWFTGTRSRSGKPSKARYFNNPMWPGEAHSLKVEKILYQGKSPYQEVLVFESSTYGNVLVLDGIVQLTDKDECAYQEMVTHLALCSIPSPKNVLVVGGGDGGVLREIAKHDSVETIDICEIDQLVIDVCKDFFPRLYVGYKDPRVRLHVGDAVEFLRNSPEGKYDAIIVDSSDPIGPAQELVEKPFFQTIARALKPGGVLSNLAESMWLHTHLIQDMLSICREVFKGGVHYAWASVPTYPSGVIGFLLCAKDGPPVDFLTPVNPIEKIEGATKDGREMRFYNSEIHRAAFILPTFVKRELEAYSTSTEKEKPEKPTAKPVKMKVMRDSAITAS

SEQ ID NO: 60194 - protein, 298 aa, Arabidopsis thaliana
MAIPVTRMMVPHAIPSLRLSHPNPSRVDFLCRCAPSEIQPLRPELSLSVGIHAIPHPDKVEKGGEDAFFVSSYRGGVMAVADGVSGWAEQDVDPSLFSKELMANASRLVDDQEVRYDPGFLIDKAHTATTSRGSATIILAMLEEVGILKIGNVGDCGLKLLREGQIIFATAPQEHYFDCPYQLSSEGSAQTYLDASFSIVEVQKGDVIVMGSDGLFDNVFDHEIVSIVTKHTDVAESSRLLAEVASSHSRDTEFESPYALEARAKGFDVPLWKKVLGKKLTGGKLDDVTVIVAKVVSS

SEQ ID NO: 60195 - protein, 142 aa, Solibacter usitatus Ellin6076
MRNLCAILILLALPLAAERKVINPPEFGAGSPNFSTAVLADGTLYIAGQVGQDLKTKQVPADFESEVKLLLTNIGIVLKAAGMSYKDAVSVQVYLTDMDLFARMNGVYTTFFPEPRPARTTVGVTKLALPNAHIEITVTARK

SEQ ID NO: 60196 - protein, 540 aa, Prochlorococcus marinus str. AS9601
MSKISSKNIKRLSVPQSPVVLAILDGWGYRKEKSDNAIKSARTPIMDSLWHAYPHTLISASGSDVGLPDGQMGNSEVGHLTIGSGRIIQQELVRISNIVKKNQLSLVNELREMADSLKKNNSTLHITGLCSDGGVHSHIEHLLGLIKWASDNEIKKVAIHIITDGRDTPAKSASKYLNQIESCIKKFNTGEIASICGRYWIMDRNLLWDRTEKAYANLTDPDIQITNISPQDYIDKSYAKNITDEFIEPIRISENYLKDGDSLICFNFRPDRARQIIKALSIKEFSDFERKNYPNLDLVTFTQYDQNFPVKVAFPPESLNNFIGQIVSENGLKQYRTAETEKYPHVTYFFNGGVEIPLPGEERHLIPSPRVATYDLEPEMSAEELTISCSKAIKSGNYSFVVINFANPDMVGHTGNMDATIKAIEKVDKCIGKIVNATGEMGGSILITADHGNAEVMKGPEGEPWTAHTINKVPLILIEGEKRKIPNMGNQINLRDNAGLADIAPTLLQLLNLPIPTEMTGKSLIQEIELKGYNKVVQHV

SEQ ID NO: 60197 - protein, 473 aa, Zymomonas mobilis subsp. mobilis ZM4
MSSESSQGLVTRLALIAAIGGLLFGYDSAVIAAIGTPVDIHFIAPRHLSATAAASLSGMVVVAVLVGCVTGSLLSGWIGIRFGRRGGLLMSSICFVAAGFGAALTEKLFGTGGSALQIFCFFRFLAGLGIGVVSTLTPTYIAEIAPPDKRGQMVSGQQMAIVTGALTGYIFTWLLAHFGSIDWVNASGWCWSPASEGLIGIAFLLLLLTAPDTPHWLVMKGRHSEASKILARLEPQADPNLTIQKIKAGFDKAMDKSSAGLFAFGITVVFAGVSVAAFQQLVGINAVLYYAPQMFQNLGFGADTALLQTISIGVVNFIFTMIASRVVDRFGRKPLLIWGALGMAAMMAVLGCCFWFKVGGVLPLASVLLYIAVFGMSWGPVCWVVLSEMFPSSIKGAAMPIAVTGQWLANILVNFLFKVADGSPALNQTFNHGFSYLVFAALSILGGLIVARFVPETKGRSLDEIEEMWRSQK

SEQ ID NO: 60198 - protein, 536 aa, Oryza sativa
  misc_feature (372)..(372): Xaa can be any naturally occurring amino acid
MVLGGWLLMWAPASSPTILVAFGLLFGLVLAWQAGLQLHRLWWRPRRLEKALRARGLRGSSYRFLTGDLAEESRRRKEAWARPLPLRCHDIAPRIEPFLHDAVVRPEQHYGKPCITWLGPTPEVHVTDPELAKVVMSNKFGHFEKIRFQALSKLLPQGLSYHEGEKWAKHRRILNPAFQLEKLKLMLPVFSACCEELISRWMGAIGSDGSYEVDCWPELKSLTGDVISRTAFGSSYLEGRRIFELQGELFERVMKSVEKIFIPGYMYLPTENNRKMHQINKEIESILRSMIGKRMQAMKEGESTKDDLLGILLESNMRHTEENSQSSQGLTIKDIMEECKLFYFAGADTTSVLLTWTILLLSMHPEWQDRAXRKEILGLFGKNKPEYDGLNNLKIVTMILYEVLRLYPPFIELKRRTYKEMKIGGVTYPAGVIINLPVLFIHHDLKIWGSDVHEFKPERFSEGISKASKDPGAFLPFGWGPRICIGQNFALLEAKMALCLILQRLEFELAPTYTHAPHTMITLHPMHGAQIKIRAI

SEQ ID NO: 60199 - protein, 324 aa, Zymomonas mobilis subsp. mobilis ZM4
MEIVAIDIGGTHARFSIAEVSNGRVLSLGEETTFKTAEHASLQLAWERFGEKLGRPLPRAAAIAWAGPVHGEVLKLTNNPWVLRPATLNEKLDIDTHVLINDFGAVAHAVAHMDSSYLDHICGPDEALPSDGVITILGPGTGLGVAHLLRTEGRYFVIETEGGHIDFAPLDRLEDKILARLRERFRRVSIERIISGPGLGNIYEALAAIEGVPFSLLDDIKLWQMALEGKDNLAEAALDRFCLSLGAIAGDLALAQGATSVVIGGGVGLRIASHLPESGFRQRFVSKGRFERVMSKIPVKLITYPQPGLLGAAAAYANKYSEVE

SEQ ID NO: 60200 - protein, 403 aa, Zea mays
MASSMLSATTVPLQQGGGLSEFSGLRSSASLPMRRNATSDDFMSAVSFRTHAVGTSGGPRRAPTEAKLKVAINGFGRIGRNFLRCWHGRGDASPLDVIAINDTGGVKQASHLLKYDSTLGIFDADVKPVGDNAISVDGKVIKVVSDRNPSNLPWGELGIDLVIEGTGVFVDREGAGKHIQAGAKKVLITAPGKGDIPTYVVGVNADQYNPDEPIISNASCTTNCLAPFVKVLDQKFGIIKGTMTTTHSYTGDQRLLDASHRDLRRARAAALNIVPTSTGAAKAVSLVLPNLKGKLNGIALRVPTPNVSVVDLVVQVSKKTLAEEVNQAFRDAAANELTGILEVCDVPLVSVDFRCSDVSSTIDASLTMVMGDDMVKVISWYDNEWGYSQRVVDLADICANQWK

SEQ ID NO: 60201 - protein, 405 aa, Pisum sativum
MASATFSVAKPAIKANGKGFSEFSGLRNSSRHLPFSRKSSDDFHSLVTFQTNAVGSSGGHKKSLVVEAKQLKVAINGFGRIGRNFLRCWHGRKDSPLDVIAINDTGGVKQASHLLKYDSTLGIFDADVKPVGTDGISVDGKVIKVVSDRNPANLPWKELGIDLVIEGTGVFVDREGAGRHITAGAKKVLITAPGKGDIPTYVVGVNADAYTHADDIISNASCTTNCLAPFVKVLDQKFGIIKGTMTTTHSYTGDQRLLDASHRDLRRARAAALNIVPTSTGAAKAVALVLPTLKGKLNGIALRVPTPNVSVVDLVVQVSKKTFAEEVNEAFRESAAKELTGILSVCDEPLVSVDFRCTDVSSTVDSSLTMVMGDDLVKVIAWYDNEWGYSQRVVDLADIVANNWK

SEQ ID NO: 60202 - protein, 232 aa, Bacillus thuringiensis serovar konkukian str. 97-27
MIYSCYPIIIFRENREMTNNNQIGENKEQTIFDHKGNVIMTEDREIQIISKFEEPLIVVLGNVLSDEECDELIELSKNKLARSKVGSSRDVNDIRTSSGAFLDDNELTEKIEKRISSIMNVPASHGEGLHILNYEVDQQYKAHYDYFAEHSRSAANNRISTLVMYLNDVEEGGETFFPKLNLSVHPRKGMAVYFEYFYQDQSLNELTLHGGAPVTKGEKWIATQWVRRGTYK

SEQ ID NO: 60203 - protein, 154 aa, Zea mays
MATTKDPATTGGEPAIGIPYHPAAEAQGHYYYAPPPNPYAAGMPPPNAIYAGAPKGVPLQQTMFRDTPAPFHCQACGEAAVSSVRSKPSLASVVACMMPFMLGVCFLCPSMDCLWHKYHYCPSCGEKVGEFRKSDPCLVVDATRWSEPSFAVPA

SEQ ID NO: 60204 - protein, 232 aa, Mucor circinelloides
RSLKVNKVNHPVSLSFDEEGLRIEGDFNAAKNSKNTKTVCCIPVPAGKGPDPTLLPIDNVYILNAFYHERTRMIQIHCVLPEDRTVDESPADIYKFIYSVDDDKKEDAVAFCEELVKQAYTDIKFGKKLLVLINPFGGQGKAKEIFEYHVRPIFESPKCDIEVRYTEHQGHALHIAQDLDIHAYDAIVTVSGDGVIHEVINGFLKRPDAREAMQQVAIGIIPGGTGNSLIIS

SEQ ID NO: 60205 - protein, 458 aa, Mesorhizobium loti MAFF303099
MRHQILSNRSGEDLRASDLAHHLHPFTDHTVLAAEGGPRVIKDGDGIYVWETEGRRLLDGMAGLWCVNVGYGRKELGEVARQQMDRLAFYNTFFKTSHEPVINLAERLAAVTPEGIDNFFFGNSGSEANDTAIRLVRSYWAAVERPERQVVISREYAYHGSTLAGASLCGLPGMHGVAGLPIPGIAHAAAPYAWAAGKDQDDPAYGRASADALEAKILEIGPKNVAAFIGEPVMGAGGVITPPPRYWARVQEICRKYDILLVCDEVICGFGRTGEWFGAQSFGIAPDIMCMAKGLSSGYIPISAVGVGTRVAEILRTRPGVLSHGFTSSGHPVAAAVALKNIELIEAEGLVNHVRDVAGPALARRLGALAMHPLVGQVRGIGAMWALELTSDKATRAPFAPLGSVATRVRNLCFERGLATRAVREGLVFAPPLIITEAQVDEMADILTSCLDTAVAEL

SEQ ID NO: 60206 - protein, 440 aa, Mesorhizobium loti MAFF303099
MSHVFHRSALSVPPMAVAADGHYIIDINGRRYLDASGGAAVSCIGHGDPRVVAAVAEQIARLDYAHSGAFTSPSAEELAAHICAEAGQGMARVYFVGSGSEAVEAAIKMARQCQIERRQPSRHVVISRRLSYHGNTLGALGRSGSETRRAPYAPMLQKRTQIAPCFPYHYAEPGETPEAYGLRAAEALEAEILRLGSENVAAFLAETVVGATSGAVVPATGYFRHIREICDRYGVLLICDEVMCGAHRTGPFLACSDEGVSPDIVTLAKGLGGGYLPIGAVVCRADVHDSFAQGSGAFTHGHTYMAHPVACAAALEVQRVIVDDRLAERVVRQGALLDAALRDRLSQHTYVGDIRGRGLLYAVELVADRETRVSFDPEMRLAARIGAQAKGRGLLVYPGSGTIDGLRGDHVLLAPAYSIDAQRVGEIADILTEAIDAALG

SEQ ID NO: 60207 - protein, 237 aa, Brassica napus
MGYWNSKVVPRFKKIFEKNSAKKAAAAEACKTFDESKETINKEIEEKKTELQPKVVETYEATSAEVKALVRDPKEAGLKKNSAAVLKYLEALVGIEFPGSTAVKEAASSFGAGYVSGPVTFIFEKVCVFLPEEVKTREVPVEEVKAEEPAKTEEPVKTEETSGEKEKEIVEETKKEETVATAVVEEKKPEVEKEEEKKPVVEEVKKEEAAPAPAVVETPVTAPETTTPAPVAEPPKP

SEQ ID NO: 60208 - protein, 422 aa, Deinococcus radiodurans R1 [sequence omitted]

SEQ ID NO: 60209 - protein, 144 aa, Triticum aestivum
MAQGTLEVLLVGAKGLENTDYLCNMDPYAVLKCTSQEQKSTVASGKGSDPEWNETFVFTVSENATELVIKLLDSDGGTDDDSVGEATIPLDGVYTEGSIPPTVYNVVKDEEYRGEIKIGLTFTPEEARDQDQPEENYGGWNQSS

SEQ ID NO: 60210 - protein, 279 aa, Nocardia farcinica IFM 10152
MSQTKDGSFEGTGSRIAWRAWLPDGPARAAIVLVHGVAEHSGRYVHVGTRLADAGYAVYALDHVGHGKSAGGKANIGSLDGAADNVAGMLDIAAREHPGVPRFLLGHSMGALIVLYLATRAPIDVAGVVVSAPPLEIPVGNPLQKLLAPVLTRLTPNLGVLQLDSSSISRDPAVVAAYDADPLVYRGKLPARTATEILDGSLTVKRRLGKLTVPTLVLHGTADTLAAPSSADLIERGAAAEDLTVHRYDGLYHEVFNEPEKETVFADLERWLQDHLTTQ

SEQ ID NO: 60211 - protein, 478 aa, Nocardia farcinica IFM 10152
MTFSTADEVIQYIKEQDIEYIDIRFSDLPGVQQHFSIPAKAFTADLAEEGLAFDGSSVRGFQSIDESDMLLLPDYSTARIDPFRAAKTLNMNFFVHDPFTREAYSRDPRNIARKAEEYLRSTGIADTAFFGPEAEFYIFDSIRYESNMNGAFYEIESISGSWNTGAEFNPDGTLNRGYKVRNKGGYFPVAPYDHYVDLRDKISTKLQDAGFELERGHHEVGTAGQAEINYRFNTLLHAADDLQLFKYIVKNTAWQEGKTVTFMPKPLFGDNGSGMHVHQSLWKDGKPLFHDEAGYGGLSDLARHYIGGILHHAPSLLAFTNPTVNSYHRLVPGYEAPINLVYSQRNRSAAVRIPVTGNNPKAKRIEFRAPDSSGNPYLAFAAMLMAGLDGIKKKIEPLAPVDKDLYELPPEEAKNIPQAPTSLASVIDRLEQDHEYLTEGNVFTEDLIETWIQLKRDNEIAPVNLRPHPYEFELYFDV

SEQ ID NO: 60212 - protein, 446 aa, Legionella pneumophila str. Paris
MEIKRVLKDRLSARVCVIGAGPSGIAAIKNLQEHGITNVTVFEKNNQIGGNWVYDEQNEHSSVYETTHIISSKRWSEFEDFPMPVDYPDYPSHSQLLKYFQSYVEHFHLDRYIRFNTVVQKVHRLDDNTWHVIYEDAQGIHEACYDYLLVANGHHWDPFMPVYPGVFDGEILHSHQYKKASIFKGKRVLVVGGGNSACDVAVEISRVAPGTCISMRRGYHIFPKFIFGKPTDVAVAKIQWMPSWLRQKFISLVIRGLQGRYAKYKLMKPDCGPLEIHPTINSELLYFIRHGKIHPRSGISRFEGNTVHFTDRTQGEFDTIIFATGYQISFPFFDKSCIDFSNSTTIPLYRKMMHPEFENLYFIGLCQPQGCIWPLADYQSKIVARIIAGTLKRPDQLHRKIAKEINKPHHRFKSHMRHALEVDYHIFRKELLEMLGQKHKRLKFYP

SEQ ID NO: 60213 - protein, 196 aa, Cichorium intybus x Cichorium endivia
GHNNLNAKFVLLGDMGAGKSSLVLRFVKGQFLEFQVSTIGAAFFSQTLAVNDATVKFEIWDTAGQERYHSLAPMYYRGAAAAIIVYDITSADSFTRAKKWVQELQKQGNPNMVMALAGNKADLEDKRKVTAEEARVYAEENGLFFMETSAKTAANVNDVFHEIAKRLPRAQPTQNPAGMVLVDRPAEGARAASCCS

SEQ ID NO: 60214 - protein, 446 aa, Thermus thermophilus HB27
MGYTKAEILKALKGENVKFLRLQITDILGVVKNVEVPESQFEKALDGEIMFDGSSIEGFTRIEESDMLLRPDYNTFVILPDLVEDPKRGRVARLICDVYYPDGRPFEGDPRYVLKRQIERLKKLGFDNLYAGPEPEFFLFLRTPEGLPTTETHDRAGYFDLAPIDKGEEARRDMVNALVAMGFEIEAAHHEVAPGQHEIDFKYADALTTADNIATFKWVVKRIALNHGLHATFLPKPIRGINGSGMHTHLSLFKDGENAFYDPNAEYQLSQTALHFIAGLLEHAAGMVAVTNPLVNSYKRLTPGYEAPTNIAWSASNRSAMIRIPARRGVGTRAELRMPDPSCNPYLALAVMAAAGADGIERKLLPPPPIQRNIYQMTVRERRKHKIRELPGTLREALEALRKDPVIREALGEHVYTHFLQAKQMEWDDYRVTVHQWELDRYLATY

SEQ ID NO: 60215 - protein, 480 aa, Glycine max
MSTQNRRSSFSSSTTSSLAKRHVSASTTSSSLAAPANMAKKRPPLSNLTNTVAHRNSSSLVPCAAKFAKTKKEVVPACSGNKRPTLANVKPTSAAIFPKANSFPVRDEAPPPVATVTVPAPVVDVSPSKSDAMSVSMDESMSSCDSFKSPDIEYVDNIDVAAVDSIERKTFSNLNISDSTEGNICSRDILVELEKGENFVNVDNNYADPQLCATFACDIYKHLRASEAKKRPSTDFMEKIQKEINSSMRAILIDWLVEVAEEYRLVPDTLYLTVNYIDRYLSGNVMNRQRLQLLGVASMMIASKYEEICAPQVEEFCYITDNTYFKEEVLQMESAVLNFLKFEMTAPTVKCFLRRFVRAAQGVDEVPSLQLECLTNYIAELSLMEYSMLGYAPSLVAASAIFLAKFILFPSKKPWTSTLQHYTLYKPSDLCVCVRDLHRLCCNSPNSNLPAIREKYSQHKYKYVAKKYCPPSIPPEFFQN

SEQ ID NO: 60216 - protein, 295 aa, Mycobacterium smegmatis str. MC2 155
MGSRTASLGGKVVFITGGGAGVGAEVSRRLYRKGAKLMLVDVDADALKAHADTLGEDVATAVADVRDLAAMKAAADAAVERFGGIDVVVANAGVASYGSVQQVDPEAFKRLLDINVLGVFHTVRATLPSVIERRGYVLIVSSLAAYAASPGLAPYNASKAAVEQFANALRLEVAHRGVDVGSAHMSWIDTAMVNDSKADLSTFGEMLSKLPPPLSSTTSVSACGEAFVKGIERRARRINCPGWVEAFRWLKPILSTRLGELPVLRFVPDLLPRMDAEVAALGRSSSAHTESIEKR

SEQ ID NO: 60217 - protein, 154 aa, Brassica napus
REWTRDWLEQEYISPYEDVSRLDQASKEMEKRTVGVFHELLSLSLLKRVPVPILGKFCEEFRFSNAFSSVFTRHSGVFYLSLKGGIKTAVLRQAYKDEELVDRDPLLAIKDKFLGLLEEGWEERKDRLKMQRERVEKDREIAKKQQEPEERLCE

SEQ ID NO: 60218 - protein, 396 aa, Ehrlichia sp. EHt224
KVKLPVLCDTNGNKVVDITSLYKSTGILTYDPGFMSTAACESKITFIDGSKGILCYRGYNIADLVNSNKSFIEIVYLLFYGSFPSVDDFKDFMLQISQEYMPPKMICDVIKSFSQDAHPMTILMACFSGLASYYNNQQHCENELKYARLAVSQIAGIIAMIYRHITDQDFIQANTELSYSENFIHMMFDISSYEFTKIVSKALDIIFILHADHEQNASTATVRLTGSTGANLFACLAAGAATLWGPAHGGANEAVINMLMEIEQPSNVKQFVQKVKDKNNGIRLMGFGHRVYKNYDPRAKIICEICKEVLKDLKVSHPLLEIALELENIALQDSYFIERNLYPNVDFYSGIVLKAIGIPVSMFTTLFALARTSGWSAQWYEMIKDKNYKICRPRQL

SEQ ID NO: 60219 - protein, 127 aa, Gibberella zeae PH-1
MSKLYVGNLSWNTTDETLRQTFSEFGEVTDSIIMRDRDTGRARGFGFVTFSTEEQATAAVDALNEQELDGRRIRVNVANARPAGGNGGGFGGGRGGGYGGGRGGYGGGDRSYGGGDRSYGGGDRGGY

SEQ ID NO: 60220 - protein, 202 aa, Triticum aestivum
  misc_feature (75)..(75): Xaa can be any naturally occurring amino acid
  misc_feature (109)..(109): Xaa can be any naturally occurring amino acid
  misc_feature (117)..(117): Xaa can be any naturally occurring amino acid
  misc_feature (146)..(146): Xaa can be any naturally occurring amino acid
MAPTVMASSATSVAPFQGLKSTAGLPVSRRSNGASLGSVSNGGRIRCMQVWPIEGIKKFETLSYLPPLSTEALLXKQVDYLIRSKWVPCLEVQARLGSSSREHNASPGXYYDGRYWXTMWKAALCSGCTDATQVINEVEESKKDYXDAYFRIIGFDNMLKGMRQLNASSNGCKNPARLNHHEGILMHSFVIILGSSITMSKK

SEQ ID NO: 60221 - protein, 392 aa, Nicotiana tabacum
NSSLQVSNKGFSEFSGLRTSSAIPFGRKTNDDLLSVVAFQTSVIGGGNSKRGVVEAKLKVAINGFGRIGRNFLRCWHGRKDSPLDVIAINDTGGVKQASHLLKYDSTLGIFDADVKPVGTDGISVDGKVIQVVSDRNPVNLPWGDLGIDLVIEGTGVFVDREGAGKHIQAGAKKVLITAPGKGDIPTYVVGVNADLYNPDEPIISNASCTTNCLAPFVKVLDQKFGIIKGTMTTTHSYTGDQRLLDASHRDLRRARAAALNIVPTSTGAAKAVALSSQALRGSSMALPLRVPTPNVSVVDLVVQVSKKTFAEEVNAAFREAADKELKGILDVCDEPLVSVDFRCSDVSSTVDASLTMVMGDDMVKVIAWYDNEWGYSQRVVDLADIVANQWK

SEQ ID NO: 60222 - protein, 1080 aa, Xylella fastidiosa 9a5c
MPKRTDLRTILIIGAGPIVIGQACEFDYSGAQACKALRAEGFRVVLVNSNPATIMTDPDMADAVYIEPIHWRTVEKIIAKEKPDALLPTMGGQTALNCALDLADHGVLEKYGVELIGAKREAIRMAEDRELFRVAMQEIGLECPKAEVAKSLERALEIQAKVGFPTIIRPSFTLGGTGGGITYNRQEFEEIIKRGLELSPVHEVLVEESVLGWKEFEMEVVRDASDNCIIVCSIENLDPMGVHTGDSITVAPAQTLSDKEYQRLRDASIAVLRKIGVDTGGSNVQFGIDPQTGRVVVIEMNPRVSRSSALASKATGFPIAKIAAKLAVGYTLDELKNEITGGKMPASFEPSIDYVVTKIPRFAFEKFPQADARLTTQMKSVGEVMAMGRTFAESLQKAVRGLETGKVGLEPTGLDLSSEDDLVVLKRELKAPGAERLFYVADAFRAGFAVADVYALSYIDPWFLDQIEEIVAAEGRLVTDGLGSIDGARLRQLKRIGFSDARIAQLTGTNEVAVRALRRVLKVKPVYKRVDSCAGEFATGTAYLYSTYEEECEAAPSDRRKIMILGGGPNRIGQGIEFDYCCVHAALALREDGFETIMVNCNPETVSTDYDTSDRLYFEPLTLEDVLEIVEVEHPVGVIVQYGGQTPLKLAKALEANGVPVIGTSPESIDLAEDRERFQKLVQQLGLRQPPNCTARTAEEALVLAREIGYPLVVRPSYVLGGRAMEIVYGEADLARYVRDAVKVSNDSPVLLDRFLDNAVEVDVDIIADREGQVLIGGVMEHIEEAGVHSGDSSCSLPPYSLSAATQDDLRRQVIRLAQALNVIGLMNTQFAIQSNDDGSDIVYLLEVNPRASRTVPFVSKATGVPLAKIAARCMTGKTLVEQSVTCEVVPAYYAVKEAIFPFAKLQGVDPILGPEMRSTGEVMGVGRSFAAAFARAQEAGDIRAPQPGRAFVSVRDPDKKRVLPVVLALVERGFGVVATAGTYAWLQQNGVACEVVNKVAEGRPHVVDLIKNGEIVYIINTTEGRAAIADSFSIRREALQHCVTYSTTIAGAKALVNSLEFRGTGPVWSLQELHKELQV

SEQ ID NO: 60223 - protein, 193 aa, Oryza sativa (japonica cultivar-group)
MAKLSCLLIVSFAVVAALAATDDDAAAAAEGITVAEASSDPENKCVYTIYVRTGTIWKGGTDSVIGVTLLGADGSGVRIRDLERWGGLMGDGHDYYERGNLDIFSGRGPCMRQAPCRMNLTSDGTGPHHGWYCNYLEATVTGPHLGCAQQLFTVEQWLATDASPYRLYAVVDNCNKAKDAAAADADEPRVTVL

SEQ ID NO: 60224 - protein, 870 aa, Aspergillus nidulans FGSC A4
MAAFPAHQRCSKTVVNKPGTNSKDLKAFAKRTSHASLTVISSAQSSELAARLLPTGRAMDGPPGLSGASPATPATISDLVKHSHEPPDHVMAFDYTEQLLTPENSRSETSSNNDNASNEEKPTVRRQSTRVTRASLRGAADLDFGAEIEHNGHKHSAETTEHVVLDKPPDNGAAPRGKNPRASHLRHSIAIMESALQAETSLTQDAMDVDNHPLAPNTPISESSHGSHTDDVPAALPPRTLRKRVEQALARDKGYGSEKDSKPASADNETPVRRSSRLSLLGKVSDLAGRATGVLGKRSTSMRENAKEPDRRSSLRPRRSTTAREEPPAEPPTKKQRVSVSAPVDKAKSESDASQEEPTPPEVITRFKEKRWLTHGLYSGQEYTNLRPSQKRTEKRRKSHNTSQPNHQRKYLPLPMFAGERLLQTGRDFQLPFDIYSPLPPGQPKPNEWRKTNKNVFVGEAGSIWRANKEEELSKCTCMPETGCDQFCQNRYMFYECDDRICGVGPECGNRNFEELKQRAKAGGKYNVGVEVIKTPDRGYGVRSNRTFEPNQIIVEYTGEIITQAECEKRMRTIYKKNENMIIDATRGSIARFVNHGCEPNCRMEKWTVAGKPRMALFAGDRGIMTGEELTYDYNFDPYSQKNVQQCRCGSSKCRGILGPRKREKEQRAELRAAKLKEIADAKKAKAAKRRKENALKRSRPRNNRKGRALAPSSIKSGVKKAASKARGAVSRKMPAAATSSKKSASKKSTNASKQTSTKSKRNIRLPTIKAPKVKAKITSRVRAPAQTTRTKVKKASTSPPKSRSRVSATKTTKAATAAESSPARKRPLKAKKDILNGVRETINKGTTKHSQRAKSSSSRTTGRSPRARK

SEQ ID NO: 60225 - protein, 451 aa, Pisum sativum
MATHAALASTRIPTNTRFPSKTSHSFPSQCASKRLEVGEFSGLKSTSCISYVHSARDSSFYDVVAAQLTSKANGSTAVKGVTVAKLKVAINGFGRIGRNFLRCWHGRKDSPLEVIVVNDSGGVKNASHLLKYDSMLGTFKAEVKILNNETITVDGKPIKVVSSRDPLKLPWAELGIDIVIEGTGVFVDGPGAGKHIQAGAKKVIITAPAKGADIPTYVIGVNEQDYGHEVADIISNASCTTNCLAPFAKVLDEEFGIVKGTMTTTHSYTGDQRLLDASHRDLRRARAAALNIVPTSTGAAKAVSLVLPQLKGKLNGIALRVPTPNVSVVDLVVNVAKKGISAEDVNAAFRKAAEGPLKGILDVCDVPLVSVDFRCSDVSTTIDSSLTMVMGDDMVKVVAWYDNEWGYSQRVVDLAHLVANKWPGTPKVGSGDPLEDFCETNPADEECKVYE

SEQ ID NO: 60226 - protein, 451 aa, Spinacia oleracea
MASHAALAPSRIPASTRLASKASQQYSFLTQCSFKRLDVADFSGLRSSNSVTFTREASFHDVIAAQLTTKPTGAAPVRGETVAKLKVAINGFGRIGRNFLRCWHGRKDSPLDVVVVNDSGGVKSATHLLKYDSILGTFKADVKIIDNETFSIDGKPIKVVSNRDPLKLPWAELGIDIVIEGTGVFVDGPGAGKHIQAGAKKVIITAPAKGSDIPTYVVGVNEKDYGHDVANIISNASCTTNCLAPFVKVLDEELGIVKGTMTTTHSYTGDQRLLDASHRDLRRARAAALNIVPTSTGAAKAVSLVLPQLKGKLNGIALRVPTPNVSVVDLVVNIEKVGVTAEDVNNAFRKAAAGPLKGVLDVCDIPLVSVDFRCSDFSSTIDSSLTMVMGGDMVKVVAWYDNEWGYSQRVVDLADLVANKWPGLEGSVASGDPLEDFCKDNPADEECKLYE

SEQ ID NO: 60227 - protein, 438 aa, Nicotiana tabacum
CLSKKFEVAEFAGLRSSGCVTFSNKESSFFDVVSAQLTPKTTRSTPVKGETVAKLKVAINGFGRIGRNFLRCWHGRKDSPLDVVVVNDSGGVKNASHLLKYDSMLGTFKADVKIVDNETISVDGKHIKVVSSRDPLKLPWAELGIDIVIEGTGVFVDGPGAGKHIQAGAKKVIITAPAKGADIPTYVVGVNEQDYSHEVADIISNASCTTNCLAPFVKVMDEELGIVKGTMTTTHSYTGDQRLLDASHRDLRRARAAALNIVPTSTGAAKAVSLVLPQLKGKLNGIALRVPTPNVSVVDLVVNVAKKGITAEDVNAAFRKAADGPLKGVLAVCDEPLVSVDFRCSDVSSTIDSSLTMVMGDDMVKVVAWYDNEWGYSQRVVDLAHLVANNWPGSCSTRKWRSHWMSFARQILLMRNAKSMNNRFCYVSSFEMDDFRSQ

SEQ ID NO: 60228 - protein, 337 aa, Antirrhinum majus
MAPIKIGINGFGRIGRLVARVALQRDDVELVAVNDPFISTDYMTYMFKYDSVHGAWKHHELKVKDEKTLLFGEKPVVVFGRRNPEEIPRASTGAEYIVESTGVFTDKDKAAAHLKGGAKKVIISAPSKDAPMFVVGVNEKEYKSDLHIVSNASCTTNCLAPLAKVINDRFGIVEGLMTTVHSITATQKTVDGPSAKDWRGGRAASFNIIPSSTGAAKAVGKVLPQLNGKLTGMSFRVPTVDVSVVDLTVRLEKKATYEQIKAAIKEESEGKLKGILGYTEDDVVSTDFVGDSRSSIFDAKAGIALNDNFVKLVSWYDNEWGYSTRVVDLIVHMASVQ

SEQ ID NO: 60229 - protein, 490 aa, Oryza sativa (japonica cultivar-group)
MERALDSLTYKGSIPDAILQSRRDNKLFVVYISDPQKAIPSISVIGQNGVMLWCHEGYISSKDLKENIEKAWATLHLQGTAAAFLTASLASRMTEPVNTTPTTLPTQGGSSAAENPSTSSNQSTGTSGASGFANPTDSVAQPPRSTSRDETPSISEKESSNLDSSPGNRTVQERPDSDSAQVKGSLPDHPRSSNIEGCANPVQSGNTASLKQKNKVDDGFTKVSSESVPTRVASRGKSSKVAVDQDKATTTSTPIEPAPVRSNDIQLVVRIPDGPSLQIKLTKDDNLRKVKNFVDENRANGAGSYDLAMLYPRKVFTEQDMEATLHELGIETRQALTIVPHHKTIRAAKRQSSSSPHEGDNNMDADSSGGSGYFGYLRTALSFVNPLSYLRANAAPSNPDQLANQGSPQYRPSTGPWNRPGEDTASESRIPDSARQQAARDTSSGSTLRRRPRQFGGNVHSLRSDDQGPSDDRNVYWNGNSTEFGGEDKK

SEQ ID NO: 60230 - protein, 294 aa, Bacillus licheniformis ATCC 14580
MAQTGTDRVKRGMAEMQKGGVIMDVVNAEQAKIAEEAGAVAVMALERVPADIRAAGGVARMADPTIVEEVMNAVSIPVMAKARIGHIVEARVLEALGVDYIDESEVLTPADEEFHLNKNEFTVPFVCGCRDLGEATRRIAEGASMLRTKGEPGTGNIVEAVRHMRKVNAQVRKVVGMSDDELMTEAKNLGAPYELLKEIKAEGRLPVVNFAAGGVATPADAALMMQLGADGVFVGSGIFKSDNPAKFAKAIVEATTHFTDYKLIAELSKELGTAMKGIEISNLLPEQRMQERGW

SEQ ID NO: 60231 - protein, 397 aa, Magnetospirillum magnetotacticum MS-1
MIVIEEGLPTPLGAHFDGRGVNFALFSQNATRVDLCLFEPGARHEHRTIRLPCRTDDVFHGYLHGLLPGQLYGYRVFGPWDPAAGHRFNPSKLVLDPYAREIAGRIRWHDALYGHRRGGAREDQIDRRDSAPFLPRGVVTRPETPDPIALPASRPLHETVIYEAHVKALTMTHPALSDAERGTYLGLAHPAIIEHLLKLGVTALELLPIQAFADDRFLVEKGLVNFWGYQPYNYFAPEPRYLGDGDASGLRFAIRELAAAGIETLLDVVYNHTAEGDHLGPTLSFRGIDNASYYKLDPDDPRRTVDCTGCGNTLNVAHPRVMRMVLDSLRHWVTAYGVAGFRFDLASSLGRAPLDFSPQAAFFQAVQQDPVLSRVKLIAEPWDIGMGGYRLGGYLNA

SEQ ID NO: 60232 - protein, 341 aa, Magnolia quinquepeta
MGGKKIKIGINGFGRIGRLVARVALQRDDVELVAVNDPFITTDYMTYMFKYDSVHGQWKHHELKVKDSKTLLFGEKPVTVFGVRNPEEIPWGETGAEFVVESTGVFTDKDKAAAHLKGGAKKVIISAPSKDAPMFVVGVNEHEYKSNIDIVSNASCTTNCLAPLAKVINDKFGIVEGLMTTVHSITATQKTVDGPSSKDWRGGRAAGFNIIPSSTGAAKAVGKVLPALNGKLTGMAFRVPTVDVSVVDLTVRLEKAASYEEIKAVIKAESEGKLKGILGYTEEDVVSTDFIGDNRSSIFDAKAGIALNEHFVKLVSWYDNEWGYSSRVIDLILIVHMASCQ

SEQ ID NO: 60233 - protein, 122 aa, Glycine max
  misc_feature (74)..(74): Xaa can be any naturally occurring amino acid
  misc_feature (93)..(93): Xaa can be any naturally occurring amino acid
DIVPFIVWFAIKAFQEQKWIHLILMHVLLGVTLIIPLANAVSLTSWTVVGFFSGFIAYICTQEWCNRCNYVLSXGGLKGEAAFMSILLFLALXKNGFTLNWWGNNHEGCPLANCPSKKGNCS

SEQ ID NO: 60234 - protein, 298 aa, Zea mays
TGRLRYGPDSSSTPRPDTFYLDLLLPLPLHAAVSAPPCAAFDFDPFLLDTLGHRISVLERALALAPPRRKYTYAAEANGRKLKWTAEDRPAGDRNLKWEAELRTPHTDGFDRKWKWESKESATGSTKVKWAKEIKGKGCLEPWSNSYSVEETYGEDDHADDDREKKKPTGVQKKVKGENKQQQKKQGNVEIVEIEDNTAGCVAIRKAFEMNHCKGKRKELSPQDAALLIQMNYRAHLAHRSQVLRCLRDLAVAKAKLKEIRSFFYNITYRRRIAYDNEELQRFAEKIIVLLLTVDALE

SEQ ID NO: 60235 - protein, 196 aa, Cichorium intybus x Cichorium endivia
GHNNLNAKFVLLGDMGAGKSSLVLRFVKGQFLEFQESTIGAAFFSQTLAVNDATVKFEIWDTAGQERYHSLAPMYYRGAAAAIIVYDITSADSFTRAKKWVQELQKQGNPNMVMALAGNKADLEDKREVTAEEARVYAEENGLFFMETSAKTAANVNDVFHEIAKRLPRAQPTQNPAGMVLVDRPAEGARAASCCS

SEQ ID NO: 60236 - protein, 345 aa, Deinococcus radiodurans R1
MTRFILGIDTSCDDTGVGIVELLPGAGPMGGGVKVRANRVLVADVHAQYGGVMPELASREHVERIDSILGDALAEAGLALSDIDAVAATAGPGLVGALLVGLMYGKGLAQALGVPFYAAHHLEGHIFAAASEEQLQAPYLALVVSGGHTHLFDVPHEGDYRLVGATMDDAAGEAFDKVARLCGLGYPGGPAISEAAKKGDPNAVPFKEPLKGQKAFDFSFSGLKTAALLAHKAGAKPEDLAASFERAAVQFLVKTTVRATEHLGRRTVVVSGGVAANRALRDAFAQTGLHVVFPGKGLNTDNGAMIALAGAAAVRAGRAPSPLSVGAEAYAPLTQQRADGEGERA

SEQ ID NO: 60237 - protein, 200 aa, Cichorium intybus x Cichorium endivia
MATIGHNNLNAKFVLLGDMGAGKSSLVLRFVKGQFLEFQESTIGAAFFSQTLAVNDATVKFEIWDTAGQERYHSLAPMYYRGAAAAIIVYDITSADSFTRAKKWVQELQKQGNPNMVMALAGNKADLEDKRKVTAEEARVYAEENGLFFMETSAKTAANVNDVFHEIAKRLPRAQPTQNPAGMVLVDRPAEGARAASCCS

SEQ ID NO: 60238 - protein, 200 aa, Cichorium intybus x Cichorium endivia
MATIGHNNLNAKLVLLGDMGAGKSSLVLRFVKGQFLEFQESTIGAAFFSQTLAVNDATVKFEIWDTAGQERYHSLAPMYYRGAAAAIIVYDITSADSFTRAKKWVQELQKQGNPNMVMALAGNKADLEDKRKVTAEEARVYAEENGLFFMETSAKTAANVNDVFHEIAKRLPRAQPTQNPAGMVLVDRPAEGARAASCCS

SEQ ID NO: 60239 - protein, 205 aa, Schizosaccharomyces pombe
  misc_feature (171)..(171): Xaa can be any naturally occurring amino acid
  misc_feature (185)..(185): Xaa can be any naturally occurring amino acid
  misc_feature (194)..(194): Xaa can be any naturally occurring amino acid
ETHGGVLEFIAEEGRVYLPYWMMTTLSLEPGDLVRVINTDIAQGSYVKLQPQSVNFLDITDHRAVLENALRNFSTLTKSDIFEILYNDQVYQIKVIDVQPDDSRHVVSVVETDLVVDFDPPIGYEESLQKNKQQNIAGVQGTMVTKIGYDELVRQGDSNLMKGTGTKLNGXEVAEVPKINLLDLXNKNSCSVDXTIGLHTSLGIL

SEQ ID NO: 60240 - protein, 355 aa, Callistephus chinensis
MVISANTRVESLATSGSDLIPKEYIRTHDELTTITNIFDEEKSDQGPQVPIIDLHDINSNDPKTRDKCTYELRKAATEWGVMHLVNHGISSDLINRVKAAGKSFFDQPVEEKEKYCNDIASGKIQGYGSKLANNACGQLEWEDYFFHLAFPEEKRDLSIWPTTPHDYIPATTEYAKQLRALATKILAALSLGLGLEEGRLEKEVGGMEELLVQLKINYYPKCPQPDVALGVEAHTDVSALTFILHNMVPGLQLFYGGKWVTAKCVPDSIIMHIGDTIEILSNGKYKSILHRGLVNKEKVRISWAVFCEPPKDKIILKPLPETISEDEPPLFPPRTFQQHMEHKLFRKNNDAVDPK

SEQ ID NO: 60241 - protein, 63 aa, Glycine max
TPYLPDGTCDLAAYDDLVNMQTGHRCRGLIVDGTTGEGPLMIWAERIMHIDHSVNCQSRTCKE

SEQ ID NO: 60242 - protein, 868 aa, Xylella fastidiosa 9a5c
MSASPTAERWIVLKFGGTSVSRRHRWDTIAMVVRKRLEEHGTRVLIVVSALSGVTNELTAIAQGVVDSAQRVAALEQRHRDFLAELGLDAQAVLGTRFTVLWDLLQDARAVTRSLDWQAELLGQGELLSSTLGAAYLGASGVDIGWMDARDWLTALPPQPNQSEWSQRLSVSCQWKSDVEWRTRFDAQRAQVLITQGFISRHQDGGTAILGRGGSDTSAAYFGALLGAACVEIWTDVPGMFSANPKEVPDARLLTRLDYYEAQEIATTGAKVLHPRSIKPCRDTGVPMLILDTERPDVLGTRIDAEVEPVLGVKAISRRDGIVLVSMEGIGMWQQVGFLADVFTLFKKHGLSVDLIGSAETNVTVSLDPSENLVNTDVLTALSTDLSQVCKVKIIVPCAAITLVGRGMRSLLHKLSEVWATFGKERVHMISQSSNDLNLTFVIDETDADGLLAVLHFKLIESGAMPVQERAVFGSPWREIIGHVRTRVMPWWHSARMRLLAMRDEEGIGPCYVYHLPTVRERARQLNAVAAVDQRYYAIKANPHPAILRTLIEEGFGLECVSLGELRHVFAVVPHLVPSRVLFTPSFASRVEYEQAFLLGVNVTLDNVEALRLWPEVFRDRTLWLRIDLGYGDGHHEKVTTGGKTSKFGLSVTRIDEFIDVAKTLNIIVTGLHAHLGSGVERGDHWSRMYDELAGFASRIGSVSTLDIGGGLPIPYRPDDEPFDVEAWGVSLAEVKALHPKLQLVIEPGRFLVAEAGVLLTRVTQVIEKDGIRRVGLEAGMHTLIRPALYDAWHDVENLSRLDEIPHVLCDVVGPICESSDVFGRCRHLPAATASGDLMLIADAGAYGFSMASTYNLRGLPAEVVLDA

SEQ ID NO: 60243 - protein, 337 aa, Mesembryanthemum crystallinum
MAKVKVGINGFGRIGRLVARVILQRDDCELVAVNDPFISTDYMTYMFKYDSVHGQCKSHEIKLKDEKTLLFGETPVAVFGCRNPEEIPWGQAGADFVVESTGVFTDKDKAAAHLKGGAKKVVISAPSKDAPMFVVGVNEHEYKSDLNIVSNASCTTNCLAPLAKVINDRFGIVEGLMTTVHAMTATQKTVDGPSMKDWRGGRAASFNIIPSSTGAAKAVGKVLPALNGKLTGMAFRVPTCDVSVVDLTVRIEKAASYEQIKAAIKEESEGKLKGILGYTEDDLVSTDFIGDNRSSIFDAKAGISLNDNFVKLVSWYDNEWGYSTRVVDLIMHISKCQ

SEQ ID NO: 60244 - protein, 306 aa, Gibberella zeae PH-1
MASVNFSPDTDIPSLNGKVILITGGNSGLGLESTRQLLKHDPAKIFLACRSKAKYDQAIAELQEQGSKTDAVSFLSLNLASLESIKSAVRQFQQESTRLDVLLNNAGIMMTPEGLTEEGYEIQIGTNHMGHAFLTHLLLPVLEETTKINPDVRVICLASMGEAMAPKNPYQFEQFKTTMSNFSTSARYYISKLANVHYAAALAERHPSLKIISIHPGIVQTNLTGPAVSNSLIMGTLTRLFFSVVGVNSSKGALNQLWALSDPKAESGVFYHPVGVTGKGSKLSQNKDARESLWEWTEKEIKQHLS

SEQ ID NO: 60245 - protein, 212 aa, Streptococcus thermophilus CNRZ1066
MVEAIIFDMDGVLFDTEKYYYDRRASFLGQKGISIDHLPPSFFIGGNTKQVWENILRDDYDKWDVSTLQEEYNTYKQNNPLPYKELIFPDVLRVLNEVKSQGLKIGLASSSVKADIFRALEENRLQGFFDIVLSGEEFKESKPNPEIYLTALKQLNVQASRALIIEDSEKGIAAGVAADVEVWAIRDNQFGMDQSAAKGLLDSLTDVLDLIK

SEQ ID NO: 60246 - protein, 410 aa, Alkaliphilus metalliredigenes QYMF
MSNPFQTALSTLKAASEVAGLEPNVVKMLSQPKRIFEFTIPMKMDNGDLEIFTAYRVHYNDALGQTKNGIRFVPNLDLDTVKALGFWMTVKHAVSGIPAGGGKGGIRVDPKKLSEGELERLTRSYIRKLPMKGAWVDIPGADIGTSAKTQGWMLDEYEEIMGFHSPAAINDKPAELNGTVGSMEATGTGAFFVTMEAVKDLSIPKGSTVVIQGFGNVGRIAGRLLHQEGYVVIAVSDISGGIYNPQGLDVEKLEAYVDETGSIKDFPGTTVVSNEALLQLECDILMPSAVQSVITEQNAHNIKTKLIMECANGPTTPAGEAILEKRGIIIVPDVLTNSGSAIVCSFERTQGLTDTYWDIETVNSKLKERIVKAYKETTTTAKDKNTSLRNAAWVNGLTKVAKAMKARGWV

SEQ ID NO: 60247 - protein, 594 aa, Neisseria meningitidis
MALVELKVPDIGGHENVDIIAVEVNVGDTIAVDDTLITLETDKATMDVPAEVAGVVKEVKVKVGDKISEGGLIVVVEAEGTAAAPKAEAAAAPAQEAPKAAAPAPQAAQFGGSADAEYDVVVLGGGPGGYSAAFAAADEGLKVAIVERYKTLGGVCLNVGCIPSKALLHNAAVIDEVRHLAANGIKYPEPELDIDMLRAYKDGVVSRLTGGLAGMAKSRKVDVIQGDGQFLDPHHLEVSLTAGDAYEQAAPTGEKKIVAFKNCIIAAGSRVTKLPFIPEDPRIIDSSGALALKEVPGKLLIIGGGIIGLEMGTVYSTLGSRLDVVEMMDGLMQGADRDLVKVWQKQNEYRFDNIMVNTKTVAVEPKEDGVYVTFEGANAPKEPQRYDAVLVAAGRAPNGKLISAEKAGVAVTDRGFIEVDKQMRTNVPHIYAIGDIVGQPMLAHKAVHEGHVAAENCAGHKAYFDARVIPGVAYTSPEVAWVGETELSAKASGRKITKANFPWAASGRAIANGCDKPFTKLIFDAETGRIIGGGIVGPNGGDMIGEVCLAIEMGCDAADIGKTIHPHPTLGESIGMAAEVALGTCTDLPPQKKK

SEQ ID NO: 60248 - protein, 338 aa, Sinapis alba
MADKKIKIGINGFGRIGRLVARVILQRNDVELVAVNDPFITTEYMTYMFKYDSVHGQWKHNELKVKDEKTLLFGEKPVTVFGIRNPEDIPWGEAGADFVVESTGVFTDKDKAAAHLKGGAKKVVISAPSKDAPMFVVGVNEHEYKSDLNIVSNASCTTNCLAPLAKVINDRFGIVEGLMTTVHSITATQKTVDGPSMKDWRGGRAASFNIIPSSTGAAKAVGKVLPQLNGKLTGMSFRVPTVDVSVVDLTVRLEKAATYDEIKKAIKEESQGKLKGILGYTEDDVVSTDFVGDNRSSIFDAKAGIALSDNFVKLVSWYDNEWGYSTRVVDLIIHMSKA

SEQ ID NO: 60249 - protein, 131 aa, Bacteroides fragilis NCTC 9343
MNVILFDGICNLCNGAVTFVVKRDRKGLFRFVSLQSETGKSLLKRYTVESTNKTLYYFRNNRCYSKSTAILYILKDLGGFWQCLYPLILIPAKLRDAIYLLVSKYRYRIFGKADSCIKPFGFSSEESKRSD

SEQ ID NO: 60250 - protein, 834 aa, Debaryomyces hansenii CBS767
MVNLSSSKFHITEPADEDIQLTLVNGNQKGHEDSCNRSSTPKFGSISRFFFNKEQSVSSDVSNADSTVSSNTDSLNHNHGSKSGVTNSEAREDEHDDAKQQPGLSKLKSFLRLSSNSLLLSNNGPNDNGEQNGPKGTDVITPNAESVTPVRSNEEKTKLKHESDRNEEGHNGNKDGSNVSTKQEASAGMMKKFMLGRKRSVSSPTSPATGNRKPQQSNLLINTESPKDIPEIITENTESPVISSNLYFAHQGLPPHMNNHNKNNHTLAASAANEDDISVALRHNDSVFSLNDGGPLKPPNVYQSKLSASDESGSEHEPIPEHTTESGLKTPEESTLQNKNKLEVPPHTLPHPGQASPFQKTLRRVASAPLVHRLLNDSNTRLPQTRAYVSNDDDFDITEHIGELKSGRPRTLSRGRMYSSASTKIMDAQVNQNSFKKIRLLGKGDVGKVYLVKENLSNRLYAMKILSKKEMIERNKIKRALAEQDILATSNHPFIVTLYHSFQSNDYLYLCMEYCMGGEFFRALQTRETKTISETDAKFYAAEVTAALEYLHLMGFIYRDLKPENILLHQSGHIMLSDFDLSKQSESTKNPEIFFSKTSHGLSSSNNHNGPTLDTKACIDGFRTNSFVGTEEYIAPEVIRGKGHTSAVDWWTLGIFIYEMLFGTTPFKGRDRKKTFGNVLKKEVKFLETRSISSSCKSLIKKLLIKDEAKRLGSKTGASDIKNHAFFKNTQWALLRHQKPPMIPVLSKNKRADKVERYDSEEDQITDSTTDVSENKDILNDPFANFSSVTLHYNELDSGDDQMVYNEADNTVYTSVAYTMTNDSSPKPKHFLKR

SEQ ID NO: 60251 - protein, 259 aa, Bacteroides fragilis NCTC 9343
MNRFENKIIIITGAAGGIGASTTRRIVSEGGKVVIADYSREKADQFAAELSNSGADVRPVYFSATELKSCKELITFTMKEYGQIDVLVNNVGGTNPRRDTNIETLDMDYFDEAFHLNLSCTMYLSQLVIPIMSTQGGGNIVNVASISGITADSNGTLYGASKAGVINLTKYIATQTGKKNIRCNAVAPGLILTPAALNNLNEEVRKIFLGQCATPYLGEPQDVAATIAFLASEDARYITGQTIVVDGGLTIHNPTINLV

SEQ ID NO: 60252 - protein, 355 aa, Solanum tuberosum
MPSIISSQLDLYSIKELPESHAWKSSLDDDGSRNINAESIPVIDLNHDHKFVMDTIGHACKTWGAFQIVNHNISHRLLNHMETHGTRLFSLPMQQKLKAARSSDGIAGYGVARISSFFDKLMWSEGFTIFGSPLEHARQLWPYDYNKFCDVIEEYENEMEKLAGRLMGLMLGSLGIAKEDVKWAVGPRSGSSALQLNSYPACPDPDRAMGLAAHTDSTLLTILHQNNTSGLQVFKEGNGWVTVLPLRGALVLNVGDLVHILSNGLYPSVLHRAIVNRTRHRLSVAYLYGPPSGVKISPLSKLVDQRNPQMYRPVTWSEYLGTKAKHFDKALSSVRLCAPRIGFANSKDQSGVQVG

SEQ ID NO: 60253 - protein, 586 aa, Chlamydomonas reinhardtii
MAELEKTFALIKPDAVRAGKAQEIMQLIELNGFTIIAKQKLQLTRARAEEFYGEHKGKEFFPKLVNFMTSGPIWALVLAKPGAILAWRALMGPTNVFKARAEQPKCLRALYGTDGTQNATHGSDSPISAAREIKFFFPTLSGDPTIYAEPTAAAEYITKRIQPALAKALAALAREKPSADKFEAITFVAGYLLQNNPNKPKVLMPDEWDPALMGDDEDDEADFINARLAAPTGNDGATKAEFDAMVEAAKADTGGAAPAQEFVYPDSKPTTPVVPAPPAPGSKPPSASGARPQSARPTSARPPSASAAPPAPLAPVPPPASSSRPASGSGRPPSATARPPSATPPPPPPAVELEEADDPAQLDEAATKVQAAFRGYQARKEVAVMRSEAQPGEAAAEPEQEAELQPEAEPEPQPEGEQEPQPQASASSSFLPDGVTEEMAAEAATRVQAHMRGHLARKQVAAIKAQQAAPAVAESSEALAEPEPQPEAEAEPQPQASVSSSFLPDGVTEEMAAEAATLVQAHMRGHLARKQVAAIKAQQAAPAVAESSEAQAEAEQTEAEAEPQPDAEAEAGAAEGEAEPEPEAAE

SEQ ID NO: 60254 - protein, 373 aa, Solanum tuberosum
MPSRISDSCRPHHSQKHFDLNSIKELPESHAWTSSNDHYTQENSCNFESIPVIDLDNNNNNNNNNILDHIGHACKKWGAFQIINHSISEKLLQDIEVAGKTLFSLPMQQKLKAARSPDGVTGYGAARISSFFSKLMWFEGFTIVGSPIEHARQLWLKDYNKFCEVIEEYEKEMEKLAGRLMWLILGSLGITKDDVKWAVGPKGETKEGCAALQLNSYPACPDPGRAMGLAAHTDSTILTILHQNNTSGLQVYQEGNGWITVPPIPGALVVNIGDLLHILSNGSYPSVLHRAVVNRTRYRLSVAYLYGPPSGVRVSPLSKLVDHRHPPLYRAVTWSEYLGTKAKYFDKALSSVRLCVPLNGFTDAKDHKGVQVG

SEQ ID NO: 60255 - protein, 99 aa, Glycine max
  misc_feature (43)..(43): Xaa can be any naturally occurring amino acid
MAPSTISNPGAGFVDRAVPSMIATITGLRIMAGFPTRKTNKDXTFIDCNGGRVHCMHVWPPVGKKKCENLSYLTDLEDAQWAKEAEYLVREGMDINARN

SEQ ID NO: 60256 - protein, 142 aa, Cryptococcus neoformans var. neoformans JEC21
MEVDQIANPGKSAAENDKKPRFEVKKWNAVALWAWDIAVDNCAICKSHIMDLCMDCQANQGAESENGCTVAWGICNHAFHFHCISRWLKTRQADSGNFRSTVANVDLYCSIFVLLCTMYDTLKAPRDLVFDARYAVWFSFTQ

SEQ ID NO: 60257 - protein, 505 aa, Bdellovibrio bacteriovorus HD100
MTTTKFTDLPLIAPLQFSLKEAGYETPTPIQLAAIPVILEGHDLLGIAQTGTGKTAAFSLPILQNLSKHTRKIEPKSPRCLILTPTRELAIQIHENIEAYSKHLNMKHAVIFGGVGQNPQVRALQGGVDILIATPGRLMDLHGQKHLKLDRVEIFVLDEADRMLDMGFMQDIKKILPLLPQKRHNLFFSATMPHEIQTLANRILVNPKKVEVTPVSSTAEKVEQRVMFVDKPQKLDLLLHILKDESLSKVLVFVQMKYGANRVVDRLTKAGVAAAGIHGDKSQNQRQRALEEFKNGDVRVLVATDIAARGIDIDGITHVINLELPHIPESYVHRIGRTARAGATGISISFCTAEERSFLFAIEKTTRTKVTVVEDHPFHSTEIANAPVMTVGKAKAILEGQRLQNKAKNRGGGPRRQGGGAPQGGHGGKKAGGKPQGGNKPDHGGKTHTKSEHKSEGAASHKTHSKPAHAKPAHKPAHKSEGKSAGKSEHAPKKRSFWSRLRNKD

SEQ ID NO: 60258 - protein, 587 aa, Nocardia farcinica IFM 10152
MAFSVQMPALGESVTEGTVTRWLKQEGDTVEVDEPLLEVSTDKVDTEIPSPAAGVLSKIVAQEDDVVEVGGELGVISEAGEAPAESAPAPEAPAAEAPAEESAAAEPEPEPAQAEQAPAQQPAASGDAAEGTPVQMPALGESVTEGTVTRWLKSVGDQVEVDEPLLEVSTDKVDTEIPAPVAGTLLEITAQEDDVVAVGGQLGVIGSGKPAAASAPAPAPAPETKAEPKPEPAPEPKPEPAPEPKPEPKPEPAPAPKAEQPAPAAQAQPQAPAPADSGATPYVTPLVRKLAEEHGVDLNSIKGSGVGGRIRKQDVLAAAEAKKAPAAAAAPAAKAPSAPAPAPQLAHLRGTTQKASRIRQITATKTRESLQTTAQLTQVHEADVTKIAALRAQAKAAFKEREGVNLTFLPFFAKAVVEALGVHPNVNASYNEDTKEITYHASVHLGIAVDTEQGLLSPVIHNASDLSLAGLARAIADIADRARNGGLKPDELAGGTFTITNIGSQGALFDTPILVPPQAAMLGTGAIVKRPVVVTDETGGESIGVRSMCYLPLTYDHRLIDGADAGRFLTTIRHRLEEAAFEADLGL

SEQ ID NO: 60259 - protein, 372 aa, Coxiella burnetii RSA 493
MTKTAKGLRGQSAGETSIATVGKEGHGLTYRGYRIEDLAANATFEEVAYLLLKNKLPTKSELDAYTKKLVNLRSLPPALKDTLERIPASSHPMDVMRTGCSMLGNLEPENGFENEQNIADRLVAIFPAIQCYWYHYSHHGKRIDTELDDLTLAGYFLHLLLGKKAAQMAIDCMNASLILYAEHEFNASTFAARVCSATLSDIYSAVTAAIATLRGPLHGGANEAAMDLIMLYKTPSEAIAGIKRKLANKELIMGFGHAVYRERDPRNAIIKSWAQKLAPNAADGYLFDISDAIENTMQDEKKLFPNLDFYSATAYHFLNIPTKLFTPIFVMSRVTGWCAHIFEQRKDNRIIRPNADYIGPEEQGWVPIEKRR

SEQ ID NO: 60260 - protein, 337 aa, Hordeum vulgare
MGKIKIGINGFGRIGRLVARVALQSDDVELVAVNDPFITTEYMTYMFKYDTVHGHWKHSDIKLKDDKTLLFGEKPVTVFGVRNPEEIPWGEAGADYVVESTGVFTDKDKAAAHLKGGAKKVVISAPSKDAPMFVVGVNEDKYTSDVNIVSNASCTTNCLAPLAKVINDNFGIIEGLMTTVHAITATQKTVDGPSSKDWRGGRAASFNIIPSSTGAAKAVGKVLPELNGKLTGMSFRVPTVDVSVVDLTVRTEKAASYDDIKKAIKAASEGKLKGIMGYVEEDLVSTDFVGDSRSSIFDAKAGIALNDHFVKLVSWYDNEWGYSNRVVDLIRHMAKTQ

SEQ ID NO: 60261 - protein, 231 aa, Arabidopsis thaliana
LQKELDYLVGAVSNPKRPFAAIVGGSKVSSKIGVIESLLEKCDILLLGGGMIFTFYKAQGLSVGSSLVEEDKLELATTLLAKAKARGVSLLLPTDVVIADKFAPDANSKIVPASAIPDGWMGLDIGPDSVKTFNEALDTTQTVIWNGPMGVFEFEKFAKGTEAVRNKLAELSKKGVTTIIGGGDSVAAVEKVGVAGVMSHISTGGGASLELLEGKVLPGVVALDEATPVTV

SEQ ID NO: 60262 - protein, 336 aa, Emericella nidulans
MAPKVGINGFGRIGRIVFRNAIEAGTVDVVAVNDPFIETHYAAYMLKYDSQHGQFKGTIETYDEGLIVNGKKIRFHTERDPANIPWGQDGAEYIVESTGVFTTQEKASAHLKGGAKKVVISAPSADAPMFVMGVNNETYKKDIQVLSNASCTTNCLAPLAKVINDNFGIIEGLMTTVHSYTATQKVVDGPSAKDWRGGRTAATNIIPSSTGAAKAVGKVIPSLNGKLTGMAMRVPTSNVSVVDLTVRTEKAVTYDQIKDAVKKASENELKGILGYTEDDIVSTDLNGDTRSSIFDAKAGIALNSNFIKLVSWYDNEWGYSRRVVDLISYISKVDAQ

SEQ ID NO: 60263 - protein, 336 aa, Bacillus coagulans
MAVKVGINGFGRIGRNVFRAAVKNPDIEVVAVNDLTANADGLAHLLKYDSVHGRLDAEVVVNDGVSVNGKEIIVKAERNPENLAWGEIGVDIVVESTGRFTKREDAAKHLEAGAKKVIISAPAKVENITVVMGVNQDKYDADAHHVISNASCTTICLAAFARVLHQIFGEVSRMMTTAHSYTNIQRILDAATHADLRGARAAAESIIDTTNGAAMAVALVLPELKGKLNGMAMRVATANVSVVDLVYELAKEVTVEEVNAALKAIAEGELKGILAYSIEPLVIRNYNGSTVSSTIDILSTMVIDGAMVKVVSWYDNETGYSHRVVALAAYINAKGL

SEQ ID NO: 60264 - protein, 399 aa, Arabidopsis thaliana
GDLTSADLKGKKVFVRADLNVPLDDNQTITDDTRIRAAIPTIKYLIENGAKVILSTHLGRPKGVTPKFSLAPLVPRLSELLGIEVTKADDCIGPEVESLVASLPEGGVLLLENVRFYKEEEKNDPEFAKKLASLADLYVNDAFGTAHRAHASTEGVTKFLKPSVAGFLLQKELDYLVGAVSNPKRPFAAIVGGSKVSSKIGVIESLLEKCDILLLGGGMIFTFYKAQGLSVGSSLVEEDKLELATELLAKAKAKGVSLLLPTDVVVADKFAPDANSKIVPASGIEDGWMGLDIGPDSIKTFNEALDTTQTVIWNGPMGVFEMEKFAAGTEAIANKLAELSEKGVTTIIGGGDSVAAVEKVGVAGVMSHISTGGGASLELLEGKVLPGVIALDEAIPVTV

SEQ ID NO: 60265 - protein, 558 aa, Erythrobacter sp. NAP1
MIPLGERLLFAADYFSGERETTMQTQNLGAMQDWSMRITSVIDHAAREAGAREIVTRWADGSETRTNWAGIREDALKMAQALKALGIKPGERVASLAMNHSRHLVSWYGVAGMGGVLHTVNPRLFEDQLEYIVTHAEDRVLLYDAAFQPIVDAMKDRWPTVEHYICYDSGEHTTSFEDWIGEQDGETEWFAGDERDPCMICYTSGTTGNPKGVQYEHRSTVMHAISGLQPAAFNFSSASVMLPVVPMFHAASWGLPYAGAMAGIKFVFSAVNDPAVLHEMMIKEGVTDSAGVPTVWLAHFQYCDKEGLDLPPLKAATIGGSAAPKFMIKRLLENGTRVQHAWGMTETSPIGTVGGPTWDWDTLTLDEKVDKCAMQGRPVFGVELRTVDLDDMATELPRDGMTSGALQIRGPWIIKRYFKAEQDAVNNEGWFDTGDVGILHPDGTLQLTDRTKDVIKSGGEWISSVELENAAVGHPAVAEAACVGMFHPKWDERPVLFVIKNEGAECTGDDIIEHLKPLVAKWWLPDAVEFVDDIPHTATGKISKKDLRDRFSDYKLEA

SEQ ID NO: 60266 - protein, 335 aa, Bacillus megaterium
MAVKIGINGFGRIGRNVFRAALKNDNVEVVAINDLTDANMLAHLLKYDSVHGKLDAEVVVDGSNLVVNGKTIEISAERDPAQLSWGKQGVEIVVESTGFFTKRADAAKHLEAGAKKVIISAPASDEDITIVMGVNEDKYDAANHNVISNAPCTTNCLAPFAKVLNDKFGLKRGMMTTVHSYTNDQQILDLPHKDYRRARAAAENIIPTSTGAAKAVSLVLPELKGKLNGGAMRVPTPNVSLVDLVAELDKEVTVEDVNNALKEAAEGDLKGILGYSEEPLVSGDYNGNINSSTIDALSTMVMEGNMVKVISWYDNESGYSNRVVDLAQYIAAKGL

SEQ ID NO: 60267 - protein, 165 aa, Streptomyces coelicolor A3(2)
MADYPEPGVVFKDITPLLADPGAFAALTDALAEAAGRTGATKVVGLEARGFILGAPVALRAGLGFIPVRKAGKLPGATLSQAYDLEYGSAEIEVHAEDLTAGDRVLVVDDVLATGGTAEASLELIRRAGAEVAGLAVLMELGFLGGRARLEPALAGAPLEALLTV

SEQ ID NO: 60268 - protein, 64 aa, Arabidopsis thaliana
IRITATRRRVARPCATDAAVEWDYKRGEIGRVSGVPEGHLSRKVRIYAAARTATQAGSGKLGKW

SEQ ID NO: 60269 - protein, 422 aa, Triticum aestivum
  misc_feature (156)..(156): Xaa can be any naturally occurring amino acid
  misc_feature (181)..(181): Xaa can be any naturally occurring amino acid
  misc_feature (252)..(252): Xaa can be any naturally occurring amino acid
  misc_feature (306)..(306): Xaa can be any naturally occurring amino acid
MYPVDPRVRSSSSALCSCRSSRWEVLRRAGSPRSPESLNQMADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKXANREKMTQIMFETFNVPAMYVAIQXAVLSLYASGRTTGIVLDSGDGVSHTVPIYEGYALPHAILRLDPRWGATLTDCLMKILTERGYSFTTTAERXEIVRDIKEKLAYVALDYEQELENAKSSSSVEKSYELPDGQVITIGAERFRCPEXVLFQPSFIGMEAAGIHETTYNSIMKCDVDIRKDLYGNIVLSGGSTMFPGIADRMSKEITALAPSSMKIKVVAPPERKYSVWIGGSILASLSTFQQMWISKGEYDESGPAIVHRKCF

SEQ ID NO: 60270 - protein, 265 aa, Brassica napus
  misc_feature (242)..(242): Xaa can be any naturally occurring amino acid
MGSIEEESPLIEEGLISQEPKLYAQDGSVDLHGNPPLKEKTGNWKACPFILGNECCERLAYYGIAGNLITYLTTKLHQGNVSAARNVTTWQGTCYLTPLIGAVLADAYWGRYWTIACFSGIYFIGMSALTLSASVPALKPAECIGTFCPSATPAQYAMFFGGLYLIALGTGGIKPCVSSFGADQFDDTDSRERVKKASFFNWFYFSINIGALVSSSLLVWIQENRGWGLGFGIQPVFMGLAXASSFFGTPLTGSEAGAAYHPISK

SEQ ID NO: 60271 - protein, 366 aa, Nocardia farcinica IFM 10152
MTVAAQFARIPHPAPLPAQRVAEILAAPGFGRYFTDHMVSIEYTEAQGWSNAKVEPYGPLQMDPATMVFHYGQAIFEGLKAYRQADGGVATFRIDANAARFRRSARRMAMAELPDELFVESVRQLLEVDERWVPAAGGEESLYLRPFMFATEAGLGVKPASAYTYLLLASPAGAYFPRGVKPVRVWLSTEYVRAAPGGTGEAKVAGNYAASLLAQAQAAEQGCDQVVWLDACERRYVEEMGTNNLFFVYGSGSQARLVTPELSGSLLPGITRDSLLTLAADAGYPVEERKISVEEWRTGAQSGEITEVFACGTAAVITPVGWVRSAEGEFTIGGGEPGEVTMALRETLTGIQRGTFADIHGWMRRL

SEQ ID NO: 60272 - protein, 656 aa, Arabidopsis thaliana
MTKMSNLPNDLAEEVLSRVSLTSLRNVRLTCKDWNTLSKGESFAKNHLGYQAIVAAKEKEFMMVLMMDFRVYLIRVNVHNDIESCIKPEGELISLGDEVDVSQVFHCDGLLLCITEDNEDNAKVVLWNPYWGQTRWIESTNNFHKLDMYTYALGYKKSSKSSRSYKILRFIDFSPTCSEFKIYNINSDSWKVLDVSPDWKIDSYIRGVSLKGNTYWIARERHGYGHTFLVCFDFTRERFRSRLPLPSQPCVLDTVSLSSVREEQLAVLFQCSSTLEMQIWVTTKIEPNAVLWNSKVFLAVDMHSLKFQFQVRASSFFIDEEKRVVVVFDKEKRYLASSRNKAYIVGVDGTWEQVDLGMSLMMVMISLHFSTPPLAFLKSDSNSRFLKNPNPNFIQFTPKSQLLFPQRLNFNTGTNLNRRTLSCYGIKDSSETTKSAPSLDSGDGGGGDGGDDDKGEVEEKNRLFPEWLDFTSDDAQTVFVAIAVSLAFRYFIAEPRYIPSLSMYPTFDVGDRLVAEKITMSKVSYYFRKPCANDIVIFKSPPVLQEVGYTDADVFIKRIVAKEGDLVEVHNGKLMVNGVARNEKFILEPPGYEMTPIRVPENSVFVMGDNRNNSYDSHVWGPLPLKNIIGRSVFRYWPPNRVSGTVLEGGCAVDKQ

SEQ ID NO: 60273 - protein, 434 aa, Zea mays
MEDDPSRQVRVRFVTKLPPPLRAPPAAIAVPADLTRMGLSEIVNSLLAAAEPDHQSQPFDFIVQGELVRLPLQEFLLAKGISAERVLELEYVRAVAPRKQEEPCPHEDWVSAVDGSNPGFILSGCYDGLARLWKDAAVCTQILEGHNDAITSTRFINKGSETEGSLHVVTGSKDRSLRLYKCDTSVIMDYPKRVGAYKILRGHTASVKSISADPSGDMLCSGSWDGTIKLWAVEGSDDDDAVSLKKRRMNSDSSGPEESQLEGSATSTLLGHTQGVTAVTWPERKTIYSASWDHSVRQWDVQTVKETWNMFCGKALNCLDCGGEGSSLIAAGGSDPVLRVWDPRKPGTLAPVFQFSSHSSWITACKWHPSSCFHLVSSSFDGKVMLWDLRTAWPLASVDSHEDKVLCADWWKGDSVISGGADSKLCISSGIQIV

SEQ ID NO: 60274 - protein, 337 aa, Cryphonectria parasitica
MVVKVGINGFGRIGRIVFRNAHEHSDVEIVAVNDPFIEPHYAAYMLKYDSQHGNFKGDVTVEGSDLVVGGKKVRFYTERDPAAIPWSETGADYIVESTGVFTTTEKAKAHLKGGAKKVIISAPSADAPMYVMGVNEKTYDGSGMVISNASCTTNCLAPLAKVINDEFKIIEGLMTTVHSYTATQKTVDGPSAKDWRGGRTAAQNIIPSSTGAAKAVGKVIPELNGKLTGMSMRVPTSNVSVVDLTVRIEKGATYEQIKTAVKKAADGPLKGVLAYTEDDVVSTDMNGNPNSSIFDAKAGISLNDHFVKLVSWYDNEWGYSRRVLDLISHVAKVDGNA

SEQ ID NO: 60275 - protein, 337 aa, Cochliobolus lunatus
MVVKVGINGFGRIGRIVFRNAIEHNDVEIVAVNDPFIEPHYAAYMLKYDSTHGQFKGDIKVDGNNLTVNGKTVRFHMEKDPANIPWSETGAYYVVESTGVFTTTEKAKAHLKGGAKKVVISAPSADAPMFVMGVNHETYKSDIEVLSNSSCTTNCLAPLAKVIHDKYTIIEGLMTTIHSYTATQKVVDGPSAKDWRGGRTAAQNIIPSSTGAAKAVGKVIPELNGKLTGMAMRVPTANVSVVDLTVRIEKGASYDEIKQAVKEASEGPLSGILGYTEDDIVTTDLNGDNRSSIFDAKAGISLNKNFVKLVSWYDNEWGYSRRVLDLLVYIAKIDGNA

SEQ ID NO: 60276 - protein, 402 aa, Oryza sativa (japonica cultivar-group)
MASPMLSAATVPLQGGGLSEFSGLRSSSSLPLRRNATSDDFMNAVSFRTHAVGTSGGARRAPTEAKLKVAINGFGRIGRNFLRCWHGRGDSSPLDVIAINDTGGVKQASHLLKYDSTLGIFDADVKPVGDNAISVDGKVIKVVSDRNPSNLPWGELGIDLVIEGTGVFVDRDGAGKHIQAGAKKVLITAPGKGDIPTYVVGVNADQYSPDEPIISNASCTTNCLAPFVKILDQKFGIIKGTMTTTHSYTGDQRLLDASHRDLRRARAAALNIVPTSTGAAKAVALVLPNLKGKLNGIALRVPTPNVSVVDLVVQVSKKTLAEEVNQAFRDSAANELKGILEVCDVPLVSVDFRCSDVSCTIDASLSMVMGDDMVKVIAWYDNEWGYSQRVVDLADIVANQWK

SEQ ID NO: 60277 - protein, 324 aa, Streptococcus agalactiae
MTVNLDWDNLGFAYRKLPFRYISHFKDGKWDDGKLTDDATLHISESSPALHYGQQAFEGLKAYRTKDGSIQLFRPDQNAERLQRTADRLLMPHVPTDKFIAAVKSVVRANEEFVPPYGTGATLYIRPLLIGVGDIIGVKPAEEYIFTVFAMPVGSYFKGGLTPTNFIVSKEYDRAAPNGTGAAKVGGNYAASLLPGKYAHEKQFSDVIYLDPATHTKIEEVGAANFFGITKDNQFITPLSPSILPSITKYSLLYLAKERFGMEAIEGDVFVDELDKFTEAGACGTAAVISPIGGIQNGDDFHVFYSETEVGPATRKLYDELVGI

SEQ ID NO: 60278 - protein, 662 aa, Bacillus licheniformis ATCC 14580
MPQEKNTFYITTPIYYPSGKLHIGHAYTTVAGDAMARYKRLRGFDVRYLTGTDEHGQKIQQTAEKENITPQELVDRAAEDIQQLWKKLDISNDDFIRTTEERHKKVIEKVFQKLLDNGDIYLDEYEGWYSIPDETFYTETQLVDVERNEKGEVIGGKSPDSGHPVELIKEESYFFRMGKYADRLLAFYEENPEFIQPESRKNEMINNFIKPGLEDLAVSRTTFDWGIKVPGNPKHVIYVWIDALFNYITALGFNTENDENYQKYWPADVHLVGKEIVRFHTIYWPIMLMALDLPLPKKVFAHGWLLMKDGKMSKSKGNVVDPVTLIDRYGLDALRYYLLREVPFGSDGVFTPEGFVERINYDLANDLGNLLNRTVAMVNKYFDGRIQSYEGPVTAFDEPLSSFSQKTIEAYEQAIENMEFSVALSSLWQFVSRTNKYIDETAPWVLAKDKDKEKELQSVMYHLAESLRITAVLLQPFLTQTPEKIFAQLGVTDASLKTWDSIQSFGQLKSVTVQKGEPLFPRLEAEDEVAYIKSKMQGTAPKEEPKQEEKAHERLPEITIDDFMSTELRVAEVIHAEPVKKADRLLKLQLDLGFEKRQVVSGIAKHYKPEELVGRKVICVTNLKPVKLRGELSQGMILAGEDNGVLSLAAVDSSLANGTRIK

SEQ ID NO: 60279 - protein, 303 aa, Streptomyces coelicolor A3(2)
MSSTLSENQAPETGTARVKRGMAEQLKGGVIMDVVTPEQAKIAEDAGAVAVMALERVPADIRKDGGVARMSDPDMIEGIIGAVSIPVMAKSRIGHFVEAQVLQSLGVDYIDESEVLTPADEVNHSDKFAFTTPFVCGATNLGEALRRIAEGAAMIRSKGEAGTGNVVEAVRHLRQIKNEIARLRGYDNNELYAAAKELRAPYELVKEVSELGRLPVVLFSAGGVATPADAALMRQLGAEGVFVGSGIFKSGDPAKRAAAIVKATTFYDDPKIIADASRNLGEAMVGINCDTLPETERYANRGW

SEQ ID NO: 60280 - protein, 393 aa, Brassica napus
PEPVYKTSVDWINQRPIEALGSFVLWAFDCILTDLAAHQVGGAKGGKKGAQQHTSSKSQVAIFVALAMVLRRKPDALTNVLPTLRENPKYQGQDKLPVMVWMMAQASLGDLSVGLLSWAHNLLPVAGSKNCNPQSRDLILQLVEKILSNPKARTILVSGAVRKGDRLIPPPSFEILVRLTFPASSARVKATERFEAVYPLLKEVALAGAPGSKAMKQVTQQIFTFALKLAGEGNPVLAKEATAIAIWALTQNVDCCKHWDSLYKENLEASVALLKRLVEEWKEHSLKLSSSPSDTAALNRTMKSFRLKNEEAITEGKGNVSLYKEADKSCKVISGRLSRGSGCLKGTAITVVVLAAAAAFLSSNPEVTSELKSLVDSLELHQYYNPIITAFKN

SEQ ID NO: 60281 - protein, 407 aa, Moorella thermoacetica ATCC 39073
MSIQERALNLHREWQGKIETRPRVQVRNADDLTMAYTPGVAEPCKEIHKDPNLVDVYTRRWNLVAVVSDGSAVLGLGNIGARAAMPVMEGKSVLFKSFAGVDAFPICIDSQDVDEIVRTVQLLTPTFGGVNLEDIAAPRCFEIERRLKETTDIPIFHDDQHGTAVVVLSAIINACKITKRELSDLKVVINGAGAAGIACGKLLVDVGVSDVILCDSKGIICSKRDDLNAIKKEMLQITNKEDRCGTLADAMEGANCFIGLSVKDAVTPEMVRSMDKDSILFAMANPVPEILPDVARAAGAAVVGTGRSDFPNQVNNVLGFPGIFRGALDVKASDINDAMKIAAAHALADLVGDRLSADFVMPEAFDPRVAPAVAMAVARAAIESGVARDPKDPEWVKRHTEELIARQ

SEQ ID NO: 60282 - protein, 525 aa, Saccharomyces cerevisiae
MAAGEQVSNMFDTILVLDFGSQYSHLITRRLREFNIYAEMLPCTQKISELGWTPKGVILSGGPYSVYAEDAPHVDHAIFDLNVPILGICYGMQELAWINGKQVGRGDKREYGPATLKVIDDSNSLFKGMNDSTVWMSHGDKLHGLPTGYKTIATSDNSPYCGIVHETKPIYGIQFHPEVTHSTQGKTLLKNFAVDLCHAKQNWTMENFIDTEINRIRKLVGPTAEVIGAVSGGVDSTVASKLMTEAIGDRFHAILVDNGVLRLNEAANVKKTLVEGLGINLMVVDASEEFLSKLKGVTDPEKKRKIIGNTFIHVFEREAEKIKPRDGKEIQFLLQGTLYPDVIESISFKGPSQTIKTHHNVGGLLENMKLKLIEPLRELFKDEVRHLGELLGIPHDLVWRHPFPGPGIAIRVLGEVTKEQVEIARKADNIYIEEIKKAGLYNQISQAFACLLPVKSVGVMGDQRTYDQVIALRAIETTDFMTADWFPFEHSFLKKVASRIVNEVDGVARVTYDITSKPPATVEWE

SEQ ID NO: 60283 - protein, 250 aa, Candida glycerinogenes
MASTFFVGGNFKMNGSKASIKTIVENINNSSIPSNVEVVLCPPAPYLSYTADLNKQANVQVGAQNCYPKASGAFTGEVSPLAVKDSGAEWVITGHSERRQYFNESDEFVAEKTKFAIDQGLKVILCIGESIDEKKAGKTLDVCKRELSAVIKAVAPEDWPPLSLPYEPVWAIGTGLAATAQDAQDIHAEIRKYLASQLGESTAQAVRILYGGSANGKDAPEFKDKADVDGFLVGGASLKPEFVDIIKSRT

SEQ ID NO: 60284 - protein, 647 aa, Nocardia farcinica IFM 10152
MCGLLGFLTADAATSEVVDQVYNALHCMRHRGPDERGTWHDDHLVFGFNRLSIIDIEHSHQPLRWGPPENPERYALTFNGEIYNYLELREELAAAHAAEFGDAPMFRTEGDSEAIVAAYHYWGAEAVAKLRGMFGFAIWDTQTRELFLARDPFGIKPLFLATGPGGTAFGSEKKSLLDLLPALRLSDDLDPRALEHYTVLQYVPEPETLHKGIRRLESGTYAVVRPGAAPQVTRYFTPRFPVRPFAPGSAQTRYNEIAAALEDSVAKHMRADVTVGSFLSGGIDSTAVAALAMRHNPNLITFTTGFEREGYSEVDVAAESAAAIGARHIVKVVSPAEFAAAIPEIVWYLDDPVADPALVPLYFVAKEARKHVKVVLSGEGADELFGGYTIYREPLSLKPFEYLPRGLRRLAGRLSERIPDGTRGKSLLHRGSLTLEERYYGNARSFNDAQLRAVLREFRPEWTHQDVTAPIYAQSRGWDPVARMQHLDLFTWLRGDILVKADKMTMANSLELRVPFLDTEVRRVAEQLPFDQKITKDTTKYALRQALEGIVPAHVLHRAKLGFPVPLRHWLRGTELYDWAHTQIAESQTDHLLDKAAITAMLVEHRAGRADHSRRLWTLLVFMVWHGIFVEDRIKPDIQEPVYPVTL

SEQ ID NO: 60285 - protein, 391 aa, Shewanella sp. MR-7
MAIINMSDLDLQGKRVLIREDLNVPVSNGVVTSDARLRASLPTIELALAKGAAVMVMSHLGRPTEGEYNSEFSMQPVVDYLAKALSCTVRLATDYLDGVEVAVGEVVVFENVRFNKGEKKNDEALSKKMAALCDVYVMDAFGTAHRAEASTNGVGLHAPIACAGPLLAQELEALGKALDNPARPLVAIVGGSKVSTKLTVLESLSGIVDQLVVGGGIANTFIAAAGHNVGKSLYEADLIDEAKRLVANAQSRGGDIPVPTDVVVAGEFSPTAAATLKAVNEVGDSDMIFDIGPDSAEALAKIIESAGTIVWNGPVGVFEFDQFGEGTKRIAQAIADSKAFSIAGGGDTLAAVDKYDIADKVSYISTGGGAFLEFLEGKELPAVAMLKQRGA

SEQ ID NO: 60286 - protein, 95 aa, Arabidopsis thaliana
AVPGFEQAIQAYASHLLSLSYQKVPRSVLAEAVNMDGASLDKFIEQQVTNSGWIVEKEGGSIVLPQNEFNHPELKKNTGENVPLEHIARIFPILG

SEQ ID NO: 60287 - protein, 1424 aa, delta proteobacterium MLMS-1
MTEDTSKQVCKPAAIDSDALRANLQETAVDCIELPAKWGILLEVVADYKGIHATLEELLYEIAHPYRNWRLILPRYRSFVLKHLDHYRRHPRGPEACLRLLEILLLALAENQRQETLLLQSAEVLAALFDKLVSIIKPADLPTFHQTLQESCNRLAELDEELLRPLVAGQHSLKKTIGRLVSKCDGESEVKICELTAPARLLKRVLILNYRNWLAEEDPQPWFASECEEICQGWEAGQLFAEISHDRLRQHLATAEATDCEHDELALPKLLELPDHMDIVRLYREIPDRLSSRPGQPQETESDDRFAENRKLLFLFRIMDTGGLALIHEETLREINRGLVQLIRRQTFEEIERFLLTTLALLKSNVRRYPHTSLQCIQIIGTEVFRRGNSRLVETFLWEAVRFGFQYANVTGIGEDWQPLANPAHLANIRVWLNLIGQEPKWCSTLFSALIINLKLSGTCLKDTDLFQRDISELLNQPIEPVYNLVTQFAKQVPVFYNDIGAEGTLREVSTEMDEIHQRRDKLIHFLRKQSHVESSNLIVDFIESIILFWRDRDKNVLAPYLPEEVLREIAPEGEYVDDLHRLSKRIWALNHIHRPTDLLNWDYNQRRHYLEAQEDIPAGERRRFDLLVRMYRLCHQKYNLGTEELRQHLKQAAAGDFPEMEQLLADLEICDTFECLSALLEHLERLKEIILSEERFTAQESIYHKRHIAIDIPSVYGRYQERKFDALSLTFRLENLANTYLEKLPETVNLNIITKATFIRILKCLRLYLRALKIDGITSRKLTTYMSLLSNSLGIKRFSYTQFLDIFRGLSEGVKDVIYTYYTNIHENNLSIIIPQIGHDNLLPKYRYLWRGQDPVGNVNRLSESFMRDLIAGTFGLQHLDNFITRIHQTLEAQREVLDEDHLDLLMTYNPDRAISPLQPRHSRNANLILLGNKGYNLSLLAIDGQPVPPGLTVTTEVFRCWPVIRQFTKCRDDFMTRLRFGLNQIEERTGRRFGDPAAPLLLSVRSGAAISMPGMMATIHNVGLNEDIVGEFACQEGRGFLAWDNFRRFIQSWAMAQGVERERFQGLMNAAKERCNVRYKRDFTAEQIRELTLEYQKTARSLGIGIPEDPWLQLTGAVEMVISSWNTPKTRDYRQIMDISDDWGTAVIIQTMVYGNLGVESGSGVLFTAHPYRKVSRVALWGDYAVGDQGEDIVSGLVTTEPISVEQAELDGREVENTLELRFPEIYQQLLSISRHLVYDKRWNAQEIEFTFEGPRTEDLYLLQTRDMITIKKKESFNVFADADTAEAAVTAHGVGVSGSAISGLVVFNAEDIARLRAERPEAQLILIRQDTVPDDIKEIAAADGLLTARGGQTSHAAVVATRLEKTCVVGCSQLKVFETEQRCEINGFTFQCGDHLSIDGRKGLVLQGDHPTRKEMQILPL

SEQ ID NO: 60288 - protein, 334 aa, delta proteobacterium MLMS-1
MGIKVAINGFGRIGRSIFRAIELDPTFKEIEIVAINDLTPPATLAHLLKYDSVMGIYPHEVKAGDGEIRVDDHPVRVYNQRDPKELPWGELGVEYVIEATGLFTDSDKAQAHLDAGAKKVVISAPAKGQVKTIVMGVNEEDYDPATDHIVSNASCTTNCLAPVAKVIVERFGIKSGLMTTVHAYTGDQRLLDFPHNDLRRARAAAMSMIPNKTGAAAAVALVLPELKGKFDGLAVRVPTPNVSLVDVVMELEQETTVTEVNEALKQATNRYLGYSEEPLVSIDYQGDPRSSVVDAISTKVLGSTVKILSWYDNEWGYSNRVLDLILHMEENRTL

SEQ ID NO: 60289 - protein, 492 aa, Rhodococcus sp. RHA1
MTTTESVPGVTEVRHLIGGDWAAASDGATFETRDPHDGSLLATVPRGTADDGEAAITAARTAFDDGPWPRMSPKERAKILHAVADKVDEHREELALIETRDGGKSINQSLHAEIPRVAHNLRFFADYVSMAANEAYPDGDLLSYVLYPPAGVVSAISPWNAPLMLATWKIAPALAFGNTTVLKPAPQTPLTAHRFAQLALEAGLPEGVLNVVHGFGGEAVAGPLTADPRVDRITFTGSSATGVRILQAAAVNHTPVSAEMGGKSANIVFGDADLDVAVPMSIRAIFGGNGQVCLSGSRLLVQNSIMGEFLDRFTEEAKKLTVGDPKDPSNFLGPLIEQRHLEKVHGYVELAQEEGGKVVTGGSRLTDDARAKGFYYPPTVITGLTNDSRTAREEIFGPVETVLGFDTEDEALRIANDSPYGLAGILFTDNLNRAHRMAARWKAGTVWINTFFERDLRLPFGGEGSSGLGREGGQYSREFFTEPRAVTIRLRS

SEQ ID NO: 60290 - protein, 113 aa, Coxiella burnetii RSA 493
MTACVFCKIAKGEIGELIYEDKQVVAFNDAAPQAPIHILVIPHRHIETINDVTPGDEDLLGHMVVVATRLAHDKNMAADGYRLVMNCNRNGGQAVFHIHLHLLGGRQMHWPPG

SEQ ID NO: 60291 - protein, 466 aa, Burkholderia thailandensis E264
MSDTKTTTLLVIGGGPGGYVAAIRAGQLGVRTILVERDRLGGTCLNIGCIPSKALIHAAGEFDKVRGFAGDSPLGIRTEAPAIDIARTVAWKDGIVKKLTGGVGALLKKNGVEVVHGDARVVDGKTVEVDMGDGARMRIECEHLLLAAGSEPVELPAMPFGGNVISSTEALSPRVLPKRLVVVGAGYIGLELGIAYRKLGVDVTVVEARERILPIYDAELTKPVAASLKRLGVRVHLGHEVLGLNARGDAVRVRDDRHEQTELAADQVLVTVGRRPRTQGWGLETLQLDRAGAALKIDDACRTSMRNVWAIGDLTGEPMLAHRAMAQGEMVAEIVAGKKRHFVPAAIAAICFTDPEVVSAGLAPDEAERAFGECLSASFPFAANGRALTLEGADGFVRVVARRDDHLIVGWQAVGVGVSELAAAFSQSLEMGARLEDVGGTIHAHPTLGEAVMEAALRALGHALHI

SEQ ID NO: 60292 - protein, 305 aa, Erythrobacter sp. NAP1
MKMFLDALAAMEGPALADMTLEEARASYVALHGMADRPARELAVIRDLTCPGPAGDIPLRLYDARETRDPGPVITFYHGGGFVIGDLETHHALCTEIAALMDLPLVAVDYRRAPEAPFPAAIEDCEAATRWIASSPQELGREATGVVTIGDSAGGNATIVIGQLLAEKPADVPVALQVPIFPLASAVEGSASFEAFADGFVLTRAAIEFFDAAYGAVREDARGFPIHGDHAKAPPTIVVTASLDPIRDSGRDYASALAQAGADVTFIEMKGVTHSFTNLRQAVPSTQGDLERIVAHMKCLLENLS

SEQ ID NO: 60293 - protein, 354 aa, Burkholderia sp. 383
MKAAVWHGRHDIRVEQVPVPERPPAGWVTIRVHWCGICGSDLHEYVAGPVFIPVDAPHPLTGLKGQCILGHEFSGEIAELGAGVTGFAVGDRVTADACQHCGTCWYCKHGLYNICENLAFTGLMNNGAFAEYVNVPAELLYKLPDDFPTEAGALIEPLAVGLHAVKKAGNIVGQTVVVVGAGTIGLCTIMCAKAAGAGRVIALEMSAARKQKALEVGASVVIDPKTSDAIAEVKALTGGYGADVSFECIGHTTTAKLAIDVIRKAGKSVMVGIFEEPAPFNFFDIVSTEKEVIGSLAYNGEFADVIRFIADGRIDVQPLITGRIALGDIVSHGFEELVNHKERNVKIIVQPALA

SEQ ID NO: 60294 - protein, 125 aa, Bacillus licheniformis ATCC 14580
MTKVVQTKEAPAAIGPYSQGIVVNNMFYSSGQIPLTPSGEMVTGDITEQTHQVFRNLKAVLKEAGASLETVVKATVFLADMNQFTEVNEVYGQYFDTHKPARSCVEVARLPKDALVEIEVIALVK

SEQ ID NO: 60295 - protein, 196 aa, Kluyveromyces lactis NRRL Y-1140
LFTVALGIIQEDFFVSRFSDDKKNGCVMRLLHYPLFRDDGVDGSSGIDPTLRIGPHSDYGALTLLLQKEGEQGLEVQLDPGCDQWTKVPFLTSRYEGSAPPIVVNFGDMLSFWTKGVIRSTKHRVKIDPGETRSSDRYSIVFFTHPDADTTLDPVPSRVIESNSNGIGAPPVTAYEYLSAHLSRVINSIPSHDGMV

SEQ ID NO: 60296 - protein, 664 aa, Shewanella sp. MR-7
MSSRKVLANAIRALSMDAVQKANSGHPGAPMGMADIAEVLWNDFLKHNPNNPKWVDRDRFILSNGHGSMLIYSLLHLTGYDLPIDELKQFRQLHSKTPGHPEYGYTPGVETTTGPLGAGISNAVGMAIAEKTLAAQFNREGHEIVDHYTYCFLGDGCLMEGISHEACSLAGTLGLGKLIAFWDDNGISIDGHVEGWFTDDTPKRFESYGWHVIANVDGHDSDAIRAAIEAAKAVTDKPTMICCKTIIGFGSPNKSGSHDCHGAPLGDAEIAAAREFLGWPHAPFEIPADVYAGWDAKEAGNAREAAWNDKFTAYAKAYPELAAEYERRVLKGELPADFEAKAQAFIQECQAKGEGIASRKASQNAIAAFGAVLPELLGGSADLAGSNLTLWAGSKGIQEDPAGNYVYYGVREFGMSGIMNGVSLHGGFINYGATFMMFMEYARNAVRMSALMGIQNIFVYTHDSIGQGEDGPTHQPVEQLANLRMTPNMAVWRPCDAAETAVAWKAAIERRHAPTSLVFSRQNLKAHARTAEQLANVAKGAYVLQDCAGTPEYILIATGSEVQLAVEAAAALTEQGKQVRVVSMPSNTEFDKQDAAYKESVLPKAVTKRIAIEAAHTDFWYKYVGFEGTVVGMTTFGESAPGNVLLKHFGFTVENVLNAAKSLG

SEQ ID NO: 60297 - protein, 294 aa, Hordeum vulgare subsp. vulgare
MAMASSTTASIAAASLRALAGASPAPLRKPFLVLLSPALPRRLGLGLRAARPRGPLAPLAASDSFETSAAVDVAEPEDEALEAVAEEEPAVAVAEEEFDVAAEEEVGEYVEPPEEAKVYVGNLPYDVDSERLAQLFEQAGVVEVSEVIYNRETDQSRGFGFVTMSTIEEAEKAVEMFHRYDVNGRLLTVNKAAPRGARVERPPRDSGSSFRIYVGNLPWQVDDSRLVELFSEHGKVVDAKVVYDRDTGRSRGFGFVTMASQEELDDAIAALDGQSLEGRALRVNVAEERPPRRF

SEQ ID NO: 60298 - protein, 399 aa, uncultured archaeon
MFFFIWEESVKMLSKRLSRIEESATIKMGQIAKKLQEEGKEVLSFTLGEPDFKTPEHICEAAKHALDLGYTHYTSSAGIDELREKIAKKTTEENKVDCAMENVIVTPGAKQAIYELMMSVLDYGDEVILLDPAWVTFEAAVKLAGGTPKWVKRIEEEVKYESLEAASSENTKLIVINSPNNPAGYVLSENELKEIAEFAVEHDLLVLSDEIYEKILYGRRHISIASFDSMQERTVIINGLSKTYAMTGWRIGYAVAPTAIQKGMLKIQQHSVSCASSIAQYAALAAFEESQECVNEMVAEFERRRDVIVKRLNNVGLRCLDPEGAFYAFVNTSNYGNGAEFTERLLKDAYVVVTPGSAFGAAGKDYIRFSFAASMENILAGMDRIEAMCTLPSSSKYSR

SEQ ID NO: 60299 - protein, 175 aa, Glycine max
  misc_feature (84)..(84): Xaa can be any naturally occurring amino acid
ASSMISSPAVTTVNRAGARMVAPFSALKNMDGFPTTNTNNDITSIGINGGTPQCMQEWPTLGYKKYDTLSYLPDLDDALLTKEXKYLLKNGWIPCLEFQLEHGFAYRDHDRSPRYYDGRYWTMRNLPMFGCTDAYHVIKDLQEVNTVYPNGFIRIIEFNNFLQEQRISFIAYKTP

SEQ ID NO: 60300 - protein, 470 aa, Bdellovibrio bacteriovorus HD100
MTGKDVLKFANEKGAKMVDLKFCDMLGTWQHLTVPLHQLTAEAFEEGYGFDGSSIRGWKGIEESDMIIMPDPSTAMMDPFMQVPTLSLICDVCLPETLQAYNRDPRQVVKKAIAYMQSTGIADTAYFGPEAEFFIFDDIRYEQTNNSAFYMIDSDEAVWNTGRDEGGKNLGYKIRPKEGYFPALPTDSQQDLRTEICLELERCGMQVERHHHEVASSQGEINFRFDTALNMGDKMMWFKYIVKNVAKRYGKTVTFMPKPIFGDNGSGMHIHMSLWKDGKNLFAGNKYAGLSEMALHYIGGVLKHAPALCGIINPTTNSYKRLVPGFEAPTKLAYSFKNRSAAMRIPNSGPNPKAKRIEFRTPDPSANIYLAEAAILMAGLDGIINKINPGDPLDKDIYGLPPQEAAAIPSVPGTLEESLNHLMKNCSFLKKGDVFTDDLIETWVQYKIDKEVRPVQQRPVPYEFHLYYDC

SEQ ID NO: 60301 - protein, 359 aa, Arabidopsis thaliana
MENLKEALRFICSSNFWRMVLFWNIALLFSYFQLLKKSIFAPKSSSSSSCSKFNHSHTPVCVITGATSGLGKATAFALSRKGFYVVLVGRSSHLLSKTLSDIKRQNEDAKLKAFEVDMSSFQLVLKFRSSLEQWLFESDLHSSVQLLVNNAGILATSSRPTVEGFDRMIATNYVGAFSLTKLLLPLLRNSPVPSRVVNVTSFTHRSAFTGRFDMDSVTGVNFSRSKQYPCARIYEYSKLCLLLFSYELHRQLHLMDDSHHISVVAVDPGAVKTNIMHELPSYIQVIAFCGLKILGLMQSPEDAAESVIDAALAPPEISGKYFFGGRTIESSTLSSDPKMAKELWDTSCLIFNELQQTHT

SEQ ID NO: 60302 - protein, 364 aa, Prunus dulcis
MTFTIRKKEILIDILVRLPTKSLVRFLCTCKSWSDFIGSSGFVSTHLDRNVTKHAHVYLLCLHHPNFECHVDPDDPYVKKEFQWSLFPNQTCEEFYKLSHPLGNTEHYGIYGSSNGLVCISDEILNFDSPIHIWNPSVRKLRTTPISTNINMKFSLVSLQFGFHPGVNDYKAVRMMRTNKGALAVEVYSLRTDSWKMIQEIPPWLKCTWQHHKGTFSNGVAYHIIEKGPIISIMSFNSGSEEFEEFITPDAICSSWRSCIEVYKEQICLLLDFYPCEEEGMEKFDLWVLQGKRWKQLCPFIYSSDYCYRTIGISIDDELLMARRGFDKGVADLCLCNYETNQLLETGIKLAIMRYGEIEFLFAI

SEQ ID NO: 60303 - protein, 207 aa, Mycobacterium bovis AF2122/97
MPNTNPVAAWKALKEGNERFVAGRPQHPSQSVDHRAGLAAGQKPTAVIFGCADSRVAAEIIFDQGLGDMFVVRTAGHVTDSAVLGSIEYAVTVLNVPLIVVLGHDSCGAVNAALAAINDGTLPGGYVRDVVERVAPSVLLGRRDGLSRVDEFEQRHVHETVAILMARSSAISERIAGGSLAIVGVTYQLDDGRAVLRDHIGNIGEEV

SEQ ID NO: 60304 - protein, 193 aa, Triticum aestivum
KKPGCLLLSKLYTYIVQPWPPTLMASSATSVVLFQGVKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 60305 - protein, 549 aa, Candidatus Kuenenia stuttgartiensis
MLNKINPIKTKSWNSLAEHFKDIQHIHMKTLFAKDPDRFKKFSIRFNDILVDYSKNIITDETLRHLIALARETGLEDAIEKMFSGNAINETENRAVLHTALRNRENTPIYADGKNVMPQVNAVLKKMEAFSRNVISGEWKGFSGRKITDIVNIGIGGSDLGPVMVTECLRPYAKKGLSVHFVSNIDGTHIVETLKTLNPETTLFMIASKTFTTQETMTNAFSAREWFLQCAKDHAHVARHFVAISTNTEKVEAFGIHRDNMFVFWDWVGGRYSLWSAIGLSIACFIGYENFSELLHGAFEMDNHFRTAPFEKNIPVILALIGIWYNNFFGAQTEAILPYDQYMHRFPAYFQQGNMESNGKSTDRSGDKVNYQTGPVIWGEPGTNGQHAFYQLIHQGTKLIPADFLAPAISHNPLGEHHNILLSNFFAQTEALLKGKTRDEVLEELKKECKSDNEIQRLAPHKVFEGNRPTNSILFKKLTPTVLGSLIALYEHKIFVQGVIWNIFSFDQWGVELGKQLAKKILPELTDNKPIATHDSSTNGLINAYKEMR

SEQ ID NO: 60306 - protein, 309 aa, Yarrowia lipolytica CLIB122
MSSILESINSTVTPAASYIGTYAKLSDAHADTLNIVERVWASYFVWWGNDLIACGIFIFLLHEILYFGRCVPWMILDQIPYFHKWKIQGEAKVPSVAEQWECMKSVLISHFMVEAIPIWGFYPVCKYAGISIDVPFPSWMKICAHLALFFVLEDTWHYWLHRGLHYGPFYKHIHKQHHRYAAPFGLTAEYAHPVEVALLGVGTVGIPIAWVMLTGDLHLFTVSVWIALRLFQAIDAHSGYEFPVSLHHFLPIWAGADHHDDHHRYFTGNYASSFRWWDFVLDTEAGPAAKAERQQRLAAKAAKKAKKQQ

SEQ ID NO: 60307 - protein, 682 aa, Moorella thermoacetica ATCC 39073
MELFPIIPAGGILALLVALYMTSSVLKEDTGPKEMQTIAAAIREGAMAFLNRQYRTIAGLALIVAVLLALLTRQYHTAVAFITGAFASALSGYIGMYVAVNANLRVAAGARNSLNKALTVAFRGGAVTGLAVTALSLLGVTSLFYAFGGATNPTRAPLDIVGFGFGASFVALFAQLSGGIYTKAADVGADLVGKVEAGIPEDDPRNPAVIADLVGDNVGDCAGRGADLFESTAAENIGAMILGIALVPFFGVKGIVFPLVARAAGIIASIIGMFFVRAEENQDPMAALNRGYIVTSILAIIFLYPISRYMLSGPGVNFIYFYGAGIIGIVLSFIFVLITQYYTSYDYRPVKEIARASITGPATNIISGVAVGFESTALPVVFISLAILGAYWLGLKSGLPGGGLYGTAVATMGMLSTAAYILAMDTYGPITDNAGGIVEMSGAPEEVRRRTDRLDASGNTTKALTKGYAIGSAALATFLLFSAYIDEVKIALNIKGNFPVDIGKPEVFVGAFIAAMMVLLFSSTAIRAVGNAAQYVILEVRRQFKEIPGIMEGTAKPEYGACVDIVTRGALKEMVLPGLIVVITPIIVGLVLKAEAAAAFLMVGTITGVIVALFLNNGGGAWDNAKKYIELGNFGGKGSEAHKAGVVGDTVGDPFKDTAGPSLHVLVKLISTITLVLAGLFI

SEQ ID NO: 60308 - protein, 442 aa, Oryza sativa (indica cultivar-group)
MASPAKAQRRPEGASVLETLPALPLAIIIAKAGPRCAAALACASSTLRAAASGEALWRHFCSDDFALDAPLSPGDLPLPSFKDAYKAWFQSFGMYPLPLVKRVKIFWSSFRAWLCEYFPEGLRTLGEGVSEAEIAVAECNLGLVLPMPTKLLYRFCNGQLHIGRGEEVSYGVMGGYDYVHQRYTVRLLPLAHHAVQKNSNYIVVATSCFGEKIFLLDCASGRLYVGTKYWNEEREIMACVPKATIRLAVDDDHGMPQDGFLLWLEEHLSRLQDGLIKVQSCKFPMLARHISLYPVQLPYCSSASMHGIKVRASAVFAPENSAFADYRCRYSYYFSIRLSLPEAFVVDGKWYSSFQLQSCHYTIQIGDEVLPYTCNYGGHGKCPLLRCGEELFVYGCSISAALEPGSVMGNLTLVPWRCGQPRGSPFIADIAPFPLHPPDYIF

SEQ ID NO: 60309 - protein, 340 aa, Moorella thermoacetica ATCC 39073
MAKIITFGEIMLRLSTPEYQRFVQAESFNVTYGGGEANVACSVVNYGAEAAFVTKVPANPLGQAAINHLRRYGVDTSHILQGGERLGIYFLETGASQRPSKVVYDRKYASIAGVQPGEFDWARIFSGASWFHFTGITPALGENVAAVTLEAARKAKEMGLTVSCDLNYRKNLWTPEQARATMTELMTYVDVAIGNEEDAEKVFGIKAAASDVTKGEINEEGYRQVARELLNRFNLQKVAITLRESFSAFDNGWSALIYDGQEFYRSRRYQIHIVDRVGGGDAFAGGLIYALTEGFAPAEALEFAVAASCLKHTIPGDFNHVTREEVLSLMRGDASGRVQR

SEQ ID NO: 60310 - protein, 487 aa, Deinococcus radiodurans R1
MTTTDLRTTYSSVTRSQAYFDGEWRNAPRNFEVRHPGNGEVIGEVADCTPTDARQAIDAAEVALREWRQVNPYERGKILRRWHDLMFEHKEELAQLMTLEMGKPISETRGEVHYAASFIEWCAEEAGRIAGERINLRFPHKRGLTISEPVGIVYAVTPWNFPAGMITRKAAPALAAGCVMILKPAELSPMTALYLTELWLKAGGPANTFQVLPTNDASALTQPFMNDSRVRKLTFTGSTEVGRLLYQQAAGTIKRVSLELGGHAPFLVFDDADLERAASEVVASKFRNSGQTCVCTNRVYVQRGVAEEFIRLLTEKTAALQLGDPFDEATQVGPVVEQAGLDKVQRQVQDALTKGAQATTGGQVSSGLFFQPTVLVDVAPDSLILREETFGPVAPVTIFDTEEEGLRLANDSEYGLAAYAYTRDLGRAFRIAEGLEYGIVGINDGLPSSAAPHVPFGGMKNSGVGREGGHWGLEEYLETKFVSLGLS

SEQ ID NO: 60311 - protein, 515 aa, Oryza sativa (indica cultivar-group)
MAAPPQPQPEPEPAAGGAGLEALEGLALDTVIAKAGARQAAALACASTRLRDAAGDDALWRRFCADDLALHAPLAPDGRALPSFKNSIFEQCDGISLCEPGCGDSSPFHHASLDTDVAWLLLPPFWPPESTVIRQIGIEWEDKDAYKVWLESFGMYPLPLVRRVKIFWSSLKSWLSENFPEAHKTLNKGVSEAQIQSAEDDLGFKLPLPTKLLYRFCNGQLPLSEHHHENMRMAHLGIIGGYVFYDHLINVHLSPLEQIVEETKEFYREFYDQGVFNMTNLIIVATSWYRPKTFFLNCSDDQLYVGTINLQDGEMLPCVPKSLIRPTNTDMPQDGLLLWLEEHLRRLQNGMIKIRMLKTSRYISLFPEASPSCTSAMTNGVKVRASAVFAPEHPESRRPGAKCLYAYSIRLSVPEACMLGGVYYSSCQLYSRHWIIRWRDRVVSDVNGEGVIGKYPLLTTGQEEFVYESCTPLPDSPGSVEGSFTFVPGKLSRPEGKPFEVTVAPFPLEIPEYIF

SEQ ID NO: 60312 - protein, 392 aa, Deinococcus radiodurans R1
MKAIVWQGVNKVGVETVPDPTLLLPTDAIVKITSTAICGSDLHLLDGYIPSMETGDILGHEFMGEVVEVGSEVRKLKVGDRVVVPFNIACGVCDPCKRGFFSACDNSNPNHRMAEALYGATSGGALFGYSHMYGGYAGGQAQYVRVPFADVGPFKIESGLKDEQVLFLTDIFPTGYQAAEQCNIVPGRDVVAVFGAGPVGQFAARSAQMLGAAHVIVIDRVPERLAMAEAAGCQTINYEKEDVLLSLREATGGRGPDHVIDAVGMEAHGHGPGSTMDKVQQNLKLTFDRITALRWAILSCAKGGTVSMPGVYGGLVDKMPIGAAFAKGLIFRMGQTHTHRHIPSLLGRIEAGQIDPSFVITHRASLDQAPELYKTFRDKQDCCIKVVLNPWA

SEQ ID NO: 60313 - protein, 320 aa, Dechloromonas aromatica RCB
MNAFPTAVDPLRLYEQLLLIRAYENAIVRGSTDGRIPGTCTSVGQEAAAVGAINALEADDLILTNHRSAGHLLARGADPGRMLAEVMGRRDGYCKGRSGSLHISAKELGVVLTTTIVGGELSLAPGVALAQTMQGRPGIVACFFGDGAACEGSFHESLNLAALWNLPVLYICENNQWQAFVHRREAMSSEHVSDWGAGYGIPARTVDGNDVFAVLEATREAATQVRDTRRPVLLEVLTYRTRGHFEPDDQGYVDKAELAAWLARDPIALCRDRLIADGHLDVAADAELAARVEASIAAAVAFAAASPFPSIEELTLDVYA

SEQ ID NO: 60314 - protein, 337 aa, Dechloromonas aromatica RCB
MPTLTLNDAIGLALAEEMRRDHKVIAFGEGIATKRHELVTEFGALRVRNTPLAEGIIAGTAAGAAAGGLRPVADLLFAPFLCYAMDELVNSAGKLRYMSGGQFSFPLVALAMTGAGWGVGAQHNHNVEAWFVHSPGLKVVMPSNPADARALLKTAIRDDNPVVFLLDIGLLYQPGEVPSEAVPIPLGQATTVRAGTDVSLISYGKTVHHCAQAAGSLAAEGIAAEVIDLRSLKPLDEAAILATARKTGRVVVVHEANRLCGVGAEIAALIAEQAFASLKAPVVRLGGPDAPVPSSFPLEQATVPQADAIAAAARQLCASRRALTHPPTENSKCALPH

SEQ ID NO: 60315 - protein, 566 aa, Mycobacterium tuberculosis
MDVSHHHHHHGMATARPAKARNEGQWALGHREPLNANEELKKAGNPLDVRERIENIYAKQGFDSIDKTDLRGRFRWWGLYTQREQGYDGTWTGDDNIDKLEAKYFMMRVRCDGGALSAAALRTLGQISTEFARDTADISDRQNVQYHWIEVENVPEIWRRLDDVGLQTTEACGDCPRVVLGSPLAGESLDEVLDPTWAIEEIVRRYIGKPDFADLPRKYKTAISGLQDVAHEINDVAFIGVNHPEHGPGLDLWVGGGLSTNPMLAQRVGAWVPLGEVPEVWAAVTSVFRDYGYRRLRAKARLKFLIKDWGIAKFREVLETEYLKRPLIDGPAPEPVKHPIDHVGVQRLKNGLNAVGVAPIAGRVSGTILTAVADLMARAGSDRIRFTPYQKLVILDIPDALLDDLIAGLDALGLQSRPSHWRRNLMACSGIEFCKLSFAETRVRAQHLVPELERRLEDINSQLDVPITVNINGCPNSCARIQIADIGFKGQMIDDGHGGSVEGFQVHLGGHLGLDAGFGRKLRQHKVTSDELGDYIDRVVRNFVKHRSEGERFAQWVIRAEEDDLR

SEQ ID NO: 60316 - protein, 338 aa, Acremonium chrysogenum
MGSVPVPVANVPRIDVSPLFGDDKEKKLEVARAIDAASRDTGFFYAVNHGVDLPWLSRETNKFHMSITDEEKWQLAIRAYNKEHESQIRAGYYLPIPGKKAVESFCYLNPSFSPDHPRIKEPTPMHEVNVWPDEAKHPGFRAFAEKYYWDVFGLSSAVLRGYALALGRDEDFFTRHFRRDTTLSSVVLIRYPYLDPYPEPAIKTADDGTKLSFEWHEDVSLITVLYQSDVQNLQVKTPQGWQDIQADDTGFLINCGSYMAHITDDYYPAPIHRVKWVNEERQSLPFFVNLGWEDTIQPWDPATAKDGAKDAAKDKPAISYGEYLQGGLRGLINKNGQT

SEQ ID NO: 60317 - protein, 472 aa, Rhodococcus sp. RHA1
MASDLTRTTAPSQHADAPGRHSHRLGIIAVVATFGGLLFGYDTGVINGALEPLEEDLHLTSFTEGLVVSILIFGAAIGALVGGRMSDRFGRRHNILVLAIIFMIGTIGCVLSPTWEVLALFRFILGLAVGGASATVPVYLSEISPTERRGSVVSRNEVMIVVGQFAAFVINAVIFNIWGEHENVWRFMLLVAVIPAIFLFAGMLRMPESPRWLMSQDRHDEALAVLLQVRSPERARAELEEVRALAEEEKLSQTGGAADLSVKWIRRLIFIGVGLGVFQQATGINSVMYYGTQLLGDAGFSSNAAIVANTLNGLFSVLGVLTGVALINRIDRRKMLIGGFTLTTTFHVLVGLSAFLLPDGTLKAYLILTFVVLFVFSMQATIGPLVWLMLSEIFPLKIRSFAIGVCIFALWIANAVVALLFPPVVTALGIGATFFIFAGLGVLALVFIKTQVPETRGRSLEELEDQFRHDYS

SEQ ID NO: 60318 - protein, 409 aa, Arabidopsis thaliana
MGSLRRSTSNRSRKKGTAVKMNRMPSSLSPPTPPCSAIVGGTGKSKKRRGGVCLWTRFDRTGFMEVAGCDKSTIIERSSVSAKDLRTAFSHSSKILAREKAIVLNLEVIKAVITSEQVMLLDSLRPEVLTLTDRLKHHFPRKDGPENILQASSHGHQEGGEEGLKSKLPFEFRVLEIAFEVFCSFVDSNVVDLETQAWSILDELTKKVSNENLKDLRSLKTSLTHLLARVQKVRDEIEHFLDDKEDMEDLYLTRKWIQNQQTEAASNSIVSQPNLQRHTSNRISTSMVTEEDDIDDMEMLLEAYFMQLEGMRNKILLMKEHIDSTEAYVKILQNSRRNGLIHLMMLVNIGNYAITAGTVVVNLFGMNIPIGLYSTPDIFGYVVWAVVALCIVLFIVTVGYAKWKKLLDG

SEQ ID NO: 60319 - protein, 263 aa, Triticum aestivum
  misc_feature (96)..(96): Xaa can be any naturally occurring amino acid
MAQPAELSREENVYMAKLAEQAERYEEMVEFMEKVAKTVDSEELTVEERNLLSVAYKNVIGARRASWRIISSIEQKEESRGNEDRVTLIKDYRGKXIEVELTKICDGILKLLDSHLVPSSTAPESKVFYLKMKGDYYRYLAEFKSGTERKDAAENTMVAYKAAQEIALAELPPTHPIRLGLALNFSVFYYEILNSPDRACDLAKQAFDEAISELDSLSEESYKDSTLIMQLLRDNLTLWTSDISEDAAEEMKDAPKGESGDGQ

SEQ ID NO: 60320 - protein, 425 aa, Helicobacter hepaticus ATCC 51449
MVYIEAIDAQEVMDSRGNPTVRAAVRLSDGTRAAAIVPSGASTGKREALELRDGDKERYLGKGVLKACANIKTEIAAQLDGVSPYDQSKIDLILKKIDGTENYSELGANATLGVSMAIARASAQSLRLPLYRYLGGSNALTLPTPMLNIINGGSHADNTVDFQEYMIMPLGFDTFAESLRASAEIYHHLKAILKGSGHITSIGDEGGFAPNLKNNEEPIEIILKAIEQAGYKPLDEIAIALDVASSELVDENGMYHLAGEGKVLDSAGMIAYYENLVAKYPIVSIEDGLSEDDWEGWKLLTQKLGNKIQLVGDDLFVTNKKILQEGIEKNIANAILIKPNQIGSVSETMQSVRLAQRNNYKCIMSHRSGESEDTFIADFAVALNTGEIKTGSTARSERIAKYNRLLEIEREISDAEYIGKTLFKR

SEQ ID NO: 60321 - protein, 1395 aa, Burkholderia sp. 383
MTATPVKSVCPYCGVGCGMVLHVEEGEVVKVSGDSDHPTNFGRLCTKGSSAHVALRRSGRLDRAFVRRAREDDLVPLSGRDAIAETARRLRTVLDTYGPDALSFYVSGQMSIEAQYLVNKLAKGFVGTNNIESNSRLCMASAGTGYKQSLGADGPPGSYQDFDRANLFFVIGANMADCHPILFLRMMDRVKAGAKLIVVDPRRTGTADKADLFLQIRPGTDLALTNGLLHLLHANGRTDAAFIDAYTEGWDAMPAFLADYTPERVAEITGLAEADLRTAAQWIGDAQEWMSCWTMGLNQSTHGVWNTNAICNLHLATGRICRPGSGPFSLTGQPNAMGGREMGYMGPGLPGQRSVASDDDRRFVENLWRVPAGTLRKETGQGTVDMFSRMAAGDIKACWIICTNPVATVPNRQNVIAGLQAAELVIAQDAFLDTETNRYADILLPGALWAEGDGVMINSERNLTLMRAAVAPPGDALPDWRIVAEVARAMGFGDAFDYASAADVFDEIVRFSNPATGYDLRGASHAALRDGPVQWPVAPGTARERHPIRYLNDGVSQTLRPAADGNDAPRLAFPTPSGKARFFARPHVDPAELPDDTFPIVLNTGRLQHQWHTMTKTGKVAMLNKLNPRPFVELHPDDASALGIAAKDSVEIRSARGRAVLPAVVTERVQRGNCFAPMHWNDVYGDDLCINAVTNDAIDPESQQPELKYCAVALRRVETDAFASADDETAQPDARADDVRPAPVMTQATASQESDMADIDTFAAALGVADLAPPPLTDTERLYVAGLVSGLKASAGKREGSVPVLPAAAPLTPPVRFWLDGMLAGLFSRSLPASVPGAAAPALPADAGASGGVRIVRTRPKVVLLWASQTGNIESLTEDYATQLMNAGFEIRTACMSDYPVASLAGAQYVLLMTSTFGDGDAPDNGSEFWEALQAGSAARLDGVHFAVLAFGDRNYDQFCGHGRRLDARLAELGAARLCARVDCDVEFQRDADQWLERVVARIKEADAALHAVPTGGMSPSGLLPTKAHPAPSKLVANLRLNRPGAAKDTRCVSLSTEGANLEYETGDALGVWPTNCPELVDELLSVTALKADSPVSVAGVGDVRLGDALARHFDITRPHPDTLAFIASRSANGALKSLLGDERKGDLKQWLWGQQLADVLHEFPVELSGTELVGMLKRMQPRLYSIASSPSAHQGEIHLTVSAVRYHNGRRARKGVASTFLADRADDGRVPVFVQKSAHFRPPVNGDVPIVMVGPGTGVAPFRGFLHERQARGARGRNWLFFGEQHAQTDFYYGDELGAMHDSGFLTRLDLAFSRDQADKIYVQDRMREQGAELFAWLEEGAHFYVCGDAARMAKDVDTALKAVVAEHGGMSDEAANDYVARLSKARRYMRDVY

SEQ ID NO: 60322 - protein, 239 aa, Zea mays
MASTSSIGDVGASDAKSRVEDVWKKMNGGFPNKMPKPAMTKLSSTATEKKNKPTNNWMTVLGLSPSKACNSSQGSKNGLKWTQHETREDAKKLAAKALAAAKNAAAVASGRGKVEITEVRDFAVKDIEIKKLVDPNSKEAIEKAKAAGAAPSAVDSILEQIRKKQKLSVLDKTKKDWGEYKEENRGLEEELDAYKKSSNQYLDKQSFLQRTDYREFERERDARLSMMAKRRTDMREDDV

SEQ ID NO: 60323 - protein, 407 aa, Oryza sativa (indica cultivar-group)
MGDDIDARYEVPRTAEFIRARAYTRVALQVFYGLEYAHALDDLKAVVAKLYKSHSRSVEVQYADVLCSVMSPSSAAEVEHGQSDGSTHSDDLSIQSDVATFVNNCCNVEGSTCKYSLGGLTWSTSIDDNMEDYLLYWIGQDNSAFANIVLTFNKCDIVRYDTVANQPSRDVSHLMKILRRRYYLVEKAKDANIVGILVGTLGVAGYLHIIEQMKDLIKAAGKKSYTLVMGRPNSAKLANFPECEVFVYVSCAQTALLDSKDFLAPVITPFEAVLAFSRGREWTGEYLLDFKDLITTDKPEISSTTEEARFSFIKGGYVEDNCLEDNEEQPETSLALAEVTEKALSIKNQNNDAVLYQGGAKSAIDYLKARSYRGLTGEYEGPAPDSVLTGRTGRAAGYNNEKKEITQ

SEQ ID NO: 60324 - protein, 148 aa, Oryza sativa (japonica cultivar-group)
AIEDGIRGKALAYGAKEKGARVVIANRTFARAQELGNLLGAPALTLAELENYHPEEEMILANTTAIGMHPNVNETPLSKQALKSYAVVFDAVYTPKETRLLREAAECGATVVSGLEMFIRQAMGQFEHFTGMPAPDSLMRDIVLTKIQ

SEQ ID NO: 60325 - protein, 416 aa, Candida glabrata CBS 138
MSLSSKLTVQDLELKDKRVFIRVDFNVPLDGKKITSNQRIVAALPTIKYVLEHNPRYVVLASHLGRPNGERNEKYSLAPVAEELQSLLGKPVTFLNDCVGSEVDSAVKASAPGSVILLENLRYHIEEEGSRKVDGQKVKASAEDVAKFRKELCSLADVYINDAFGTAHRAHSSMVGFDLPQRAAGFLLTKELQYFGKALENPTRPFLAILGGAKVADKIQLIDNLLDKVDSIIIGGGMAFTFKKVLENAEIGDSIFDKAGAEIVPKLMEKAKAKGVEVVLPVDFVIADAFSADANTKIVSDKEGIPAGWQGLDNGPESRKLFAATIAKAKTIVWNGPPGVFEFEKFASGTKAMLDEVVKSSTSGNTVIIGGGDTATVAKKYGVTDKISHVSTGGGASLELLEGKELPGVAFLSEKN

SEQ ID NO: 60326 - protein, 563 aa, Deinococcus radiodurans R1
MFCPQWKFTFLINQRPCAAGQLSRRGFAPSFAAFSGAAMSDIEALKKELPPFQIFDLIPQYAAAGQIDPEKIDLLKWAGVYPQRPQEDGFLMMRVKVPTAELHTDALRVVAGISEDFGRGLLDVTDRQAFQFHWLRIQDIPEILDRLETVGLHTKGACGDTVRAVIASPLAGLDAREKIDVRPLAAAMEGTLSGNHDFEDLPRKFKISITATPELEGIHLINDIGFLAHEVDGEIGFDVWVGGGLGAVPHLAERLGVFIRPDEVVEVGRAIVGAYRDHGYRVNRKKSRLKYLIKDLGPAKFREIVETEYLGRPLRDGPSAPVARFGGSDVLGVNPQKDGLNYVVLTTTVGRITPEKARRLADLAEQYGNGYLRTTAFQNMMIPNVPDEHVGALVAELQELELAPKATLRGTTIACTGTQFCRLAQTETKARVAGMIDVLEPRHNDLDVPFVINLTGCSNACTRYQVADLGFMGALRANKETGGEDEVYNVHLAGSIGQAQRTGTKLRGIVPAERLTEYTDRVISDFKANKTPGESFVEYADRVGADRFVPDTVLDGGKELVNA

SEQ ID NO: 60327 - protein, 104 aa, Kluyveromyces lactis NRRL Y-1140
NTFLLTLITKILRFNIDSGYIGEFEYIDDHRSGKIVVQLNGRLNKCGVISPRFNVKIADVEKWTANLLPARQFGYVILTTSAGIMDHEEAHRKHVSGKILGFVY

SEQ ID NO: 60328 - protein, 336 aa, uncultured archaeon
MMKVAINGWGRIGRLVFRAVLQDHSALDFVAINSRSADASWIEHLLTYDSVHGKQEGAIRAEKDTLFVDGKEIKILSESDPENLPWRDLGVDVVVESTGQFRDRKGASKHLKAGCKKVIITAPGKEPDVTLVPGVNDAMYNPATHNIISLASCTTNCLAPVAKVLEDEFGINRGFMTTVHAYTGDQKILDGRHKDLRRARAAAMSIVPTTTGAAAALGIVLPSLAGKMDGISLRVPTTNVSVVDLVAELGSEVTREAVNSAFEEASKTSLTGILAVSHLPLVSIDYNGSSFSAIVDAEYTTVVGGRLVKVLAWYDNEWGYSCRVLDMIKRLEAEGV

SEQ ID NO: 60329 - protein, 741 aa, Oryza sativa
MVRSGSVRRTAASSSPAAAAVPTAFTASPGDYRLLEEVGYGANAVVYRAVFLPSNRTVAVKCLDLDRVNSNLDDIRKEAQTMSLIDHPNVIRAYCSFVVDHNLWVIMPFMSEGSCLHLMKVAYPDGFEEPVIASILKETLKALEYLHRQGHIHRDVKAGNILMDSPGIVKLGDFGVSACMFDRGDRQRSRNTFVGTPCWMAPEVLQPGAGYNFKADIWSFGITALELAHGHAPFSKYPPMKVLLMTLQNAPPGLDYDRDKRFSKSFKEMVAMCLVKDQTKRPTAEKLLKHSFFKNAKPPELTVKSILTDLPPLWDRVKALQLKDAAQLALKKMPSSEQEALSMSEYQRGVSAWNFDIEDLKAQASLIHDDDPPEIKEDVDSDRINEADKEPFSGNHFGQPKILSGKHFSEQTCVTAVSPGGNMHETSRGLVSEPGDADSERKVDGYRKQGSENESLPSTSKHDSEGQNSSSEVKQKERTCSGPILCSGVHNKSITESSRIFDREAAVKLASDKQKSCTKRTTNLSGPLALPTRASANSLSAPIRSSGGYVGSLGDKSKRSVVEIKGRFSVTSENVDLAKVQEVPTSGISRKLQEGSSLRKSASVGHWPVDAKPMSNSHQRKELCNGSVSASVLIPHLRNLVQQTTFQQDLITNLLSSLQQNEKADATQYRLGNMDGDTEVETSISEGERSLLVKIFELQSRMISLTDELITTKLQHVQLQEELKILYCHEEIIDTREVDNA

SEQ ID NO: 60330 - protein, 144 aa, Daucus carota
MGSKIFLLLGLSIAFAILISSEVAARELAETAAKTEGYNNGGGYHNGGGGYNNGGGYHNGGGGYNNGGGYHNGGGGYNNGGGYHNGGGGYNNGGGHHNGGGGYNNGGGHHGGGGSCYHYCHGRCCSAAEAKALEATTAQVKPQN

SEQ ID NO: 60331 - protein, 297 aa, Salinibacter ruber DSM 13855
MSGTVCVVTGANSGIGKATAAELARLGARVVMVCRDEGRGREAQAELRAEARTAHPSRADTIDLRIADLSVQEEVYHLGETLRADYDRLDVLVNNAGVFLESREETVDGVEATFAVNHLAPFLLTHLVLPRLRETAGRAGEARIVTLSSEAHRGVSMDFDDLNAETGYNPLQAYAQSKLANILFTHELSRRLQDEGVVANVVHPGIVNTNIWRGSGWISRIARLFSWLYKRPEEGARNVVYLAASPDVEGVTGQYFKETEVVNPSPEAYDEKAEARLWRISREMTGLAEVDEDGAPG

SEQ ID NO: 60332 - protein, 404 aa, Kluyveromyces lactis NRRL Y-1140
LDNVFFTTTTSGELNLLKQSVVLDFNYSLIYSSTKLKLQSNKSKTKLLTSTKHLLDMSSHPFQVIDLCAPAEETSRLLLEAANTQGFLFIDGHSFSQQQVDALFRLSMEYFTNTPHHEKLQYAFDVAKNYGYTDYTREQGDPSKAKDFKECYNFGSINFSNGTYNGQSRSTSENCMQHGEVPPLFTYHNDLIVDSIKKFHELARNIMGLFTVALGIIQEDFFVSRFSDDKKNGCVMRLLHYPLFRDDGVDGSSGIDPTLRIGPHSDYGALTLLLQKEGEQGLEVQLDPGCDQWTKVPFLTSRYEGSAPPIVVNFGDMLSFWTKGVIRSTKHRVKIDPGETRSSDRYSIVFFTHPDADTTLDPVPSRVIESNSNGIGAPPVTAYEYLSAHLSRVINSIPSHDGMV

SEQ ID NO: 60333 - protein, 565 aa, Coxiella burnetii RSA 493
MLDITFKTDKNNKPYLETGITGKALLTIPQLNKGTAFTEEERDTFGLRGKLPNRVETLDDQVARAYLQYKSFDMQLNRNFYLNHLLDTNQVLFHRLVKNHVQEMLPTIYTPIVGNAVRAFNKRFMHPRGLYISYEDRNQIKKILNNRSHPIIDLIVVSDGEGVLGIGDQGVGAMAIPVAKLMVYTAIGGINPIRTLPILLDAGTNNEELLNDPLYLGWRHPRLSGNEYAEFIEKFIEAVQATFPQVFLHWEDFGRTNAYRNLIKYREITCSFNDDIQGTGCVALAAILAALKITRSTLPEQRIAVFGAGTAGMGITDTLFRALSQNGLSEKEARNPFWLIDRNGLLTEYSEEVTSAQQPYLRKKEEIASWKIKNPQQISLLEVIENVKPTILIGASAQSHAFDQTIVKAMAKHVEKPIIFPLSNPTDRSEAEPADLHRWSHGKALIATGSPFEDIIFDNQIFPVNQCNNYLAFPGIGLGAIAVKANRVSDNMLWSASQALSRYANESTHRLLPSIAQAQEASRQVAIAVAKTAIEEGLAKFSLDQVETLVDQQIWEPHYLSYRKR

SEQ ID NO: 60334 - protein, 452 aa, Streptomyces coelicolor A3(2)
MTSGSLHQRGTAREAALARAVEDGLLGPRTPLVGLLDVDGVLAAVDALNEAFEGPAPVQHTFAAKACGLVPVLRLLAEAGMGCEVASPGELEQALAAGFTYDRLVFDSPAKTVEELEFALAHGIAINLDNFQEMARVDGLLAGREAAGPIGLRVNPQVGAGAIGAMSTATATSKFGVALRDEGAVDAVIEAFARRPWLNRLHAHVGSQGCPLPLIAQGVRTAYELAERINRELGRAQITGLDIGGGLPVNFDGEDDRPTYADHVAELRSAAPGLFDGRYALITEFGRSLLAKSGTIASVVEYTKSAGGRRIAVTHAGAQVATRTVFMPDAWPLRVGVFDAAGRPKQGPAEVVDIAGPCCFAGDLTATGRELPAVEPGDVVALYDTGAYYFSSHFSYNSLPRPAVYGYRTDSRGQIAFALVREAQSVRAVVEESGLAQADALVALGTDQSAER

SEQ ID NO: 60335 - protein, 632 aa, Coxiella burnetii RSA 493
MCGIAGIFNLNGKPVAFDQIKAMTDSIAHRGPDGEGQFTDKYIGLGHRRLAIIDLSPAGHQPMQTKDGRYLITYNGEVYNFKILRKELETLGYSFFSNTDTEVVLNAYVQWGEKCLEKFNGMFAFAVWDRKEKTLFLARDRYGIKPLYYYQTNDCFVFASEIKAIIASGLYGAEINKEALVEYLTFQNFFTDRTLFKDVRIMPAGHFMMVKRENSSLHQYWDFNFTNDSALSEKMLLEKINDLFQQAVNRQLVSDVPVNSYLSGGVDSGSITMIAAKQLPHIRTFTVGFDLSSASGLELAFDERQAAEHLSYLAGTEHYEMVLKAGDMERCMQDLVWHLEEPRIGQSYPNFYAAKLASKFGKVVLAGTGGDELYAGYPWRYLCGQSSENFEDYIDKYYQYWQRLMSNKNLFKVLAPIAEEVKSIWTRDIFANVFRIKDTPIKTEDYINYSLYFEAKTFLHGLLVVEDKLSMAHGLETRVPCLDNDFVDFALQVPVKYKLSDFAFERVNENDTFSKREKRMNGKKILRKMMSRYVPDNVAHAPKQGFSAPDASWFKGESIEFVRSLLGDRNAKIFELLDYSVVNHLVNDHIQNHHNHRLLIWSLIYLEIFMQVHLSKGHKSNYHLFTPETVEL

SEQ ID NO: 60336 - protein, 525 aa, Yarrowia lipolytica CLIB122
MSVPIFSDQVVEERGENARLSAFVGAIAVGDLVKTTLGPKGMDKLLQSASSGNSLVTNDGATILQQIPFDNPAAKVLVNISKVQDDEVGDGTTSVTVLAAELLREAEKLVDLKIHPQVIIEGFRIATKAALSALEKSAVNNGANPELFRKDLEAIARTTLSSKVLSGDKDYFAKLAVDAVLRLKGSTNLEHIQIIKKFGGQLHESYLDEGFILNKRFGTNQPSKITNCKIMIANTPMDTDKVKVFGAKFKVDSTQKLAELEKAEKDKMRAKVEKIKNHGITCFVNRQLIYNYPEALFTEAKVNSIEHADFEGVERLALVTGGEVVSSFEHPELVKLGYCDSIEEVTVGEDIMTKFSGVAAGEACTVVLRGATNQILDEAERSLHDALAVLSQTTAETRTTLGGGCAEMVMSQAVERAAQSVDGKQSLAIEAFARALRQLPTILADNAGFDSSELVSKLKSAIYNGLHTSGLDLNNGVVADMRDLGIVESYKLKRAVVSSAAEAAELLLRVDNIIRAKPRTADRRH

SEQ ID NO: 60337 - protein, 427 aa, Ipomoea batatas
DMPLDSDVFRVPPGYNVPQQVHITQGDYEGKGVIISWVTPEEPGSKTVVYWAENSSVKRRADGVVVTYKYYNYTSGYIHHCTIKDLEYDTKYYYELGLGDAKRQFWFVTPPKPGPDVPYTFGLIGDLGQTYDSNTTLTHYELNPVKGQSLLFVGDLSYADRYPNHDNNRWDTWGRFVERSTAYQPWIWTAGNHEIDFVPDIGETVPFKPFTHRFFMPFESSGSTSPLWYSIKRASAHIIVMSSYSAYGTYTPQWKWLQGELPKVNRSETPWLIVLMHCPMYSSYVHHYMEGETMRVLYEPWFVEYKVDVVFAGHVHSYERTERVSNVAYNIVNGLCSPKNDSSAPVYITIGDGGNSEGLATEMTQPQPSYSAYREASFGHGIFDIKNRTHAHFGWHRNQDGLAVEGDSLWFINRYWMSKEEASVSAV

SEQ ID NO: 60338 - protein, 596 aa, Candida glabrata CBS 138
MSNNNSSISNKVINLFRSGSKSSKAVKPTDKTAIKQNAKPTVAAITTRISSETGEGSSPPRSGSSESILSSDIHKQKSSPTTRSSSSLALDNSAAVSNTVQAGAPISANVQASSSTVKLSTMDSSRSESNTHHDNSHSHTNCMRFMVHEDGSHEHHLKNARRQEKLTSMIKNIMKTNNYSTAQKKLRNEAKSAVPDIITSPVVSTPITPKLQSPLNPSQGGPQYKGPPSLFAGYMKQVVGNDGQVAINGPVSGAFNGDQKVMYQDNETNEDIQQAPLTLPPHFNDSLSFAEKYGSCKEILGKGAFGVVRICHKKVPENPKVEKLYAVKEFKRKATEPKEKFAKRLTSEFCISSSLHHTNIVDTLDLFQDANGDYCEVMEYCAGGDLFTLIIAAGKLEYMEADCFFKQLLRGVVYMHDMGVCHRDLKPENLILTHDGVLKITDFGNSECFKMAWEEDIHLSGGVCGSSPYIAPEEYVLEEFDPRPVDIWACGVIYMAMRTGRQLWTAAKKDDPFYNKYLQGRRQKSGYEPIESLKRARCRNVIYSMLDPAPHRRINGKQILNSEWGREIKVCYDKQIAVTSRSDSQQSRVHAPITVK

SEQ ID NO: 60339 - protein, 215 aa, Mycobacterium tuberculosis H37Rv
MAHHHHHHGPNTNPVAAWKALKEGNERFVAGRPQHPSQSVDHRAGLAAGQKPTAVIFGCADSRVAAEIIFDQGLGDMFVVRTAGHVIDSAVLGSIEYAVTVLNVPLIVVLGHDSCGAVNAALAAINDGTLPGGYVRDVVERVAPSVLLGRRDGLSRVDEFEQRHVHETVAILMARSSAISERIAGGSLAIVGVTYQLDDGRAVLRDHIGNIGEEV

SEQ ID NO: 60340 - protein, 1816 aa, Arabidopsis thaliana
MVMYKEDYVSNSRGIQLFTCSWKQEEQQEPKALIFLCHGYAMESSITMSSTAVRLANAGFSVYGMDYEGHGKSGGLNGYVKKFDDLVQDVSSHYSSICELEENKGKMRFLMGESMGGAVVLLLERKKPNFWDGAVLVAPMCKLAEDIKPHPMVISFLTKLTRFIPTWKIVPSNDIIDVAFKETHIRKQVRDNEYCYKGRPRLKTAHQLLMVSLDLEKNLDQVSMPFIVLHGEDDKVTDKNVSKLLYEVASSSDKTFKLYPNMWHGLLYGESPENLEIVFSDIISWLKERASVTNQKLETELKHAHVDGQVGYSEEFIENSRGMQLLTCKWFPVNQEPRALIFFCHGYAIDCSTTFKDIAPKFAKEGFAVHGIEYEGHGRSSGLSVYIDNFDLLIDDVSSHFSKISEMGDNTKKKRFLMGESMGGAVVLLLHRKKPEFWDGGILIAPMCKIAEEMKPSRMVISMINMVTNLIPSWKSIIHGPDILNSAIKLPEKRHEIRTNPNCYNGWPRMKTMSELFRISLDLENRLNEVTMPFIVLHGEDDKVTDKGGSKLLYEVALSNDKTLKLYPEMWHSLLFGEPPENSEIVFNDIVQWMQTRITTLQMYLYSLTLQQATGIVCAINGNFSGGKTQEIAVARGKILDLLRPDENGKIQTIHSVEVFGAIRSLAQFRLTGAQKDYIVVGSDSGRIVILEYNKEKNVFDKVHQETFGKSGCRRIVPGQYVAVDPKGRAVMIGACEKQKLVYVLNRDTTARLTISSPLEAHKSHTICYSLCGVDCGFDNPIFAAIELDYSEADQDPTGQAASEAQKHLTFYELDLGLNHVSRKWSNPVDNGANMLVTVPGGADGPSGVLVCAENFVIYMNQGHPDVRAVIPRRTDLPAERGVLVVSAAVHKQKTMFFFLIQTEYGDVFKVTLDHNGDHVSELKVKYFDTIPVASSICVLKLGFLFSASEFGNHGLYQFQAIGEEPDVESSSSNLMETEEGFQPVFFQPRRLKNLVRIDQVESLMPLMDMKVLNIFEEETPQIFSLCGRGPRSSLRILRPGLAITEMAVSQLPGQPSAVWTVKKNVSDEFDAYIVVSFTNATLVLSIGEQVEEVNDSGFLDTTPSLAVSLIGDDSLMQVHPNGIRHIREDGRINEWRTPGKRSIVKVGYNRLQVVIALSGGELIYFEADMTGQLMEVEKHEMSGDVACLDIAPVPEGRKRSRFLAVGSYDNTVRILSLDPDDCLQILSVQSVSSAPESLLFLEVQASIGGDDGADHPANLFLNSGLQNGVLFRTVVDMVTGQLSDSRSRFLGLKPPKLFSISVRGRSAMLCLSSRPWLGYIHRGHFHLTPLSYETLEFAAPFSSDQCAEGVVSVAGDALRIFMIDRLGETFNETVVPLRYTPRKFVLHPKRKLLVIIESDQGAFTAEEREAARKECFEAGGVGENGNGNADQMENGADDEDKEDPLSDEQYGYPKAESEKWVSCIRVLDPKTATTTCLLELQDNEAAYSVCTVNFHDKEYGTLLAVGTVKGMQFWPKKNLVAGFIHIYRFVEDGKSLELLHKTQVEGVPLALCQFQGRLLAGIGPVLRLYDLGKKRLLRKCENKLFPNTIISIQTYRDRIYVGDIQESFHYCKYRRDENQLYIFADDCVPRWLTASHHVDFDTMAGADKFGNVYFVRLPQDLSEEIEEDPTGGKIKWEQGKLNGAPNKVDEIVQFHVGDVVTCLQKASMIPGGSESIMYGTVMGSIGALHAFTSRDDVDFFSHLEMHMRQEYPPLCGRDHMAYRSAYFPVKDVIDGDLCEQFPTLPMDLQRKIADELDRTPAEILKKLEDARNKII

SEQ ID NO: 60341 - protein, 525 aa, Zea mays
  misc_feature (182)..(182): Xaa can be any naturally occurring amino acid
MAEVKPEEISHPPMEQLQGFEYCIDSNPPWGEAIILGFQHYILALGTAVMIPTVLVPMMGGDDGDRVRVVQTLLFVTGINTLLQSLFGTRLPTVIGGSYAFVIPIMAIIQDPSLSGIPDGHERFLETMKAIQGALIVSSSIQIILGYSQLWGIFSRFFSPVGMTPVVALLGFGLFERGFPVXVGRCVEIGLPMLILFVVLSQYLKNIQIKEIPILERFSLFICVALVWAYAQILTSGGAYKNSAEVTQNNCRTDRANLISSAPWIKIPYPLQWGAPTFNAGQSFGIVSAVLVSLVESTASYKAAARLASATPPPAHILSRGIGWQGIGILLDGLFGTGTGSTVSVENVGLLGSTRIGSRRVIQISAGFMIFFSMLGKFGALFASIPFTIFAAVYCVLFGLVAAVGLSFLQFTNMNSMRNLFIVGVSIFLGLSVPEYFFRYTMAAHRGPAHTKAGWFNDYINTIFSSPPTVGLMVAVFLDNTLEVKQAGMDRGMPWWQRFRTFKGDSRNEEFYRLPFNLNRFFPPA

SEQ ID NO: 60342 - protein, 569 aa, Mycobacterium avium 104
MLAALAIFFRGERPMTTARPAKARNEGQWALGNREPLNPNEEMKQAGAPLAVRERIETIYAKNGFDSIDKSDLRGRFRWWGLYTQREQGYDGSWTGDENIEKLEARYFMMRVRCDGGAISAAALRTLGQISVDFARDTADITDRENIQYHWIEVENVPEIWRRLDAVGLRTTEACGDCPRVILGSPLAGESLEEVIDPSWAIAEIARRYIGQPEFADLPRKYKTAISGLQDVAHEVNDVAFIGVNHPEHGPGLDLWVGGGLSTNPMLAQRVGAWVPLHEVPEVWAAVTSVFRDYGYRRLRSKARLKFLVKDWGIEKFREVLETEYLKRPLIDGPAPEPVAHPIDHVGVQRLKNGLNAVGVAPIAGRVSGTILLAVADLAQQAGCDRIRFTPYQKLVLLDIPDDKLDEVVAGLEALGLQSQPSHWRRNLMACSGIEFCKLSFAETRVRAQGLVPELERRLADVNRQLDVPITINLNGCPNSCARIQVADIGLKGQMVDDGEGGSVEGFQVHLGGSLGQDSGFGRKLRQHKVTSDELGDYIERVARNFLKYRGEGERFAQWAMRADEDDLR

SEQ ID NO: 60343 - protein, 384 aa, Arabidopsis thaliana
MGWWRKKKKPKSEIASERGAKLLKDLIECCDGKSNPIKFFSADEIRKATNNFGVSNLVSELSHDFDYKWYSGKNENHDMILVRKAFSQSVYYKDTFFRDIAVSSMVSGHKNFLKLIGYCLEFEEPVMVYHGVKKHYHLESSEQPWKRRMKIAEDIATALAYLHTAFPRPFVYRCLSLTNILLDEDGVAKLMDFSFCVSIPEGETFVQVDYIAGTVDYLKPNYLKHGVVSEETDVFAVGHSMQMLLMGEKIFDRIMRRPFPTSKFMEEPKMDEIADPEMGEISEEELCQMKAFLLLSLRCTGHVGEVPTMVEVAKELKSIQRCLHNDTFSPSVETQFDSHQDISSSVILSNQTKDTRALLRYIINRKALVSLPLSDLVGKNDQRD

SEQ ID NO: 60344 - protein, 454 aa, Deinococcus radiodurans R1
MTATQAKPRQPDLKTSLPGPKTAEIMARDQATLSTSYMRPYPFVPDFGKGVWLTDVDGNTMLDFFAGIAVSTTGHAHPHVVQAVQRQIEKFTHVCLTDYPQEITTSLAERLVKHVERPGEKWRVFFSNSGAEAVEAAVKLARNHTGRQHIISTMGSFHGRTYGAITLTGSKTKYKRGFGPLLPAVSHVPYPNPFRPPLGSTPENCGQAVIDHIESLFVGILPADEVAAIIVEPMQGEGGYIVPPADFLPGLRALCDKHGIMLIFDEVQAGMGRTGKMFSFQHFDVQPDIITSAKGIASGMPLGALLAKESVMTWPVGSHGSTYGGNPVAAAASHATLDLLEGQVKHEGCGDSLMDNAAQVGDFILGELKGMQDEFPFIGDVRGRGLFIGIEFVKPDGSPDGALRDQASMMMFEKGLLNLDCGEAVIRISPPLILTREEAATGLDIMRGVFQELK

SEQ ID NO: 60345 - protein, 627 aa, Hypocrea jecorina
MPRFVTLAPASATLMAVIGLASAGSLKDIDHVVLFMQENRAFDHYFGTMAGVRGFADANLQMNDGVPVWKQVTNSQLTNETDYVTPFYINYLGGNWTEATQCMVSGSNSWQENHAAWNSGRNDRWAVDNSPYSIGFYKRQDIPIQFALADSFVVADMYQEAIVAATNPNRVTWLSGSVNVPGGPQTPDQGGNPYIDNNITPGCEPGGFNCYPLKWKTVGEHYEDAGVTWQVFQDADNFDDNSYARFQQFQDAEPGSSLYERGMKGLSLDTFYAKAANGTLPEVSYIVAPMELSEHPPYSPHDGAWLQHQVAQAVLNSPKYNRTALMISYDETGGWFDHVDPYRSPRDTAGEWIDDPYGQVGYTFVGPGFRLPFYIISPWTRNGGVFSAHSDHNSQILFVEKWQAAKGRNVTTEEMVYWRRSHMSDLVDAFDFDHPDYSIPQLPEPQTPHTDSNGVYDGSSYCQSLYSEVQPPVPYTGTGVIADLTTQVERGFKPLRGMLTEGRHLVLEANGFALTQKTSFLGTIVLSRATERHDAPSQRWIAHAVTVGGDEFTLSDDSGRNYICDNGQLCSDAGKAVVFTVGYKSGKGYSFGVKGTGRYLGVGGRGASSYASLNGGLGYWKVYSVSY

SEQ ID NO: 60346 - protein, 433 aa, Aspergillus clavatus
MTVLSLAIFFTLGLGVGAAPRRPHGKTSSPIKNVVVLVQENLSFDNYAGGLTYNPNIDGLVHREYCNPANISDPHSAMVCAQPIAKNVAADDPDHSITGGNQQVYSTYHPDYEANSPGMQGFIAEQIAAYGIMGDLSRAAEVINYYTPEHVPVFNAMAQNFVLFDRWFAAVPGPTNPNRAYLTSGTSHGHGTNDGDFLTSSLPQRSIFEQLSANGISWINYSNTTDFLPDALFYSWTAKSGLGETNVRPVDQFYRDAQAGALPQFTWINPECCSYMSFHPPSPINMGEGWIKSVYEALRSSPQWNETLFVLTFDEHGGFADHVSPPENVPPGDDLTYTETARDGKASTFAFDRLGIRVPTVLMSPWVGKGVVQNKPSGQPGEFTHTSILKYVADLWGLEYLSPRVEWSASFEDLITDTFRDDTPERLPEPADF

SEQ ID NO: 60347 - protein, 314 aa, Rhodococcus sp. RHA1
MDTASTVVRRSTVEYAPDLLLDLVRPAEAEHPLPAIVWIHGGGWRLQDRTACPDLVQHFAQHGYVMVSIDYRLAPGTCHPGQLFDVRRAVRWLRANAADHGIDPDRIGVWGSSAGGHLAALTGVHSGTTRLPGEEPATVDSSVQAVVDGYGPGDLPGLVDLSAERTPGEDHSPEASLLGGAIRDRLDAARSASPALQVAPGAPPFLVMHGLGDNLVPFAQSVALYDALVAHGNDAVLYLIEGFGHGFFNPGHVLELGPDQTLDQGRLERDPQAPASTRAVSDVGRALTERYPSASFAAVEAFFSHTLKPGTGTP

SEQ ID NO: 60348 - protein, 380 aa, Arabidopsis thaliana
MEYGEEPSIKRFLMLPDDLVFNCLARVSRLHYPTLSLVSKKFRFLLASKELYQTRILLGGTESCLYVCVRLHTDSEQLHWFIIYQGPNSSKKVLVPISSPNFTSAALPGFVVVGHEIYAIGGGSENKNASINATGSKTYNALSSVMVMDSRSHTWREAPSMRVARVFPSACTLDGRIYVTGGCENLNSMNWMEIFDTKTQTWEFLQIPSEEVCKGSEYLSISYQRTVYVGSREKDVTYKMHKGKWRGADICLNHGWSLDPSSCCVIENVFYRCSLGDVRWYDLKKREWAALKGLEGLPTFTNYYRNFKSADHCGKLAISWEEYVLVDDETKIWCAEIAIQKRQNGEIWGTLEWFDNVFISSGPNRHVDLLVNALTATVWG

SEQ ID NO: 60349 - protein, 520 aa, Coprinopsis cinerea okayama7#130
MTVTLDLAAAASDAQTKRVLSDLSLAVAKRKKIVLVTGAGISCSCGIPDFRSSDGLYNLVKERYPDVVLKGKDLFDASLFRDSTSTSVFFSFIAELKKKIDVAKPSATHHFIKTLDSKNKLLRSYTQNIDGLEERVGLVGCAPASADVKGKGKATRLKAVRNVQLHGDIHRVRCIACAAEFPCTDEHLNSFLQGVAPGCPECTSRSEARVARSARALRVGSLRPAIVLYDEPHPLGDDIGEIQTTDLSKKPDMLIIMGTSLKVHGLKKLVKEFAKTIHASTAASSNATSTSAPSLGRKPFKVIFVNKTPPSSEWSDYIDYHVQGDSDTWVNRVIEDWKRMRPADWEIQQTLSGELGFKAAKPTTVAAKKASKKKDENAPPDAIYSVANPPSSPGKRRQKSTHYDDLDSSPSKRQSVAPFQGILPPSERKMLFSEATNTIPDPMETSRMDISIVDLSMQDLESEVLKDLKSEKPKTVEVVIPPRKKAVAAKTSRRAAPTKKAATAKPTARRRGKAAEVSAT

SEQ ID NO: 60350 - protein, 518 aa, Glycine max
MGSTPEVLAQRSCGKLIGTRLLQYLNGGPLSFKTHQAIVLIVTFFAYASYHATRKTTSIVKSVLDPQSAATGLTFFPFRPTNFTESNGSKRLSSNLGDGWAPFNGSDGTSLLGQLDVAFLAVYAFGMYFSGHFGDRCNLRIFLTVGMIGTGLFTSLFGVGYWGNIHNFYYYLIVQMIAGLFQSTGWPSVVAVVGNWFGKSKRGLIMGIWNAHTSIGNIAGSLIASAMLSYGWGWSFVVPGLMTAFVGLVVFLILPVTPESVGAREEDEFSCPIKSGEEAAEPLLRQETPVEEKEAVGFIEAWKIPGVAPFALCLFFAKLVAYTFLYWLPFYVSHTAIDGKYLSSGTSGTLSTLFDVGGVLGGILAGHISDHLEARAITAASFMYCAIPALFFYRSYGHVSLIVNGALMFVTGMFVNGPYALITTAVSADLGTHKSLKGNSRALATVTAIIDGTGSIGAAVGPLLTGYISAKSWSAVFTMLMAAALIAGLLLTRLVVSEVATKIEESRYNRAQDCSFNV

SEQ ID NO: 60351 - protein, 624 aa, Aspergillus flavus
MLLGVTLAMLLGSRPARAGSLKDIDHVVIFMQENRSWNNYFGTMAGVRGFNDPNVQVNDDGLSVWHQSVDPSMSENATTLLPWYLGYKGGDWNDAIQCMVAGSNGYEDNQASLNHDLNNNWARNNTPWSWGYLKRNDIPVQFAIAEGWTAGDMYQESQITSTNPNRVTLVSGSVNIPGSPQASDQGGPYIDNNETPGCDTDNINCYPLKWKTIFEIYEEAGVSWQVYQEKNNFDDNPLAWFQQYQNASASSPLAKKGLSYLGLDAFYKAAANGSLPEVSFIVGPAELSEHPPYMPKDGAWLQKKVVDAVTKSPKYSSTLLIISYDETGGFGDHVVPYHSPEDTPGDWMTDPYGKFGKIYVGPGLRVPFYMISPWTRGSRVFTEHADHNSQILFIEQWLKARGYENVETPEMVQWRREHMSDLVSALDLDHPDTSLPTLPDAEEPATLLGNYVGSSNCQASHPTQRPPVPYGQQSNVSDALWFEEGYKEVVGYLTEGRYLVFEKSGYALTNAGNATRISSSRTGSGYGDKKQRWVIHYSGGQQSGVFHISSALDGKWLGPKGTLLSSNQGSQAADVKITFVGNGQGYTLQYADSTPIEIDSKGALTLQRRETSEEGYKVWSVSYR

SEQ ID NO: 60352 - protein, 132 aa, Glycine max
QEEEDHGDQITAPLLPNRPSTSRSSPEHHDDGHGESSENSPIEQVALTVPVGDDLDTPVLTFRMWVLGMASCAVLSFLNQFFWYRKEPLTITAISAQIAVVPLGRLMAAALPERAFLRGTRWEFTLNPGPST

SEQ ID NO: 60353 - protein, 637 aa, Coxiella burnetii RSA 493
MCGIVGFWDFRRSWKKEQYQKVAAKMADQITSRGPDSSGVWCDEKTGLAFGHRRLAVIDLSTAGHQPMLSHSGNTAIIYNGEIYNAPFIRRELENAGIYCCGHSDTEVLLEACELWGVKSAVKKMNGMFAFAYWNKLEKKLYLGRDRLGIKPLFWSLKNNIFYFSSQLKALAAHPVWNVEIDRTALTSYFRFNYIPAPLSIYKGVYKLKPGTILTIDPNQKIIEETFWSLETVCQKNINKKKIDDNEVLEKTETLLRDAVKCRMYSDVPLGAFLSGGIDSSAVVALMQAQSTNRIKTFSIGFYEKEYNEASYAKEVAQHLKTDHHELYLHVDEAARLIPQIPEWYDEPFADSSQIPTYLVSQLARQHVTVSLSGDGGDELFAGYNRYLLAENLWSKLVRFPLWMRQSGSKTINFFSPSAWDKFANVIPRKLRPSSVGDKAHKLAALLTQSSEDLYKGLVSLWERPAELVIDGSDISLWPEPLPDLNFTERMQYIDTLTYLPDDILTKVDRASMAVSLEARIPLLDYRLVEYIWSLPMRFKLERGETKWLLRRVLGKYVPEKLFTRPKMGFGVPIDHWLRCQLREWAEDLLSVPKLEKDGLLHSSLIRQRWQEHLSGKRNWQYSLWSVLMFQLWRERW

SEQ ID NO: 60354 - protein, 404 aa, Glycine max
FGSRATSISSTDNNFGNPLAMTAVVVVPLGLLFFASGLIVNLIQAICYVVVRPVSKNLYRRMNRVVAELLWLELVWIIDWWAGVKVQVFTDPETFHSMGKEHALVISNHRSDIDWLVGWVLAQRSGCLGSTLAVMKKSSKFLPVIGWSMWFSEYLFLERSWAKDERTLKSGLQQLRDFPLPFWLALFVEGTRFTQAKLLAAQEYAASAGLPVPRNVLIPRTKGFVSAVNHMRSFVPAIYDVTVAIPKSSPAPTMLRLFRGKSSLVHVHIKRHAMKDLPEEDEAVAQWCRDVFVAKDALLDKHIAEDTFSDQELQDTGRPVKSLVVVILWACVVVTGVVKFLQWSSLLSSWKGVAFSAFGLGVVTLLMHILIMFSQSERSTPSKVAPTKKSKNSEQLEARDNKQD

SEQ ID NO: 60355 - protein, 320 aa, Yarrowia lipolytica CLIB122
MPDTDIMQQAAAQANIEYISSDEGEDEGAFSRFGTGDVESLAAHSKIHTFGDLLRELETAQNIVVLCGAGISTSLGIPDFRSADGLYKSLDLESLGLSDPQEVFDLEVFDQDPTPFYRVASKVMMPTQALISPTHAFLKLLQDKGKLLRIYTQNIDDLEHIAGIEESKMVQCHGAFHMATCRQCGAKVTCESLRPEIVAGEIPMCRRKRCEGVIKPDIVFFGEALPDRFRHMVRSDIIMGGPTPKVDLFLCLGTSLKVSPACDIAKQVPLGVPRVYINREPSARFYFDISLCGESDLAVQAICEGMGWDLSHPQMKPMDR

SEQ ID NO: 60356 - protein, 553 aa, Parvularcula bermudensis HTCC2503
MVTDPSARAFSWKKLTALAAEGPPPLSDLFDHNPGRVAHFSLEAAGVYADYSKTPVNQTILDALYGLARACDFEARRDAMFGGQRINETEERAVLHVALRDTSDRIYTVDGQNVTTDIHAVKDRMKAFVEKVHDGRHDGYGGAPLDTVVNIGIGGSDLGPAMVSRALDPYTVDGRRTFYVSNVDGADIASVLRQIDPERTLFLIASKTFTTQETMTNAETARNWFLSSGGNEAAIAKHFVALSTNEAAVTDFGIDPENMFAFWDWVGGRYSLWSAIGLSIALQIGWSGFEDLLSGARGMDRHFETMPLEGNLPASLALIDVWHRSFLGYSARAVLPYDQSLARLPAYLQQADMESLGKRIDRSGQVVDYPTGAIVFGEPGTNGQHAFYQLLHQGTDVIPCDFIAAACGQVEVGDHHEKLLANFLAQPEALMAGRSVEAARSEALATGKNPETADRLAIHRSFPGDRPTISLLVERLTPEALGALLALYEHRIFVQSILWDINAFDQWGVELGKGLAKTILAELEGEVDVASHDPSTADLIRRIKRLRREGGVA

SEQ ID NO: 60357 - protein, 650 aa, Sinorhizobium meliloti 1021
MSQIPSAQVPSGAGAKPLDLITIGRASVDLYGQQIGTRLEDVASFAKSVGGCPCNISVGTARLGLKSALLTRVGDEQMGRFIREQLQREGVETRGIVTDPERLTALAILSVENDKSFPLLFYRDNCADNALCEDDISEDFIRSARAVLVTGTHFAKPNADAAQRKAIRIAKESGARIVFDIDYRPNLWGLAGHDAGESRYIASDRVSAHLKTVLGDCDLIVGTEEEVLIASGESDLLAALKTIRSLSKATIVLKRGPMGCIVYDGPISDDLEDGIVGKGFPIEVYNVLGAGDAFMSGFLRGWLTGEPHATSATWANACGAFAVSRLLCAPEIPTWTELQYFLEHGSKEKALRKDEAINHVHWATTRRRDIPLLMALAVDHRSQLEDIAEGNPELLSRIPAFKVLAVKAAAEVAQGRSGFGMLIDDKYGRDALYAAGAHRDFWIGKPIELPGSRPLTFEFSQDLGSRLVDWPVDHCIKVLSFYHPDDPAELKAAQVAKLRSAFEAARKVGREILIEIIAGKHGKLDDRTIPRALEELYDAGLKPDWWKLEPQASRAAWAAIDAVIETRDPLCRGVVLLGLEAPYEVLKDGFAAARTSKTVKGFAVGRTIFADAAKAWLAGRMTDEQAVSDMAAKFKALVDLWLQLGETKAA

SEQ ID NO: 60358 - protein, 221 aa, Pisum sativum
TTSSSDGIPKSEASERIKTGFLHFKKEKYDKNPALYGELAKGQSPPFMVFACSDSRVCPSHVLDFQPGEAFVVRNVANLVPPYDQAKYAGTGAAIEYAVLHLKVSNIVVIGHSACGGIKGLLSFPFDGTYSTDFIEEWVKIGLPAKAKVKAQHGDAPFAELCTHCEKEAVNASLGNLLTYPFVREGLVNKTLALKGGYYDFVKGSFELWGLEFGLSSTFSV

SEQ ID NO: 60359 - protein, 927 aa, Oryza sativa (japonica cultivar-group)
MAPAQCARVQRVFHFGKGKSEGNKAMKDLVSMPGMMDTVLNLGLNDEVAAGLAAKSGDRFAYDSYRRFLDMFGNVRTVHHTGLGGLHNFCPLLGVRNRSVGHLAPDRTGPVAGVEVVRTPLRPEPSTTSLLLPIPAMVRLITSAAAAAAAAATAARRRAPCGPRLSPSWMLDLYQLRLPWPRFAEGNFAFIQPKNWLQVMDIPHALFEEKLEAMKAVKGLHNDTDLTATDLKELVAQYKDVYVEAKGEPFPSDPKKQLQLAVLAVFNSWDSPRAIKYRSINKITGLKGTAVNVQTMVFGNMGNTSGTGVLFTRNPSTGEKKLYGEFLVNAQGEDVVAGIRTPEDLDAMRDHMPEPYEELVENCKILESHYKEMMDIEFTVQENRLWMLQCRTGKRTGKGAVKIAVDMVNEGLVERRTALKMVEPGHLDQLLHPQFENPSGYKDKVIATGLPASPGAAVGQIVFTAEDAEAWHAQGKDVILVRTETSPEDVGGMHAAVGILTARGGMTSHAAVVARGWGKCCVSGCSSVRVNDASKIVVIEDKALHEGEWLSLNGSTGEVIIGKQPLCPPALSGDLETFMSWVDEVRKLKVMANADTPEDATTARQNGAEGIGLCRTEHMFFASDERIKAVRQMIMASSLELRQKALDRLLPYQRSDFEGIFRAMDGLPVTIRLLDPPLHEFLPEGHVEDMVRELCSETGAAQDDVLARVEKLSEVNPMLGFRGCRLGISYPELTEMQARAIFEAAITMTNQGIQVFPEIMVPLVGTPQELGHQVDVIRQIANKVFTDMGKTIGYKVGTMIEIPRAALVADEIAEQAEFFSFGTNDLTQMTFGYSRDDVGKFLPIYLSQGILQHDPFEVLDQRGVGELVKLATERGRKARPNLKVGICGEHGGEPLSVAFFAKAGLDYVSCSPFRVPIARLAAAQVLL

SEQ ID NO: 60360 - protein, 254 aa, Myxococcus xanthus
MGAGLVASLLAGTATGLGALPVLVTSELSRKAQGPDVGLQRGRDAGGQSFSLVIPAMELVRGQGHDGPSAALRVAAGVLLGGLFLRVWHDLMPHEHALKGHEGHGGTKWNSALLFVLAMTLHNFPEGLAVGVSFAAPQPELGLSVALGIGAQNIPEGLVVALALRASGASASRAAFLALLTGMVEPVGALFGVLALSLSSALLPWGLAFAGGAMLYVISHEMIPESHRGGFEREATTGLMWGFVLALVLDMSLG

SEQ ID NO: 60361 - protein, 350 aa, Campylobacter lari RM2100
MLDFTKEELENLVQPKFRAKQIFEWVYKKYADDFLQMSSLPKDFRVYLQKNFHFSPLKCVKDEKSKDGSIKYLFELLDGKKIEAVLLPMKEELVDENGKIIKHARYTICVSSQVGCKSGCSFCLTAKGGLSRNLSAGEIVGQILWIKKHNKIPYERRVNIVYMGMGEPLDNLKNVSKAVKILADNDALAISPRRQTISTSGLAKQIKELGEMNLGVLLAISLHAVNDELRSELMPINKAYNIASIMEAVRNFPIDQRKRVMFEYLLIDGINDKIEHAKELVKLLNGIKAKVNLILFNPHEGSLYNRPSVENAIKFQDYLSAKGVTCTIRESKGLDISAACGQLKERQSKQ

SEQ ID NO: 60362 - protein, 203 aa, Wolbachia endosymbiont of Drosophila simulans
MGLIGGFCHLSIGQEAVAVGTQAASKLGDAFITSYRDHGLMLACDSDPNVVMAELTGKETGCSKGKGGSMHVFDVEKKFFGGHGIVGAQVPIGTGIAFANKYKKKDNVVFTYFGDGAANQGQVYESFNMASLWELPVVYIIENNEYAMGTSVQRSTLVTELYKRGESFGIPGKQVDGMDFFSVYEATSEAAEHTRSGKGAILL

SEQ ID NO: 60363 - protein, 375 aa, Marinobacter sp. ELB17
MAKRDYYETLGVSRDADDKEVKRAYRKLAMKYHPDRNPDDKDADNKFKEASEAYEILADANKRAAYDQFGHAGVDGQGGGGFGGGNGNFSDIFGDVFGDIFGGGGGRGRNTRGSDLRYTLDLDLEEAVKGRTVKITIPGHRECETCDGSGAEKGSRPEACGTCKGMGQVRMQQGFFTVQQACPTCRGAGKVIKNPCSKCHGQGRVKEEKTLSVKVPPGVDTGDRIRLSGEGEMGIEGGPPGDLYVQMAVREHSIFTRDGRNLYCEVPISIVDAALGGELEVPTLDGRVKLKIPAETQTGKLFRLRNKGVAPVRGGGAGDLLCRVTIETPVRLTKRQKELLNEFQDTLDSGDGDQHGPKKTSWFRGVKSFFDETKF

SEQ ID NO: 60364 - protein, 1072 aa, Marinobacter sp. ELB17
MPKRTDIKSILILGAGPIVIGQACEFDYSGAQACKALREEGYRVILVNSNPATIMTDPAMADATYIEPIIWSTVAKIIEKEKPDALLPTMGGQTALNCALDLEKHGVLAKYGVEMIGANADTIDKAEDRSRFDKAMKSIGLECPRADIAHNLEEAHRIADNVGFPCIIRPSFTMGGSGGGIAYNRGEFEEICIRGLDLSPTSELLIDESLIGWKEYEMEVVRDKNDNCIIVCAIENFDAMGVHTGDSITVAPAQTLTDKEYQIMRNASLAVLREIGVETGGSNVQFGIHPDTGRMVVIEMNPRVSRSSALASKATGFPIAKVAAKLAIGYTLDELKNDITGGITPASFEPSIDYVVTKIPRFTFEKFPQADARLTTQMKSVGEVMAIGRTFQESLQKALRGLEVGSDGFDEMLSEFDSEESRQTLTRELNVPGAERIWYIGDAFRAGQSVADIFRQTHVDPWYLVQIEDLVKEEKALQASGKAELDHATLFRLKRKGFSDARLAKLMGVKEDAFRARRHGLGIRPVYKRVDTCAAEFASDTAYMYSSYEEECESNPTDREKIVVIGGGPNRIGQGIEFDYCCVHAALAMREDGYETIMINCNPETVSTDYDTSDRLYFEPITLEDVLEIIHVEKPKGVIVQYGGQTPLKLARGLEAAGVPIIGTSPDAIDCAEDRERFQKLIAGLGLKQPENATVRSHEEGVIAARKIGYPLVVRPSYVLGGRAMEIVYGEDELERYMRSAVLVSNDSPVLLDHFLNAAIEVDIDAICDGKDVVIGGIMQHIEQAGIHSGDSACSLPPYSLPADVQNAMRDAVKQMALALKVVGLMNVQLAWQDGDIYVIEVNPRASRTVPFVSKAIGVSLAKVAARVMAGTSLADQGFTQEIIPAHYSVKESVFPFNKFPAVDPILGPEMKSTGEVMGIGDSFDEAFGKAVLAAGERLPSTGVAFMSLRDVDKHGAEHVARSLVDCGFKIIATTGTAAALRKAGVEVALVNKVHEGRPHIVDAIKNGNVQLVINTTEGRKAVSDSSQIRQSALQAKISYTTTLAGGEAFCRAIKFGPERTVRRLQDLHSGK

SEQ ID NO: 60365 - protein, 468 aa, Mesorhizobium loti MAFF303099
MRLSNLGTEQLREKDRSFVFHPSTHLAKHSRGETPNRIMAGAEGVYIWDTEGRKSLDGFGGLYCVNMGYGCTEIAEAIARQAHELPFAHVYASQGTEPVALLAEAVVEYFGQNMRRVFFGLSGSDANETNIKLVWYYNNILGRPEKKKIISRHRGYHGSGLVTGSLTGLAFFHNFFDLPLDLVRHTTTPHHYRQAHDGESEQAFSTRCADELEGLILAEGPETVAAFIGEPVLGTGGIVPPPKGYWTAIQGVLDKYDILLIADEVVCGFGRTGEQFGSHLYGMRPDFVTIAKGLSSAYLPISGSIIGDRVWSVLEQGTEKHGALGHGWTYSGHTLCAAAALANIRLLKERNILEHVRDVGPYWHARMNAELAGHPIVGEVRGVGILAAVELMRDPKQRIPFESDLQVGVRAAAALFENGVIGRAMPHGDILGFAPPLIITRKEIDIIVDATAKSVETTYRALKAEGAI

SEQ ID NO: 60366 - protein, 443 aa, Blastopirellula marina DSM 3645
MTSRLFYWSLTSALAGFLFGFDTVVISGAEETIEKLWDLDKVTHGLAMSAALWGTVIGSLIGGWPTDAWGRRKTLLSIGVLYFISAVWSALANDVSAFMIARLVGGLGVGISTVVAPLYISEISPPERRGRLAAMFQFNIVFGILIAYASNALLAGIGPNSWRWMLGVEAFPAIIYTLMCFTLPESPRWLITKKNDREAGLRVLQMVAPERTPAEIDALANEIAEAATVEKQSLSSFWSAKMKTPIMLAFLVAFFNQMSGINAILYFAPRIFKEAGQSGEAALQTSVSIGIVNLIFTFAGLWLIDRLGRKTLLWIGSVGYIVSLVGCSWASWNDQYVVLAACVNIFIASHAIGQGAVIWVLISEVFPNRYRAMGQSLGSSTHWVFAALITALFPLFAEQLGMGAIFLFFCGMMVLQLIWVVTMVPETKGVPLEEMERKLGVTP

SEQ ID NO: 60367 - protein, 480 aa, Aspergillus flavus
MQWTWALITALATATSALPHEARKDVWGQLRSNIKHVVYLMMENHSFSNIAGYWDFHPEIDNLRNRKYCNEYTNPNWTVWGEPLDICAGPYETEVPLEDPDHEFAGVTYQIYRKWNVTNDDVPNMGGFIERQSEKYQATPGESAFVIKAYDEKKSSTLAEIAQNFAFWDSYFAEHPGPTNPNRQFATSGSTCGFVDNAGQAAGFFNNVTGTTCATSIFEALSNKNISWKNVNRSTIFGSPIANAGSVLRNGYYRWMDVQDNAIDNLAHASDFYRDLEEGTLPTFSYINPECCTIDSMHPKSNMAAGEQMIKHLYDAVRRSKYWDNVLIIINFDEHGGFADYVPPPVNVPRPEDGIAFDGESEGRPVTYDFTRLGVRVPAFIISPYIEPNTLIHNDGTNYANNSAYTHTSMLHFLQELWELEGLNNRVQWAKTFEHVFSDTKREDTPKTLSTPIWYGDSWEPKPEPFYLLNQNEDYYANRP

SEQ ID NO: 60368 - protein, 524 aa, Erythrobacter sp. NAP1
MDDQHLPDSILIVDFGSQVTQLIARRVREAGVYSEIAPFSMAEEAFKRLNPKGIILSGSPASVPDDGSPRTPQAFFEAGVPILGICYGQQVMSHQLGGEVRPGHETGEGGEFGRAYLTVTKECALFDGLWKEGERHQVWMSHGDKVTEFAPGFEIVATSDGAPFAVIADEKRKFYGTQFHPEVVHTPDGGKLLANFVRHVCGLKGDWTMAEFRKTKIEEIRAQVGEGRVICGLSGGVDSAVAAVLIHEAIGDQLTCVYVDHGLMRLNETEQVVSLFRDHYNIPLIAVDAEETFLAGLAGVTDPEKKRKFIGGAFIDLFEAEAKKVGGADFLAQGTLYPDVIESVSFTGGPSVTIKSHHNVGGLPERMNMELVEPLRELFKDEVRELGRELGLPEAFVGRHPFPGPGLAIRIPGEVTKERCDILRKADAIYLEEIRNAGLYDAIWQAFAVLLPVKTVGVMGDGRTYDSVCGLRAVTSTDGMTADVFPFDAAFLSQVATRIINEVKGINRVVYDYTSKPPGTIEWE

SEQ ID NO: 60369 - protein, 339 aa, Mycobacterium avium 104
MPDLPNRQILLRRRPSGLVRPDDTELVTTPAPEPAEGEALLRTTYVGIDAAARTWLDDQPSYLPPVQLGEVIRAAGIGEVVASRCDAFAVGDVVTTLTGFQEYAIIRDDLFSTPIPGEDDQLAIMSVYGPTGATAYFGMTDIGRPQPGETVVVSAAAGATGSIAGQIAKIAGARVVGIAGGPEKCRAVVADFGFDACIDYKNDDVAAALKQHCPRRVDVYFDNVGGPILDAVLGRLAPRARVVLCGVISSYLTGDHPGPANYVNLLSKTALMQGFNALDQWGRFDEAFAALRKWEAEGRLHHRQTIFEGIESCVDALNGLFTGVNIGKTLVKLSEPGAG

SEQ ID NO: 60370 - protein, 442 aa, Aspergillus flavus
MSIISLLAFFSLALGINGLPHARSSSPSYGKPVNPIKDTPIKNVVVLVEENLSFDVFAGGLTYNAKIDGLVNREYCNPSNASDPFSEKVCAKPIAKNVAPDDPDHSITGGNQQVYSTYHPNAKNDMPGMQGFVTEQIVSYGLGSDLSRAAEVINYYTPDHVPVFNAMAENFVLFDRWFAAVPGPTNPNRAYLTSGTSHGHGQNDHDFDISNLPQVSIFEQLSAAGISWINYSNTTGFLPDSLFYQWTAKSGKGTTNVKSIDQFFNDAKAGTLPQFTWINPECCSYMSFHPPSPINMGEGFIKSIYEALRSSPQWNETLFILTFDEHGGFADHVSPPENVPAGDNLTYTETAKDGQEATFHFDRLGIRVPTVLMSPWVGKGVVQNSPADQPNEFTHTSILKYVAELWNLDILTPRVDWSPSFRGLITNTFRETPEKLPEPADF

SEQ ID NO: 60371 - protein, 636 aa, Coprinopsis cinerea okayama7#130
MSFGLNFRPNGSLGVDNYNHSEAQQYELTEYGLLAEPPKYGDKYRDGSSIDWLHEENAERERNHALQSEAGIRGALLPALDSIRMWIVVIATGIGIGLAGAWLDILVKWLADIREGRCSHGFFYNSVVCCTGFEANAGETCDLWQRWADVAGIKSMFGQSLLQTFIYVTLAVIFAGSSAFLVVTFAPYAFHTGIPEIKAGPLVHVACCFASLFSRMFTQFRHNEASKRRLFAAAAAAGVSVAFGSPLGGVLFGLEELDTFANETEVMWKGFVASAIAAMALQWVNPFGTAKLVLFQVTAFSDQWRAFELIPWITLGIIGGVLGSWLIRLNVEFAIYRRQSVPAGIFLPTIGIGACLGRAFGLITQSLYRSNPKAWLFLSCPPDPSVRCISPGFYAVIGAAAMLGGVTRMTISLVVILFELTGALSHVLPIMICVMTSKWVGDALGKDGIYSVWIAMRRYPWLPPVDYRDNGETGAHLMKPVQNLIVVRDGETTVGELAEMLDEYSDFHGFPVIDNHGEFIGYATRDALLRAIDGTRFSDSFDVMREKKCTFSQNFMRVSASARVDMSSTLERALIQLRKEVPQELVVAMFQKLNTRQIFFTHAGKLTGMVTKRDVVTLLTSHFPHAGSLAQGVRPT

SEQ ID NO: 60372 - protein, 863 aa, Coccidioides immitis RS
MNPNISSHSAPRRRPSSHSIPAKRHSGLSFLSTVEHEPNTPITPVTPVAGEPHSQNPTITEEISEIKRYEDFTTIDWVQDAVHEQARRRARRKQGARFWDKEGAFGWRRKVSEAYDAGQAWLVVTIVGAAIGLNAGFLNIVTEWLADVKLGYCTTAFYLNEAFCCWEAENGSMFLVDAIAPYAAGSGISEIKVIIAGFIMKGFLGVRTLLIKSIGLPLAIAAGLSVGKEGPSVHIAVCTGNVISRWFSKYKRHAAKTREILTATSAAGVAVAFGSPIGGVLFSLEEMASHFPLKTLWRSYFCALVATGVLAAMNPFRTGQLVMFQVKYERTWHFFELIFFVILGVFGGLYGAFVMKWNLRAQAFRKKHLSRHPIIEATVLAGLTALVCYPNMFMRITMTEMMEILFRECEGKHDYNGICQATRRWSMVFSLFMATVLRVLFVIISYGCKVPAGIFVPSMAIGASFGRMVGILVQALQESFPHSKFFAACEPDVPCITPGTYAFLGAGAALSGIMHLTISVTVIMFELTGALTYILPTMIVVGVTKAVSDRFGRGGIADRMIWFNGFPFLDSKEEHIFNVPVSHAMTNKPVVLPATDFPVRKAERLLENNKFQGFPIVEDLTSRTLVGFIGRTEFQYAINRAKREDRLFSPEAKCRFVPQPSSFQTTSSTSLSTSNLSQSSGRYFDSSIATPSSSRPVEEHLPPQTFDDIATPSGVRSIDFSSYVDVAPITVHPRLALETVMEIFKKMGPRMILVEHRGRLSGLVTVKDCLKYQFKVEHQELADANATSSDRLAANGGKEEGLVEQKVWEIIQWVVGKVASWRRRGGRSERFEDGSRRPRDNSFDIIDGTEDVDTFDGIVELEE

SEQ ID NO: 60373 - protein, 464 aa, Aspergillus flavus
MKSTALLTGLGLLASLGLASPVTSEYTSVREAPFGYKPGSKESIENLKDKVENIVWLILENRSFDNILGGVRRQGLDNPINNGPFCNYKNASDPSSGKYCTQAKDYDSVFNDPDHSVTGNNLEFYGTYTPNNGAIASGKVVADQSGFLNAQLNDYPKLAPEEATRQVMGYYTEEEVPTLVDLVDEFTTFNSWFSCVPGPTNPNRLCALAGTAAGHGKNDDDFLNYGISSKSIFEAANEKGVSWLNYDGTNGEFEPDSLFFTYVNQTSRSNVVPVENFFQDAYLGVLPKFSYINPSCCGTNTNSMHPTGNVSYGEVFVKQIYDAIRQGPQWDKTLLFITYDETGGFYDHVPPPLAVRPDNLTYTETAKNGQKYTLHFDRLGGRMPTWVISPYSKKGYIEQYGTDPVTGKPAPYSATSVLKTLGYLWDIEDFTPRVAHSPSFDHLIGTTLREDAPIALKTPHTFSV

SEQ ID NO: 60374 - protein, 755 aa, Haemophilus somnus 129PT
MDAQLRQAALDFHEFPKPGKIEVTPTKSLGTQRDLALAYSPGVAVPCLEIQADPASAYRYTSRGNLVAVISNGTAVLGLGNIGALAGKPVMEGKGVLFKKFAGVDVFDIEIDEQNPDKLVEVIAALEPTFGGINLEDIKAPECFYIEQKLRERLKIPVFHDDQHGTAIISAAAIINGLRIVNKKIEDVRLVASGAGAASIACLNLLVSLGMKRENITVCDSKGVIYKGRDEKMDDTKKLYAIDDNGQRSLADAIPDSDIFLGCSAAGALTQEMVKTMGPNPLILALANPEPEILPPLAKAVRPDAIVCTGRSDYPNQVNNVLCFPFIFRGALDVSATTINEEMKLAAVYAIADLALAEQSEVVSSAYGESGVSFGPDYIIPKPFDPRLIVKIAPAVAKAAMDSGVATRPIEDFEAYIEKLTQFVYKTNLFMKPVFAQAKEDKKRVILTDGEEKRVLHAIQEIATLGIAYPVLLGRTHIIEESIKKLGLQLQLGRDFEIIDIENNPYYEECCDTYYNKLKRQGMTPTGAKRKMLHNPTALGAVLLELGKVDAMICGLVGPFAAHLATVKEVVGEKEHEIPATVNGLVLPTGNLFIADTFVNSSPTAEELAEITIMSAKEVRRFGIEPQVALVSHSNYGSINDPSAVKMRQVLELVREKAPDLIIDGEMHCDIALSENLRKEVMPDSPIKGAANLLIMPNMETARISLNLLQGTATPITIGPILMGVEKPAHILTSASSVRRIINMVAVAAVKAQNR

SEQ ID NO: 60375 - protein, 255 aa, Brassica napus
RFSKEEMVVDLQNLFQRFTFDTTFVLVTGFDPKTLSVEMPEDEYAEALDVLGEGIFFRHVIPKFLWKLQKWIGFGQEKRTMEADATFDRVSAKYILAKRHEVLSQGIHDQQQSNGECHEDLLTSHMKLDTTKYELLNPSDDKFLRDTILAFNLAGRDTTASALSWFFWLLSENPRVVTKIRQEIITNISLHGQDNLDKLVYLQAALYESMRLYPPVPFQRKSPIKPDLLPSGHKVEANSTIMIFLYALGRMRAVW

SEQ ID NO: 60376 - protein, 499 aa, Dechloromonas aromatica RCB
MRHALLFSVFVIASCGLAYELIAGALSSYLLGDSVTQFSTVIGTYLFAMGAGSWLSKYITRDLIGRFIQIELMVGLLGGFSAVGLFLVFTWLSAPFKLVLYLAVFGVGVLVGLEIPLVMRILKRELAFKDLVSQVLTFDYLGALAVSILFPLVLAPQLGMVRTGLLFGVLNVAVALWALHLFREQLPSRRWLAMQSWGVFGLLAIGFAGAGQLTTFAEAHLYADEIVHAETTPYQRIVVTRWRDDLRLFLNNNLQFSSHDEYRYHEALVHPGLASLPGAKRVLVLGGGDGLAVREILKYPNVESVTLVDLDPAMTDLFATAPALVALNQGALKSERVTVVNADALQWLEDSKEYFDFIVIDFPDPANFALGKLYTSAFYRLIEKRLSARGLLVVQSTSPLYARQSFWCVVATLESAGFKTAPYHALVPSFGEWGYIIAGRQAFSMPAFASDKTRFLTSETLAGMFNFPADMARVPAEVNQLNNQVLVRYFETEWRKVIR

SEQ ID NO: 60377 - protein, 580 aa, Oryza sativa (indica cultivar-group)
MDDDGETPMPSLELHKLPTLAGAAIPNPIARHPLYHPSPSFFISPTDVVLRDILFDASPASAAGERRRRHVAAYHRAGPRREVAFDPATVRAAIFTCGGLCPGTNTVVRELVVGLSELYGVRGGVFGVRNGYRGFYSDEVVPLDPAAVEHWHKAGGAALGTSRGGFDLARIVDAIERHGFNQVYAVGGDGTMRGAARIHREVRRRGRLAVAVAGIPKTVDNDVGVVDRSFGFHTAVEAAQQAIAAGHVEAESAANGVGLVKLMGRSAGHIALHATLSSRDVDCCLIPEEDFYLRGAGGLFDFLYRRIKDNGHAVVVVAEGAGQRLIPRTTTTSASGACAGADESGNETFLDVGAWLKAEMRAWWEEEHAGEVFTVKYIDPTYMIRAVPANAGDNLYCTLLAHAAIHGAMAGYTGFVSGTINGNYAYIPMDEVAEAKNPVDTKDHKWAWSFVVYLGGHSHGRGGAALASSQERAKNSHHEFLGSFLGSKEKARDAIFYSYTKYINGFAATLEEEEAMEISKHPSVISVFPNRGHRLHTTRSWEFLGMEKDGRIRANSIWAKARFGEGVIIGNLDTGNLTSA

SEQ ID NO: 60378 - protein, 463 aa, Legionella pneumophila subsp. pneumophila str. Philadelphia 1
MDLFRKKDIKGSLDNESHLAKCLSVFDLTFLGVGAIIGAGIFVLTGIVAATISGPAVIFSYVVAGFACAFAALSYAELAASIGGCGSAYGYAYAGFGELIAWIVGWDLLLEYSIAVSAVSIGWSGYANDFLMALKIFIPTHLLHGPADGGDLNILAILIIAVLTTLLIVGVKSSSRFNNIMVLVKLLVIFIFIAIAFGEVKVENWSSFMPYGWAGVMKGASIIFFAYVGFDAVSTAAEEAINPQRDLPIGIIASLAICTVIYILVSGLLTGIAHYTTLNVSSPISHVLLVLGYKTAAGLVGVGAIAGLTTVMLVLFYGLTRVFLAMSRDGLLPRFLSKTNEHTKTPIRIILLCGILMASLASVTPIGTLAELVNIGTLFAFIVVCGGVLYLRRTHPDMERPFKTPFMPYVPILGIISCFYLILNLPWVTILRFIIWMAVGMAVYFAFSRGNSALSVEGDCAAE

SEQ ID NO: 60379 - protein, 482 aa, Bacteroides fragilis YCH46
MNHTNEGSKLYLYSITSVAILGGLLFGYDTAVISGAEKGLEAFFLTATDFQYDKVMHGITSSSALIGCVLGGALSGIFASRLGRRNSLRLAAVLFFLSALGSYYPEFLFFEYGKANMNLLITFNLYRILGGIGVGLASAVCPMYIAEIAPSNIRGTLVSCNQFAIIFGMLVVYFVNYLILGDHQNPVILKDAAGTLSVSSESDMWTVTEGWRYMFGSEAFPAAFFGMLLFFVPKTPRYLVMIDQDQKAYSILKKVNGATKAQEILAEIKATSQEKTEKLFTYGAAVIVIGILLSVFQQAIGINAVLYYAPRIFENAGAEGGGMMQTVIMGIVNIVFTLIAIFTVDRFGRKPLLIIGSVGMAVGAFAVALCDSMGIKGILPVLSVIVYAAFFMMSWGPICWVLISEIFPNTIRGKAVAIAVAFQWIFNYIVSSTFPALYDFSPMFAYSLYGIICMIAALFVWRWVPETKGKTLEDMSKLWKKR

SEQ ID NO: 60380 - protein, 547 aa, Coxiella burnetii RSA 493
MSLVESPPWQALKSKYQELSSLHMRDFFAQDKKRGTRLSLEAAGLYFDYSKNRVDEKTIDLLCESANACNLPLRIEQLFSGKLTNESGEMVGFHTALRQVNNFSFKTNNNAIQEIHASWEKIKKLSIRIREGDYKGFTNKSITDIVNIGIGGSSLGPQMAYNALKPYVKAPLRCHFISNLDDTDFYETVRTLNPETTLFIITSKTFTTKETLENARRATEWLMQAAKKENLIQTHFMAVTAAPEKAHEFGIQKDNIFMLWPWVGGRFSVWSAAGLSLAIAIGWEEFFEFLRGAHAMDTHFRQAEFNKNMPILLALLSIWYINFFHAKTQAIIPYSQRLVYLPDYLTQLHMESLGKSVQLDGSAVHWQTGAVVWGDLGTNSQHSFHQLFLQGTMVIPVDFIAVLKNSRESHWQLPLIANCLGQSQTLMEGYDKEGVMRDLINQGIEHEKAEKLATYRLIRGNNPSNTIILEELNPYSLGSLLALYEHKVYVQSVIWNINPFDQWGVERGKHLAKDILQALQAETDQSSFDSSTERLINYVLKIKGNRP

SEQ ID NO: 60381 - protein, 71 aa, Brassica napus
MATTMKGLLKGLRYITQIFEDEEKEQEMQIGFPTDVKHVAHIGSDGPAANTPSWMNDFKSQENENAQVVSR

SEQ ID NO: 60382 - protein, 524 aa, Sinorhizobium meliloti 1021
MSTPGAYFRLIRIGWVLARENAFAAVPSEHLPPLARFVQKLAGLLASREARLGARSGRLARAVERLGPSYVKIGQFLATRPDVVGAELAADLSLLQDRMATFPESASRAAIEASLGRPVGELFLEFSEPIAAASIAQVHPAVVMRDGTRERVAVKVIRPGVRQRFVADIEAMYLVSRMQERFLPYTRRLRPVEVTKTLEQTTKVEMDLRLEAAALSELGENTREDSGFRVPRVDWERTGRDVVTMEWIDGIKMSDIEGLKRAGHDLNRLAETLIQSFLRHTLRDGFFHADMHQGNLFVDEAGHIVAVDMGIVGRLGRKERRFLAEILYGFIMRDYQRVADVHFEAGYVPSHHDAASFAQAIRAIGEPIHGQPAETISMAKLLTLLFEVTELFDMQTRPELVMLQKTMVVVEGVARTLNPRFNMWKASEPVVGKWIRDNLGPKRIVADLRDGIHAALRVAEALPEIAARTERFSGEIMAMSENGLRFDPETAEAIGRSEARHTRSGRIALWVIAAALVYIAWQLA

SEQ ID NO: 60383 - protein, 241 aa, Marinobacter sp. ELB17
MNGSQSLVNELVGLVAQQVRELGMEAVVFPPALYVSAVIQAADNAMAVGVQNVSEKAQGAYTGELSAPMAADVGCRYGLVGHSERRQLFGETDVQVAVKTEQLLSAGLNAIVCVGETLEQREAGQAEATVATQVRDGLSKVTPEQWGQIVVAYEPIWAIGTGKTATGEDAQAMHKAIRGVLANMGAPAESISLLYGGSVKADNAAALFAEPDIDGGLIGGASLSATDFVSICQALPADTHC

SEQ ID NO: 60384 - protein, 130 aa, Oryza sativa (japonica cultivar-group)
MAYQRGETSSVVEAFTLSPLPYPVILILLMVMLLLGVSWFFTYEDFMEEAAEQLSWALLLVPVALVLLIRWISSVDTFDGYFSFYPTERRWNRYDPGPAEGSSPWGVAMVVLLLLVLASFHSTFQDMWKP

SEQ ID NO: 60385 - protein, 634 aa, Gladiolus hybrid cultivar 'Traveler'
MEGCDCIEPQWPADELLVKYQYISDFFIALAYFSIPLELIYFVKKSSFFPYRWVLIQFGAFIVLCGATHLINLWTFTMHSKTLALVMTVAKVSTAVVSCATALMLVHIIPDLLSVKTRELFLKNKAEELDREMGLIRTQEETGRHVRMLTHEIRSTLDRHTILKTTFVELGRTLDLAECALWMPSRTGLNLQLSHTLHNQIPVGSTVSINLPTVNQVFNSNRAVRIPHTSPLARIRPLAGRYVPPEVVAVRVPLLHLSNFQINDWPELSARSYAVMVLILPSDSARKWHVHELELVEVVADQVAVALSHAAILEESMRARDLLMEQNVALDLARREAEMAIRARNDFLAVMNHEMRTPMHAIIALSSLLLETELTPEQRIMVETMLKSSNLLATLINDVLDLSRLEDGSFELEKSSFNLHTVFREVINLIKPIAAVKRLSVSVSLAPDLPLCAMGDEKRLMQTILNVAGNAVKFTKEGHISITASVSRPDSFRDPQVHEFYPVFTDGHFYLCVQIKDTGCGISPQDIPFLFTKFAHTQNGGNKGYSGSGLGLAICKRFISLMEGHIWLESEGLGKGCTATFIVKLGICESQNGHQQQMIPTNRLLLGGADFPGPGALLKEDNKAIPSKLRYLSV

SEQ ID NO: 60386 - protein, 498 aa, Mycobacterium avium 104
MARDHAHAALIIGAGFTGLGAAIRLAEAGVDDIVILERADRVGGTWRDTTYPGASCDVPSLLYSYSFVKNPTWSRTYSPAPEIYRHLEDMADRFDIRRRIRFGHEVSGLAFDEDAGVWTATTKNRKKFRARTVVLASGPLSDVSFPDIRGLDSYRGHKIHSARWDHDYDFAGKRVAVIGTGASAIQIIPELVKQAGFVKVFQRTPCWVLPRLDVATPPAVQALFAKVPAAQELARQALYWGHEASATALVWDTPLTSLVARLGKAHLRAQVKDPWLRRQLTPDFRPGCKRMLVSSDYYPALQRDNCKLIDWPIATLSPAGIRTSDGIEHHLDCIVFATGYDVHLTGPPFPVTGLGGRSLAAEWAGGAQAYKSINVHGYPNLFVMTGPNSGPGHNSLLVYIEGQLDYAVRGITTILNDDLRYLDVREEVQRRHNEAIQRRLTKTTWMSGCRSWYLTKDGFNGSMYPGFATQYLRQMSDFRYQDYQAVARRARTPAASSA

SEQ ID NO: 60387 - protein, 353 aa, Arabidopsis thaliana
MPGIAVVIAVLTAFFSLTFLLLLYVKHCKRRNGSVYVNHPQRFAITRYGGGYYNGGGVVGGRKNSGIDRSVIESLPVFRFGALSGHKDGLECAVCLARFEPTEVLRLLPKCKHAFHVECVDTWLDAHSTCPLCRYRVDPEDILLIGDCNSWFELQFSKDESNSVNNNPPGLTRFIPVSRISGRHSSAGERASRLNEIRTSSSYKSNPMSFRRSLDSSLKVNDAGEEKSESVAVNCLDRLQRKDGLLLIPNRESFEGRFEHRIIISGGNRDDQRWSEVRPSDLLYLRSEMILSDCRKLAAAEGGRDVINGRSVSELTGIERRRRWGGEPRQRQATAVISRWLAWSHRASASSIV

SEQ ID NO: 60388 - protein, 213 aa, Triticum aestivum
  misc_feature (210)..(210): Xaa can be any naturally occurring amino acid
MSPSAVEGNGVVDVKTTLKPNVGVYTNPNHDLWVAPAEPSAEAVKSGSDLKQGEVSVAIRSTGICGSDVHFWHAGCIGPMIVEGDHILGHESAGEVIAVHPSVSHLKVGDRVAVEPNIPCGTCEPCLTGRYNGCETVQFLSTPPVPGMLRRYINHPAVWCHKIGNMSYENGALLEPLSVALAGMQRAEVRLGDPVLICGAGPIGLITLQXCAA

SEQ ID NO: 60389 - protein, 426 aa, Blastopirellula marina DSM 3645
MSRTRSHEIFQRALQLMPGGVNSPARAFGGVGGEPLVFERGEGAYLIDVDGNRYIDYIGSWGPMILGHGNEQVRAAIHAAVDQGTSFGAPTERENTLAELIIELVPSVEKVRLVNSGTEATMSAIRVARGFTGRNKIIKFAGNYHGHVDSLLVAAGSAAATLGVPNSPGVTPGTTADTIVLPYNDPAALAAVFEQHGDDLACVIFEPIVGNMGTVIPKPEFLAAIRELCTKHGAVMLMDEVMTGFRVALGGAQQLFGVTPDLTTMGKIVGGGLPIAAYGGRADIMNHVLPAGQVFQAGTLSGNPLATAAGIATLSILKETNPYPRLEQLGERLMTGLAKAAADAGAPYSVARVGSMATLFFGAGTVVDWDTAEKSDTERYADFFWGLIDRGVYFPCSQFEALFISVTHTDEDIDTTIAAARASLQA

SEQ ID NO: 60390 - protein, 433 aa, Neosartorya fischeri
MTVLSLAVFFTLGFGAGAAPHVPHSRLSSPIKNVVVLVQENLSFDNYAGGLTYNPNIDGLVNREYCNPANVSDPYSPMVCAKPTAKNIAPDDPDHSITGGNQQVYSTYHPDYDVHAPNMQGFVAEQIASYGIEGNLSRAGEVINYYTPEHVPVFNAMAENFVLFDRWFAAVPGPTNPNRAYLTSGTSHGHGTNDPDFDRSALPQRSIFEQLSENNISWINYSNTTGFLPDALFYRWTAMSGLGETNVRPIDQFYRDAKAGTLPQFTWINPECCSYMSFHPPSPINMGEGWIKSVYEALRSSPQWHETLFILTFDEHGGFADHVPPPENVPAGDDLTYTETARDGKASTFAFDRLGIRVPTVLMSPWVGKGVVQNRPTDGDGEFTHTSILKFVADLWGLEYLSPRVTWSASLAHLITDTYREDTPATLPETADF

SEQ ID NO: 60391 - protein, 403 aa, Arabidopsis thaliana
MFPMSSTSRSSAANNRKDPPRKKNKETPSPVTREPTSIDSLPNDLLLNCFARVSRMYYPALSRVSKRFRSIVTSPEIYNTRSLLNRTEKCLYLCLRFPFDNNTHWFTLYQNPNRTVSDKVFLQIPSPQYPLTLSSNLVAVGSNIYRIGGTVGDDSCPLGFDREPSSKVSILDCRSHTWRDGPRMRLNRRSSTTSVVDGKIYVTGGTEDTDNPSHWIEVFDPKTQSWGTVTNPHIVKVWEEVCYRRAVKSIGHDGKLYLSGDKYVVYDPDEGKWNSVEEHWLIGYAIGSSNCVVDNILFYWDQGVFKWYDSKVSSWKQLKGLEGLPDDFSQREYCKLVDLGGKMAVLWDKWEYSGVCMIFCAEISLEKRDGDEIWGKVEWFDTVLEVGASCSLKSADALSASVG

SEQ ID NO: 60392 - protein, 294 aa, Shigella flexneri 2a str. 301
MSHLKDPTTQYYTGEYPKQKQPTPGIQAKMTPIPDCGEKTYVGSGRLKDRKALVTGGDSGIGRAAAIAYAREGADVAISYLPVEEEDAQDVKKIIEECGRKAVLLPGDLSDEKFARSLVHEAHKALGGLDIMALVAGKQVAIPDIADLTSEQFQKTFAINVFALFWLTQEAIPLLPKGASVITTSSIQAYQPSPHLLDYAATKAAILNYSRGLAKQVAEKGIRVNIVAPGPIWTALQISGGQTQDKIPQFGQKTPMKRAGQPAELAPVYVYLASQESSYVTAEVHGVCGGEHLG

SEQ ID NO: 60393 - protein, 473 aa, Oryza sativa (japonica cultivar-group)
MAAALARRGGGGLARALARGRGMCSATAAERAAGAALTSEELMRMERERSAHNYHPIPVVFSKGEGSHILDPEGNKYIDFLSAYSAVNQGHCHPKVLRALKEQAERLTLSSRAFYNDKFPIFAEYLTSMFGYEMMLPMNTGAEGVETAIKLVRKWGYEKKKIPKNEALIVSCCGCFHGRTLGVISMSCDNDATRGFGPLVPGHLKVDFGDTDGLEKIFKDHGERICGFLFEPIQGEAGVIIPPDGYLKAVRDLCSRHNILMIADEIQTGIARTGKMLACDWENIRPDVVILGKALGAGVVPVSAVLADKDIMLCIKPGEHGSTFGGNPLASAVAVASLKVVTDEGLVERAAKLGQEFRDQLQKVQQRFPQIIREVRGRGLLNAVDLSNEALSPASAYDICIKLKERGVLAKPTHDTIIRLAPPLSISPEELAEASKAFSDVLEHDLPQLQKQIKKTESAAEKQSCDRCGRDLY

SEQ ID NO: 60394 - protein, 453 aa, Arabidopsis thaliana
MAESSEEPKVSLRLFIDEEKNKVVLAEASKAFVDVLFSLLTLPMGTIIRLLEEHRESQPITVGCFSNLYRSVAEMGIDNFKTDVCKHILLHPRSVRDLQYKRLMLNINPTEVKLFKCPISCNFYSHFSTSRCQCGSSMNKEFQEPRVVPVASSIQNDVNGVFIITDDLKVAVRSTDVVLNELKSLGSGDISKLREMLVYIGFEEVLTLLECMFSSKAPLTNTFLNKQTFQGQGVTKVYETLSPCMETNGDTFLTLDVIVRKQDMEILYVECGEDFVDLLFTFLAVPLEYVVGISGNSCSFVCIRNLIRSFKDLNAAEVSTSKSAIHHFYTCQKQLLNIITDQPPLYHRYNYYSLKECSGSTPLILIDPEGSGFVKRETKFTVSDDLIVTAMNSSSPICLLQKFQIHADDLEVQQISTSKTEATSLLRASLVTSSALKTSLRNLILKNPEEEIG

SEQ ID NO: 60395 - protein, 429 aa, Shigella flexneri 2a str. 2457T
MTTDDLAFDQRHIWHPYTSMTSPLPVYPVASAEGCELILSDGRRLVDGMSSWWAAIHGYNHPQLNAAMKTQIDAMSHVMFGGITHAPAIELCRKLVAMTPQPLECVFLADSGSVAVEVAMKMALQYWQAKGEARQRFLTFRNGYHGDTFGAMSVCDPDNSMHSLWKGYLPENLFAPAPQSRMDGEWDERDMVGFARLMAAHRHEIAAVIIEPIVQGAGGMRMYHPEWLKRIRKMCDREGILLIADEIATGFGRTGKLFACEYAEIAPDILCLGKALTGGTMTLSATLTTREVAETISNGEAGCFMHGPTFMGNPLACAAANASLAIIESGEWQQQVAAIEVQLREQLAPARDAEMVADVRVLGAIGVVETTRPVNMAALQKFFVEQGVWIRPFGKLIYLMPPYIILPQQLQRLTAAVNRAVQDETFFCQ

SEQ ID NO: 60396 - protein, 474 aa, Acidobacteria bacterium Ellin345
MADQKTPNIAVIGGGPGGYAAAFLAADLGMTVTLIDMELNPGGVCLYRGCIPSKALLHVAKLIEEAKHSTNWGVTYDAPKIDLERLRTFKEGVVKKLTGGLGQLSKQRKVTYIQGKATLVDSCTVKVEKTAGGEETLHFDKLILATGSRPAVIPAFNIGSPRVMDSTGALNLEDIPKRLLVVGGGYIGLELGSVYAAIGSKVSVVEMTAGLLPGADRDLVAPLHKRLTGIFEAIMLNTTVISIADTGSAVKVKFKTQDGKEEEQTYDRVLVSVGRKPNSQIPGLDKTRVKVNQKGFLQVNPSLMTDDPFIYAIGDVVGEPMLAHKASHEGLVAVESIAGHKVAFEPQAIPAVVFTDPEIAWAGLTETQAQNEGREVTVTKFPWAASGRAVTIDRTEGLTKLIIDPQTERVLGVGICGPGAGEMIAEGVVAIEMGALAGDIKLSIHPHPTLSETIMEAAEVFYGQSTHIYRPKRK

SEQ ID NO: 60397 - protein, 327 aa, Glycine max
  misc_feature (296)..(296): Xaa can be any naturally occurring amino acid
MEVVQEQQLQNTDGRKLHNSDRNSNVTQQLQHPRFRKYKWWLRVSLYIIFLLVGQSAATLLGRLYYDNGGNSKWMATFVQSAGFPVLLPLLFYFPRQTHAKFNNNPSNNDYSYKTKPKFSTLVFLYLAFGLILTGDNLMYSYGLLYLPLSTYSLLCATQLVFNAVFSFFLNSQKFTAFIINSVVLLTISASLLAINSDSDEDSTGLSREKHVIGFFCTIGASATFSLYLSLVQLSFQKVIKRETFSAVLDMQFYPSFIATCACVVGLFASGEWKSLNNEMKGYDKGSVPVVMTVLXIAVTWYICSLGMLGGTLEESALLSDVRSTWG

SEQ ID NO: 60398 - protein, 137 aa, Helicobacter hepaticus ATCC 51449
MEQTLSIIKPDAVKKGVIGKIIDRFESNNLRICAMKKLQLTRCDAEAFYAIHKERPFFKDLVDFMISGPVVVMVLEGNNAVMKNRDLMGATNPKEAEAGTIRADFAQSIDANAVHGSDSLENAKNEIAFFFSTREIC

SEQ ID NO: 60399 - protein, 699 aa, Oryza sativa (japonica cultivar-group)
MVVSVSLPCWTEITHYYSPSPWERTWIELLFAHAGNTPMDRRLILSVAVAVALLAPRAAGEPWPVCGQDFGTFTPKSRFFANLQLIAATLPGNASSSPDLYATAVDVGAVPEQVTAAALCRGDVSASSCLGCLTQAFADLPNACGNSREAATYYDRCMVSYSAINFLSGGAGGEDPARIDAYTVNNENKVTSEQGRYNRLVAALVNATADYAAYNSTRRYAAGEADFDAALPKVYSLAQCTPDLSPARCRSCLAKIVAQELWSYKDDIGGRTLSVRCSFRIETKPFLNGTTMVRLPATSAPSPAPPVNATPSAATPGRETKYKVPRLVLIILLPIIAAVNLVVCFCVWRRKRPVITKAKQTNANYYAEADDVDSVDSMLMDISTLRAATGDFAESNKLGEGGFGAVYKGVLPDGNEIAVKRLSKSSTQGVQELKNELALVAKLRHKNLVSFVGVCLDQHERLLVYEFVPNRSLDLILFDTEKREKLDWEKRYRIINGVARGLQYLHEDSQLKVVHRDLKASNILLDANMNPKISNFGLARIFGQDQTQAVTNRVVDTYGYMAPEYMMRGNYSVKSDAFSFGVMVLEIVTGRKNNDFYNNSHQSEDLLNTIWERWMAGTVDEMVDPAMSRYVSASDVRKCVHVALLCVQENPADRPVMSSVVMMLDSETVSLQVPSKPAFFARNGGAKPGVASDESTASV

SEQ ID NO: 60400 - protein, 893 aa, Acidobacteria bacterium Ellin345
MNPVNLDTIDINSLEVLENREWLESLEYVLQTGGPERVGRLIQQLQLQCERAGVKLPFTATTPYENTIPADRQPPFPGSQEMERRIKSLIRWNALAMVMRANKVEEGIGGHISTFASAATLYEVGFNHFFRAATEDGDRDIVYFQGHSAPGIYSRAFLEGRLPIEKLENFRRELHPGGGLSSYPHPWLMPDFWEFPTVSMGLGPITAIYQARFNKYLENRGLKTATSGKIWAFLGDGETDEPESLGAISLASRERLDNLIFVINCNLQRLDGPVRGNFKIIQELEANFRGAGWNVIKVIWGSDWDSLIEKDTDGLLVKRMGEITDGQFQKYAVETGRYFRQNFFGTDPRLLKMVEHLSDEQLEHLRLGGHDPIKVHAAYKEAVDHKGSPTVILAKTIKGYGLGESGEGKNITHQQKKLNEEELKIFRSRFGIPVADEDLAKAPFYRPSDDSAEIKYLQERRKQLGGYMPARKVRAAALPIPKEELFEEFYKGTEGRKASSTMVFVRMLGKLLRDPEFGKYVVPIVPDEARTFGMEALFRQVGIYSSVGQLYEPVDMDTLLYYKESKDGQILEEGITEAGSMSSFIAAGSAYSTHGIPTIPFFIYYSMFGFQRIGDLVWAAADTRCRGFMLGGTAGRTTLAGEGLQHQDGHSHLLAYPVPTCMAYDPAFAFELAIIIQDGIKRMYHDGESIFYYITVMNEPVENPAMPEGVREGILRGMYRFKKSEHKSKLKANLFGSGTIMQEVIKAAEILESKYDIASDIWSITSYKELYKDGNDVDRWNMLHPAEKPRQTFIGEQLKDAEGVFVAASDYVKAMPESISQWFPRPLLALGTDGFGRSEGRASLRDFFEVDAKHIVVGTLTALMRDGKVKPDAVSRAIKDLGVDPNKPNPFTV

SEQ ID NO: 60401 - protein, 351 aa, Xanthomonas oryzae pv. oryzae KACC10331
MATMAAHLLYRLPVPMSRPSLTRFLIEEQHAGRIDAELRQLITIVSRACKRISIAVSKGALGGVLGDAGTGNVQGEAQKKLDVLSNDILLEANAWGGHLAACASEEMDHSQPVPEQYPSGDFLLLFDPLDGSSNIDVNVSVGTIFSVLRAPKGTEKPGDEHFLQPGTQQVAAGYCIYGPSTMLVLTLGHGTHAFTLEREEGSFLLTQANMRVPDETAEYAINMSNQRHWEPAMQAYVGDLLAGKDGARGKDFNMRWIASMVADVHRILTRGGIFIYPWDKKDPSKPGKLRLMYEANPMSMLVEQAGGAATTGRERILDIQPTQLHQRVPVFLGSKNEVAAATRYHLDADKA

SEQ ID NO: 60402 - protein, 183 aa, Oryza sativa (japonica cultivar-group)
MLRRRGFCCCSGAPAAAAAALLLLAVAAAAPRAAGFHLGGDESVLVRGMLAAIRREQAEAEDAARFAVAEYNKNQGAELEFARIVKAKRQVVTGTLHDLMLEVVDSGKKSLYSAKVWVKPWLDFKAVVEFRHVGDSQSQSATAADDNAGQDTADPTVASRNDLHNTENNKVSVVLSTFSQANP

SEQ ID NO: 60403 - protein, 267 aa, Oryza sativa
MGEIRALRNMDDDEVFAYAKRIAAPYDLVMQTKQLGRLPVVQFAAGGVATPADAALMMQLGCDGVFVGSGIFKSGDPARRARAIVQAVTHCRSSRPSTPPPRRPRWHTFAVELCPNRYMVMEAFIDTAGKDQSDPLILTQLNSTKAIRDSIQINFGECGLAACLGSLQGIYELYSSIVKYVNPITKLCVIRVSREDHQKVWAAITMVRSIGKIPVSFNLRDVSGSIRACKKAALECEEAKFEYYKLAAGDRITPKFVETMESCFNKD

SEQ ID NO: 60404 - protein, 348 aa, Aspergillus nidulans FGSC A4
MSTFPAEPRSDIVNGHVESDFNYQTGTWSEPVFVQDHYLKVHGLAPGLNYGQQVFEGMKAYRDPNGQIQIFRPTDHALRMQRSCDAVSIPSIPESLFWASVNLAVAKNSEFVPPHASEAAMYIRPLAFGSGGWMPVAAGPQYKFVVYALPFCAYHGTLPVDAVVLEELDRAAPLGVGNVKVGGNYAPVLKWSDKARKEGFGITLHLDSKTRGEIDEFSTSGFVGIKYTESGGEKGYTLVVPNSQCIIKSVTSTSVVEVARSLGWRVEVRPIPYDELEFFDEVLAVGTAAMITSIRSITHRSKDQVFRYKTSDEPGSACEKLSRHLKGIQKGDEKDTFGWLKRVEEVTV

SEQ ID NO: 60405 - protein, 331 aa, Beta vulgaris
MAELNNGGHSKELVVSFGEMLIDFVPTSSGVSLAEAPGFLKAPGGAPANVAIAVSRLGGNAAFVGKLGDDEFGHMLAGILKKNGVSADGLSFDKGARTALAFVTLKSDGEREFMFYRNPSADMLLTPDELNLDLIRSAKVFHYGSIRLIVEPCRSAHLKAMEEAKKAGALLSYDPNLRLPLWPSAEEAREQIMSIWDKAEVIKVSDNELEFLTGNSTIDDATAMSLWHPNLKLLLVTLGDQGCRYYTKNFKGSLDGFKVNAVDTTGAGDSFVGALLNKIVDDHSIIEDESRLKEVLKFANACGAITTTKKGAIPALPTVADALELIKKNAS

SEQ ID NO: 60406 - protein, 461 aa, Acidobacteria bacterium Ellin345
MSTAITTAGPKIRTKLPGPNAQRVLEGDARIISPSYTRSYPLVAKRGHGVVIEDVDGNEFFDFSSGIAVTSTGHCHPEVVAAIQKQAGELIHMSGTDFYYESMITLGDRLSKIAPMKGPHRVYYGNSGAEAIECALKLARYHTKRQHIIAFYGAFHGRTMGALSLTASKPQQHRRFSPLVPGVTHIPYPNLYRRPEGTDANEYAVSVARFLEEKVFTTDIAPEEVAAIFVEAIQGEGGYLPAPPAFMQELRKICDKHGILLVCDEVQSGCGRTGKWWAVEHTGVEPDMITIAKGIASGMPLSVCLTKAEIMDWVPGSHASTFGGNPVAIAAALATLDVLEREGVKNAETVGKHIMNRISKWPEKMPLVGDVRGHGLMLGVEFVSDKKTKRPAGELRDAVVDLAFEKGILYLGAGPNTLRIAPALIVTKEEADIALDILEECILNVAALHEKGKKAGEEVGS

SEQ ID NO: 60407 - protein, 483 aa, Caulobacter crescentus CB15
MAREILTVAEMAASDRAAVLAGTPIPVLMERAGEAVAQAVRARYQRRPVVVWCGPGDNGGDGYVAARHLRRHGWPVVVEAAYPPATDACRWAASRWRGEVKPLSQRLAAEALYIDAMFGAGLSRPLEGEVAELARTAVRQALTIVAVDTPSGVHGDTGRSLDGVALAAELTITFHRRKPAHVLIEGRKACGDILVSDIGLSTVASAALFENDPSLWRERYPWPAIDAHKHSRGRLSVVSGDAWNTGAARLAARGGLRIGAGAVTLLSPPSALSVNASHLEAVMLASFESDADLAARAEKADAVIIGPAAGVGDATARNLRALTQTGAALVADADALTSFRDDPGELFACLDRDDVLTPHPGEFERIFPGLLGRSPERITAAREAASAAGAVILLKGADTVIAAPDGRAAVGLNGTPWLATAGSGDVLAGFIGGLLAQGMGSFEAACAGAWIHAECGALHGPGLIAEDLPGLAPAILARLHQER

SEQ ID NO: 60408 - protein, 651 aa, Oryza sativa (japonica cultivar-group)
MAALLLWLSWLLLSLLSIYLLDLLAHSRRCLPPGPRPLPLIGSLHLLGDLPHRSLAGLAKTYGPLMSLRLGAVTTVVASSPEVAREFLQKHDAVFATRSTPDATGDHARNSVAWLPPGPRWRELRKIMATELFSTRRLDALHELRQEKVAELVDHVAGLARDGTAVDIGRVAFTTSLNLVARTIFSHDLTSLDDHGASKEFQRLITDVMEAVGSPNLSDFFPALAAVDLQGWRRRLSGLFARLHRLFDAEMDHRRLHGMKEKDGDFLEVLLRLAARDDDTARLDGDTLRSLFTDLFTAGSDTSSSTVEWAMAELLQNPISMAKLCDELRRVVGSRRRIEESEIGQLPYLQAVIKETFRLHSPAPLLLPRQATRTIQIMGYTIPKGTRVLINVWAMGRDEDIWPEAGKFIPERFLERTIDYKGGDLELIPFGAGRRICPGMPLAVRMVHVLLASLLIHFKWRLPAEVEGNRIDMTEKFGVTLAKANHLCAMAAPTTSNSGGVSGKGEEEDEAYWDEWLAKPIHERVAWQMPSATELQDAGVTFHAKGLPCSLVDVTFSQRDGVMEIPTVENYANHAMLANLVAYEQSRGRLEMQRVYSRRCSTVRWRAAASGVRDERAVGWQRHHLHDWRLAVHGSRSRGEDGGEEKGIGSV

SEQ ID NO: 60409 - protein, 526 aa, Candida glabrata CBS 138
MSVQIFGDQVTEERAENARMSAFVGAIAVGDLVKSTLGPKGMDKLLQSASSENSLVTNDGATILKSIPLDNPAAKVLVNISKVQDDEVGDGTTSVTVLSAELLREAEKMIDQARIHPQTIIEGFRIASAAALKALDSAAVDNSSDSEKFHSDLVHIAKTTLSSKILSQDKEYFSNMATDAILRLKGSTNLEHIQIIKILGGKLSDSFLDSGFILQKKFGNNQPKRVEKAKILLANTALDTDKVKIFGTKFKVDSTSKLAQLEKAERDKMASKINKISKFGINTFINRQLIYDYPEQLFTDMNINSIEHADFEGIERLALVTGGEVVSTFDDPEKCKLGECDLIEEVIIGEETFLKFSGCKAGEACTIVLRGATDQVLDEAERSLHDALSVLSQTTKETRTVLGGGCAEMIMSKAVDTQAQNVDGKKALAVEAFARALRQLPTILADNAGFDSSELVSKLRSSIYNGISTSGLDLDNGTIADMRELGIVESYKLKRAVVSSASEAAEVLLRVDNIIRAKPRTADRHM

SEQ ID NO: 60410 - protein, 440 aa, uncultured archaeon
MLLPHISHCIGIAYHPIVHKGLCIVRIFSLMMDLEMDVDADMDSTEFSKYVVDRMQQLELKNDLLEKQYQKVETEKQLAEDQRLKYERELRKLRSELDKLKTTPQLVGTLVSILEEGKSIVRSSTGPEFIVGSSQFIKDGDLKPGVQVALNKEHLSIVAVIPRSEDPLVQAMEVIESPDIDYDQIGGLDKQIEVLRGAVEFALTKPEIFERIGIDPPKGVLLFGPPGTGKTLLAKAVATRTEATFIRVVGSELVQKYIGEGARMVRDVFEMARKKAPAIIFIDELDSIGAVRLDDASSGGREVQRTLMQLLSEMDGFNSRGDVCILAATNRWDILDPALIRAGRFDRLVYVPIPDREARAKILLIHTEKMRLADDIDFDRIVALTEDANGATLRAIAMEAGMCAVREEADAVHQKDFEDAIKHIMNPEGMVDRYSEGMFA

SEQ ID NO: 60411 - protein, 258 aa, Neosartorya fischeri
LPKPTNPNRAALVSGTSYGHGTNDAAFGLHQFPQRSIFQQLTETNHSWINYVDPAGGTGPDAGFFNWTWATKNNDKIQPLSKFYTDAAAGALPELAYLNPSCCGVGTTSMHPAGLISDGEAFIKQVYDALRGSPQWEQTLFILTFDESGGFHDHVPSPLAPRPDNLTYTQTTPSGEPYTLPFDRLGGRIPTLLISPWVGKAQVEQKGRNAQGETVSYSASSVLRTLGYLWDFEPFTPRVEHAASFEHLIAHHAREDTP

SEQ ID NO: 60412 - protein, 244 aa, Triticum aestivum
MSGTGYTVEVTNLSSSASENDLHEFFSFSGPIEHIDLIRSGGYGSTAYVTFKEPYALETAVLLSGATIVDQPVCISRWGQPDEPCNFWDRPTWQVEEEIEYRDYQSCQFNATPQEALTVAQDVVKTMLSRGYILSKDALSRARAFDESHQLSGSAAAKAAELSRRLGLTDRVSAGVGAIRSVDETYHVTETTKTVATATGRTAVKVMNTIVTSSYFSAGAMMVSEALTRAAKAAENLAAHGRQN

SEQ ID NO: 60413 - protein, 172 aa, Neosartorya fischeri
PSCCGLDTNSMHPSGNVSFGQVLVKQIYDAVRTGPQWDKTLLLITYDETGGFFDHVQPPLAVRPDDKTYTETAPDGSSYTFNFDRMGGRMPTWLISPYAPKGHVENYGVDPATGKTASYSATSVLKTLGYLWDLEDLTPRVSHSPAFDHLIGPKMRGAPATLANPHPFPDAV

SEQ ID NO: 60414 - protein, 484 aa, Dechloromonas aromatica RCB
MNLQNTELLRSTNLIGGIWARADDGAQLAVINPATGEKLADVPLCGATETRRAIDAANAAWPAWRALTARRRSQLLQAWFSLIIKNADDLAQLVTAECGKPLQEAKGEVIYGASFVEWFAEEGKRTYGESIPSPAANTRLLVIKQPIGVCAAITPWNFPLAMITRKVAPALAAGCPVVVKPAEATPLTALALAVLAEQAGFPAGVFNVVTGKPAEIGGELCANPIVRKLSFTGSTGVGRLLMAQCAPTIKKLSLELGGNAPFIVFDDADVNAAVDGAIAAKYRNTGQTCVCANRFLIQAGIYDEFAAKFAEKASALKVGAGIEADVAQGPLINAAGLSKVEAHVADAVGKGARVLCGGARHERGGNFFQPTVLADVTTAMMVAREETFGPVAPLFRFETEEQAIAMANDTEFGLAAYFFTRNVGRCWRVGEALEYGMVGINTGMISNEVSPFGGIKQSGLGREGSKYGIEDYLEIKYLCFDVNT

SEQ ID NO: 60415 - protein, 298 aa, Haemophilus somnus 129PT
MTTHRPLFYGSITALITPMNNHGEVDFNALKKLVEYHIVSGTHAIVSVGTTGESATLSIAENVKTILKTLEFADGRIPIIAGTGANATSEAITMTKLLNDSGVAGCLSVVPYYNKPTQEGMYQHFKAIAECTDIPQILYNVPSRTGSDLLPETVGRLSQIANIVGIKEATGDVSRVAKIKQMAGEDFIFLSGDDATGLESMKLGGQGVISVTNNIAAADMAKMCELALAGKFDEAEIINDKLRALHKDLFIESNPIPVKWAAYKLGLVPDPILRLPLTTLSEQAQPKIINALKNAGLL

SEQ ID NO: 60416 - protein, 386 aa, Acidobacteria bacterium Ellin345
MPKLSERALGIKQSEIRVMSVECERVKGINLAQGICDTEVPPPVRQGAHEAIENGNNQYTRMDGIAGLRQAIAKKMKRYNRIERDPETEVVVTGGSTGGYLSTCLALLEAGDEVILFQPYYGYHVHTLETLGVTPRFVNLQPPSWEFKKEELERAISARTKAIVVNTPGNPSGKMFTREELGWIAEIASQHDLFVITDEIYEYFRYDGREHISPATVDRLRERTVTISGFSKTFSVTGWRLGYVVADAKWTNAIKYFSDLAYICGPSPLQWGVMMGIDELGDEFYDELNAEYAQKRRLLCDTLHEVGLTPFEPQGSYYVLADASSLPGKDSKERAMHLLHTAGVATVPGESFMKSGGETLLRFCFAKRMEELEEACRRLEGVRANV

SEQ ID NO: 60417 - protein, 339 aa, Haemophilus somnus 129PT
MNKNIDWENLGFSYIKTDYRYISYWKNGAWSKGELTQDNVLHISEGSTALHYGQQCFEGLKAYRCKDGSINLFRPEQNALRMQKSCQRLLMPEIPVEMFVDACKQVVKANADWLGPYGSGATLYLRPFLIGVGDNIGVSPAPEYIFSIFCCPVGAYFKGGMKPTNFIVSDYDRAAPQGTGAAKVGGNYAASLYPGKMAKTRHFADCIYLDPTTHKKIEEVGSANFFGITKDNKFITPLSPSILPSITKYSLLYLAKERLGMEVIEGDVYIDQLDQFKEAGACGTAAVITPIGGIQYGDHFHVFYSETDVGEITTKLYNELVGIQFGDVDAPEGWIVKVE

SEQ ID NO: 60418 - protein, 361 aa, Arabidopsis lyrata subsp. petraea
CKAAVAWEAGKPLVMEEVEVAPPQKHEVRIKILFTSLCHTDVYFWEAKGQTPLFPRIFGHEAGGIVESVGEGVTDLQPGDHVLPIFTGECGDCPHCHSEESNMCDLLRINTERGGMIHDGESRFSINGKPIHHFLGTSTFSEYTVVHSGQVAKINPDAPLDKVCIVSCGLSTGLGATLNVAKPKKGQSVAIFGLGAVGLAAAEGARIAGASRIIGVDLNSQRFDQAKEFGVTEFVNPRDHDKPVQQVIAEMTNGGVDRSVECTGSVQAMIQAFECVHDGWGVAVLVGVPSKDDAFKTHPMNFLNERTLKGTFFGNYKPKTDIPGVVEKYMNKELELEKFITHTLPFSEINKAFDYMLKGES

SEQ ID NO: 60419 - protein, 396 aa, Aspergillus nidulans FGSC A4
MARLLNRWHLPALVRRHYSSRFQSLRIEKTQSPKPLPDSTELQFGRSFTGKYPSQTRNHILKLEWTTTQGWSDAQITPYDNLRLDPASCVLHYAFTCFEGMKAYKDPHGNARLFRPEENLARLNRSAARLALPTFEESGVLEFLAKYVDLEKRFIPHLPGHSLYLRPTLLGTDASISVSRPRSALLFVIASPMGDYFANGMKAVTLQATRSPVRAWPGGVGEFKVGGNYAPSIVPQEEAAEAGSQQNLWLLADRESGEEFVTEAGTMNLFVVWVSSSTGKKELVTPPLDGTILPGVTRMSILELARERLEGDRSGIEVVERRITMRELAAASKEGRLLEVFGAGTAVVVSPVRSIRWGDQCISCGLRDGEEAGPMSLQMKTWLEEVQYGLVEHPWR

SEQ ID NO: 60420 - protein, 469 aa, Caulobacter crescentus CB15
MSTAKDILNLIKEKDVKYVDVRFTDVRGKMQHVTFDIDLVDDDFLNDGTMFDGSSIAGWKAINESDMKLRPDLSSAIIDPFYQQTTLALFCDVVNPDTGTPYNRDPRSIAKAALNYLKSAGVGDTVYFGPEAEFFIFDDVRWSTAPHDTSYSFDSTELPVNSNKQYAEGNMGHRPGPKGGYFPVNPVDSCQDLRGEMLAVMGELGMKPEKHHHEVAPAQHELGLKFDTMVTMADRMQLYKYVIHNVAAAYGKTATFMAKPMFADNGSGMHVHQSIWQDGKPLFAGDKYAGLSQECLWYIGGIIKHAKAINAFSNSTTNSYKRLVPGYEAPVKLAYSSRNRSASIRIPHVDSPKAKRLEARFPDPMGNPYLTFVALLMAGLDGIINKIDPGAPADKNLYDLPPREQKKIPEVCGSLREALENLDKDRAFLKAGGVMDDDFIDSYIELKMEEVMRLQLHPHPVEFEMYYKC

SEQ ID NO: 60421 - protein, 355 aa, Gerbera hybrid cultivar
MVIQATTRVESLSTSGIRQIPKEYIRPQEELRSITNIFDEETNKQKPQVPTVDLTDIESDDPEKRHKCLEELKKAAMEWGVMHVVNHGISGDLIGRVKAAGEGFFGLPVEEKEKYGNDPDGGRIQGYGSKLANNASGQLEWEDYFFHLVFPEEKRDLTIWPTTPSDYTDATTEYAKQLRALATKILSALSLGLGLEEGRLEKEVGGIEELILQLKINYYPKCPQPELALGVEAHTDVSALTFILHNMVPGLQLFYDGQWVSAQCVPDSIILHIGDTLEILSNGKYKSILHRGLVNKEKVRISWAVFCEPPKEKIILKPLPETVSEAEPPLFPPRTFQQHMEHKLFRKNKDEVMQN

SEQ ID NO: 60422 - protein, 903 aa, Solanum lycopersicum
MEVDNCWNIRLVNCVIICLVIYIQSAFAQEGFLSIQCCATANFTEPRTNLSWISDGIWFPENQSCISRPVYKSEHYERARSFSSDISHKWCYSLPTRKEHDYLVRGTFLSVKQEKTLPHSSFVVLIGVTPIATVKSSDELKVEGIFRATRSYTNFCLLKKKGNPYISKVELRPINSDYLKKEPSEILKLVHRVDAGNKAAEIRYPYDQYDRIWRPASNLESQVTQTPPSIIKHVFARKHSLLPPAFVLRTALTHPERLDFLHEDLDTGYYTYSLFLYFLEPNDSVQAGERVFYIYINNEKRLKVDILASGSRYLDVVLNFRANRSVNLTMIKASNLSQLGPICNGYEILKALPRVKETATEEVDIMANVKKELLQQNKNNEIWKSWSGDPCLPLPWPGLTCDRVNGTSVITQIDLSSGGLSGPSPPSIQKLMHLRKLNISINGSSGTNSLFTSYFTYSTRYLSSRIHISNKLSRSIKESNITTDKGMANVKQNSSSTHKLVIGAAVGTALLVILAIVISVVCLFKRRVMAGPKFLMRNYSITRNAVYSVPSMDTTMMKSISSRNFKLEYIEAITQNYKTLIGEGGFGSVYRGTLPDGVEVAVKVRSATSTQGIREFNNELNLLSAITHENLVPLIGYCCENEQQILVYPFMSNSSLQDRLYGGAAKRKILDWPARLSIALGAARGLLYLHTFSERCLIHRDVKSSNILLDQSMCAKVADFGFSKYASQEGDSGTSLEVRGTAGYLDPEYYSTQRLSAKSDVFSFGVVLLEILTGREPLNINKPRNEWSLVEWAKPLIRSSRVEEIVDPTIKGGYHGEALWRVVEVALACTETYSTYRPCMADIVRELEDALIIENNASEYLKSLDSFGGSNRFSVERSIVLPPIKSQTEPSSLLSKPAPPQPR

SEQ ID NO: 60423 - protein, 263 aa, Triticum aestivum
MTAPAELSREENVYMAKLAEQAERYEEMVEFMEKVAKTVDSEELTVEERNLLSVAYKNVIGARRASWRIISSIEQKEESRGNEDRVTLIKEYRGKIETELSKICDGILKLLETHLVPSSTAPESKVFYLKMKGDYYRYLAEFKSGPERKDAAEDTMVAYKAAQDIALAELAPTHPIRLGLALNFSVFYYGILNSPDRACNLAEQAFDEAISELDTLSEESYKDSTLIMQLLRDNLTLWTPDITEDTAEEEIREAPKNDSSEGQ

SEQ ID NO: 60424 - protein, 331 aa, Glycine max
MGKQSTEFSALNCIDLSNPDINQSVNLLKQACLDSGFFYVVNHGISQEFMEEVFAQSKKFFSLPHKEKMKILRNEKHRGYTPVLDELLDPENQVHVGDYKEGYYIGVEKGEDDPESNKPFYGPNNWPAPGVLPGWRETMEKFHRETLEVGKAVAKIIALALDLDANFFDQPEMLGEPIATLRLLHYEGQVSDPLKGLYGAGAHTDYGLITLLATDDVSGLQICKDRDAKPQKWEDVAPLKGAFIVNLGDMLERWSNCVFKSTLHRVLGNGQGRYSIAYFLEPSHDCLVECLPTCKSDSNPPKFPPILCHDYLTQRYNDTHADLNVYKKQQA

SEQ ID NO: 60425 - protein, 103 aa, Brassica napus
  misc_feature (13)..(13): Xaa can be any naturally occurring amino acid
MSGRGKGGKGLGXGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 60426 - protein, 370 aa, Pseudomonas putida GB-1
MIKSRAAVAFEAKKPLEIVEVDVAMPKAGEVLLRVVASGVCHTDAYTLSGADPEGIFPSILGHEGGAIVEAVGEGVTSVAVGDHVIPLYTPECGKCKFCLSGKTNLCQAIRATQGKGLMPDGTTRFSYKGQQLFHYMGTSTFSEYTVLPEISVAKIQKEAPLEKVCLLGCGVTTGIGAVLNTAKVKPGDTVAIFGLGGIGLSAVIGAVKAKASRIIAIDINPAKFEIARQLGATDCVNPKDYDRPIQEVIVDLTDGGVDFSFECIGNVQLMRAALECCHKGWGESVIIGVAGAGQEIATRPFQLVTGRVWRGSAFGGVRGRSELPSYVEMSEKGEIPLDTFITHTMGLEDINKAFDLMHEGKSIRSVIHF

SEQ ID NO: 60427 - protein, 471 aa, Dechloromonas aromatica RCB
MATPQDVIKMIKENDAKFVDFRFTDTRGKEQHVTVPVSAFSEDKFENGHAFDGSSIAGWKGIQASDMQLNPDPATAYIDPFFDETTVVLTCDVVDPADGRGYDRDPRSIAKRAEAYLKSSGIGDTAYFGPEPEFFIFDGVEWNVDMSGCSLKIHSAEAAWGSGEKNDGNGSTGHRPTVKGGYFPVPPVDSLHDIRSAMVLTLEALGCPVEVHHHEVATAGQCEIGTVFNTLVKRADQTQILKYVVHNVAHQYGKTATFMPKPIVGDNGSGMHVHQSIWKDGKNLFAGDGYAGLSELALFYIGGIIKHAKALNAITNPGTNSYKRLVPHYEAPVKLAYSAKNRSASIRIPYVASTKARRIETRFPDPIANPYLCFAALLMAGLDGIQNKIHPGDPADKNLYDLPPEEDAKIPTVCASLEEALAALDKDREFLTRGGVFSNDWIDAFISLKMDEVNKVRMTTHPVEFDLYYSC

SEQ ID NO: 60428 - protein, 429 aa, Pseudomonas putida GB-1
MAKIVDIKGREVLDSRGNPTVEADVLLDNGIIGSACAPSGASTGSREALELRDGDKSRYLGKGVLKAVANINGPIRELLLGKDPSDQKALDRAMIELDGTENKAKLGANAILAVSLAAAKAAAQDQDLPLYAHIANLNGTPGQYSMPVPMMNIINGGEHADNNVDIQEFMVQPVGAKTFSDGLRMGTEIFHHLKAVLKARGLNTAVGDEGGFAPNLASNEDALGAIAEAVEKAGYKLGTDVTLALDCAASEFYEDGKYNLSGEGKSFDAEGFAEYLKGLTERFPIISIEDGLDESDWAGWKILTDKIGEKVQLVGDDLFVTNTKILKEGIEKGIGNSILIKFNQIGSLTETLEAIQMAKAAGYTAVISHRSGETEDSTIADLAVGTAAGQIKTGSLCRSDRVSKYNQLLRIEEQLGAKAVYRGRAEFRG

SEQ ID NO: 60429 - protein, 456 aa, Oceanicola granulosus HTCC2516
MLKNDPLEQWDRDHFLHPSTHLAEFARGNVAHRIVSGGEGSHIVDRNGTRLLDGFAGLYCVNVGYGRREIADAIAKQARELSYYHSYVGHGTEASVTLAHMILERAPANMSKVFFGLGGSDANETNIKLIWYMNNILGRPGKKKIISRWRGYHGSGLMSGSLTGLPLFHKAFDLPLAPILHTEAPYYYRRPNADMSEEAFSAWCASELEAMIQREGPDTIAAFWAEPVLGTGGIVPPPEGYWAAIQEVLDRHDILLVADEVITGFGRLGTMFGSDHYGMKPDVITIAKGLTSAYAPLSGSVLSEKVWKVLEQGTDEMGAIGHGWTYSAHPIGAAAGVANLKLIDELGLIDNAAEVGAHLRAGMRDALGEHPNVGDIRGEGMLCAVELVSDRESKEGFDPSRKVTVNAVAHLMENGVIGRAMPHSETIGFAPPFCLTRDEADEIVAKTAAAVKAVLG

SEQ ID NO: 60430 - protein, 805 aa, Oryza sativa (indica cultivar-group)
MARGLKRGRTRLIGLIIADITNPYSVNVLSGIEAACREKGFTPLVCNTNNEVDQELHYLDLLRSYQVEGIVVNAVGMREEGLNRLQQSSLPMVLIDRKIPEFACDVVGLDNTQAATTATEHLIEQGFEAILFLSEPLGMVNTRRDRLAAFRATLARYPGVIAENAETPLHEADQLDNTLRQFHTRHRGMRKAVISANGALTLQVARSLKRIGLHWGSDIGLLGFDELEWAELAGVGITTLKQPTWQIGYAAVEQVVRRIEGTSEAVREQRNSIDMLRWSPKMGRKIMVVTAAYGAEQVRQAGGQRAMLPVIAGAGADGVEIRRELFNSEELLALPALGESIELLGLLACYSAPAALFMPDGTLNPDLPRYLSEASTLNALWLKVSLGHFSDTQPLDALRTLLNTSGIALVVENDQTDCGQLAPMQRFQAACRERALPVTLTFDMGNWLWVGDSPEEAARHLAPAVSYIHVKAAVPHKDNFRAVAPDGADSRWLDLLGQLPADAPRAMAMFVATETGELSAVEHFIKRVAGAELNVATGLARLGLNVGWVSRVGDDSFGHFVLDSLKKEGIDAAGVTLDGRFPTGFQLKSKVENGTDPIVEYFRKGSAASHLSVEDYHADYFASARHLHLSGVAAALSASSYSLLDHAATTMKSLGKTISFDPNLRPVLWKSEAEMIEKLNRLAFRADWVLPGLKEGMILTGKNTLEGIADFYLNKGVKAVVLKTGADGAWFKTAEGEQGAVAAVKVENVVDTVGAGDGFAVGVISALLEGKPLQQAVARGNKIGSLAIQVQGDSEGLPTRAQLGM

SEQ ID NO: 60431 - protein, 411 aa, Arabidopsis thaliana
MNALAATNRNFRHASRILGLDSKIERSLMIPFREIKVECTIPKDDGTLVSYIGFRVQHDNARGPMKGGIRYHPEVDPDEVNALAQLMTWKTAVADIPYGGAKGGIGCSPRDLSLSELERLTRVFTQKIHDLIGIHTDVPAPDMGTNAQTMAWILDEYSKFHGHSPAVVTGKPIDLGGSLGREAATGRGVVFATEALLAEYGKSIQGLTFVIQGFGNVGTWAAKLIHEKGGKVVAVSDITGAIRNPEGIDINALIKHKDATGSLNDFNGGDAMNSDELLIHECDVLIPCALGGVLNKENAGDVKAKFIVEAANHPTDPDADEILSKKGVIILPDIYANAGGVTVSYFEWVQNIQGFMWEEEKVNLELQKYMTRAFHNIKTMCHTHSCNLRMGAFTLGVNRVARATQLRGWEA

SEQ ID NO: 60432 - protein, 550 aa, Schizosaccharomyces pombe
MSFCLASTLPAWEVVQTHYESVGKHLVLKELFAKDSSRFEKFSFTFNGLKEEDGPILFDFSKNLITEETVELLVKLAKEANVEGLRDALFAGEHINFTEDRAVFHPALRNVSEKPMKVNGQDVMPGVRKVLRHMKEFSDAVRSGAWKGYTGKPIKSIVNVGIGGSDLAPVMVTEALKPYGQENLELHFVSNIDGTHLSEALKKCDPETTLFLIASKTFTTAETCTNAKSAKDWFLASAKDPSHVAKHFVALSTNEKEVTAFGISAQNMFEFSDWVGGRYSVWSAIGLSVALYIGYENFEAFLSGAHAMDEYFCSTPLEKNIPALAALISIWYSDFFGAQTHLVAPYDQYLHRFPAYLQQLSMESNGKAITRSGDMVNYTTGKILWGEPGTNSQHSFFQLIHQGTKLIPADFLIPIESHNPIDNNKHHRMLFSNFAAQTEALMLGKTPAEVKAEGTPDEIVPHKTFVGNRPSNSIIAKKITPASLGALIAFYEWVTFTEGAVWNINSFDQFGVELGKKLVKNVLAQLETKGDVENHYSSTNGLINLFKNGF

SEQ ID NO: 60433 - protein, 285 aa, Oceanicola granulosus HTCC2516
MKDYPVPPFPKQKQPMPGSTDKMDPRPDHGEDSYRGSGRLEGLAAIVTGGDSGIGRAVALAYAREGADVLISYLDEHDDAEETKRLVEEAGRKAVLVPGDLGEAAHCRDVVKKAVGAFGRLDILVNNAAHQAHFDSVEEIPDEEWDKTFRANIHSMFYLSKAAIGEMKNGGAIINSASINSDKPNPGLLAYATTKGAIQNFTNGLAQMVAGKGIRVNCVAPGPVWTPLIPATLPEDSVSHFGEQSPMGRPAQPVELAPAYVMLAEPNASYISAATIAVTGGIPMM

SEQ ID NO: 60434 - protein, 697 aa, Acidobacteria bacterium Ellin345
MSSEPAVKEEQKIAAEPKRGPEGGVSEKQEDLLAINTIRTLSMDAVQKANSGHPGTPMALAPVAYTLWSRFLRFNPKNPHWANRDRFVLSNGHASMLLYSLLHLFGYGLSLDELKNFRQWDSKTPGHPEYRLTEGVETTTGPLGQGVANSVGMAISERWLDSHFNKGDQKIVDYRIYAICGDGDLMEGVSQEAASIAGHLGLSNLLWIYDNNQITIEGNTSLAFSDDVGTRFLSYHWNVLRVSDANDVESIDRAIRTAQKETERPTLIILDSHIAWGAPNKQDTAAAHGEPLGEDEIKLAKKAYGWPEDAKFLVPQEVYDHLKPYADRGKKLEGDWNDKLNSYRSANADLAKEWDTLHAGKLPDGWDKDIPVFPADAKGMATRESNGKVLNAIAKNLPWLIGGAADLAPSTKTLINGAKGFEKGSYDGRNFHFGIREHAMGSILNGMALSGLRPYGATFLIFTDYMKPPVRLSALMELPVIFLYTHDSIGLGEDGPTHQPIEQMLGLRSVPRLIDFRPGDANEVAVAWKTILQLHNTPVAMALSRQGMPTFDRTKYASADGVAKGGYVLADSENPELILIGTGSEVQLCVSAYEELKKEGVRARVVSLPSWKLFQQQSQEYRDSVLPPAVRARVAVEAGTDLGWREHVGIDGEIIARSDFGASAPIKDLFKHFGFTVENVVAKSKVTLDRVRQGGKK

SEQ ID NO: 60435 - protein, 761 aa, Sinorhizobium meliloti 1021
MPGIDKTDRAMTSVTAQEALDFHSQGRPGKLEISPTKPMATQRDLSLAYSPGVAVPVKAIADDPATAYDYTARGNMVAVISNGTAILGLGNLGALASKPVMEGKAVLFKRFADVDSIDLEVDTENVDEFVNCVRFLGPSFGGINLEDIKAPDCFIIEQRLREVMDIPVFHDDQHGTAIIAAAGLVNALTLTGRDFKTAKLVCNGAGAAAIACIELIKAMGFNPENIILCDTKGVIYKGRTDGMNQWKSAHAVETDRRTLAEALDGADVFFGLSAKGALSADMVRSMGARPIIFAMANPDPEITPEEVALIRDDAIVATGRSDYPNQVNNVLGFPYIFRGALDVRASTINDAMKIAAAEALANLAKEDVPDDVAAAYQGNRPRFGPQYIIPVPFDPRLISAIPMAVAKAAMETGVARKPIEDLKAYGQQLSARRDPIASTLQRIVERVRRQPKRIVFAEGEEVQMMRSAIAYANQQLGTALLLGREEVMRETAEREGIDLDRAGIQIVNARLSKRVGAYTDFLYSRLQRKGYLFRDVQRLINTDRNHFAASMVALGDADGMVTGLTRNYSTALEDVRRCIDPKPGHRVIGVSIALCRGRTVLVADTAVHDMPTSEELADIAEEAAGLAKRLGYVPRVAMLAYSTFGHPSGERSERVREAVKILDRRRVDFEYDGEMAADVALNARVMEQYPFCRLSGTANVLVMPAFHSASISTKMLQELGGSTVIGPLLVGLDKSVQIASMSAKDSDLVNLAAIAAYNAGT

SEQ ID NO: 60436 - protein, 260 aa, Nicotiana tabacum
MAESTREENVYMAKLAEQAERYEEMVEFMEKVAKTVDVEELTVEERNLLSVAYKNVIGARRASWRIISSIEQKEESRGNEDHVSSIKEYRGKIEAELSKICDGILNLLESHLIPVASTAESKVFYLKMKGDYHRYLAEFKTGAERKEAAENTLLAYKSAQDIALAELAPTHPIRLGLALNFSVFYYEILNSSDRACNLAKQAFDDAIAELDTLGEESYKDSTLIMQLLRDNLTLWTSDTTDDAGDEIKEASKRESGEGEQ

SEQ ID NO: 60437 - protein, 458 aa, Rhizobium sp. NGR234
MYSNSLIELDRAHLIHPVASYRGHEKLGVRVLASAKGATVTDASGRQLIDGFAGLWCVNAGYGHESIVEAATRQMRELPYATGYFGLGSEPAIRLASELAERAPGNLDHVFFTLGGSDAVDSTIRFIRYYWIGRGEPQRDQFISVEQGYHGSSTVGAGLTALPAFHAGFGIPFDWQHKIPSHYAYRNPVGDDPQAIIDASLAALRQKVEEIGPERVAAFYAEPIQGSGGVLVPPKGWMKAMRQLCQELGILFVADEVITGFGRTGPLFACHEDEIVPDFMTVAKGLTSGYVPMGAVFMGDHIYQTIADSAGAGAVGHGYTYSAHPVSAAVGLEVLKLYENELLDNGRKAGARLMAGLESLKDHPLVGDVRGRGMLAAVELVVDKEKKTPLPAKAEPARRIFDRAWENGLVIRAFANGVLGYAPPLCCTEAEIDGIVERTRKVLDETLEDPAVRSGLSD

SEQ ID NO: 60438 - protein, 311 aa, Actinobacillus pleuropneumoniae serovar 1 str. 4074
MNYLASARETLSLYTQAIDSLHNRLSTEFNQAIEMILSCEGRLVVAGIGKSGLVGQKMVATFASTGTPSFFLHPTEAFHGDLGMLKPIDIVILISNSGETDDVNKLIPSLKGFGNKIIAMTGNSHSTLAQHADIILNIGVEKEACPNNLAPTTSTLVTMALGDALAIALIKARNFQAMDFARFHPGGSLGRKLLCTVKDVMIRSLPIVSPTAIFSECLNIMNEGRIGVALVMEHDCLLGIITDGDIRRLLADKGANSLLMTADQIMTKNPKTILESTFLAKAEEEMKSLHVHSLVVMNEENRVVGIFEFSN

SEQ ID NO: 60439 - protein, 260 aa, Nicotiana tabacum
MAESTREENVYMAKLAEQAERYEEMVEFMEKVAKTVDVEELTVEERNLLSVAYKNVIGARRASWRIISSIEQKEESRGNEDHVSSIKEYRGKIEAELSKICDGILNLLESHLIPVASTAESKVFYLKMKGDYHRYLAEFKTGAERKEAAENTLLAYKSAQDIALAELAPTHPIRLGLALNFSVFYYEILNSSDRACNLAKQAFDDAIAELDTLGEESYKDSTLIMQLLRDNLTLWTSDSTDDAGDEIKEASKRESGDGEQ

SEQ ID NO: 60440 - protein, 451 aa, Oryza sativa (japonica cultivar-group)
MLAAVRRRRLLLLPLPLRFFSAAAAAASTTTDPKVVSYLISSCGLTPAAAARAAATSPWLPLASPDFASNADAVVALLRRYGFTDADISATVRAFSRILASDPARTLQPKLDYLRSVGITAPLLPRVVSLSPVILHRSIESHLAPLIASLREVLGSDSRIVTALRQMPFAMRCSPKATFLRTLPVLRDVHGLTPSELSKLVASQPGVILLGPGRAGEIVQAVKDAGVEPGSPMFVYIFAAFSKLKAPTLENKFAIYRSLGFGKDDIAVMLRRLPNAAGISEERLKRTVGFLTGKAGLRREDIVAYPNLLSRSLDSHARRCAVLAVLRREGKPEGQHRVPHVLVASLARFMKAYVRRYEGEVPDVLRAINGEIPFEGFGLGELEKKKPQRQEKIRSGAWPCLEEQPNMRTCTFLPRAGRACHMVQVNCVCKLAKPHVRYSFPGLSTCMQKNI

SEQ ID NO: 60441 - protein, 584 aa, Oryza sativa
MLVRPVSASPFVDLQTEHVDHADAGDASPAYKREKEAMGIGIGIGIGIGIGTGTGAALPFGEASPWSLLGGAVAALLLVWAAQMLEWAWLAPRRMERALRAQGLRGTQYRFLHGDLTEDLRLVTAARSKPVPMDRPHDFIPRVAPLLHRALEEHGRVSFTWFGPMPRVTITDPDLVREVLSNKFGHFEKTKLATRLSKLLVGGLVILHGEKWVKHRRIMNPAFHAEKLKRMLPAFSASCSELIGRWENAVAASVGKAELDIWPDFQNLSGDVISRAAFGVRHHEGRQIFLLQAEQAERLVQSFRSNYIPGLSLLPTENNRRMKAIDREIKSILRGIIEKRQKATKNGEASKDDLLGLLLQSNMDYYSDEDGKSSKGMTVEEIIDECKLFYFAGMETTAVLLTWTMVALSMHPEWQDRAREEILQVFGRNKPDINGVSRLKVVTMVLHEVLRLYPPVVMMNRRTYKEIELGGVRYPAGVMLSLPVLFIHRDAAAWGHDAGEFDPGRFAEGVARACKDPGAGAFFPFSWGPRICIGQNFALLEAKVALGMILQRFAFELSPAYAHAPYTVLTLHPQHGVPVRLRRL

SEQ ID NO: 60442 - protein, 375 aa, Oryza sativa (indica cultivar-group)
MKQGSDRSSMDDSLSDLQERGMDSRPPDGFLSYFQDPSSLQNHQPSIPLNYYATQQAAPWAPSPAEYRSPVTKSGPGEQHPINIDSGGEETPTVRTEKRLTWTHEEDIRLVSAWLNNSNDSINGNFKKNDRYWGDVTTAYNSTTPRNRMRQEKQIKDRFHEIKKNVGRFCCAYKEVKSIYVSGQNELQLMEKVHATYEADYKEGQFTFLHCWKALRDQPKWHAYLEELEKPNKTKSDNEVEVRELTSTPNSPEDIRRPEGTKAAKARRNGKDKRKRKAKVYLSDMDDEIDKLKEVQNMVDKGRDELLETQRRVSSENLESKRLAHLAAMEHKEAVMLETYRAVMLQDTKDMPDDVRSEHVMALKSMREKLFPKTN

SEQ ID NO: 60443 - protein, 322 aa, Wolbachia endosymbiont of Drosophila simulans
MNKIINNVFAREILDSRGYPTIEVEIELCDGAIGRASVPSGASTGKLEALELRDQDEKRYCGKGVLKAVQAVNGIIADEIIGMNAADQNAIDKALIELDGTKNKSKLGANATLGVSLAVAKAAANSFKMPLYRYLGGKQTSVMPVPLINIINGGVHADNKLDFQEFMILPVGAETFSEAIRISAEVFHNLRSILKKKGYSTNVGDEGGFAPNIESTEEALDLIIYAIESAGYSAQSDFALGLDVASSTFYEDGIYEFESKGLTSEELTEYYCNLVERYPIISIEDAMSEDDYEGWKLLTAKLGNKIQLVGDDLFVTNCELIC

SEQ ID NO: 60444 - protein, 397 aa, Oryza sativa (japonica cultivar-group)
MEGGGARNGSTTGAARTGGSGGDAAAGGGGGSAGNGKPLPPCCVKARAAAPESEAKCHATVVSGWFTEPRSRGGKTSKVQYYNNPMWPGEAHSLKVEKILYQGKSPYQEVLVFESSTYGKVLVLDGIVQLTDKDECAYQEMITHLPLCSIPSPKKVLVIGGGDGGVLREICRHGSVESIDICEIDQLVIDVCKDFFPDLSVGFKDPRVRLHVGDAVEFLRNAPEGTYDAIIVDSSDPIGPAQELVEKPFFDTIARALRPGGVLCNQAESMWLHTHLIQDMLSICRETFKGSVHYAWTSVPTYPSGVIGFLLCAKEGPPVNFLTPANPIEKLEGAMEAGRDIRFYNSEMHRAAFVLPTFARRELEAYCTTVEREQQEETTAEPLKMNIMPNSEILTAS

SEQ ID NO: 60445 - protein, 539 aa, Arabidopsis thaliana
MAYASRIINHSKKLKDVSTLLRRENAATIRYYSNTNRAPLNREDTFNSRLGYPPLERISICSTSTLPVSIIFSTTRSNLSSAMGRPIFGKEFSCLMQSARGFSSGSDLPPHQEIGMPSLSPTMTEGNIARWLKKEGDKVAPGEVLCEVETDKATVEMECMEEGYLAKIVKAEGSKEIQVGEVIAITVEDEEDIGKFKDYTPSSTADAAPTKAEPTPAPPKEEKVKQPSSPPEPKASKPSTPPTGDRVFASPLARKLAEDNNVPLSDIEGTGPEGRIVKADIDEYLASSGKGATAKPSKSTDSKAPALDYVDIPHSQIRKVTASRLAFSKQTIPHYYLTVDTCVDKLMALRSQLNSFKEASGGKRISVNDLVVKAAALALRKVPQCNSSWTDDYIRQFKNVNINVAVQTENGLYVPVVKDADRKGLSTIGEEVRLLAQKAKENSLKPEDYEGGTFTVSNLGGPFGIKQFCAVVNPPQAAILAVGSAEKRVVPGNGPDQFNFASYMPVTLSCDHRVVDGAIGAEWLKAFKGYIENPKSMLL

SEQ ID NO: 60446 - protein, 358 aa, Dechloromonas aromatica RCB
MKICVIPGDGIGVEICAEAVRVIDALKDIHGLKIEYEYGLLGGAAYDQTGRPLPVETLRLADEANAILLGAVGGPKWDKLPAESRPERGLLGIRKYLGLNANLRPIKVYPELANASTLRPEVVSGLDMMIVRELTGDIYFGQPRGIRTSGFERVGYNTMEYSESEIALIAEMAFRIARQRSGKVMSVDKMNVLECMQLWRDVVTKVGERFPDVTLDHMLVDNAAMQLVKNPKQFDVLLTGNMFGDILSDEAAMLTGSIGMLPSASLNVEDKGMYEPCHGSAPDIAGQGVANPLGMILSAAMMFRYSLGRPDMADAIESAVQTVLTNGARTRDIFQAGDRLVSTSEMGGLVEAALRRIS

SEQ ID NO: 60447 - protein, 80 aa, Oryza sativa (japonica cultivar-group)
MSEEAGRPLPKFGEWDVNDPASADGFTVIFNKARDEKKGGNGQDTDSPCKETRTERVESYAPKTNSKKWFCCVTSSPTQS

SEQ ID NO: 60448 - protein, 481 aa, Haemophilus somnus 129PT
MFGPFKPAPYIEELSKDRIDPTYRRLRWQVFMGIFFGYAAYYFVRANFDLAQKGLIEAGLYNKAELGIIGTGAGLAYGLSKFVMAGISDRSNPKVFLPFGLLLSGLCMTMMGLMPWATSGIAVMFVMIFLNGWFQGMGWPPCGRTMVHWWSKSERGTIVSIWNCAHNIGGMVPGLMVLLASAIYFSEFGVQATAKDIWQQALYYPGIAAMICAIPVYFVMKDTPQSCGLPAIEKWRNDYPDDYNEKTYENNLTTKEIFVTYVLKNKLLWYIAIANVFVYLIRYGVLKWSPVYLGEVKHFNIKGTAWAYTIYELAAVPGTLLCGWVSDKVFKGKRGLTGFIFMILTTIAVVALWMNPATPEHELAQYAGKAWYQNPYQLTDFILMTTVGFLIYGPVMLIGLHALELAPKKAAGTSAGFTGLFGYLGGTVSASAVVGWAAEYYGWDGGFYVMITGGILAILLMFITMIEEGKHKAKLDDHYGK

SEQ ID NO: 60449 - protein, 352 aa, Glycine max
MESGDMFYSVDEFRLDPKWLIDPKHLFVGPQIGEGAHAKVYEGKYKNQTVAIKIVHKGETTEDIAKREGRFAREVAMLSRVQHKNLVKFIGACKEPVMVIVTELLLGGTLRKYLFSMRPKCLDRHVAIGFALDIARAMECLHSHGIIHRDLKPDNLLLTEDQKTVKLADFGLAREESLTEMMTAETGTYRWMAPELYSTVTLRQGEKKHYNHKVDAYSFAIVLWELLHNKVPFEGMSNLQAAYAAAFKNVRPSAENLPEELAVILTSCWQEDPNARPNFTQIIQMLLNYLYTVAPPEPMIPSRIFSSENTVLPPESPGTSSLMAKRDDTGDTPRAKDEIKPNGFLCCFSQCY

SEQ ID NO: 60450 - protein, 484 aa, Rhizobium sp. NGR234
MKLKDKELFRQAGVIGGEWIGAASGDVVEVFDPASQAVLGTVPDMGTAETRAAIEAAETAFGPWKKKTHAERAALLERWHALMIEHLEDLALILTLEQGKPLDEARGEIRYGAAFVKWFAEEARRIGGHTIPSPTPDRRIVVLKEAVGVCAIVTPWNFPNAMITRKVAPALAAGCTVVIKPSEFTPFSALALGVLAERAGIPAGVVNIVTGMPTAIGNEIMANETVRKISFTGSTRVGSLLMRGAADSVKRLSLELGGNAPFIVFDDADLDLAVEGAIASKFRNGGQTCVCANRILVQSGVYDAFAEKLAARVNAMKVGPGTEPGVAIGPMINAAAIDKIDRHVEDALAKGAKIAARGRSLPVGRQYTAPLVLTGATTEMLLASEETFGPVAPLFCFETEEEAITIANGTPFGLAAYFYTENLKRSWRVAEALEFGMVGLNTGAISTEVAPFGGVKQSGLGREGAQVGIEEYLELKSFHIGGLA

SEQ ID NO: 60451 - protein, 347 aa, Rhizobium sp. NGR234
MKSYSIALIPGDGIGQDVTDAAWQVLSTVARHSGFTLTATPFPWSCAFYKETGAMMPPDGIETLRRFDAILLGAVGWPAEVPDSVSLHGLLLPIRKAFVQYANIRPHRLLSGVKGPLKAEGFDILCIRENTEGEYSGAGGRVHQGTADEVAVETSIFTRTGVERILRFGFDQARQRRRKLASVTKSNAQKYSMVLWDEITRELAAEYPDVEVTSYHIDAMAARMVMAPESLDVVVASNLFGDILTDLGAAIQGGLGFAASANINPDRSAPSMFEPVHGSAPDIAHLGIANPIAAIWSGAMMLDHLGQARAARKVIEALERTTARGIGTVPGKNRTETITAAVLAALD

SEQ ID NO: 60452 - protein, 260 aa, Nicotiana tabacum
MADSSREENVYMAKLAEQAERYEEMIEFMEKVAKTGDVEELTVEERNLLSVAYKNVIGARRASWRIISSIEQKEESRGNEDHVKTIKEYRAKIEAELSKICDGILGLLESHLIPSASAAESKVFYLKMKGDYHRYLAEFKTGSERKEAAENTLLAYKSAQDIALTELAPTHPIRLGLALNFSVFYYEILNSPDRACNLAKQAFDEAISELDTLGEESYKDSTLIMQLLRDNLTLWTSDNAEDAGDDIKEAPKHESSEGQQ

SEQ ID NO: 60453 - protein, 498 aa, Oryza sativa (japonica cultivar-group)
MASKPSSRAESNQAAAAVPSLYGRALPSPPAVEFASAEGRRLFAEALQGGTMQGFFSLVSVFQTQSEPAFCGLATLAVVLNALRIDPGRRWKGPWRWFDESMLDCCEHLDTVRAEGITFGKVACLAHCSGADVRTFRAAQATLADLRRHLLRCASSQDCHLVASYHRKLLGQTGTGHFSPIGGYHAGQDMALILDVARFKYPPHWIPLPLLWEAMNTIDEATGLLRGFMLISRNTEAPLLIRAVNCRDESWQSMAKYCIEVVPNLLRDNSVDNVLTILSRLVNHLPPNAGNFIKWVIEVRRQEEGGSSPSKEANEMPFLKEKVLQQIRDTKLFQLVHKLQCSKQPCCSCSSLTDEDSISQIAASVCCEATALLSGNLSSRDGLFFSETCSGCTQVNDEGLKNVITGKVVSEGNGHVDKLSPISSTETCFCNSTLSNETVNYPSNTDILTVLLLSLHPSTWLCIEDEKLKAEFQSLVSTDDLPDPLKLEVCCLTPRTLH

SEQ ID NO: 60454 - protein, 260 aa, Nicotiana tabacum
MAESSREENVYMAKLAEQAERYEEMIEFMEKVAKTGDVEELTVEERNLLSVAYKNVIGARRASWRIISSIEQKEESRGNEDHVKTIKEYRAKIEAELSKICDGILGLLESHLIPSASTAESKVFYLKMKGDYHRYLAEFKTGSERKEAAENTLLAYKSAQDIALTELAPTHPIRLGLALNFSVFYYEILNSPDRACNLAKQAFDEAISELDTLGEESYKDSTLIMQLLRDNLTLWTSDNAEDAEDDIKEAPKHESGEGQQ

SEQ ID NO: 60455 - protein, 268 aa, Mesorhizobium mediterraneum
RVTRHTMVHEQMSRFFTGFRRDAHPMAVMCGVVGALSAFYHDSTDISDPYQRMVASMRLIAKMPTIAAMAYKYHIGQPFIYPKNELNFAANFLHMCFAVPCEEYKINPVPARAMERIFILHADHEQNASTSTVRLAGSSGANPFACIAAGIACLWGPAHGGANEAALNMLGEIGHVDHIPEFIARAKDKNDPFRLMGFGHRVYKNYDPRAKIMQKTAHEVLGELGIKDDPLLDIAMELEKIALTDSYFIEKKLYPNVDFYSGITLKAL

SEQ ID NO: 60456 - protein, 268 aa, Rhizobium galegae
RVTHHTMVHEQMSRFFTGFRRDAHPMAVMCGCVGALSAFYHDSTDITDPHQRMVASLRMIAKMPTLAAMAYKYHIGQPFVYPQNNLDYASNFLRMCFAVPCEEYVVNPVLSRAMDRIFILHADHEQNASTSTVRLAGSSGANPFACIAAGIACLWGPAHGGANEAALNMLTEIGTVDKIPEYIARAKDKNDPFRLMGFGHRVYKNYDPRAKIMQKTTHEVLGELGHKDDPLLQVAMELERIALTDEYFIEKKLYPNIDFYSGITLKAM

SEQ ID NO: 60457 - protein, 389 aa, Mycobacterium sp. JLS
MTVSRLRPYAVTVFAEMSALAARIGAVNLGQGFPDEDGPASMLEVARQAIADGVNQYPPGLGIAPLREAIAAQRKRVHGVDYDPDTEVLVTNGATEAIAAAVLGLVEPGSEVLLVEPFYDSYSPVLAMAGCHRVAVPMVEHGRGFAIDVDGLRGAITPRTSALIVNSPHNPTGMVASDEELTAITELAVEHDLLVITDEVYEHLVFDGYEHRPLAAYPGMSGRTVTISSAAKMFNVTGWKIGWACGAADLIAGVRAAKQYLTYVGGAPFQPAVAHALDHEDAWVAALRDSFQNKRDRLGSALAELGFAVHDSAGTYFLCADPRPLGYDDSTTFCADLPERAGVAAIPMSAFCDPHSPHTDRWNHLVRFAFCKRDDTLDEAIRRLQVLRR

SEQ ID NO: 60458 - protein, 484 aa, Dechloromonas aromatica RCB
MKQILNFINGEFVATGKQFEKRTPLDNSLIGMVHEAGKAEVDAAVKAAHDALEGPWGKMTVVERTDILNKVADEITRRFDEFLEAECADTGKPKSLASHIDIPRGAANFKIFADVIKNAPTEFFEMATPDGKGALNYAIRRPVGVVGVVCPWNLPLLLMTWKVGPALACGNTVVVKPSEETPSTATLLGEVMNACGVPKGVYNVVHGFGPNSAGEFLTTNQNVNAITFTGETRTGAAIMKAAADGARPVSLEMGGKNPAIVFADANLDVAIEATLRSCFSNCGQVCLGTERVYVERPFFETFVAALKAGAEKLKLGVPSDPSANMGPLVSQEHRNKVLSYYKKAVEEGATVVTGGGIPDMPGELANGAWVQPTIWTGLDDNAAVVREEIFGPCTTVMPFDSEDEVIKRANNTTYGLAASVFTQDVNRAHRVAGRIEAGLVWVNSWFLRDLRTPFGGAKQSGIGREGGVHSLEFYTELKNVCIKL

SEQ ID NO: 60459 - protein, 120 aa, Triticum aestivum
  misc_feature (69)..(69): Xaa can be any naturally occurring amino acid
  misc_feature (77)..(77): Xaa can be any naturally occurring amino acid
  misc_feature (108)..(108): Xaa can be any naturally occurring amino acid
MAPAGMASSATTVAPLQGLKSTAGLPDSRRSGSAGLSSASNGGRIKCMQVRPNEGIKKFETLRYLPPLXSEALLRTXDYLIRSKRVPCLEFTKVGCAFREHNNSPEYXPGRYWTRVTCLC

SEQ ID NO: 60460 - protein, 421 aa, Oceanicola granulosus HTCC2516
MDHFLYRDGRLMAEDVALDDIAAAVGTPVYVYSAKTLLRHYGLFAQALEGLDHLICFSVKSLSNLAILSLLAREGAGMDVVSGGEYARARAAGVPGERIVFSGVGKTREEMRLALEGGIRQFNLESEPEMRALSEVASGMGVVAPVTVRVNPDVDARTHAKISTGKSENKFGIPIRKAREVYAEAAALPGLEVVGIDVHIGSQLIELGPFEQAYRKVADLTATLRADGHDIRRLDLGGGLGIPYTRSNEVPPLPLDYGALIKRTVGDLGVEVQIEPGRLIAGNSGVLLSRVIYVKEGEGRDFLILDGAMNDLVRPAMYDAWHDIVPVAEPAAGGATRDFDVVGPICESGDTFARARPLPELAAGDLVAFRSAGAYGAVMASEYNSRPLVPEVLVSGDHFAVIRQRPTYEELIARDSIPEWL

SEQ ID NO: 60461 - protein, 722 aa, Oryza sativa
  misc_feature (541)..(541): Xaa can be any naturally occurring amino acid
  misc_feature (551)..(551): Xaa can be any naturally occurring amino acid
MGRNGSVKRTSSSGAAAAFTANPRDYQLMEEVGYGAHAVVYRALFVPRNDVVAVKCLDLDQLNNNIDEIQREAQIMSLIEHPNVIRAYCSFVVEHSLWVVMPFMTEGSCLHLMKIAYPDGFEEPVIGSILKETLKALEYLHRQGQIHRDVKAGNILVDNAGIVKLGDFGVSACMFDRGDRQRSRNTFVGTPCWMAPEVLQPGTGYNFKADIWSFGITALELAHGHAPFSKYPPMKVLLMTLQNAPPGLDYDRDRRFSKSFKEMVAMCLVKDQTKRPTAEKLLKHSFFKNAKPPELTMKGILTDLPPLWDRVKALQLKDEAQLALKKMPSSEQEALSMTSLIRDDEPPEIKEDDRHEGTIEVEKDSFSRNHLGKSSSTIENFFSGRTSTTAANSDGKGDFSFEAFDFGENNVDTKIMPNGYENARSENSSSPSTSKQDPESKYWRSTSGQKQQTSGTPAVHSGGVNSSTTEKGHGVERDATVQLASDKLRTETRRATNLSGPLSLPTRASANSLSAPIRSSGGYVDSLGDKSKRNVVEIKGXRFSVTSENVXLAKVQEVPLSSLSRKSPQASPLKKSASVGDWLVNTKPMSNSHHVKELCNSSVSSSILIPHLENLVKQTMFQQDLIMNVLSSLQQNEKVDGVLSGISPQLRNTDSDTMVGSVNSEKERSLLVKISELQSRMITLTDELIAAKLKHVQLQQELNALYCREEIEDIRDDDNEET

SEQ ID NO: 60462 - protein, 151 aa, Lemna gibba
MAEMRDEPTSSATPSAPRRWARASRPADTARGQARPRRIRCGAAGRRIRCGQQAGGYGAGQQAGGYGAGQQAGQQELRRSGSSSSSSSEDDGMGGRRKKKGIMEKIKDKMPGQKSEQHHHEPGYAHQRPTHVEPEKKGIMEKIKEKLPGHN

SEQ ID NO: 60463 - protein, 475 aa, Rhizobium sp. NGR234
MKHARKFYIDGEWVEPSVSKTLEVIDPSTEQPMGTIALGSAADAEKAVAAARRAFASYSQTSKQERVELLRRILTILKRRNDELGDIISREMGAPLAMARAEQAGIGAAHFEQAIKSFETFAFDYMQGTTRIVHEPVGVVAMITPWNWPINQIACKVAAALATGCTMVLKPSEIAPFNAVLFAEIMDEAGVPKGVFNLVQGDGPTVGAALASHPDVDMVSFTGSTRAGIAVAQAAAPTVKRVHQELGGKSPNIILRSADFPAAVAAGVRRCFGNSGQTCTAPTRMLVPAERMDEAGAIAARQADALVVGPPSDSRTDLGPVASAAQFDKIQALIERGIAEGAELVAGGLGRPSHLNAGYYVRPTVFARVTNQMSIAREEIFGPVLSIIGYDSEDEAIAVANDTPYGLAAYIQGDPKETRALAGKLRSGTVRLNSSGWDSAAPFGGYKQSGNGREYGKFGLHEFTEIKGIVGFLNE

SEQ ID NO: 60464 - protein, 450 aa, Bifidobacterium longum DJO10A
MSIRKELTAQNVLLGFQHVLVSNVWLDPVFVAGAIGLPIALSSNMINAIFIVSGLVTLVQATRLVRLPVVQGPSAAFDALMIAAGTAGMLGAASSSILIASLVFLLLCLTGVIERMRFLFSPMISGVVIFMVGVSLSGFTLSEFLGGAPGDKTFADPHILTVSILTTAIVLVLSLLGKGLLKSFSFLIALVVGTVVAAAFGMVDFSPVASKGWLGLPTFLPYGPFTFDWKIFIPFFIAYMVAVMEALGVYQAASEIQGTPLERKQVRYGLAGEAAGSAISSLIGGFTTTAYPQNVGLLNLTGEGKLRTRTPVIIAAVLLLILGFVPKAGALLSVIPSAVVGGIFLPAAASLIVTGLRALRKVADDERRQTVIGMSLLLGIALPKALSGLTGGASVFFGNNIMVGVFSAIILNALFVALPDLVAKHRAPASVDVPAADPADGTGAAAYDER

SEQ ID NO: 60465 - protein, 387 aa, Trichodesmium erythraeum IMS101
MNFATRMNSLGGDAAIEVFTKAKQLESQGRNIIHLEIGQPDFKTPKNIREAAFQAMNDGYTTYTPAAGLLKLREVIAEHISQTRNISVNSDEVVVMPGAKPVIFFTLLALINSGDEVIYPNPGFPVYESVINLVGGKPIPLPLLEELDFQFSIDNLVNSISEKTKLLIINSPHNPTGSVLTPEYLEAIAKLAVKHNFYVLSDEIYSHLNYDSKFTSIISFPSMKERTILLDGHSKTYAMTGWRLGYSISPKAIAEKLDKLMLNSNSCACSFTQIAGIEAIKNSQEFVKKIFAEFKQRRDVIVDGLNSISGINCRKPAGAFYAFPNVKQLPISSNKLADYLLAEAGVALLPGTAYGKFGDGYLRLSYANSIENIREGISRIETAIAKL

SEQ ID NO: 60466 - protein, 364 aa, Candida glabrata CBS 138
MEQVKVVAEHLKKYPSSKVIFLVGAGISTSSGIPDFRSPKTGLYHNLSKLKLPYAEAVFDIEYYQENPQPFYLLADELYPGNFKPSKFHYLMKVLEKNGRLRRVYTQNIDTLEREAGIPDDYLVEAHGSFAKNHCIGCDKEFPLDDFKKALLRYNKYKMKHNNDMKEFEYLRCPECEALIKPKIVFFGENLPKRFFDSWDTDLEWLEEESNSIVIVAGTSLTVYPFASLPNDVPNNVRRVLCNLDVVGDFLTSPRDMDLKFSEHTDDFANQLVKELGWDKELEKLSLSHGKESIMENEVDNVIEEIKQLSLDNNNTSLKNDGNADSEKHEDKASIKGDDNQKDMNKDTHTTEKVRDKKSIDEKL

SEQ ID NO: 60467 - protein, 211 aa, Actinobacillus pleuropneumoniae serovar 1 str. 4074
MRKYIKIGVAGPVGAGKTALIERLTREIASKYSVAVITNDIYTQEDAEFLTKNSLLPPERIMGVETGGCPHTAIREDASMNLEAVDEMVARFPEVELIFIESGGDNLSATFSPDLADVTIFVIDVAQGEKIPRKGGPGITRSDLLVINKTDLAPFVGADLSVMERDARRMRNGQPFIFTNLMKNENLDGVIGWIEKYALLKNIEDPASLVR

SEQ ID NO: 60468 - protein, 427 aa, Escherichia coli O157:H7 EDL933
  misc_feature (27)..(27): Xaa can be any naturally occurring amino acid
MADTKAKLTLNGDTAVELDVLKGTLGXDVIDIRTLGSKGVFTFDPGFTSTASCESKITFIDGDEGILLHRGFPIDQLATDSNYLEVCYILLNGEKPTQEQYDEFKTTVTRHTMIHEQITRLFHAFRRDSHPMAVMCGITGALAAFYHDSLDVNNPRHREIAAFRLLSKMPTMAAMCYKYSIGQPFVYPRNDLSYAGNFLNMMFSTPCEPYEVNPILERAMDRILILHADHEQNASTSTVRTAGSSGANPFACIAAGIASLWGPAHGGANEAALKMLEEISSVKHIPEFVRRAKDKNDSFRLMGFGHRVYKNYDPRATVMRETCHEVLKELGTKDDLLEVAMELENIALNDPYFIEKKLYPNVDFYSGIILKAMGIPSSMFTVIFAMARTVGWIAHWSEMHSDGMKIARPRQLYTGYEKRDFKSDVKH

SEQ ID NO: 60469 - protein, 442 aa, Silicibacter sp. TM1040
MSHVFPRHTKSDLPTAVGGDGCYLIDANGKRYFDGSGGAAVSCLGHSDAAVIKAVQEQVEKLAFAHTGFMTSEPAEALADLLISKAPGTLDRVYFVSGGSEATEAAIKLARQYHLERGEPQRRHLIARRQSYHGNTLGALAAGGNAWRRQQFDPLLIGVSHIAPCYEYVDRSDGESSFDYGQRVANELEAEILRLGPDTVMAFMAEPVVGATLGAVPAVEGYFKRIREICDTYGVLLILDEVMCGMGRTGHLFACDADGVAPDILCIAKGLGAGYQPIGAMLCSSAIYDAIAQGTGFFQHGHTYLGHPVATAAGLAVVNQMLERDLVSRVAEKGTQLQAALMERFAQHPNVGDIRGRGLFRGLELVQDRDSKAPFDPAHGLAARIKRAALEAGLICYPMSGTRDGRMGDHILLAPPFILSETQIEEICDKLAIAIEEGLASI

SEQ ID NO: 60470 - protein, 178 aa, Zea mays
MDFVKRLLCKDPRRRMTAAQALNCSVAASISQLVLRSIGPPTRSCSLQGSVKLRNLFADQPHRKFGDFIKGVFALFHRFGKCGEAMEDTDIAVELYKLSVSTLDLLKLASKEEQGAYVGAWYNMLLSCAQELKHGVALWQEFYHANVCDRVVSEGGHYLIALGEIYRVAQILYLSFSV

SEQ ID NO: 60471 - protein, 234 aa, Arabidopsis thaliana
MSVRARRIVSGRSETVAANYAFDPLHDDKIIRNRLLTRTTTTRGEPPLKKLQKKFTSFVIELDKEEDNYSECGRLAKAFLQELSAFEIPLLKSQVVVAANLREKENFNELKDETNRQIMQAQADIEDLKKQLEESKIERQQKEECEAIRKLISAQPPRSETQKVIHELKKEIAELEAENTASWRLLELRKKQFALLLHVVDELQETMEDEQKSMVEEMQRNITADGAEAMSIDG

SEQ ID NO: 60472 - protein, 107 aa, Triticum aestivum
MTKLMCLCFIILTIAVAVSADECEGDRQAMIKECAKYQQWPANPKLDPSDACCAVWQKANIPCLCAGVTKEKEKIWCMEKVGYAANFCKKPFPHGYKCGSYTFPPLA

SEQ ID NO: 60473 - protein, 186 aa, Triticum aestivum
PASSSPPIIQYHGPPPLMASSATTVAPFQGLKSTAGLPVSRRSSGSLGSVSNGGRIRCMQVWPIEGIKKFETLSYLPPLSTEALLKQVDYLIRSKWVPCLEFRKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 60474 - protein, 573 aa, Aspergillus oryzae
MTTEMAAAPVLSTPDDRILEATEPVTTQEAPRALSDEELSITYDIDRTLKEIRDARYKRIALQFPDDMLPDAPRVFQLLSRGLNKRNVTDSSVSQTQKDGASDTANSDGLAHSVSQLNMADTTETSPKLYILADTSYGTCCVDEVAAEHVNADVVVHYGRSCLSPTSRLPVIYVFTHKPLPIDPVVRAFKETYPDPTTKVILAADVTYTDHIPAVYSRLVNEGYTDLFATDLVHNPSSAIPNRTVPDSVRETPDSLSDWQLFHISDPPTALLMTLASRVASIHIYPTDDPDNENVKPLPASTAIALRRRYATLTRLSTAPIFGILVNTLSVKNYLHIVEHVKQKIAEAGKKSYMFVVGKLNAAKVANFSEIDGWVVIGCWESSLVDSKDFWKPVITPFELELALKGDAERIWTGAWQSDFQSVLNQPNQEAKDMDEDETPLSSGATADEEEDMSESESAPPEFDLRTGRYVSHSRPMRNPAPRVSASAEDAASAANGPSAARALAKRAKGDLAMIGGTFSPGAEFLRSQRTWKGLGSDFNIQYEEDATDDTLVVEGRKGIARGYTVGDSIDRH

SEQ ID NO: 60475 - protein, 262 aa, Malus x domestica
MSPTDSSREENVYMAKLAEQAERYEEMVEFMEKVAKTVDVEELTVEERNLLSVAYKNVIGARRASWRIISSIEQKEESRGNEDHVAIIKEYRSKIETELSKICDGILNLLESHLIPSASSAESKVFYLKMKGDYHRYLAEFKTGGERKEAAESTLLAYKSAQDIALAELAPTHPIRLGLALNFSVFYYEILNSPDRACNLAKQAFDEAISELDTLGEESYKDSTLIMQLLRDNLTLWTSDITDDAGDEIKEASKRESSETQQ

SEQ ID NO: 60476 - protein, 358 aa, Rhizobium sp. NGR234
MMREYSIATIPADGIGPEVIAAGRTVLATLEKRLGDVKFTVENFDWGSDYYRKHGVMMPSDGLEQLKKFDAIYFGAVGAPDVPDHITLWGLRLPICQGFDQYANVRPTKILPGITSPLRNCGPGDLDWVIVRENSEGEYSGHGGRAHRGLPEEVGTEVAIFTRVGVTRIMRYAFKLAQSRPRKLLTVVTKSNAQRHGMVMWDEIAAEVAEEFPDVTWDKMLVDAMTVRMTLKPQSLDTIVATNLHADILSDLAGALAGSLGVAPTANIDPERRFPSMFEPIHGSAFDITGKGIANPVATFWTAAQMLDHLGEQDASARLMRAVERVTGARILTPDVGGTATTREVTEAVCDAIHSSNV

SEQ ID NO: 60477 - protein, 608 aa, Listeria monocytogenes str. 1/2a F6854
MNKEEMNARQKKIRNFSIIAHIDHGKSTLADRILEQTGALTHREMKNQLLDSMDLERERGITIKLNAVQLKYKAKDGETYIFHLIDTPGHVDFTYEVSRSLAACEGAILVVDAAQGIEAQTLANVYLALDNDLEILPVINKIDLPAADPERVREEIEDVIGLDASDAVLASAKSGIGIEDILEQIVEKVPEPSGDVNKPLKALIFDSVFDAYRGVIANIRIMDGVVKTGDRIKMMSNGKEFEVTEVGVFSPKATPRDELLVGDVGYLTAAIKNVGDTRVGDTITLANNPAEEALDGYRKLNPMVYCGLYPIDSSKYNDLRDALEKLELNDSALQFEAETSQALGFGFRCGFLGLLHMEIIQERIEREFNIDLITTAPSVIYHVNLTDGSNIVVDNPAEMPEPGVIESVEEPYVKATVMVPNDYVGAVMELAQNKRGNFITMEYLDDIRVSIVYEIPLSEIVYDFFDQLKSSTKGYASFDYELIGYKASKLVKMDILLNAEKVDALSFIVHRDFAYERGKIIVEKLKELIPRQQFEVPIQAAIATKIVSRSTIKALRKNVLAKCYGGDVSRKRKLLEKQKEGKKRMKQIGSVEVPQEAFMAILKMDESK

SEQ ID NO: 60478 - protein, 189 aa, Malus x domestica
CWWKELREVGHSDKKEEPWWPKMQTCDELIESCTTIIYIASAHHAAINYGQYSTGGFVPNRPTLSRRFMPEEGTPEYEELRTNPDKAFLKTFAPQLPTLLGMATVEILSRHPTDELYLGQRDTAEWTTDADILQASEDFKKNLEAIEAKIEKMNKDERLKNRFGPAKIPYTLLYPSSEPGLTNKGVPTS

SEQ ID NO: 60479 - protein, 679 aa, Xanthomonas oryzae pv. oryzae KACC10331
MMRRWQSHRSSLHSFSSLHSLALQPADQAGCISMFNINRLLRSRPQTDNADQAPAQDRPSRQPSPAQGLLSPLLARPRRRESRSAADTSTPRNAAQGRFSRSPLHPSSQPEALAGASSAPPRSIEHDIDDWLAQSLPMAERIPTGYNLHDGSRDTSRDVLQSAAEAIRRAATRRSTELLVDGLPATRLPDAIGRLDALQKLMLLYTGVQSLPDSLGQLSQLRHLQISGAQELKTLPPSLTRLSNLRTLQLMMVPLDELPADLGRMQGLRSLALGGGHYARLPASIVELSRLTGLRVWHSSHFRELPENIGLMQGLRSLELASNSKLEQLPGSLTQLHRLKKLDLSSNRRLAHLPEDIGQLRGLTELSLKSCAALRQLPGSVGDLAQLQLLDLRGTGLQTLPPWLARLPDRCDIKVSDHLADQLQQIRDPERAQRAAQRLADRRRHASVPAAQQAGASWNRVPEFTRVLRSVDADLGERFEKWTQGLTQNARIFGASITSADMPLLDQVVAEAIRSPEFRSTFGQFLNEHTVKTLNMDGMTQVGDGGPRVRGDVKTAFAEMLKHNIMHTQDQETALGLLQQALQNSGLGLARERLLRSTNQLTGRAEMWPPLKAYISMHDVEGKAAQDAAITWAMAQLDEAHEGVIGEAEAKQESEQAQANANRFIERRARVLLREWGIH

SEQ ID NO: 60480 - protein, 170 aa, Trichodesmium erythraeum IMS101
MIIIIMGVSGAGKSTIGKLLAKSLDWHFFDADLFHPKANIEKMSNGIPLSDADRTPWLKRIRNAINEWLGEHKNVVFACSALKKTYRNYLVTNTKNVKIVYLQGSFDLFSQRLTARKNHFMKVEMLRSQFDILEEPREAIIVDAAKSPKEIIKYIRKKLYDLKFLTFSKS

SEQ ID NO: 60481 - protein, 405 aa, Escherichia coli O157:H7 EDL933
MSSVDILVPDLPESVADATVATWHKKPGDAVVRDEVLVEIETDKVVLEVPASADGILDAVLEDEGTTVTSRQILGRLREGNSAGKETSAKSEEKASTPAQRQQASLEEQNNDALSPAIRRLLAEHNLDASAIKGTGVGGRLTREDVEKHLAKAPAKESAPAAAAPAAQPALAARSEKRVPMTRLRKRVAERLLEAKNSTAMLTTFNEVNMKPIMDLRKQYGEAFEKRHGIRLGFMSFYVKAVVEALKRYPEVNASIDGDDVVYHNYFDVSMAVSTPRGLVTPVLRDVDTLGMADIEKKIKELAVKGRDGKLTVEDLTGGNFTITNGGVFGSLMSTPIINPPQSAILGMHAIKDRPMAVNGQVEILPMMYLALSYDHRLIDGRESVGFLVTIKELLEDPTRLLLDV

SEQ ID NO: 60482 - protein, 146 aa, Hordeum vulgare subsp. spontaneum
MEFQGQHDNPANRVDEYGNPFPLAGGMGGAHAAPGTGGQFQARREDHKTRGILHRSGSSSSSSSSEDDGMGGRRKKGMKEKIKEKLPGGHKDNQQHMATGTGTGGAYGPGTGTGGAYGQQGHAGMAGTGEKKGIMDKIKEKLPGQH

SEQ ID NO: 60483 - protein, 377 aa, Brassica napus
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYMFTTTAEREIVRDIKEKLAYVALDYEQELETAKSSSSVEKNYELPDGQVITIGAERFRCPEVLFQPSLVGMEAPGIHETTYNSIMKCDVDIRKDLYGNIVLSGGSTMFPGIADRMSKEITALAPSSMKIKVVAPPERKYSVWIGGSILASLSTFQQMWISKGEYDESGPSIVHRKCF

SEQ ID NO: 60484 - protein, 398 aa, Zea mays
  misc_feature (215)..(215): Xaa can be any naturally occurring amino acid
TRPEEPPEVTKARNDNSHGTNFPDSPEPIYGTQYLPRKFKVAVTAAGDNSVDILTNDIGVVVVSDDAGEPIGFNIYVGGGMGRTHRVETTFPRLADPLGYVPKEDILYAIKAIVVTQRENGRRDDRKYSRMKYLIDRWGIDRFRAEVEKYYGKKFESFRPLPEWQFNSYLGWQEQGDGKLFYGVHVDNGRVGGQAKKTLREIIEKYNLDVSITPXTKNLILCGIDQAWREPITTALAQAGLLEPKDVDPLNLTAMACPALPLCPLAQTEAERGILPILKRIRAVFNKVGIKDSESVVVRITGCPNGCARPYMAELGFVGDGPKSYQIWLGGTPNQSTLAESFMDKVKLDDIEKVLEPLFTYWNGTRQEGESFGSFTNRTGFDKLKEVVNKWAESPSAA

SEQ ID NO: 60485 - protein, 564 aa, Streptomyces avermitilis MA-4680
MAATPQNPAAAPRRKVSRHRGEGQWAVGHFTPLNGNEQFKKDDDGLNVRTRIETIYSKRGFDSIDPNDLRGRMRWWGLYTQRKPGIDGGKTAILEPEELDDKYFMLRVRIDGGRLTTEQLRVIGEISQEFARGTADITDRQNIQLHWIRIEDVPEIWQRLEAVGLSTTEACGDTPRVILGSPVAGIAEDEIIDGTPAIDEIHRRILGNKDFSNLPRKFKTAVSGSPLLDVAHEINDVAFVGVNHPEHGPGFDLWVGGGLSTNPKLGQRLGAWVPLDEVADVHVGVLSIFRDYGYRRLRTRARLKFLVADWGVEKFRQILEDEYLKRKLVDGPAPDQPVASWRDHVGVHRQKDGRFYVGFAPRVGRVDGTTLTKIAEVAAAHGSGRLRTTVEQKMIVLDVEEGQVESLVEGLEALDLTVKPSSFRRGTMACTGIEYCKLAIVETKARGASLIDELERRIPEFDEPITINLNGCPNACARIQVADIGLKGQLVLNDQGEQVEGFQVHLGGALGLEAGFGRKVRGLKVTSDELPDYIERVLKRFQAEREDGERFATWAARASEEALS

SEQ ID NO: 60486 - protein, 72 aa, Oryza sativa
LLLLIPCLFDSQIPQAANYLNIKGLLDLTCQTVADMIKGKTPEEIRKTFNIKNDFTPEEEEEIRRENQWAFE

SEQ ID NO: 60487 - protein, 341 aa, Caulobacter crescentus CB15
MTTSREIRLKARPVGMPKDSDFELATVELPAPGDGEIQVKNLWMSVDPYMRGRMYDRPSYVPPFQLGEALQGGAIGEVIASNDPDFKPGDIVSSMFGWREAYNAHPKSLAAAGMGAITKIETHGIPPQAFLGVAGMPGMTAYAGLLRVAALKDGDVVFVSAAAGAVGSIVCQIAKLKGHTVIGSAGGPEKVAFLKSIGVDHVIDYKATPDVVAELAKVAPKGIDVYFENVGGVHLEAAINSARPFARFALCGMISQYNETSKPEGPSNIILAVGKSLRLEGFIVSNHFDLYPQFAKDMAEWIKAGKITWKETVEDGVDRAPNAFLKLFTGENLGKMLVKLG

SEQ ID NO: 60488 - protein, 248 aa, Brassica napus
MGKPARWLKSVLLGKKSSKSSGSKDKEVTLTNIWIKILQYDPLYTVCLWCHSLMFFLFVLSVSNGYHAQRVVNGKEVVVVSKIEESDVVSDLPSFGNATVSTSAVVETQKTEHEVVSDDEIQLPESQVQPTDSPTAASVVVSDDLLSDSDKIQQEVAATTLQAAFRGYLARRAFWALKGIIRLQALIRGHMVRRQAVATLCCVMGIVRLQALARGKEIRRSDIGVEVHRRCWGNKLPEDSVVKHILIW

SEQ ID NO: 60489 - protein, 348 aa, Acidobacteria bacterium Ellin345
MTYKITLIPGDGIGPEVTSAAVRVLEATGLKFEWESFAAGAEAYEKYKEYIPKELNESIERTRIGLKGPVTTPIGGGFSSINVELRKRFELYANVRPIRNLPGVHTRYPGVDLVVVRENTEGLYSGIEHEVVPGVVESLKIITEKASTRISKFAFNYARKMGRKKIHSIHKANIMKMSDGLFIRCSRNISKEYPEIIYGEHIVDNTCMQLVMNPYQYDILLLENLYGDIVSDLCAGLVGGLGLAPGANIGERASIFEAVHGSAPDIAGKNIANPTAVIRSGILMLRHLDEQDAANRVKAAVHHVYREGKHLTRDMGGTTSTSEFADKVVEAIHSKDLVVPAPPVQSPA

SEQ ID NO: 60490 - protein, 293 aa, Flavobacteria bacterium BBFL7
MQDLIGTGVALITPFTAAGEVDHSALEQVVNYQIDNGIDYLVVLGTTGESATLTLEEKEAVKSTITKANAGRLPMVLGIGGSNTAAVVNELKTTDLTDYIAVLSVSPAYNKPTQEGVYQHFKAVATATDKPIILYNVPGRTASNMDVETVVRLAHDFDNIIGIKEAAGDIVQAMKLIQYTPKDFLVISGDDMITLSMVLAGGAGVISVIGQGLPQGFSDMVRYGLNGDVEEAFELHYKIAASIDMIFEQGNPGGIKAMLAEIGLINEYLRLPLVPINDDLRSRIKLFIKQYDA

SEQ ID NO: 60491 - protein, 472 aa, Pseudomonas fluorescens PfO-1
MWTIRHSYIDGAFVPVQGRETIECINPATESVIGTVTLANREDARQAIAAAQRAQVTMGRTSKAERIDMLRRLQAAVLESTEEIRDTAIDEYGAPLARAQWVSQYASQSFANTAQVLENHQLVRPVGRATVVMEPVGVSALFAPWNSTAGTVCSKLAAAIAGGCASVIKPSELSPLQTQVLALALHRAELPNGVINIVLGRGSDVGDEISTSPHIAKISFTGSTATGKLIARAGIETMKRVSLSLTGKSASIVLDDADLETAIPMALNAAFMNNGQACVAGTRLLVPRGCLPQVIERVKTLVDATVVGDPRDPATAIGPLVNQAQFDRVQGFIRRGLEQGARLIVGGEGRPHGLSKGYFVKPTVFADVSNDMDIAREEIFGPVLSIIAYDDEEDAIRLANASVYGLQAYVFTREVERGRRIAARLEAGSVLINRIAPELLAPFGGVKQSGIGREFGVSGLEAFLEAKSIVED

SEQ ID NO: 60492 - protein, 457 aa, Zea mays
  misc_feature (67)..(67): Xaa can be any naturally occurring amino acid
  misc_feature (92)..(92): Xaa can be any naturally occurring amino acid
MAGLLHLQSTLLPSASALRRRAGVPVPSSSRRRCRIEAKIREIFMPALSSTMTEGKIVSWTAAEGDXLAKGDPVVVVESDKADMDVETFYDXFLAAVLVPAGDSAPVGSAIALLAESEEDIPVAQSQAASFSSTSPLPSPPQETAAQEASPSPPPPPPPGPVSVSAPTPPLPATQGERVVASPYAKKLAKDLGVDLFSVTGSGPCGRIVAKDVEAALAAPKKAAPVTAPRPDVPLGSTVPFTTMQGAVSKNMVESLAIPTFRVGYTITTDALDQLYKKIKSKGVTMTALLAKATAMALVQHPVVNSSCRDGKSFTYSSSINIAVAVAIDGGLITPVLQDADKLDIYSLSRKWKELVDKARAKQLQPHEYNSGTFTLSNLGMFGVDRFDAILPPGTGAIMAVGASEPTIVGTKDGRIGIKNQMQVNVTADHRVIYGADLAAFLQTLAKIIEDPKDLTF

SEQ ID NO: 60493 - protein, 271 aa, Sinorhizobium meliloti 1021
MNAQFTEETMQTSKGSCRARVYRGASLLAPPPIVLHLHGGGFVGDSVAAGEKVANALAAAGAVVISPEYPSACMNPFPAALDCAYAMLSSMRSRCPQFAHKKSMLFVAGEEAGGNLAAGLALMARDQFLTDLKGQILLSPLLDPCLATASFRKFCPQSSVQSIAEGWQQYLGERSGLTHPYAAPGHCSRLGGLVPALVVTSEECPMRDEAEAYAERLRKAGVPVETHVLPGRASWLPVGGAAQETWPSHEEIISGIFSRFFKQAGAKPAKE

SEQ ID NO: 60494 - protein, 405 aa, Aspergillus oryzae
MLFRTAWARQAAPLRRHAFTPLARRSVTTDAASSHAENVPQEDDKPFTVQLSDESFETYEIDPPPYTLEVTKKELKQMYHDMVSTRRMEMAADRLYKEKKIRGFCHLATGQEAVATGIEHAITRDDKIITAYRCHGYAYMRGGTIRSIIGELLGRREGIAYGKGGSMHMFAPNFYGGNGIVGAQVPVGAGLAFAQQYNEEPTTSIVLYGDGASNQGQVFEAFNMAKLWNLPVLFGCENNKYGMGTSAARSSALTEYYKRGQYIPGIKVNGMDVLATKAAVQYAKNYAVSGNGPLVMEYVTYRYGGHSMSDPGTTYRSREEIQRMRSTHDPIAGLKQKILDWKVMTEDELKALDKAARAFVDEEVAIAENMPVPDNSTRILFEDIYVRGSEPRWMRGRTVDETFYY

SEQ ID NO: 60495 - protein, 130 aa, Oceanicola granulosus HTCC2516
MDLIAQLEAEQIASLGKDIPDFKAGDTIRVGYKVTEGTRTRVQNYEGVCISRKNGEGIAGSFTVRKISFGEGVERVFPLYATNIDSITVVRRGKVRRAKLYYLRSRRGKSARIAEVSNYKPKADKAAAQA

SEQ ID NO: 60496 - protein, 544 aa, Haemophilus somnus 129PT
MKLNDIKRLYKIVRVFLSYGIDEILPHNKYTRSIRCWRMLFFWLKNKHKNKAFGLCLRLALQELGPVWIKLGQMLSTRRDLFPAEIADELALLQDNVEAFSGKIARQQIEQALGSSLENWFTDFDENALASASIAQVHTAKLKLGEEQEKEVVIKVLRPNIQPQIEADLSWMYKLAGLLPKLFREGYRLRAVEVIQEYEKTLRDELDLRVEMANAIKLRENFLDSPMLYIPKMYEAFCHKNVIVMERIYGIPVSDVETLQRNGTDMKLLAERGVQVFFTQVFRDSFFHADMHPGNIFVNPHYPENPQYIGIDCGIVGKLNESDKRYLAESFVAFFNRDYRRVAQMHVDAGWTPQDTNIDDFEQAFREVCEPIFAKPLSEISFAQVLLNLFNVAREFNMQVQPQLVLLQKTLLYIEGLGRQLYPQLDLWDTAKPFLQNWLNEQIGMKVTFKKLKAKLPYLQEHLPDFPETLMDALKQQKFISQQLVEINKKLAKQQRWQKKMFVLIVGIVIFSVTLWQFAALPLAISAGLFLVGFLVWLIGFLLP

SEQ ID NO: 60497 - protein, 327 aa, Trichodesmium erythraeum IMS101
MTHPYAICLGEILFDCLADQAEKTFNKVESWTTYPGGAPANVACGLVNLGTTAALISSVGEDTEGKKLVQILQEIGVDTSGIQGHPYAQTRKVYVLRSKTGEREFAGFGKQTTTEFADTYLKAELLPESLFLNGEFLILGTLGLAYPQTRQAIYQALDLADRYHLKIMVDVNWRPSFWPNPDDAKPLIQSILKRSDFVKLSLEEAEWLFDCTDPAAITYRLDSVEGLLLTAGNQGCAYYLSENEGKVPAFSVDAVDTTGAGDGFVAGFIHQLRQYGIRRLQQPGVAKQIVTYASAVGAITTTKLGAVTAQPTESEVEAFLGSYLPKN

SEQ ID NO: 60498 - protein, 225 aa, Hordeum vulgare subsp. vulgare
MDVADIASPSGQQKQQGHRTVSSEPPKRPAGRTKFHETRHPLYRGVRRRGRVGQWVCEVRVPGIKGSRLWLGTFTNPEMAARAHDAAVLALSGRAACLNFADSAWRMRPVLATTGSFGFSSTREIKLAVAVAVVAFQQQQIILPVACPSPEAPASPSAALFYISSGDLLELDEEQWFGGMDAGSYYASLAQGMLVAPPDERARPENREHSGVETPIPLWSYLFDC

SEQ ID NO: 60499 - protein, 273 aa, Listeria monocytogenes str. 1/2a F6854
MEKYVVIGNPIRHSLSPAMQNRIFQELGMNAEYNSVLIEEDAFETEIKKLMDSGVRGFNITTPFKERILPFLDELDNLAAASGAVNTVLKKEDKWYGFNTDGKGYLEGLEEIRLITEDDSILITGAGGASKAIYLALSTHTDAKITVANRTTEKAIEMTKDNNNHHAITLEEAEKQLADFTIIIQTTSIGLEASKNKSPISLANVKQGTICSDIIYNPAETAFLKEAKKNGAITQNGLPMFVNQGALAFEIWTGIKPERSLMKEAVLEQLGGN

SEQ ID NO: 60500 - protein, 219 aa, Trichodesmium erythraeum IMS101
MSNSQAVVLSESIPVKQVRYNEQGLVPAIIQDYLDGTVLMMAWMNQESLQKTLETGQTCFWSRSRQEFWHKGKTSGHFQNIRWLRYDCDSDTLLVGVEQVGNIACHMGERSCFHLVDGKVVPPPADILSQLFDVIRDRRDHPQEGSYTCQLFAGGDNKILKKIGEESAEVVMACKDDHKESIAAEVADLFYHTLVTLAYHNVELRDVYRKLDERRSQNK

SEQ ID NO: 60501 - protein, 432 aa, Trichodesmium erythraeum IMS101
MVVTTLNTTKSEEIFAAAQKLMPGGVSSPVRAFKSVGGQPIVFDRVQGAYIWDVDGNQYIDYVGTWGPAICGHAHPEVLNGLKEVLEKGTSFGAPCALENTLAKMVIDAVPSIEMIRFVNSGTEACMAVLRLMRAFTGRDKVIKFEGCYHGHADMFLVKAGSGVATLGLPDSPGVPKHVTKNTLTAPYNDLETVKKLFEENPDQISGVILEPVVGNSGFIVPDAGFLEGLRMITKENGALLVFDEVMTGFRIAYGGAQEKFNVTPDLTTLGKIIGGGLPVGAYGGRQDIMSMVAPAGPMYQAGTLSGNPLAMTAGIKTLELLKKPGTYDQLNKITKRLADGLLNIAKETNNDIWGGHISAMFGIFFNKGPVHNYDDAKKSDLTKFSKFHRGMLEHGIYLAPSQFEAGFTSLAHTEEDIDRTLATAKKVMSSL

SEQ ID NO: 60502 - protein, 111 aa, Oryza sativa (japonica cultivar-group)
MGAADKGTGVQFEDFLPSMARKLGVEGLIEELCKGFELLMDPGAGKITFRSLKRNAAMLGLGELRDDELSEMMREGDLDGDGALDQMEFCVLMVRLSPELMQDESHRAFQC

SEQ ID NO: 60503 - protein, 72 aa, Triticum aestivum
  misc_feature (55)..(56): Xaa can be any naturally occurring amino acid
MDNPEMQRFLQQEQQKAMMNEMVGKLTSVCWDKCITSAPGSKFSSGESTCLTNCXXRFLDMSVMIAKRFEMK

SEQ ID NO: 60504 - protein, 1070 aa, Listeria monocytogenes str. 4b F2365
MPKRDDIKTILVIGSGPIVIGQAAEFDYAGTQACLSLKEEGYRVVLVNSNPATIMTDAEMADKVYIEPITLDFVSRIIRKERPDAILPTLGGQTGLNMAMELSAAGILDECNVEVLGTDLTAIKKAEDREAFRDLMNELGEPVPESDIIHNLDEAYTFVERIGYPVIVRPAYTLGGSGGGICHNEQELIETVTSGLKLSPVTQCLLEKSIAGFKEVEYEVMRDANNNAMVVCNMENIDPVGIHTGDSIVVAPSQTLSDREYQLLRDVSLKIIRALEIEGGCNVQLALDPDSYNYYVIEVNPRVSRSSALASKATGYPIAKLAAKIAVGLTLDEVRNPVTGTTFAHFEPTLDYVVAKIPRFAFDKFEQADRRLGTQMKATGEVMAIGRSWEEALLKAVRSLEIGADHLLLEEAENADEATLERKICFPEDDRLFFLAAALRRGQTIEQLHAKTKIDLFFLYKLSKTIELENRIKENPQNQEILAEAKRAGFSDAFLATCWNVDEQAIYDLRKAQNLFPVYKMVDTCAAEFESTTPYFYSTYEEENESTRSAKESVIVLGSGPIRIGQGVEFDYATVHSVWAIQQAGYEAIIINNNPETVSTDFSISDKLYFEPLTLEDVMHVIEIEQPLGVVVQFGGQTAINLADGLAKRGVKILGTSLEDTDRAENRDAFEKALEILQIPQPAGKTATSVEEAINVATDIGYPVLVRPSYVLGGRAMEIVESEEALKHYMTNAVKVNPKHPVLVDRYVSGQEVEVDAISDGENVLIPGIMEHIERAGVHSGDSIAVYPAQRLSSQVKNTIVDYTTRLATGLNIIGMLNIQYVVDGEEVFVIEVNPRSSRTAPFLSKITEIPMANVATRVILGENLIDLGYTPGLAPEKQEIFVKVPVFSFAKLRSVDTSLGPEMKSTGEVMGKDVTLEKALYKGFVASGTTMHDYGTVLLTVADRDKEEAVELAKRFNRIGFTIMATKGTASTLEEANIPVSQVKKIGENQETLIDYIRNGQVTLVVNTLTTGKRPERDGFQIRRESVENGIPVCTSLDTAEAILRVLESRSFELESMNASEVKQPKARV

SEQ ID NO: 60505 - protein, 302 aa, Triticum aestivum
MADAKQQQAAAPTGVWKTIKPFVNGGASGMLATCVIQPIDMIKVKIQLGEGSAAQVAKTMYANEGLGSFYKGLSAGLLRQATYTTARLGSFRVLTNKAIEANDGKPLPLVQKAFIGLTAGAIGACVGSPADLALIRMQADSTLPAAQRRHYKNAFHALYRITADEGVLALWKGAGPTVVRAMSLNMGMLASYDQSVELFRDKLGAGEYQTVIGASAISGFCAAACSLPFDYVKTQIQKMQPDATGKYPYTGSLDCAMQTLKTGGPFKFYSGFPVYCVRIAPHVMMTWLFLNQIQKYQKKIGI

SEQ ID NO: 60506 - protein, 449 aa, Alkalilimnicola ehrlichei MLHE-1
MKNSDIVKRDLDVLWHPCTQMKDHEWLPLIPVKKGEGVWLEDFDGNRYIDAISSWWVNLFGHCHPHISGAVQQQAAELEHVILAGFSHEPVVRLSEKLVQITPPGLSRCFYTDNGSSAVEVALKMSYHYWRNTGKPEKLKFITLSNSYHGETLGTLGVGDVALYKETYKPLLMEAITVPSPDAFLREPGSSWAEHAERMFAHMEAALERHAHETAAVIVEPLVQCAGTMRMYHPVYLERLREACDRHGVHLIADEIAVGFGRTGTMFACEQAGISPDFMCLSKGLTAGYLPLATVLTHDRIYQAFYDDYATLRAFLHSHSYTGNPLACAAALATLELFERDDVIARNRELAREMGEAFAHLADHPHVGEVRQTGMVLAAEMVPDKHKPEPYPWEERRGMIVYQHALKNEALMRPLGSVVYLMPPYVITPEQIRHLARVATEGIDLATRA

SEQ ID NO: 60507 - protein, 255 aa, Zea mays
  misc_feature (138)..(138): Xaa can be any naturally occurring amino acid
MSHFGRSGPPDIRDTFSLLVLNISFRTTADDLFPLFERYGKVVDVFIPRDRRTGDSRGFAFVRYKYADEAQKAIDRLDGRDVDGRNIMVQFAKYGPNAEPIRKGRVKEGVEKSQDRSRSRSPRPRHRDRDHRSQSRSXRSRERHVRDRDRGYRRRSRSRSQSLSSSPDNRSHHRARDDDRRKSMSKSRSRSTSRSRSYYSASPARHSASPRKSPPPQRSPTPAKHANGKDSPLSRCVSPLPKRATSRSPGSDGKE

SEQ ID NO: 60508 - protein, 550 aa, Azoarcus sp. EbN1
MTERESSPYEIGLEKNAANYVPLTPLTFIERSAYVYPDRIAVIHGARRYTWLESYTRSRRLASALKQLGVGKNDTVAVVLNNTPEMFECHFGVPATGAVLNTINTRLEPETVAFMLNHAEAKVLITDREFARVMAKAIELANRPDLIVIDVDDPEYSGPGDRVGTLEYEALLETGSPDFAFEQPADEWDAISLNYTSGTTGNPKGVVYHHRGAYLNAMSNIVSWGMPPHSVYLWTLPMFHCNGWCFAWTMAANAGTNVCLRRVDPRLIFEAIREHGVTHYCGAPIVHSMLANAPESWREGIDHKMYGLVAAAPPPAAVIEGMAKIGIDLTHVYGLTETYGPAAVCAKHDEWKDLPLAEQIALNGRQGVRYHAQEGITVLDPQTMEPVPWDNQTMGEIMFRGNLVMKGYLKNPDATEESFRGGWYHTGDLAVMQADGYVKIKDRSKDVIISGGENISSIEVEDALYKHPAVMAAAVVALPDPKWGEVPAAFVELREGTTVTEAELVAHCREHLAGFKSPKKIIFGPLPKTSTGKIQKFVLREQAKSTQSFE

SEQ ID NO: 60509 - protein, 293 aa, Hordeum vulgare subsp. vulgare
MSPTLSLKLKKSSHTPQSSVSSSTMLRLFKKEAACQSPSTLPVAMDMGLEVSSSSPSSSSVSSSPEHAARRASPAKRPAGRTKFRETRHPVYRGVRRRGNTERWVCEVRVPGKRGARLWLGTYATAEVAARANDAAMLALGGRSATCLNFADSAWLLAVPSALSDLADVRRAAVEAVADFQRREAADGSLAIAVPKEASSGAPSLSPSSGSDSAGSTGTSEPSANGVFEGPVVMDSEMFRLDLFPEMDLGSYYMSLAEALLMDPPPTATIIHAYEDNGDGGADVRLWSYSVDM

SEQ ID NO: 60510 - protein, 662 aa, Haemophilus somnus 129PT
MANAIRFLSMDAVQKAKSGHPGAPMGMADIAEVLWRDFLNHNPTNPQWANRDRFVLSNGHGSMLIYSLLHLTGYDLSIEDLKQFRQLHSKTPGHPEYGYAPGIETTTGPLGQGITNAVGMAIAEKTLAAQFNRAGHDIVDHHTYVFLGDGCLMEGISHEACSLAGTLGLGKLIAFYDDNNISIDGHVDGWFTDDTQKRFEAYGWHVIPAVDGHNAEQIVGAIKQAQAEKNKPTLIMCKTIIGYGSPNKQNTHDSHGAPLGDEEIALTRQALNWNYAPFEIPADIYAKWNAHEKGQVAENAWNEKFAAYEKAYPELAVEFKRRLNGELPANWATESQSFIEKLQANPANIASRKASQNAIEAYAKLLPEFLGGSADLAGSNLTLWSGSKPIRATENVDGNYINYGVREFGMSAIMNGIALHGGFIPYGATFLMFMEYAHNAVRMAALMKQRSLFVYTHDSIGLGEDGPTHQPVEQTTALRLIPNLETWRPCDQVESAIAWKAAVERQDGPSALIFTRQNLAQMNRTSEQLENVKRGGYILRACCEKGDCPDLILIATGSEVELAMKAAEALDAEGVKVRVVSMPSTNVFDKQDVAYREAVLPSAVTKRVAIEAGISDFWYKYVGTNGRIIGMNSFGESAPADQLFKLFGFTVENIVSKAKEIL

SEQ ID NO: 60511 - protein, 230 aa, Methanocaldococcus jannaschii
  misc_feature (1)..(1): Xaa can be any naturally occurring amino acid
  misc_feature (70)..(70): Xaa can be any naturally occurring amino acid
  misc_feature (111)..(111): Xaa can be any naturally occurring amino acid
  misc_feature (175)..(175): Xaa can be any naturally occurring amino acid
  misc_feature (222)..(222): Xaa can be any naturally occurring amino acid
XEDIKIKEIFENIYEVDLGDGLKRIATKSIVKGKKVYDEKIIKIGDEEYRIWNPNKSKLAAAIIKGLKVXPIKRDSKILYLGASAGTTPSHVADIADKGIVYAIEYAPRIXRELLDACAERENIIPILGDANKPQEYANIVEKVDVIYEDVAQPNQAEILIKNAKWFLKKGGYGXIAIKARSIDVTKDPKEIFKEQKEILEAGGFKIVDEVDIEPFEKDHVXFVGIWEGK

SEQ ID NO: 60512 - protein, 350 aa, Oryza sativa (japonica cultivar-group)
MAGGTGIGADEQELPLFHPSPCAYYVQSPSAASHTLSHPASESTAIILSPFPDAAFAAPRHSRVVDDATAHDNDVDQEASRLTLSRYSSSRGSNNSFLAADKKLPAGGGHRGRQVLSGRSGGGVDEEEEDDSEGARSGAWRYVKLDPDAPCCCIVFQVAWRVAVSVAFALLVFFVATKPRDPGVTFKVGKIQQFSLGEGLDGSGVITSFLSCNLTVAMAVDNHSRVFTLHVRPPRLDMSFGRFTFATSQGVEEEGSSYDVGARGKRTVRLFVAAEGKPMYAAGRGMQDLLESGGGLPLAVTVRARSRYRMVGSLVRLSYRHDAQCVVRLRRTPRRNNAIDASGYTCSAIR

SEQ ID NO: 60513 - protein, 193 aa, Oryza sativa (japonica cultivar-group)
MGSGSFLKLLANNFDVLAGPLVSLAYPLYASVRAIETKSPVDDQQWLTYWVLYSFITLFELTFAPVIEWLPFWSYAKLFFNCWLVLPCFHGAAYVYDHFVRPMFVNRQIVNVWYVPRKENLSKPDDVLSAAERYIEQNGPEAFEKLISKSTRPSTSKRSTKQSILEEVESEHMARAERESWGENPFYDKNYRC

SEQ ID NO: 60514 - protein, 612 aa, Caulobacter crescentus CB15
MNIQSTIKAVAETISTGPIPGSRKVYQAGELFPELRVPFREVAVHPSANEPPVTIYDPSGPYSDPAIQIDIEKGLPRTREALVVARGDVEEVADPRQVKPEDNGFAQGKHLAPEFPDTGRKIYRAKPGKLVTQLEYARAGIITAEMEYVAIRENLRREQDRPCVRDGEDFGASIPDFVTPEFVRQEIARGRAIIPANINHGELEPMAIGRNFLVKINANIGNSAVLSTVADEVDKLVWATRWGADTVMDLSTGRNIHNIRDWIIRNSSVPIGTVPIYQALEKVNGVAEDLNWEVFRDTLIEQCEQGVDYFTIHAGVRLPFIPMTAKRVTGIVSRGGSIMAKWCLAHHKENFLYERFDEICEIMRAYDVSFSLGDGLRPGSTADANDEAQFSELRTLGELTKVAWKHGVQVMIEGPGHVAMHKIKANMDEQLKHCHEAPFYTLGPLTTDIAPGYDHITSAIGAAMIGWFGTAMLCYVTPKEHLGLPDRDDVKTGVITYKLAAHAADLAKGHPGAAMWDDAISRARFEFRWEDQFNLGLDPETARKFHDETLPKEAHKTAHFCSMCGPKFCSMKISQEVRDFAAGKAPNSAELGMAEMSEKFREQGSEIYLKTE

SEQ ID NO: 60515 - protein, 600 aa, Coccidioides immitis RS
MSSSLEVAPVLSTPDDHILEATDPLVTPRTADQVSDEELRITYDIERTIRDIKQGRWRRIALQFPDEMLPDAPRVFQLLSRGLESVDLPSQSNGHKAAENEHSCACGKSGHRIAKATDLDDVTQSIANDLNVHEPRGGQKPKLYILGDTSYGTCCVDEVAAEHVSADVVIHYGRACLSPTARLPVIHIFTHRQLDHDPILAAFEETYPNKDEKVLIVADVTFADHVELITSRLVQEKGYTNTFPTGLIHDPSSPVPNRTVPESVRENLESLKDWQLFHISTPPTALLLTLSSRVASIRIYPTDQESSVPNQAPKPLLASTAATLRRRYAILTSLSTVPIFGILINTLSVKHYLHMVEHVQKQIAAAGKKSYLFVVGKLNAAKVANFSEIGGWVVIGCWESSLVDSTDFWKPVITPYELEVALQKDTERVWTGEWRSDYQVLLDAAKGGKGDQSDGCPTETAGPDSQTDYETRNDEDDSFSDPESAPPEFDLRTGKYVSVSSTRPMQSSYAPVHTRTRGPVEAGVSKVLAKRVNGDLATIAGVVSPGAQYLRSNRTWSGLGSDFTIRYEEDDRVTERGSAVVEGRSGIARGYTVGEDLGRR

SEQ ID NO: 60516 - protein, 628 aa, Oryza sativa (japonica cultivar-group)
MPSLALLRAVAMALLLLLARSMEGVDGAGGGGNATCPLDLSYVTTFPWDADLCAGGAGNMTRSAPRGHFRIPSVGESAACLKDYGAKLSAAPLSLPGASLVQTCFPSPEQFVSSPSFCAGVTTAAEYRAVVGNDSVAALDSACGDLSSTPHCLRCLDAGIAATSRLKAAANISANATTDGAATTRNCFYLTVTYAAGISNVAGPTNPPTAACTLGLALSNPPAAPPKSHDTVIYATAIPVAFLLLASLLAFLVWRRHDKKKKKKKIHEISKEGSAKRRSHPRPNTGSILYDIAELSKATDAFADRNLVGRGGFGAVYCGVLADGSVVAVKKMLDPDVEGGDEEFTNEVEIISHLRHRNLVPLRGCCIVDDDAEEGKQKFLVYDFMPNGALEDFIFRDGKRPALTWAQRRSIIMDVAKGLEYLHYGVKPAIYHRDIKATNILLDGDMRARVADFGLARRSREGQSHLTTRVAGTHGYLAPEYALYGQLTEKSDVYSFGVLVLEVLSARRVLDMSAPSGPVLITDWAWAHVKAGQAREVLDGALSTADSPRGGAMERFVLVGILCAHVMVALRPTITEAVKMLEGDMDIPELPDRPLPYGHSAMFSEAGSNFSASPAFSGPFIDNGDMLR

SEQ ID NO: 60517 - protein, 439 aa, Desulfovibrio vulgaris subsp. vulgaris str. Hildenborough
MDKARVVVVGAGFAGLWVVRRLASEKDVEVMLLDRHNYHTFLPLLYQVAAAELEPEQIAYPLRGICRRHSNVRLAVTEVRGIDTARKLVRADGLDIPYDYLVVAAGSRTAYFGVPGAEEHSFSLKTLEEAVCLRNQIISCFEQAALESDPERRRAMLTFTVVGGGPTGVEYAGALAELVRAPLRKDFPELDMNEVRVVLLEAAPGVLGGFPERLRGYAKKRLGAMGVDVRLDASVAEVTAAGVLFASGEHLPTHTVVWTAGVRGEVVAEHMGLPLGRGGRVAVLSTLQVEGLPEVFVVGDMSLPEGQNPPMNAPNATQQGRLAAENILAMLQRRDPVPFRYRDKGAMATIGRQAAVVRMGNFAFSGFLAWLLWLFVHLAYLIGFRNRLIVLINWAWDYLFYERAVRLILPRRGCGTIDSRKREAAQGAGDADRPGATCS

SEQ ID NO: 60518 - protein, 232 aa, Brassica napus
MVGMAVVGQWTLCVASPSPRVKSATCNSNSCPTTVNLRSELSAFRPQFRLFSRVSPTRRRRLCASSSADSGIFLPHLVASMEQVEETYIMVKPDGIQRGLVGEIISRFEKKGFKLIGLKMFQCPKELAQEHYKDLSAKSFFPSLIEYITSGPVVCMAWEGVGVVASARKLIGKTDPLQAEPGTIRGDLAVQTGRNIVHGSDSPENGKREIALWFKEGELCEWDSVLAKWLRE

SEQ ID NO: 60519 - protein, 377 aa, Vibrio angustum S14
MTTQQQKPPVLWLNVAVFSVTLLVAIIGVPLYAYQYGFDWTQILMLVVAFSFCGMSITAGYHRLWSHKTYQANALLRFIFAIGGAFALQNSILHWSSDHRIHHRHVDNNDKDPYSAKKGFFYSHIGWMLRDYQASRYHDYDNCRDLQKDKIVMWQHKYYLWLAIGTNFGIPLAFGFIHGDIWGALLLVGFLRLVLSHHTTFFINSLAHIWGSQPYTDRNTARDNGFLAFLTFGEGYHNYHHIFENDYRNGICWWQFDPTKWLIKVCSWIGWTRNLKVTPADRIEKTKAKMQFKRIQQQLSKMPNNVARLTQLQQEYEALIAKISDYYQAKKRLLDMEKQKIANSYDNFEFIQQYKSMQARLEQQRRAWKGLTQQYTM

SEQ ID NO: 60520 - protein, 248 aa, Glycine max
AATNTVEEESLITNPNAAHVQGIPTPEIYESPRVTAGPLRRKENIPLQLLDINFPPRTAKHAVFPQLSKPKCAENLAKEPLPENQVEGEQNKHTRPTTPIPDVSSTGSVNGAAQSEVQSSSSPVEVHEMQNGYSSEGETMYSAETAESRNYTSPRELKFQQVGRSQSCVSYNRWGAAPRSQVARGMMVENQRSFMHVKRMYSQGATTSQRSNDYFSPTVSSIMKRNSSSSKPPPRQSAVHSPSPRWMF

SEQ ID NO: 60521 - protein, 239 aa, Debaryomyces hansenii CBS767
MSSGASLVEKAKKSAAYQAVDENFPEGAKVVGVGSGSTVIYVAERISQLKNKESFVCVPTGFQSKQLIIDAGLRLGTIEQYPEVDIAFDGADEVDTELNLIKGGGACLFQEKLVAAAASKFVIVADFRKRSPSKLGIQWRKGVPIEIVPCAYAKVSKDLEAMGAKKVELRQGGSAKAGPVVTDNNNFLIDADFGEIEDPAKLHTDIKQLVGVVETGLFVQMAYKTYFGEESGEVKCWSK

SEQ ID NO: 60522 - protein, 185 aa, Triticum aestivum
  misc_feature (170)..(170): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCXESGKALNSSLTTGHI

SEQ ID NO: 60523 - protein, 473 aa, Glycine max
MSVQDYLDKHMLSRKLEDAVNAAVRAKTSDPVLFISNHMRKAVQSVITKIKARQILDSRGIPTVEVDLHTNKGVFRASVPSGNSTSMYEAVELRDGDKGVYLGNGVAKAVKNINDKISEALIGMDPTLQSQIDQAMIDLDKTEKKGELGANAILAVSIAACKAGAAEKEVPLYKHIADLSGKTSPTLPVPAFTVISGGKHAGSNLAIQEIMILPIGASKFEEALRMGTETYHHLKAVITEKYGAHNCNVGEDGGFAPNISSFREALDLVKEAISRAGYDEKIKIALDVAATDFCIGKRYDLDFQSPQKSGQNFKSAEDMIDLYKELCSEYPIVSIEDPFDKEDWEHIKHISSLGICQVVGDDLLMSNAKRIERAITESACNALLLKVNQVGTITEVIEVVKLAKEAHWGVVTSHRCGETIDSFIADLSVGLASGVIKAGAPCRGERLEKYNQLLRIEEELGDQAVYAGEDWRQ

SEQ ID NO: 60524 - protein, 154 aa, Lupinus luteus
MGVLTDVQVALVKSSFEEFNANIPKNTHRFFTLVLEIAPGAKDLFSFLKGSSEVPQNNPDLQAHAGKVFKLTYEAAIQLQVNGAVASDATLKSLGSVHVSKGVVDAHFPVVKEAILKTIKGVVGDKWSEELNTAWTIAYDELAIIIKKEMKDAA

SEQ ID NO: 60525 - protein, 671 aa, Listeria monocytogenes str. 1/2a F6854
MKKTLDRQAVDTIRSLSIDMIEKANSGHPGMPMGAAPMAYMLFAKHLVFNPANPEWFNRDRFVLSAGHGSALLYSMLHLFGYDVKMEDLKQFRQLDSLTPGHPEFGWTAGVDATSGPLGQGIGMAAGMALAESHLAAEYNQPNYPIVDHYTYAICGDGDLMEGVASETASLAGHLGLGKLIVLYDSNDICLDGDLSATFSENAADRFRAYGWQVLRVEDGNNLAAIQEKIVQAKLETSKPTLIEVKTVIGYGAPTKAGSSASHGAPLGEKEANGAKEHYEWAEEPFTVPAEVRDYLRNYKARGEKLEGAWNTMLANYKKEFPELASQLDRVLAGEVAADWNANLPTFEAGTNVATRSASGKMINAIAAELPELFGGSADLGCSNKTFIDASPAYSIQDPAGKNIWFGVREFAMGAMLNGMALHSGLRVFGSTFFVFSDYVRPAMRMAALMQLPVTYVFTHDSIAVGEDGPTHEPIEQLASLRAMPGLTVIRPADAKETRAAWEIAATNTNGPIALVLSRQDLPVLENDQEEVDAGIEKGAYIVAPANSSKPDAIIIATGSEVSLAIEAKAELAKKDIDVSVVSLSSWERFEKTTDTYKESILPKEVTARFAIEAGATFGWKEFIGSEGDMLGIDHFGASAPAKDLFNAYGFTPENVADRVEAVIAKAGVRV

SEQ ID NO: 60526 - protein, 702 aa, Streptomyces avermitilis MA-4680
MQVWPGEAYPLGATYDGAGTNFAVFSEAAHRIELCLLHDDGSETAVELRETDAFVRHAYLPGVMPGQRYGFRVHGPFAPGRGVRCNSAKLLLDPYAKAISGEIKWGEEVYGYHFGAPDKRNDLDSAPHTMTSVVINPYFDWGNDRRPRTEYHHTVLYEAHVKGLTMRHPALPEELRGTYAALAHPAIIEHLTELGVTALELMPVHQFVNDHRLVDMGLNNYWGYNTIGFFAPHNAYASWGDRGQQVLEFKSAVKALHEAGIEVILDVVYNHTAEGNHMGPTLSFKGIDNASYYRLTDDPRYYMDTTGTGNSLLMRSPHVLQLIMDSLRYWVSDMHVDGFRFDLAATLARQFHEVDRLSSFFDLVQQDPVVSQVKLIAEPWDVGEGGYQVGNFPPLWTEWNGKYRDTVRDMWRGEPRTLAEFASRLTGSSDLYQDDGRRPLASINFVTCHDGFTLHDLVAYNDKHNQANGEDNRDGESHNRSWNCGAEGDTDDPAVLALRARQMRNFIATLMLSQGVPMLSHGDEFARTQGGNNNAYCQDGELSWVAWPEDGSELLEFTRAMVWLRRDHPVFRRRRFFHGRPVEGTHDELSDIVWFTPTGEEMIQRDWDSAQARALTVFLNGTAISEPGPRGERISDDSFLLMFNASPKSLEFVVPVDHGRQWQVVVDTARTDGIPPGTVAKVKAGDRLTLVDRSLTVLQRPA

SEQ ID NO: 60527 - protein, 292 aa, Candida albicans SC5314
MSAIYKALQSKSSKETSEKTKHINRQRLLVISSRGITYRHRHLIQDLLALLPHARKEPKFDSKKNLHQLNEVAELYNCNNIFFFECRTQQDLYLWISKPPNGPTLKFHIQNLHTLDELNFTGNCLKGSRPILSFDKSFLENDHYKLLKEMFLQTFGVPPNARKSKPFIDHVMTFSIVDGKIWIRNYQINETLDVKENDKIEDDEDYDVDQLNLVEIGPRLVLTLITVLEGSFSGPKIYENKQYVSPNFVRAQLKQQAADQAKSRSQAALERKIKKRNQVLKADPLSNDALFK

SEQ ID NO: 60528 - protein, 624 aa, Glycine max
MRTSWADLAANSAAENAGPGSSADNVGTGSTLAPTRPVYVPPHLRNRQPAAESPAPAPAYSGPSSGAGSSSGAGNSGSRYAAPRNDYRPGYGGGGGRTGGWGNKSGGWDRGREREVNPFEEEDNAEEAFSEQENTGINFDAYEDIPVETSGDNVPPPVNTFAEIDLGEALNQNIRRCKYVKPTPVQRHAIPISLAGRDLMACAQTGSGKTAAFCFPIISGIMRGQPVQRPPRGVRTVYPLALVLSPTRELSMQIHEEARKFSYQTGVRVVVAYGGAPINQQGDARDTYTVASGVDILVATPGRLVDLLERARVSLQMIRYLALDEADRMLDMGFEPQIRKIVEQMDMPPPGARQTMLFSATFPKEIQRLASDFLSNYIFLAVGRVGSSTDLIVQRVEYVQESDKRSHLMDLLHAQRANGVQGKQALTLVFVETKKGADSLEHWLCLNGFPATTIHGDRSQQERELALRSFKSGNTPILVATDVAARGLDIPHVAHVVNFDLPNDIDDYVHRIGRTGRAGKKGLATAFFNDNNSSLARALSELMQEANQEVPAWLSRYAARSSFGGGRNRRSGGRFGSRDFRREGSFSRGSSDYYSAGNSSGGGYGGSGGYAGGGYGPGVTSAWD

SEQ ID NO: 60529 - protein, 343 aa, Listeria monocytogenes str. 1/2a F6854
MKAVVKTNPGYDQMELKDVEEPQVYGDKVKIKVAFTGICGSDIHTFKGEYKNPTTPVTLGHEFSGVVVEVGPDVTSIKVGDRVTSETTFETCGECIYCKEHDYNLCSNRRGIGTQANGSFAEFVLSREESCHVLDERISLEAAALTEPLACCVHSALEKTTIRPDDTVLVFGPGPIGLLLAQVVKAQGATVIMAGITKDSDRLRLAKELGMDRIVDTLKEDLAEVVLGMTGGYGAERVFDCSGAVPAVNQGLPLTKKKGDFVQVGLFAEKKNAIDEESIIQREIAYIGSRSQKPSSWILALDLLANGKINTDKMITKVYGLDDWREAFEAVMAGNEIKVLVKS

SEQ ID NO: 60530 - protein, 637 aa, Oryza sativa (japonica cultivar-group)
MKKWHGGFVIVSLFIILMLRYVILDSPLAEKSLQYVFQQNNTTPLHWLDVPNPPAVQNPQNISQVISTELLASNLSITRNFSDRELQSLHSWNHLKDLVSHAHILPDGVEAIKEAGVAWRELNAALEYDESAVSVNGSTHQKSKEKQCPYSIRRMNATRSGDRFVLKIPCGLIQGSSITIIGTPGGLLGSFKIELTGATVPGEPDPPIVLHYNVRLLGDKLTEDPVIVQNTWTIADDWGSEDRCPSPGSDAKDIAKVDELEKCGSMVGNDQKQAWATKLKSNVSSIQPAWKKNTEPKKYFPFRQGYLAIAILRVGAHGIHMTVDGKHVTSFAFREDLEPGFVGEVRIAGDIKLLSVIASGLPTTEDFEHVTDLEILKAPPVPMDKPLDLFIGIFSTANNFKRRMAVRRTWMQYDAVRSGKAAVRFFVGLHKNEVVNEELWNEARTYGDIQLMPFVDYYSLILWKTIAICIYGTNVLSAKYVMKTDDDAFVRVDEILLSLDRVNISHGLLYGRVNSDSQPHRDPYSKWYITPEEWPEESYPPWAHGPGYIVSQDIAKEVYRKHKRGELKMFKLEDVAMGIWINEMKKDGLDVKYENDGRILVEGCEEGYVVAHYQEPRDMMCLWDKFLKTKRGTCCKE

SEQ ID NO: 60531 - protein, 250 aa, Escherichia coli O157:H7 EDL933
MAVTKLVLVRHGESQWNKENRFTGWYDVDLSEKGVSEAKAAGKLLKEEGYSFDFAYTSVLKRAIHTLWNVLDELDQAWLPVEKSWKLNERHYGALQGLNKAETAEKYGDEQVKQWRRGFAVTPPELTKDDERYPGHDPRYAKLSEKELPLTESLALTIDRVIPYWNETILPRMKSGERVIIAAHGNSLRALVKYLDNMSEEEILELNIPTGVPLVYEFDENFKPLKRYYLGNADEIAAKAAAVANQGKAK

SEQ ID NO: 60532 - protein, 570 aa, Bacillus sphaericus
MTHLACIAASDGIAIAKAYRFVQPNLTFSQTTVQDVQAEQQRLAAALAKTEQELRPSKQQTLKKFSAEEAAIFEAHLLVVKDSELIGPINQKTADEGVNAEFALHEVSSMFVALFESMDDEYMSARASDIKDVTNRILAHLLGAHIPNPSSISEQVIIVANDLTPSETAQLDRNFVLGFITDIGGRTSHSAIMGRSLEIPAVVGTGVATTTIQDGDILIVDGLSGQVFVNPTADVIVSYQEKAQSYHTQQAEWSTLVNEQTVSKDGVHVELAANIGSPGDLEGVLRHGAEGIGLYRTEFLYMGRENLPSEDEQFTAYQTVLEGMQGKPVVIRTLDLGGDKHLPYLPLQEEMNPFLGHRAIRLCLEQQELFRTPLRALLRASVYGNLKIMFPIIATIQEFRDAKAILLEEQEKLKAAGEEVSADIEIGMMVEIPATAVMADVFAKEVDFFSIGTNDLIQYTMAADRMNEKVSYLYQPYNPAFLRLIQMVIHAAHQEQKWVGMCGEMAGDELAVPLLLGLGLDEFSMSATSILKTRSLLKRLSVKDMQALATEALQVATAEEVMEKVKQAVK

SEQ ID NO: 60533 - protein, 302 aa, Oryza sativa (japonica cultivar-group)
SRFGFLRYGEDGRIEGELERILGPQCLISDSWEVHSPDWCDPGVNFGEFLGSRIWPTVPARNRGNWGPIWCQLGSNLEVEAIDPAGEMIAAVGRGPEGWGEDEMSVLPRHTKVVVTGNNRTKSVLVGLHGVVKKAVGLGGWHWLVLTNGIEVKLQRNALSVIEPPTGNEDDDKFDCENMQWNSSDLASDDAQSPKPQRSRSRQHRGFQTKSFSRSMSCDSHSKASFSSSSRAHTKVDLSKLEMTALWRYWRHFNLDASPNPSREQLVDAVQRHFVSQQLDELQVIVGFVQAAKRLKTNVKVA

SEQ ID NO: 60534 - protein, 168 aa, Triticum aestivum
RSRKITQFPAFNFEFPPPAPAQQRQPKPARGAMARTKQTARKSTGGKAPRKQLATKAARKSAPTTGGVKKPHRYRPGTVALREIRKYQKSTELLIRKLPFQRLVREIAQDFKTDLRFQSHAVLALQEAAEAYLVGLFEDTNLCAIHAKRVTIMPKDIQLARRIRGERA

SEQ ID NO: 60535 - protein, 254 aa, Triticum aestivum
MDPKIGGNGISRAAPLEALLFDIDGTMCVSDPFHHRAFSELLQNLGYNGGAPITPEFGMAHMAGRSNEQIGRFLFPDWPQARLDAFFAEKEALFARYAGEGLREVPGLAELCRWARERGLKRAAVTNAPRANAELMIGILGLADFFQLVVAGEDCGEGRSKPCPDPYLRALDLLGASAERSLVFEDSVVGVQAGVAAGMPVVAVASESREAKVVAAGASMVVRDYRDAELWAALEAAAGAPKIDSEVNAVDAKL

SEQ ID NO: 60536 - protein, 468 aa, Methylobacillus flagellatus KT
MLAQLFRTKPVEIGHHSGLKKCLSAFDLALLGIGCAIGTGIFVLTGIAAAVYSGPAVVISFVIAGFAAAFAGFAYAELASSVGGSGSAYGYSYVAFGEFIAWVIAWILLLEYGVGAAAVANGWSGYFINTLANFGIAIPEAWTKAPSQGGIINLPAFGIIWLLVFILISGVKQSSTVNNIMVAIKLSTIAIFLAIAVGHINSDNWHPFMPFGWFSSQADGSNIGILAGASLVFFAYFGFDAVSTAADEARNPQRDLPIGLIASVTFCTLIYILVSGVLTGVVHYSDLNVSSPVAYALSKLGYSWSSSLVATGVLAGLITVLLVLLYGLTRILYAMSRDGLIPAAFSKVNPDRQSPTRVILFCGSIISIVAGFFPLGTLAETVNIGTLASFVMVCVGVIVLRKRQPDLHRPFKNPGGPIIPLLGIISCSALMAFLPGETWHRFLIWVGIGIIMYFAYSMHHSKLRQRNS

SEQ ID NO: 60537 - protein, 453 aa, Synechococcus sp. WH 7805
MPQPFDPGCDLKSPNRNLAPITAEIDDQGKLSIGGCVLSELAERYGTPLYVLDEASIRQACRAYREALERHYPGPSLAIYASKANSSMALTAVVASEGLGLDAVSAGELITALDGGMPADRMVLHGNNKSSEELALAYRNGVMVVADNQHDLDLLQTIVPDQGEPVRLMLRFTPGIECHTHEYIRTGHLDSKFGFDPDQLEPVLRSLQGASWARVEGLHAHIGSQIFELEPHRDLAAVMADALLLARTLGHPVEDLNVGGGLGIRYTASDDPPSIDAWVQVVGSAVASACRERNLELPRLLCEPGRSLVATAGVTLYTVGARKVVPGIRTYLSVDGGMSDNPRPITYQSQYTACLADRPQARAEEMVTIAGKHCESGDVLLKDLAFPSCSSGDILVVLATGAYNSSMSSNYNRIPRPAAVLISASEAELVQRREQPEDLLRYDLLPERLRSLV

SEQ ID NO: 60538 - protein, 175 aa, Brassica napus
MVPLLRSNRQRKIFRRFIPQTWQMNFNSVFQSLTELFPQIDERILRTVAREHPTDADEAAAVVISEVVPLFPQEWEVHVPKRKLHHLPLCKVEPETQHEDALSQWLHPSHLPQSYLALLNEEEEEEEKSTPDLKPLLDYAVKKVVLPSRDAAAGARREVPTIYSASNKTASSVVK

SEQ ID NO: 60539 - protein, 290 aa, Oceanicola granulosus HTCC2516
MFRGSIPALVTPFSDGAVDFGVLKALVDWHVEQGSHGIVPVGTTGESPTLTHDEHDAVVACVVEQAAGRIPVIAGAGSNNTAETVRLIEAAKAAGADAALVVTPYYNKPTQRGLIAHYTAAAECGLPIIIYNIPGRSVVDMSPETMGELARHEMIAGVKDATGDLSRVPKTRITCGTDFIQLSGEDATALGFNAHGGVGCISVTANVAPRLCAEFQEATLAGDYATALELTDRLMPLHIAIFLEPGVVGAKYGLSLLGHCADTVRSPLTEATDGTKEAIRAAMVHAGLLN

SEQ ID NO: 60540 - protein, 134 aa, Triticum aestivum
MDGRTRQHYQPPPLLQPHISSSAARRGSSATMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 60541 - protein, 448 aa, Trichodesmium erythraeum IMS101
MNMNFKSSNPASSLALPPGDLGLPFIGQNKKIFKNPQNFIEEVYQKYGPVYKTNFLGKNFIYFQGYEAIKFILTNENKYFTYSQILRNYQRIFGENDITVLAGKEHRERQKILAKTIKSKNLNNYIDIIHDLSQSYFLKWIKSDYVDLYSEINNYTLDMILKLLLGIDYASKSEISNYLKDMSSGLNTIPVVFPWTKFGSALESKNKLFNQFEQIIVRRKKENNFGSDILGILLTVQEQMNYELTPREIVGQMVNLLSLGKKELSSALSSFFILTSEHLDVLKLLQIEQEKMDVSEPLSLDKYKKMVYLEQVIKEVLRLVPPVSGGLRKIIEDCSFQGFRIPKGWHAYYYISSVLKDPEIYKQPEIFNPERFNPTNAEDKKKPLCYIPFGGGARECIGKEFAYLVIKIFISALLDNCSWKFKENQDLTINTFPVARPAHKIEVCFTPK

SEQ ID NO: 60542 - protein, 506 aa, Oryza sativa (japonica cultivar-group)
MGEEKQNDERKNKYAVGCSIIGSIISVLMGYDTGVMSGAMLFIKEDLKTNDTQVQVLAGILNVCALVGSLTAGRVSDCVGRRLTISLAACIFLVGSVLMGLAPNFATLLAGRCVAGVGVGYALMIAPVYAAEIASADIRGSLTSLPEICISFGILIGYVANYLLAKLPLVYGWRAMLGLGALPSAALALGVLAMPESPRWLVVQGRAEEALSVLRRVCDRPSEADARLAEIKAAAGLADDDGAAANAGSGGKGVWRELFLHPTPPVRRIVIAALGIHFFQHLTGIEAVVLYSPRIFKAAGIASRNSVLAATIGVGVTKTAFILTAILLVDRIGRRPLYLSSLAGIIASLACLGMGLTVIERSPPHHSPAWAVVLAIATVFTFVASFSIGVGPITWAYSSEVYPLRLRAQGASVGVAINRVMNAGVSMTFVSLYKAITIGGAFFLFAGLAVAAATFFYLLCPETQGKPLEEIEEVFSQGWRARRRASAAAVEMPASGGGGGGGAPMA

SEQ ID NO: 60543 - protein, 331 aa, Caulobacter crescentus CB15
MDGNHSGGLGLVGDIGGTNARFALVEFDGQDPRLIEPTAYRGEDYGTAEDAIEEYLRKVGVKHPDQAVVAVAGPIDHGQVHMTNLDWRISEDGLRRAGGFRNAKLINDFTAQALAAPRVGPKDLRQIGELPTSGEGDLAILGPGTGFGVAGLVRRHGQEIPLATEGGHVAFAPVDDVEIEVLRALTRRLDGGRVSVERILSGPGMEDLHVDLAAAEGRGVEALTAKQITERAVEGCADSLATVNRFCAILGSTAGDIALTLGARGGVFIAGGIAPRIIDILEKSPFRERFDSKGRLSGFTRSIPTHVILHPHTALIGAAVALTPEGRAAVS

SEQ ID NO: 60544 - protein, 476 aa, Methanosarcina barkeri str. Fusaro
MKMQINGKAVEACSGEFFDIINPATGELIDRVPKGTEDDAAIAVESASSAFNGWASTSPQQRARILYTAAGIVRQRKDELAVLLTREQGKPLAEAKNEIEGFAHVLEYYCGLASSFHGDFVPVPQNGYAFTVKKPLGVCTAIIPWNMPALIMAWKIGPAMISGNTLVLKPASNTPLTNLALASILSEAGLPPGVLNIVTGPGEVVGESLVKSPKVKKISFTGEVRTGKRIAELAAGGMKRVTLELGGSDPMLVCDDANLEAAVAGALRGRFYNCGQACTAVKRLFVFESVAERFIKKLEAGIRNLRVGNGLHENIDLGPLNNRRQWEYIKELVADAEEKDEGRIVAGGRVPEGSACSKGYFFEPTLIVDVDRKSRLLNEEVFGPVLPVVRVKDLDEAIEEANNTCYGLGASIWTKNLDRARIGCEQLNAGIIWLNQHLKVAPEVPFGGTRESGIGNENGPDALSEYLDLKTVMLKI

SEQ ID NO: 60545 - protein, 180 aa, Cryptomeria japonica
LQHTLTGHGDAVSSVEFSKDGLLVGSGSVDKSIRLWSSSTGTFERSLHGHTEGISDVAWSSDSRYICSASDDKTLKIWDVHTGDCVKTLKGHSNFVFTVNFNDHSNLIVSGGFDETVRIWDVKTGKCLRVIHAHTDPVTAADFNRDGSLIVSSSHDGSCKIWDASNGNCLKTLIDDKTPA

SEQ ID NO: 60546 - protein, 879 aa, Listeria monocytogenes str. 4b F2365
MRKFVYQFSEGSKEMKNILGGKGANLAEMTNIGLPVPPGFIISTDACNDYTANNKNLSEAIFEEVKIHLAELEKQTGKIFGFAENPLLVSVRSGAPFSMPGMMDTVLNLGLNDQAAEGLANLTGDARSAYDSYRRFIQMFGDVVFEIPSYQFEQALSRIKKANNYRLDTELTATDLSNLIDAYKLIFSQATGIDFPQDPLEQLRLAIIAVFDSWMNPRAVIYRRLHDIDASFGTAVNIQAMVFGNTGETSGTGITFTRNPSTGEKKVFGEFLLNAQGEDVVAGIRTPEPISALEERMPTVYKELLQTCELLENHYLDMQDIEFTIEKGKLYVLQTRSGKRTAKAAIQAAIDFVHEGKITRQEAIMRVETKQLNQLLHPTFLESALKNGQVIATGLPASPGAATGQIFFEAKEAVQAAERGIPVILVRNETSPEDIEGMARSNAILTAHGGMTSHAAVVARGMGKCCIAGCAELTINEKDKTIILPTGDTLHEGDALSLDGSSGKVYLGEIALREAKIGGHFDELMAWADAEKRLMIRVNADTPADFKKALLFGAEGIGLCRTEHMFFDEKRIPYVRQMILAELLNERESVLAILKEMQKADFNELFRIADGRSVNIRLLDPPLHEFLPTMKQEIEQLAGAMNRTVPQITNRINGLREANPMLGHRGCRLAITFPEIYRMQAEAIIESAIIVHNEGIDVHPEIMIPLIATKNELSYIKKELQQAVQAIFDREQVVIPYDIGTMIEIPRACVTADEIAEEAAFFSFGTNDLTQLTYGFSRDDATKFLADYYEKDILPKDPFVSIDKNGVGALVEMAVTRGRMTSEHLKMGVCGEHGGDPESIQFFHQLGLSYVSCSPYRVPIARLAAAQAALAEKQLVPTI

SEQ ID NO: 60547 - protein, 180 aa, Cryptomeria japonica
LQHTLTGHRDAVSSVEFSKDGLLVGSGSVDKSIRLWSSSTGTFERSLHGHTEGISDVAWSSDSRYICSASDDKTLKIWDVHTGDCVKTLKGHSNFVFTVNFNDHSNLIVSGGFDETVRIWDVKTGKCLRVIHAHTDPVTAADFNRDGSLIVSSSHDGSCKIWDASNGNCLKTLIDDKTPA

SEQ ID NO: 60548 - protein, 116 aa, Zea mays
  misc_feature (71)..(71): Xaa can be any naturally occurring amino acid
NENLLQALFTLSLYPNHQSKIYSVNEGNAKNWDGPTAKLVEECKYLEDGSLPRSFRYIRSMVADVHCTLIXGGIFLCRADQKSPNGKLCYLLLLLPMSFLMEQAGGQAFTGKQRGR

SEQ ID NO: 60549 - protein, 456 aa, Photorhabdus luminescens subsp. laumondii TTO1
METIRMSKHYDYIAIGGGSGGIASINRAAMYGQKCALIEAKALGGTCVNVGCVPKKVMWHAAQIAESIHQYGPDYGFDATINRFNWKTLIASRTAYIDRIHQSYGRGLGNNKVDVIQGFARFVDAHTVEVNGEKITADHILIATGGRPVWPDIPGAEYGIDSDGFFALEEMPKRVAVVGAGYIAVEIAGVLHALGSETHLFVRQHAPLRSFDPMIVETLLEVINTEGPTLHTESVPKSVSKNADGSLTLQLQNGKEQTVDTLIWAIGREPVTDNLNLSVAGVELNEKGYIRVDEYQNTNVKGIYAVGDNTGAVELTPVAVAAGRRLSERLFNNKPEEHLDYTNIPTVVFSHPPIGTVGLTEPQAKAQFGEEQVKTYQSSFTAMYTAVTQHRQPCRMKLVCVGPEEKIVGIHGIGFGMDEMLQGFAVALKMGATKKDFDNTVAIHPTAAEEFVTMRG

SEQ ID NO: 60550 - protein, 184 aa, Physcomitrella patens
MSASKDGDPRIQYISDSIRTIPDFPHKGIMFRDVTTLLLDHKAFKDTIDIFVERYRDQKVDVIVGIEARGFIFGPPIALAIGAKFVPMRKPRKLPGPVIREEYSLEYGTDCIEMHVGAIEKNERVVIVDDLIATGGTLGAAIKLLDKVEAEIVECACLVELVDLKGREKLSGKPLYILVEYEGE

SEQ ID NO: 60551 - protein, 553 aa, Cryptococcus neoformans var. neoformans B-3501A
MPDSHDLPAQSIASSSRQPSSILNRADQHASEAGPSRSASTDKGYHADVVNRPKGDHLGVPPSSAYARGPTSPTSELSPLSCSGMTPHLDICKYPTQQLLRLLAGLLQHIAGSNDQLRAELEAEEDDEMDEQHVDDNTANVDWRSRPHSRASGRSYVPSGTSSTAELFSEPASSTLTSPALTSRSSSAASNPTSYPLSQFPLFTASKSSLSHPSALLAFHARHIPSISIEAYLLRILKYCPATNEVFLGVLVYFDRMTKLGTPAGIGGESSKVGKKGKGFAIDSYNVHRLVIAGVTVASKFFSDVFYTNSRYAKVGGLPPTELNSLELQFLLLNDFRLRVSVEEMQRYGDRLLAYAEEAGEDIGTVGVERRRSDASEWGEFEGRHNERGFEGRTFRESSGGRDSRSSRPTVEEANSAFSSTPTRNPASAASANAPLPNPVSIKYASTQPPLPPNQSSTPVTVPTSPRIVQSKTQPREAQQPQTRAQTQPMKSHTFPVGSSVPSASAGSRTGTGGGVANAGNGADTVSGGIRDWVRGDDPIAVVGGRMTSPMRD

SEQ ID NO: 60552 - protein, 484 aa, Agrobacterium tumefaciens str. C58
MHLNDPTLFCEKVPVAGRWIGCDDRETATIRNPATGKIVGQVPELGATETQAAITAAVIAQKAWARRTAGERAAILKAWHRLVMENRDDLGMILTLEQGKPLAEAKGEIAYGASFIEWFAEEARRINGETVPGHQADKRILVLRQPVGVVAAITPWNFPNAMITRKVGPALAAGCAVVLKPAPQTPFSAIALAILAERAGLPLELFSIVTGPAAEIGGVLTASPDIRLLTFTGSTRTGEHLYRQCAPTIKKLGLELGGNAPFIVFNDADLDAAVEGALIAKFRNNGQTCVCANRLYVQSGVYDAFAEKFARAVSGLKVGNGLEEGSILGPLIDGNAVAKVEAHIADALSKGAQIAAGGSRYALGGNFFEPTILRNVTADMQVAREETFGPLAPLFRFEDEEDVIAQANNTDFGLASYFYARDLSRVFRVAEALEYGMVGVNTGAISTAEAPFGGVKMSGLGREGSRHGIEEYTELKYVCIGNIL

SEQ ID NO: 60553 - protein, 109 aa, Arabidopsis thaliana
  misc_feature (87)..(87): Xaa can be any naturally occurring amino acid
WLTPCDRDNLPVRERITQERHLLTSESEHDEIYLSTAPESASLGPWKKRTFDIRKDGLADTVMSHPCDNKSETIADVGHEHHEHMLXGESASMERPITLHPGEQRAAIL

SEQ ID NO: 60554 - protein, 171 aa, Larix laricina
APSKTGNSNVVSAFTGLKSMAQFPSSKTMSNAGAEWERKTTSNGARVRCMQVWPPYANKKWETLSYLPRLTPEQLVKEVEYLLKNKWVPCLEFEEDGEIKRVYGNSPGYYDGRYWVMWKLPMFGCTEASQVLNEVNECAKAYPNAYIRVIGFDNVRQVQCISFIVHKPEYN

SEQ ID NO: 60555 - protein, 465 aa, Glycine max
MSFHPNPNLNTAATTEPLNHMVLAMHLSDPKSKTLTLIPNSTLIILDRTLLLSDELLLRILSKLPDSSQQRNSNSLVCKRWLNLQGRLVRTLRVLDWSFVLSGRLINRFPNLNHVDLVPGSFTSSSVNTTTTIVVSHRLLSMHVDSAWRIGVEKNLLPVETVDAGLKSLASGCPNLRKLEVAGCSEVGISTIGAECATLQELELQRCDDAVLGGVAGCENLQILKIVGCVKGFYESVVSDIGLTILAQGCKRLVRLELVGCEGSFDGVKAIGQCCVMLEELVIVDHRMDDGWLAGVSYCENLKTLRVQSCKVIDGSPGLEEHLGCCEALERVHLHKCQVRDRNAVGALFSVCRNAREIVLQDCWGLDDATLSLAVVCRRVKLFYVEGCSLLTTEGLESVIEHWKELECLRVDSCKNIKDSDISPELATLFSTLKELKWRPDTKYLFESDVGVSMGKKGGKFFKRT

SEQ ID NO: 60556 - protein, 217 aa, Triticum aestivum
MGVSPVSPGGSGGYECSFKILLIGDSGVGKSSLLVSFVAAANLDDDIAPTIGVDFKIKFLTVGGKKLKLTIWDTAGQERFRTITSSYYRGAQGIILVYDVAKRESFTNLGDVWTKEIDSNSSNKDCIKMLVGNKVDKDDERTVTREEGLAFAQESGCLFLESSAKTRENVENCFEELVLKILEVPSLLEEGSSSVVKRNILKKQQESHAKYGGRCCQ

SEQ ID NO: 60557 - protein, 554 aa, Vibrio parahaemolyticus RIMD 2210633
MCSVFGILDIKSDAAALRPIALEMSKKLRHRGPDWSGIYSSERAILAHERLAIVGLNSGAQPLYSPDKKLILAVNGEIYNHKEIRARYEGKYEFQTDSDCEVILALYQDMGADLLEELNGIFAFVLYDEEKDEYLVGRDHIGIIPLYQGYDEHGNYYVASEMKALVPVCKTVSEFPPGSHYSSKDAEPQRYYIRDWNEYAAVQGNSTSKEELTEALEAAVKRQLMTDVPYGVLLSGGLDSSITSAVAKRYAAMRIEDDEKSEAWWPQLHSFAVGLEGAPDLKAAREVAEKIGTVHHEMTYTIQEGLDAIRDVIYHIETYDVTTIRASTPMFLMGRKIKAMGIKMVLSGEGADEIFGGYLYFHKAPNAKEFHEETVRKLLALNMFDCARANKSLAAWGVEGRVPFLDKEFIDVAMRLNPADKMCGNGKMEKHILRECFEHYLPDSIAWRQKEQFSDGVGYSWIDTLKAVAEEKVTDQQMETAQYRFPYNTPTTKEGYVYREIFEELFPLPSAAECVPGGPSVACSSAKAIEWDESFKNCVDPSGRAVQTVHNDAY

SEQ ID NO: 60558 - protein, 496 aa, Staphylococcus aureus subsp. aureus Mu50
MELLKHLSQRQYIDGEWVESTNKNTRDIINPYNQEVIFTVSEGTKEDAERAILAARRAFESGEWSQETAEKRGKKVRAIADKIKEHREALARLETLDTGKTLEESYADMDDIHNVFMYFAGLADKDGGEMIDSPIPDTESKIVKEPVGVVTQITPWNYPLLQASWKIAPALATGCSLVMKPSEITPLTTIRVFELMEEVGFPKGTINLILGAGSEVGDVMSGHKEVDLVSFTGGIETGKHIMKNAANNVTNIALELGGKNPNIIFDDADFELAVDQALNGGYFHAGQVCSAGSRILVQNSIKDKFEQALIDRVKKIKLGNGFDADTEMGPVISTEHRNKIESYMDVAKAEGATIAVGGKRPDRDDLKDGLFFEPTVITNCDTSMRIVQEEVFGPVVTVEGFETEQEAIQLANDSIYGLAGAVFSKDIGKAQRVANKLKLGTVWINDFHPYFAQAPWGGYKQSGIGRELGKEGLEEYLVSKHILTNTNPQLVNWFSK

SEQ ID NO: 60559 - protein, 291 aa, Methanosarcina mazei Go1
MFEGAMPALITPFTKDDRIDREGLQRNIAFVEEGGVSGIVPCGTTGESATLSAAEHEEVIDIAVECSKVPVIAGTGSNNTGEALQFTKHAADAGVDGVLLISPYYNKPNPAGLLAHFKKIAEAVDIPMILYNVPSRTGQDMPVDVIVELAKVENIVGIKEASGNAAKVSQILENTMDDDFVVLSGEDGLTLPIISMGGRGVISVAANIVPDKMSGMVNAALKGDYETARKLHFEIAPLIRALFLETNPIPVKKAAELVGLASGHLRLPLAPISDANQAKLANELRKLGVME

SEQ ID NO: 60560 - protein, 180 aa, Thujopsis dolabrata
LQHTLAGHGGAVSSVEFSKDGRLVGSGSVDKTIRLWSSSTGAFKRSLHGHTEGISDVAWSSDSRYICSASDDKTLKIWDVHTGDCVKTLKGHSNFVFTVNFNDHSNLIVSGSFDETVRIWDVKTGKCLRVIQAHTDPVTAADFNRDGSLIVSSSHGGSCKIWDASSGNCLKTLIDDKMPA

SEQ ID NO: 60561 - protein, 344 aa, Rhodopseudomonas palustris CGA009
MNLADLNQIARAMVAPGKGILAADESSGTIKKRFDVIGVESTETNRRDYREMLFRSKEAMSDYVSGVILYDETIWQNAADGTPLVKLIEQAGSIPGIKVDEGTQPLPNCPGETITVGLDKLAERLAKYYKQGARFAKWRAVIDIDTARGVPSHTAIMTNAHALARYAALCQQAQIVPIVEPEVLMDGAHDIDTCYNITEWVLKETFQQLYFQRVALEGMILKPNMAVPGKKSAKKASVQEVAEKTVKLLKACVPSAVPGIAFLSGGQSDEEATAHLDAMNKIGGLPWGLTFSYGRALQAAPQKAWSGKAENVAAGQAAFTHRARMNSLAAKGEWSAELETKKAA

SEQ ID NO: 60562 - protein, 308 aa, Oryza sativa (japonica cultivar-group)
MAIISDFQEEEAPPRQQQQPASVAAAAGSGDEVLAAELERRGGAIPFLQAAIDVARRRSDLFRDPSAVSRVTSMASAARAVVEAEERKAREAKRKAEEAERKAAEAERKAKAPAEPKPESSAGKDSMEVDKKEEGNVRKPNAGNGLDLEKYSWIQQLPEVTITVPVPQGTKSRFVVCDIKKNHLKVGLKGQPPIIDGELFKPVKVDDCFWSIEDGKSLSILLTKQNQMEWWKSVVKGDPEVDTQKVEPENSKLADLDPETRQTVEKMMFDQRQKQMGLPTSDEMQKQDMLKKFMAQHPEMDFSNAKIA

SEQ ID NO: 60563 - protein, 180 aa, Chamaecyparis formosensis
LQHTLVGHGGAVSSVEFSKDGRLVGSGSVDKTIRLWSSSTGAFGRSLHGHTEGISDVAWSSDSRYICSASDDKTLKIWDVHTGDCVKTLKGHSNFVFTVNFNDHSNLIVSGSFDETVRIWDVKTGKCLRIIPAHTDPVTAADFNRDGSLIVSSSHDGSCKIWDASSGNCLKTLIDDKTPA

SEQ ID NO: 60564 - protein, 180 aa, Chamaecyparis pisifera
LQHTLAGHGGAVSSVEFSKDGRLVGSGSVDKTIRLWSSSTGAFGRSLHGHTEGISDVAWSSDSRYICSASDDKTLKIWDVHTGDCVKTLKGHSNFVFTVNFNDHSNLIVSGSFDETVRIWDVKTGKCLRIIHAHTDPVTAADFNRDGSLIVSSSHDGSCKIWDASNGNCLKTLIDDKTPA

SEQ ID NO: 60565 - protein, 131 aa, Brassica napus
  misc_feature (16)..(16): Xaa can be any naturally occurring amino acid
  misc_feature (38)..(38): Xaa can be any naturally occurring amino acid
  misc_feature (59)..(59): Xaa can be any naturally occurring amino acid
  misc_feature (115)..(115): Xaa can be any naturally occurring amino acid
MEAVLLCSKVVPRATXLESNRKLSFSHFNKHLKCNSLXTDSKKTPLLLSFELVRVLKAXDKLHSQGSCALPRCLISTSTVFNSDNPFLSSLVDKVRQLKVKPLNAVKLTLLLSIXTLVPKKVVTLVFNPFF

SEQ ID NO: 60566 - protein, 584 aa, Phaseolus vulgaris
MCGILAVLGCSDHSRAKRVRVLELSRRLKHRGPDWSGLHQHGDCFLAHQRLAIVDPASGDQPLFNEDKSVIVTVNGEIYNHEELRKQLPGHKFRTGSDCDVIAHLYEEHGEGFVDMLDGIFSFVLLDTRDNSFIVARDAIGVTSLYIGWGLDGSVWISSEMKGLNDDCEHFECFPPGHLYSSKDRGFRRWYNPPWFSEAIPSAPYDPLVLRRAFEQAVIKRLMTGVPFGVLLSGGLDSSLVASITSRYLANTKAAEQWGSKLHSFCVGLEGSPDLKAAKEVADYLGTVHHEFHFTVQDGIDAIEDVIYHVETYDVTTIRASTPMFLMSRKIKSLGVKWVISGEGSDEIFGGYLYFHKAPNKEEFHRETCRKIKALHQYDCLRANKSTFAWGLEARVPFLDKEFINAAMNIDPEHKMIKRDEGRIEKWILRRAFDDEDQPYLPKHILYRQKEQFSDGVGYSWIDGLKAHAAKHVTDKMMLNAGNIYPHNTPVTKEAYYYRMIFERFFPQNSARLTVPGGASVACSTAKAVEWDAAWSNNLDPSGRAALGVHISAYENQNNLANKGVEIEKIIPMDAAPLGVAIQS

SEQ ID NO: 60567 - protein, 1019 aa, Arabidopsis thaliana
MSSKRMDSGSKDIISNLPDALLCHVLSFLPTTEAASTSVLAKRWRFLLAFVPNLDLDNMIYDRPKMGRRKRLELRKSFKLFVDRVMALQGNAPLKKFSLRCKIGSDPSRVNGWVLKVLDRGVEELDLYIASEYEYPLPPKVLMTKTLVSLKVSGTDEFTIDVGEFFLPKLKTLHLSAISFGDEGGPPFAKLISACHALEELVMIKMMWDYWEFCSVSSPSLKRVSIDCENIDENPKSVSFDTPNLVYLEFTDTVAVKYPKVNFDSLVEASIGLRMTPDQVFDARDLVNRHHGYKRCKGANAADFMMGVCNVKTMYLSSEALEVLTFCCKKAIPVFNNLIHLTVETDERVDWESLPILLKNCPNLETLIFEGLHYGDLNQCFDKDYSFKDTNECYGDQGDTCQCKPWYGTPVWLSSSPVKILKVLKFGQISSYKDDMERQTDLIEHFLESMPNLEQMLEKVASPKCKIQVISDNISYSFTVYSSSSTKGLNFFKDTFPKKMDFVSRDRISSLPNPVVSHILSFLPTKEAASTSVLSKKWRYLFAYVTNLDFDDSDYQDGKPKSDVELSRSFMEFVDRVLALQGNGSVNKFSLECSNYDVDLARVTGWILNVLGRGVSELDLSILEYPLPSEIFVSKTLVRLKLGPANDLTLTLDRKDVFLPKLKTLYIDCVDVQERGFGFVKLLSGCPVLEELVLMNIGWENWKFCSVSVKTLKRLTFFCEETYENPKSVSFDTPNLVYLEYSDAIASKYPKVNFNSLVEAHIGLRLTEDQSGDADFSEEDYFSEGDEKKQMVGNATDFLKGISTVQILYLSAQAIEVLTFCCEPIPVFNNLIQLTIENNSEIRWDSLPGLLKNCPNLETLVLKRLLHKYNKACGNVCCCKRPKQPSCLSSSPVKVLKIFLFDDNDEEDGSEMRQIKYFLEKMPRLEELVVYYNTAYDPAVLELSKKLQKIPKIASPKCKIQVISENLSLSSTVPSFLTTRWSSLPPEEAYPWVDSPPPQIIDPMLEYGSPPEDDDSWLY

SEQ ID NO: 60568 - protein, 938 aa, Oryza sativa
MPPRKDPNGGAFPSEPAPPQPAKAKGKKKDENKDDDLSEEDQALKEQLELYVVRAQDPDPGVQKLALESMRQEIRSATSSMTSVPKPLKFLRPHYGILKAYFETMPESELKKYMADILSVLALTMSAEGERESLKYRMIGSEGDIGSWGHEYVRLYLEITLEFSVFLFPLFVIENKIGFSNNVNVSLARNLAGEIAQEFQKRQDDGMTTDSLKELVEQIVSFHMKHNAEPEAVDLLMEVEKLDLLVKHVDSTNYKRTCLYLTSSSKYLPAPDDMSALKIAFEIYMKFGDFANALRIALLLDDKSLELKQIFTATDDFHLKKQFAFIIARHGLSTDIDDDIAADENEKEALQDIISNIKLSEGYLTLARDIEVMEPKSPEDIYKVHLIDGRGATSSSLDSARQNLAATFVNAFVNAGFGQDKLMTAPSDSSGSGSSGNWLFKNKEHGKASAAASLGMILLWDSDSGLAQLDKYLHSNDIHVVAGALLGIGIVSCGVKSDCDPAFALISEYFSRDESIIRIGAILGLGIAYAGSQKEEVKILALGLAIPLVRENLTAFLSDSQVPLEVLVFAAISLGLVFVGSCNEEIAQTIICVLMEHSEPELAEPIIRLLPVALGLLYLGKQESVEATAEVSKTFDEKIRNYCDVTLMSLAYAGTGNVLKVQKLLGICSEHLEKGETHQGPAVLGISLISMAEELGAEMAVRSLERLLQYGEQNIRRAVPLALGLLCISNPKVNVMDTMSRLSHDADAEVSMAAIISLGLIGAGTNNARIAGMLRNLSSYYYKEAGHLFCVRIAQGLVHLGKGLLTLSPYHSDRFLLSPIALAGLVTVLHACLDMKSIILGKYHYMLYILALAMQPRMLLTVDEDLKPLSVPVCVGQAVDVVGQAGRPKTITGFQTHSTPVLLAAGERAELATEKYLPLTPVLEGFVILRNNPEYHED

SEQ ID NO: 60569 - protein, 180 aa, Chamaecyparis obtusa
LQHTLPGHGGAVSSVEFSKDGRLVGSGSVDKTIRLWSSSTGAFGRSLHGHTEGISDVAWSSDSRYICSASDDKTLKIWDVHTGDCVKTLKGHSNFVFTVNFNDHSNLIVSGSFDETVRIWDVKTGKCLRVIRAHTDPVTAADFNRDGSLIVSSSHDGSCKIWDASNGNCLKTLIDDKTPA

SEQ ID NO: 60570 - protein, 280 aa, Zea mays
PAGTPSVNRQIDEIREKLEEERSLPETRWVEIFTGPRMMYRTLLGITLQAGQQLTGINFFFYFGTTVFASTGLKDSYVTQLILGSVNCACTFGGLYVVQKCGRRISLMIGAAWMMMCFFIYAFVGHFALDRADPLNTPAAGTVLVTFSCLAIVAFATTWGPLVWHVNAELYPIRYRSVCMGIATASNWFWNFMISFFTRFITDDIDYFYGLIFAGCCAALVLVVFFFVIESKDRTLEEIDTMYVQHVNPITSSRWTPNKQHQNEVGEISDVRSHTQNSEK

SEQ ID NO: 60571 - protein, 210 aa, Photorhabdus luminescens subsp. laumondii TTO1
MTIKNHNYHMTRFITSAPDIRHLPQDMGIEVAFAGRSNAGKSSALNALTKQKSLARTSKTPGRTQLINLFEVEEGIRLVDLPGYGYAEVPEEMKRKWQKALGEYLQKRECLIGLVVLMDIRHPLKDLDQQMIQWAVAMQVPVMVLLTKADKLASGARKSQLNKVRDALLALNGDIQVEYFSVPKKIGIDKLHQKLDIWFSQKAVQVENHR

SEQ ID NO: 60572 - protein, 392 aa, Prochlorococcus marinus str. NATL2A
MTDKSQISIRALSIKPSLTLEISAKAKALKAEGKNICSLSAGEPDFDTPEFIVDATLKALKDGKTRYGPAAGDPELREAIAQKQSDINKVPTKTDNVLVTNGGKQAIYNLFQVVLNPGDEVLIPTPYWLSYPEITLLAGAKPIKIKSSTKDKFKIDINSLEEHVTEKTRLLIINSPSNPTGCVLTEQEMKTISDFLRRHPRILLMSDEIYEFLISPNQVHHSFAKIAPDLKNRIFTVNGFAKAWAMTGWRIGYLTGNAEVIKKAIALQSQSTSNVCSFAQKGAIAALQGSKDCVHEMANIYNKRRLLITERLKKIKHISFVPPNGAFYVFPEINLEEIDSISFCKLALEKVGLAIVPGIAFGDDKCIRISYAASNKMIEDGVNRLERLLNDF

SEQ ID NO: 60573 - protein, 156 aa, Haemophilus influenzae
NRTNTPVLVDGKDVMPEVNAVLAKMKDFCQRIISGEWKGYTGKAITDVVNIGIGGSDLGPYMVTEALRPYKNHLNMHFVSNVDGTHIAETLKKVNPETTLFLVASKTFTTQETMTNAQSARDWLLKAAKNESAVAKHFAALSTNAKDVEKFGIDTN

SEQ ID NO: 60574 - protein, 113 aa, Triticum aestivum
MAMAPSASVVSFSARPSAALRPRAASVTAGAGGRVRAGAPKGGKWWAPLVGWSGRADYMEAAAPTPVVEVEEKTFVGLTEEKARQLRARMSGMESFHDAMYHSAIASRLARST

SEQ ID NO: 60575 - protein, 347 aa, Oryza sativa (indica cultivar-group)
MAAAAAAASDDAAAAGGRFDFDVIVVGAGIMGSCAAHAAASRGARALLLERFDLLHHLGSSHGASRTIRDAYAKAHYPPMVRLARRLWADAEAESGYRVLTPAPQLTVGPPGDASLLAAVGNSGARRVDEDDLAGRWGGAFRGVPDGWVAAVSELGGGVLNATKSVAMFQALAVKGGAVVKPGRERELAAEAGFPTFSSHGDPHVYGTPSLELPGLIKINYDGGPPCDPDGRDWAGGGGDAASRVARWIEEFMPDHVEAAGGPVVRQPCMYSMTPDKDFVIDFLGGEFGDDVVVGAGFSGHGFKMGPAVGRILAEMAMDGEARTAAEAGVELRHFRISRFEGNAMGN

SEQ ID NO: 60576 - protein, 398 aa, Rhodopseudomonas palustris CGA009
MTKTFRTLDDVDVKGKRVLLRVDLNVPMDAGKVTDTTRLERVMPTITELSGKGAKVILLAHFGRPKGRDDKNSLKPVAAALADVIKKPVGFADDCIGEPAAKAIAAMADGDILCLENTRFHPEEEKNDPAFVAKLAELGDIWVNDAFSAAHRAHATTEGLGHKLPAYAGRTMQAELVALNKALEAPVKPVIAIVGGAKVSTKIDLLENLVTKVQALVIGGGMANTFLHAQGVKVGKSLCEKDLAPTALRILDKAEAANCAIILPVDATVAYHFEANAPSFAYGLDAIPDDAMILDVGPRSIERIHAAIDDAATLVWNGPVGAFELTPFDKGTVEAAKHAAKRTKAGKLVSVAGGGDTVAALNHAGVADDFTYISTAGGAFLEWMEGKPLPGVEVLQVK

SEQ ID NO: 60577 - protein, 484 aa, Cryptococcus neoformans var. neoformans JEC21
MPSPSPEASSSMSQPGPPSRSPSPASSNPDAPEASHNKTFADLGISPELCRACASMGFKKPSDIQAEAIPHALEGKDIIGLAQTGSGKTAAFSLPILQTLWENPQPFFALVLAPTRELAYQISQQVTSLGSGIGVRTAVLVGGMDMMSQSIALSKRPHIIVATPGRLMDHLENTKGFSLKSLKYLVMDEADRLLDLDFGPIIDKILKVIPKERNTYLFSATMTTKVAKLQRASLNKPVRVEVSSKYSTVSTLLQHYLLLPLKNKDAYLLYLANELSSSSMMIFTRTVADSQRLSIILRRLGFPAIPLHGQMTQSLRLASLNKFKSGGRSILVATDVASRGLDIPLVDLVINYDMPTNSKDYVHRVGRTARAGRSGKSITLVTQYDVEILQRIESHIGKKMTSFDVDKEAVALLTDTVAKANREAALEMRESGTGGGGGKRGRDKGKRKTFGDGDDRDRDDDVVEAGVPRKKNKFTPGGKKKARK

SEQ ID NO: 60578 - protein, 335 aa, Rhodopseudomonas palustris CGA009
MAVRVAINGFGRIGRNVLRAIYESGRKDIEVVAINDLGPVETNAHLLRFDSVHGRFPFEVKVDGDTIDAGRGKIKVTAIKDPSALPYKEVGVDIALECTGIFTARDKAATLLTAGAKRVLVSAPSDGADATIVYGVNHETLSKDHMVVSNGSCTTNCLAPVAKVLNDTVGIETGFMTTIHAYTGDQPTLDTMHKDLYRGRAAAMSMIPTSTGAAKAIGLVLPELKGKLDGVAIRVPTPNVSVVDLKIIAKKATTKEEINEAIKRAAEQELKGILGYTNAPNVSIDFNHDPHSSTFHMDQTKVQNGTLVRVMSWYDNEWGFSNRMADTAVAIGKLI

SEQ ID NO: 60579 - protein, 428 aa, Trichodesmium erythraeum IMS101
METAIESIQAREILDSRGRPTVEAEVHLVNGSMGLAQVPSGASTGSFEAHELRDGDKGRYSGKGVLTAVKNVEEQITPNLVKINALNQNLVDSKMIEIDGSPNKSNLGANAILAVSLATAKAAANSVGMPLYRYLGGPQASLLPVPLMNVINGGAHAANNVDIQEFMIVPVGATSFKEALRWGAEVFATLSGVLKDKGLLGGVGDEGGYAPNLGSNQEALDILIAAIEKAGYKPGEQVALALDVAASEFYKDGNYIYDGATHSPSELIDYLASLVDQYPIVSIEDGLHEEDWESWVQLTQKLGSKVQLVGDDLFVTNGSRLQKGIDMAAGNSILIKLNQIGSLSETLETIDLATRNSYRSVISHRSGETEDTTIADLAVGTRAGQIKTGSLCRSERVAKYNRLLRIEDELGDRAVYAGVIGLGPKSRS

SEQ ID NO: 60580 - protein, 661 aa, Rhodopseudomonas palustris CGA009
MAQVDHSRMANAIRALAMDAVEKAKSGHPGLPMGAADVATVLWTQFLKFDAVDPHWPDRDRFILSAGHGSMLLYALLYLTGNEELTLDQIKNFRQLDSKTPGHPENCITSSVETTTGPLGQGVASSVGTALAERLLQAEFGDIVDHYTYVLCSDGDLMEGVSHEAIALAGHLRLSKLIFLYDDNGISIDGPLSLTDTVDQVARFQAHGWNSFRIDGHDHKAIADAIRKAQASDRPTMIACKTTIGFGAPHKAGTSKAHGEPLGAEELAGAKKALGWDYGPFEIPDDVLSAWRNVGKQGASARADWLARFDALPADKRGDFKRRVIDRKRPAAIADAIRTLKDKLVAEPQTIATRKASELALEALTPVVPELLLGSADLTPSNNTRVKQAKDVTPDDFSGRYIHYGIREMGMAAAMNGLAMHGGFAPAGGTFLCFTDYARPSMRVAALSHVPVVYIMTHDSIGLGEDGPTHQPVEHLAALRAMPNMRVFRPADAVETAECWQLALENTNGPTLLALSRQNLAQVRTATSEANLCATGGYELIPAPGKAQVSIFATGSEVEIAVAAQKLLEVQGVAARVVSVPSLDLLLAQDDATRAAIIGDAPVKVAVEAAVRFGWDAVIGPDGGFVGMTGFGASAPAKDLYKHFGITAEAVADAAKRRLAA

SEQ ID NO: 60581 - protein, 715 aa, Escherichia coli; identical to SEQ ID NO: 58767
  misc_feature (140)..(140): Xaa can be any naturally occurring amino acid

SEQ ID NO: 60582 - protein, 180 aa, Chamaecyparis obtusa
LQHTLAGHGGAVSSVEFSKDGRLVGSGSVDKTIRLWSSSTGAFERSLHGHTEGISDVAWSSDSRYICSASDDKTLKIWDVHTGDCVKTLKGHSNFVFTVNFNDHSNLIVSGSFDETVRIWDVKTGKCLRVIHAHTDPVTAADFNRDGSLIVSSSHDGSCKIWDASNGNCLKTLIDDKAPA

SEQ ID NO: 60583 - protein, 435 aa, Oryza sativa (japonica cultivar-group)
MALHAAPPPPPPFTAGRLPTTSRRPCFSAGRIFRCSLPAAAARPRNAAFLAPLRTSSAVCTKAVSNSDGTPGTSSSPHVVCFGELLIDFVPTVNGVSLAEASAFKKAPGGAPANVAVGIARLGGSSAFIGKPQFELGRNIEKVFQPSSFSFKIKRLFFHYTLFNIQHMQVGDDEFGYMLADILKENNVNNQGLLFDAHARTALAFVTLRNDGEREFMFYRNPSADMLLEEKELDLDLIRKAKIFHHGSISLITEPCKTAHIAAAKAAKDAGVLISYDPNLRLPLWSSADDARDGILSIWETADVIKISEEEVSFLTKGEDPYDDSVIKKLMHPNLKLLLVTEGPEGCRYYSKEFNGRVGGLKVNAVDTTGAGDAFVAGILSQLSVDFSLLQDEGRLKEALKFANVCGALTVTERGAIPALPTRQQVVDALTKVVA

SEQ ID NO: 60584 - protein, 227 aa, Gibberella zeae PH-1
MASSQPTRWAALARDTNETKIQLALNLDGGDFPPDTDSRLLDNDDSHASQASKSQKIAVNTGIGFLDHMLHALAKHAGWSLALNCKGDLHIDDHHTAEDVCIALGYAFAQALGTPAGLARFGYAYAPLDEALSRAVIDLSNRPYAVVDLGLKREWLGQLSTEMVPHCLQSFAQGARVTLHVHCLHGDNDHHRAESAFKALAIAVKAATTRIPGKEGEVPSTKGTLSA

SEQ ID NO: 60585 - protein, 429 aa, Vibrio parahaemolyticus RIMD 2210633
MADKKATLHVEGQAPIELPIMDGTLGTPVIDVRKLGANGYFTFDPGFLATASCESSITYIDGGKGILLHRGYPIDQLANNADYLEVCYILLYGEAPTREQYEQFKTTVTRHTMVHEQIASFFHGFRRDAHPMAVMCGVVGALAAFYHDSLDINNDEHREIAAYRLLSKMPTLAAMCFKYSVGQPFIYPRNDLSYAENFLHMMFANPCEEYEVNPVVARAMDKIFTLHADHEQNASTSTVRLAGSSGANPFACIAAGIASLWGPAHGGANEACLKMLEEIGSVDNIPEYVERAKDKDDPFRLMGFGHRVYKNYDPRATVMRETCHEVLKELNIKDPLLDVAMELERIALSDEYFVSKKLYPNVDFYSGIILKAIGIPVSMFTVIFAISRTIGWIAHWNEMHSDPLNRIGRPRQLYKGETQREFSPLHERE

SEQ ID NO: 60586 - protein, 435 aa, Glycine max
MASKTADTTQKTPGSAPPQPDNQEIMNQVVEKTDDEVANLIKLFDNNIRAMKNEEKRLGHEIKNAQARIKENQEKIKLNKQLPYLVSNIVEVLDVEPDEEDGDDVPAAPVQRTEKAVVVKTSTRQTIFLPIPGLVDVSELRPSDLVGVNKDSFLILEKLPAEYDARVKAMEVEERPTEEFTDIGGLEKQIEELREAIVLPIAHKDKFKNLGIRPPKGVLMHGPPGVGKTMMARACAAQTSATFLKLAGPQLVQMFIGDGAKIVRDAFALAKERAPAVIFIDELDAIGTKRFDSDTSGDREVQRTMLELLNQLDGFSSAEDIKVIAATNRPDILDPALLRSGRLDRKIEFPLPNEEARGQIMKIHSRKMNVSKKDVNFQELARSTDEFNGAQLKAVCVEAGMSALRRGATFLVHEDFLDGIAQVQAKKKNELDYFA

SEQ ID NO: 60587 - protein, 256 aa, Rubrobacter xylanophilus DSM 9941
MAGERRPLMAANWKMNKTVREAQDYMAALLPRVADLAGEVDVAVFAPFTCLSEVARMAEGSGVLAGAQNFFYEDSGAYTGEVSAPMLLDVGARASIVGHSERRELFCETDESVARKARRAVEAGLLPVVCVGETEEERDAGRMWEKVSGQVRAVVEGLGDASGGRVVFAYEPIWAIGTGKTASPEDAQDAIGRIRGLLRELRGEGFAEEARLLYGGSIKPENISEIMAQKDVDGGLVGGASLEVGSFLQLVEAARG

SEQ ID NO: 60588 - protein, 562 aa, Zea mays
  misc_feature (436)..(436): Xaa can be any naturally occurring amino acid
MMANRLAGHLNAMVSPNQTAFIKKRFILDNFILVQRTARYLHQQRQARILFKLDISKAFDSVSWPFLIEVLRKMGFGQIWLSLYADDAVVFLRPVASDINLVLEILRLFGEASGLKTNIPRVNILPLSLGKLSKAQLQALVDKAANVLPGWKADLMTKAGRAVYVQFVLTAKMIYAAMALDLPNWTIKAIDKVRRGFLWKGRKQANGGHCLVAWGKVTRPKDLGGLGITDLRLLSVALRARWPWLQRTDHSKPWSVLPAQACGAVEALINVAVVSQFGDGHDILFWKDRWLNGRCIGEVAPVVLEHVPKRVASKRLGTSQVLCPSTGDDCFDSWWEKSAEVVGKPLSDGFNSLVILVEKEKPSQLFGTYDFDSSPFDWGDNYKLPNLPETDLVIYEMNVRAFTADESSKLGPAIRGSYLGVIDKIPHLLELGVNAXELLPVFEFDELEFKRFPNPRDHMVNTWGYSTINFFAPMSRYASAGGGPVAASKEFKQMVKAFHNAGIEVILDVVYNHTNEADDANPYMTSFRGLDNKVYYILDLNNSAQLLNFSGCGKTMVLSFSF

SEQ ID NO: 60589 - protein, 1123 aa, Solanum lycopersicum
MSSSRPSQSSTTSSRSKHSARIVAQTSIDAKLHADFEESGDSFDYSSSVRVTSVAGDEEKPKSDKVTTAYLHQIQKGKFIQPFGCLLALDEKTLKVIAFSENAPEMLTMVSHAVPSVGEHPVLGIGTDIRTIFTGPSGAALQKALGFGEVSLLNPVLVHCKNSGKPFYAIVHRVTGSLILDFEPVKPYEVPMTAAGALQSYKLAAKAITRLQSLPSGSMERLCDTMVQEVFELTGYDRVMGYKFHEDDHGEVVSEITKPGLEPYLGLHYPATDIPQAARFLFMKNKVRMICDCRAKHVKVVQDEKLPFDLTLCGSTLRAPHYCHLQYMENMNSIASLVMAVVVNDGDEEGESSDSSQSQKRKRLWGLVVCHNTTPRFVPFPLRYACEFLAQVFAIHVNKELELENQFLEKNILRTQTLLCDMLMRDAPLGIVSQSPNIMDLVKCDGAALLYKNKIHRLGMNPSDFQLQDIVSWLCEYHTDSTGLSTDSLYDAGFPGALALGDAVCGMAAVRISDKDWLFWFRSHTAAEVRWGGAKHEPGEKDDGRKMHPRSSFKAFLEVVKTRSIPWKDYEMDAIHSLQLILRNAFKDAEVVNSNTNSIYKKLNDLKIDGMQELESVTAEMVRLIETALVPILAVDVDGQVNGWNTKIAELTGLPVDEAIGKHLLTLVEDSSVDTVNKMLELALQGKEEKNVEFEIKTHGPSRDSSPISLIVNACASKDVRDNVVGVCFMAHDITGQKSIMDKFTRIEGDYRAIIQNPHPLIPPIFGTDQFGWCSEWNTAMTKLTGWRRDDVMDKMLLGEVFGTQAACCRLKNQEAFVNFGVVLNNAITGQESEKIPFGFFARYGKYVECLLCVSKRLDKEGAVTGLFCFLQLASHELQQALYVQRLSEQTALKRLKVLAYIRRQIRNPLSGIIFSRKMLEGTSLGEEQKNILHTSAQCQRQLNKILDDTDLDSIIDGYLDLEMLEFKLHEVLVASISQVMMKSNGKNIMISNDMVEDLLNETLYGDSPRLQQVLANFLLVSVNATPSGGQLSISGRLTKDRIGESVQLALLEFRIRHTGGGVPEELLGQMFGSEADASEEGISLLVSRKLVKLMNGEVQYLREAGQSTFIISVELAVATNSS

SEQ ID NO: 60590 - protein, 392 aa, Rubrobacter xylanophilus DSM 9941
MDKRSVRDLELRGKKVLVRVDFNVPVKGGEVTDDTRIRRALPTIRYLLQRGARVALISHLGRPKGEPDPRYRMDPVARRLEELLGEPVRKLDTATGPEVGRALEELERGVILLENSRFYPGETKNDPAFAAELAGPFDLYVNDAFGAAHRAHATTVGVAERLPAAAGFLLEQELDYLDGVLRSPERPFVAILGGAKVSDKLGVIESLLGVADRLLVGGAMCFTFLKARGLGVGASLVEDDYLGEARRLMEGAADRLVLPVDVVVAERMEEGARTRTVPVEEIPEGWMGLDIGPRTVELFRRHILQARTIFWNGPMGVFEIDAFARGTEGVARAVAESGATSVVGGGDSVAAVRKLGLEDRMSHISTGGGASLEYVEGRELPGVAVLPEREEV

SEQ ID NO: 60591 - protein, 333 aa, Rubrobacter xylanophilus DSM 9941
MAVRIGINGFGRIGMLVAKAAMQRGDVEVVAVNDLMPMESLALLFKRDSTHGIWDEDVALEGSVLRVGDRQIKTFSEREPSGIPWGDVGADIVVEATGKFTSRDGAAGHLEGGAKKVVISAPAKGADATFVYKVNHETYDPDNHQVVSNASCTTNCIIPMVKVLQDNFGIESGFMTTCHAYTNDQSLLDAAHKDPRRARSAPNNIVPTSTGAARTAGVIYPELRGKVDGMALRVPVPDGSITDFVAELSREASVEEVNGAFRRAAEGELSGILEYSEAPIVSQDIVGNPASCIFDAPLTMSTGRTVKVLGWYDNEWGYSNRTVDLVSYIGERL

SEQ ID NO: 60592 - protein, 1499 aa, Oryza sativa (indica cultivar-group)
MEKVWESGRRMSRSIGRGMGMEAWGVDEAFMPQNSGGGGGSRGRRRSGRGGTADDDEEALRWAAIERLPTYSRMRTAILSSAEEEAAAAAGAGKQQYKEVDVRRLGVGERQEFIERVFRVAEEDNQRFLQKLRNRIDRVGIELPTVEVRFEELMVQARCHVGSRALPTLLNTARNIAEAALGLVGVRPGRQATLTILRGVSGAVRPSRMTLLLGPPSSGKTTLLLALAGKLDPSLRRGGEVTYNGFELEEFVAQKTAAYISQTDVHVGEMTVKETLDFSARCQGVGTKYDLLTELARREKEAGIRPEPEVDLFMKATSMEGVESSLQTDYTLRILGLDICADTIVGDQMQRGISGGQKKRVTTGEMIVGPTKVLFMDEISTGLDSSTTFQIVKCLQQIVHLGEATILMSLLQPAPETFELFDDIILLSEGQIVYQGPREYVLEFFESCGFRCPERKGTADFLQEVTSKKDQEQYWADKHRPYRYISVSEFAQRFKRFHVGLQLENHLSVPFDKTRSHQAALVFSKQSVSTTELLKASFAKEWLLIKRNSFVYIFKTIQLIIVALVASTVFLRTQMHTRNLDDGFVYIGALLFSLIVNMFNGFAELSLTITRLPVFFKHRDLLFYPAWIFTLPNVILRIPFSIIESIVWVIVTYYTIGFAPEADRFFKQLLLVFLIQQMAGGLFRATAGLCRSMIIAQTGGALALLIFFVLGGFLLPKAFIPKWWIWGYWVSPLMYGYNALAVNEFYSPRWMNKFVLDNNGVPKRLGIALMEGANIFTDKNWFWIGAAGLLGFTIFFNVLFTLSLVYLNPLGKPQAVISEETAKEAEGNGDARHTVRNGSTKSNGGNHKEMREMRLSARLSNSSSNGVSRLMSIGSNEAGPRRGMVLPFTPLSMSFDDVNYYVDMPAEMKQQGVVDDRLQLLRDVTGSFRPAVLTALMGVSGAGKTTLMDVLAGRKTGGYIEGDMRISGYPKNQETFARISGYCEQNDIHSPQVTVRESLIYSAFLRLPEKIGDQEITDDIKIQFVDEVMELVELDNLKDALVGLPGITGLSTEQRKRLTIAVELVANPSIIFMDEPTSGLDARAAAIVMRTVRNTVDTGRTVVCTIHQPSIDIFEAFDELLLLKRGGQVIYSGQLGRNSQKMIEYFEAIPGVPKIKDKYNPATWMLEVSSVAAEVRLNMDFAEYYKTSDLYKQNKVLVNQLSQPEPGTSDLHFPTKYSQSTIGQFRACLWKQWLTYWRSPDYNLVRFSFTLFTALLLGTIFWKIGTKMGNANSLRMVIGAMYTAVMFIGINNCATVQPIVSIERTVFYRERAAGMYSAMPYAIAQVVMEIPYVFVQTAYYTLIVYAMMSFQWTAAKFFWFFFVSYFSFLYFTYYGMMTVAISPNHEVAAIFAAAFYSLFNLFSGFFIPRPRIPKWWIWYYWLCPLAWTVYGLIVTQYGDLEQIISVPGQSNQTISYYVTHHFGYHRKFMPVVAPVLVLFAVFFAFMYAICIKKLNFQHR

SEQ ID NO: 60593 - protein, 422 aa, Vibrio angustum S14
MKDETLSIHSGYETDPTTKSVATPIYQTVAYEFDDAQHGADLFNLEVPGNIYTRIMNPTNDVLEKRMAALEGGIAGLVVSAGSAAINYAILTLAQAGDNIVSTPQLYGGTYTLFAHMLSSQGIEVRFAKDDKPESMAALIDENTKAVYCESIGNPSGNIIDLERVSQLAHDKGVPVIVDNTVATPVLCKPIEFGADIVVHSLTKYVGGHGTTLGGVIVDSGKFPWAQYKDRFPVFSQPEPSYHGVVYNEAFGEAAFIGRARTVPLRNTGAALSPMNAFMLMQGLETLPLRMERHTENALKVAQYLANHDQVSWVNYAGLPDSDYYELSQKYTKGKPSAILSFGLKDGYEAGVRFYDALGLFKRLVNIGDAKSLACHPASTTHRQMTPEEQCQAGVHPEMIRLSIGIEHVDDIIADLEQALNA

SEQ ID NO: 60594 - protein, 480 aa, Pseudomonas syringae pv. tomato str. DC3000; identical to SEQ ID NO: 1197

SEQ ID NO: 60595 - protein, 426 aa, Pseudomonas syringae pv. tomato str. DC3000
MSQTNESLMQRRHAAVPRGVGQIHPIFAASAKNATVTDVEGREFIDFAGGIAVLNTGHLHPKIVAAVQEQLTKLTHTCFQVLAYEPYVELCEKINAKVPGDFDKKTLLVTTGSEAVENAVKIARAATGRAGVIAFTGAYHGRTMMTLGLTGKVVPYSAGMGLMPGGIFRALYPCELHGVSVDDSIASIERIFKNDAEPRDIAAIIIEPVQGEGGFYVAPKAFMLRLRELCDKHGILLIADEVQTGAGRTGTFFAMEQMGVAADLTTFAKSIAGGFPLAGVCGKAEYMDAIAPGGLGGTYAGSPVACAAALAVLDIFEEEHLLERCKTVGERLVTALKGMQAKYPVIGEVRALGAMIAVELFEDGDSHKPNAAAVAQVVAKARDKGLILLSCGTYGNVLRVLVPLTAEEELLTRGLAILDECFAEIA

SEQ ID NO: 60596 - protein, 435 aa, Agrobacterium tumefaciens str. C58
MTLDLSKFAAEKGIKYFMISYTDLFGGQRAKLVPAEAIADMQKGGAGFAGFATWFDLTPAHPDLFAVPDASSVIQLPWKKDVAWVAADCVMEDQPVEQAPRVMLKKLIAEAAGEGLRVKTGVEPEFFLISPDGAKISDEYDTAEKPCYDQQAVMRRYDVIAEICDYMLELGWKPYQNDHEDANGQFEMNWEYDDALQTADKHSFFKFMVKSVAEKHGLRATFMPKPFKGLTGNGCHAHISVWDMDGKVNAFADKEMPFGLSAKGKTFLGGIMKHASALAAVTNPTVNSYKRINAPRTISGATWAPNTVTWTGNNRTHMVRVPGPGRFELRLPDGAVNPYLLQAIIIAAGLSGVRSKADPGPHYDIDMYREGHTVTDAPKLPLNLLDALREYEKDAELQQALGMEFSKAYLKLKQGEWNSYCAQFTAWEHQTTLDV

SEQ ID NO: 60597 - protein, 114 aa, Brassica napus
  misc_feature (27)..(27): Xaa can be any naturally occurring amino acid
  misc_feature (101)..(101): Xaa can be any naturally occurring amino acid
PRVRVTSDGYVRVFNLRDKEHSTIIHXSPEPDIPLVHHGWNKHDPTYMATIITDSAKVVMLDSRFPALPVVELQRHHASVNAITWAPHSSCHICFAGDDSXALIWEISSMGHHG

SEQ ID NO: 60598 - protein, 256 aa, Glycine max
MSSADTFNASSAESVKEPVIGSSLEVKQDDAEIKAQVDAMWEQMNKGVSNKTLNKFTSKPNSTSKKTAKKSSSNWMSYLGLAPTATESLGQGASKNGPGVLQSSTSDEVKKLAAAALAAVKDDAAIAASSRGKLVITEVRDFAGQDIEVKKLVDSDSKEAMERAKAPPLSAVDAVLEQIKKKQKLSVLDKTKKDWGEFKEEKRLEEELDAYKKSSNQYLDKVSFLQRADYREFERERDARLALQSRKRPDNMQEDD

SEQ ID NO: 60599 - protein, 412 aa, Pseudomonas syringae pv. tomato str. DC3000
MLIATFFFTSHFSRAKQPMWYNGLLDLSVWQVIAVTLAMTHVTIVGVTVYLHRYSAHRSLELNAGLKHFFRFWLWLTTAQNTREWTAIHRKHHAKCETVDDPHSPVVKGLSTVLRKGAELYREEAQNQDTLRIYGKNCPEDWIERNLYSRYKMLGIVLMAVIDLALFGAIGITVWAIQMMWIPFWAAGVVNGLGHAVGYRNFECRDAATNLVPWGIVIGGEELHNNHHTYPNSAKLSVKPWEFDMGWAWIKLFSFLRLAKVQRVAPIAHRVEGKGHIDMDTAMAILNNRFQIMAQYRKLVIAPLVTQELAKADESVRHQFRRAKRLLSRETSLLDDKHHLRIQTMLEHSHALKVIYEKRLALQQIWVKTSSNGHDMLSAMKEWIHEAEASGIQSLREFADQLKTYSLRPVHA

SEQ ID NO: 60600 - protein, 767 aa, Aspergillus oryzae
MESTPIRHTYYIERVSGLGMDSVNTVSTCTRHFGALFLNFYSPITTGNITSTSSPRTSSSIPLQSLEYRFQPTPVQSVRARESASEKGSRRSSLSAQSVESEYSLWTDTGDLAEQLANEEDPLRVRLGEPLDREISSPSGSRARVKQLKRVHYPNESNLVTEQAEPEKTSIEIPRPPPRHISRVERLLAVIMSPSNRQTAQMHGLVGKPLLYFTSVFVSLGVFLFGYDQGVMSGIITGWYFKDYFNQPSRAAIGTVVAILEVGAFISSLLVGRIGDLIGRRRTILYGSIVFFIGGALQTFANGLAMMMVGRIVAGLGVGALSTIVPVYQSEISPPHNRGKLACIEFTGNISGYAASVWVDYFCSFIDNNYSWRLPLLCQCIMGALLGLGSLVICESPRWLLDNDYDEEGMVVIANLYGQGDLHNDKARQEYREIKMDVLLQRQEGERSYTDMFKRYRKRVFIAMSAQALAQLNGINVISYYAPLVFESAGWAGRDAILMTGINAISYLASTVPPWYLVDRWGRRPILLSGAVAMIVSLSLISYFIFIDVAATPTLTVILVMIYNAAFGASWGPIPWLYPPEILPLSIRAKGASLSTATNWAFNWLVGELTPILQAVIKWRLYLVHAFFCACSFVLVYFLYPETSGVRLEDMDTLFGDATTAMPTPASQGEHGSLMSISSPVPSLDIRRQYSQFGPENAIPGLDIDPPTINAGENAKVGQRGSRDGGGGRLEGLGGWISNMVSRHKGSSGQRLQGTQYRRLGQDDENE

SEQ ID NO: 60601 - protein, 499 aa, Sphingomonas xenophaga
MATQLKSGTNEYGIKSEYGHFIGGEWISSDSGKTIDLINPATGAVLTKIQAGNAKDIQRAVAAAKAAFPKWADSSAAERQEILIEVARRLKARHQHYATLETLNNGKPIRESMHFDMPQAIGQFELFAGAAYGLHGQTMDYPDAVGIVHREPLGVCAQIIPWNVPMLMMACKIAPALASGNTVVLKPAETVCLSVIEFFVEMADLLPPGVINVVTGYGADVGEALVTHEDVRKVAFTGSVGTARRIMQYASTNIIPQTLELGGKSAHIVCADADIDAAVESATMSTVLNKGEVCLAGSRLFLHESIQDEFLAKFKVALEGIRQGDPLDFATQLGAQASQMQMDKVISYLELATEEGANVLTGGSANDKLADGNFIRPTVFTNVNNSMRIAREEIFGPVTSVISWKDEDDMMKVANDTNYGLAGGIWTRDIARAHRMARKLETGTVWINRYYNLKANMPLGGYKQSGFGREFSHEVLNHYTQTKSVVVNLQEGRTGMFDQ

SEQ ID NO: 60602 - protein, 305 aa, Methanosarcina mazei Go1
MVKPEKFIPKAIEKISKEIKDGKAIIALSGGVDSSVCAELAYRAIGDRLQPIYIDTGLMRKGETERIRHIFSHMNLDVVYAKDRFLAALAGVTDPEEKRKAIGETFIRVFEEEARKLAADYLIQGTIYPDRIESEGGIKSHHNVGGLPSVMDFKKIVEPIEDLYKDEVREVAWALQLPDEICERMPFPGPGLAVRVLGEVTEEKLEVAREANFIVEEELLERFCPWQTFAAVLGKGTGVKGDVRAYGWIVAIRAVGSRDGMTAEALELPWEVLKHLESRITSEIPKVARVVYDITPKPPATIEFE

SEQ ID NO: 60603 - protein, 233 aa, Thujopsis dolabrata
APFMVNAYPYFAYRDNPKEVSLDYVLFGQSPGVKDPKGFTYNNMLDAQIDSVYSAMAALGHNDSIPVSVSETGWPSKGDPADIGVTPENARNYNTRVIKHVTSNAGTPMRPNRVIDTYIFALFNENQKPGPTTERNFGLLQPDGSKVYDIDLSCGYCGAAAPAPAPPPPAPLPMQWSRPANAGRQPGAIWCIAKPNADPSVLQESLDFSCGQGGADCAAIREGAPCYSPNTVH

SEQ ID NO: 60604 - protein, 233 aa, Chamaecyparis formosensis
APFMVNAYPYFAYRDNPKEVSLDYVLFGQSPGVKDPKGFTYNNMLDAQIDSVYSAMAALGHNDSIPVSISETGWPSKGDPADIGVTPENAKNYNTRVIKHVTSNAGTPMRPNRVIDTYIFALFNENQKPGPNTERNFGLLQPDGSKVYDIDLSCGYCGAAAPAPAPPPPAPLPMQWSRPANAGRQPGAIWCIAKPSADPSVLQESLDFSCGQGGADCAAIRQGGPCYSPNTVH

SEQ ID NO: 60605 - protein, 331 aa, Camellia sinensis
MEVERVQALSHVTLHELPAKFIRPVHEQPENSKAIEGVTVPVISLSQPHDVVVDALSKACSEWGFFLITDHGVEPSLIGRLKEVGEEFFNLPQKEKESYANDPSSGSFEGYGTKMTKNFDEKVEWIDYYFHVMHPPKKLNLDMWPKNPSSYRGVTEEYNVEIMRTTNKLFELLSEGLGLDGKVLSSSLGGDEIEFEMKINMYPPCPQPQLALGVEPHTDMSALTLLVPNDVPGLQVWKDGNWVAVNYLPNALFVHVGDQLEVLSNGKYKSVLHRSLVNKERTRMSWAVFVVPPHEAVIGPLPELIDEKNPAKYSTKTYAEYRHRKFNKIPQ

SEQ ID NO: 60606 - protein, 451 aa, Pasteurella multocida subsp. multocida str. Pm70
MTKHYDYLAIGGGSGGIASINRAASYGKKCAIIEAKALGGTCVNVGCVPKKVMWYGAQIAEAIHQYAPDYGFDLQVNKFDFAKLVESRQAYISRIHTSYHNVLAKNNVDVIQGFAKFVNANTVEVNGEHITADHILIATGGRPSHPAIPGAEYGIDSDGVFALSELPKRVAVVGAGYIAVELAGVMNSFGVKTHLFVRQHAPLRHFDPLIVDTLLEVIQQDGIQLHTQAIPQEVVKNADGSLTIKLEDGRSQEVDCLIWAIGRHPATDTINLEASGVETNARGFVKVDKYQNTNVEGIYAVGDIIEGGIELTPVAVAAGRRLSERLFNNKPNEHLDYNLVPTVVFSHPPIGTIGLTEPKAIEQYGEENVKVYKSSFTPMYSAVTQHRQPCRMKLVCVGKEEKIVGLHGIGFGVDEMIQGFAVAIKMGATKADFDNTVAIHPTGSEEFVTMR

SEQ ID NO: 60607 - protein, 233 aa, Chamaecyparis pisifera
APFMVNAYPYFAYRDNPKEVSLDYVLFGQSPGVKDPKGFTYNNMLDAQIDSVYSAMAALGHNDSIPVSISETGWPSKGDPADIGVTPENAKNYNTRVIKHVTSNAGTPMRPNRVIDTYIFALFNENQKPGPNTERNFGLLQPDGSKVYDIDLSCGYCGGVAPAPAPPPPAPLPMQWSRPANAGRQPGAIWCIAKPSADPSVLQESLDFSCGQGGADCAAIRQGGPCYSPNTVH

SEQ ID NO: 60608 - protein, 1028 aa, Cryptococcus neoformans var. neoformans B-3501A
MRFSSRDEEPEDGEVVEDDAVWKNPLATTKYLKGAPSVSSSQKTSSYKKSRPSFIPSLDPADDDGHRPRRPPPPSLSSPPYQQSRHRSSSHNRKTISYEDEERGSGMQHALPKNPQTRLYPHSTEMREPEQRREDKYAKEPRSPHRREGYYSSRRGDGRDYPPQLDRERYGPARRLESGGDGGYGDRSRDRNMDRGGYRDKDDRRSYGRPSDSSAWGRPPREEYRDRRPEEFARHPTGERYREDSRERFPVDRDTGQRRSCSPVRIRSPERSSDRPLTPVPDNGRTSSPDHGAKNIASSRGHRSSPSHSSNHEDHNGEKGNGPIKLNRNRHRPSLPLKHISTQPPRSPSAPPPPPPPDPSTVPPSPTEPPPPMPGNLSLEQTVPHAPNPRAQMATRPPSPKREEGEIRQETESVVFKFKLWTAEEELKALGKNFGGSSTLMRYNMGTKLGEGTFGVVTKAVENDTKRAVALKKITQHNFRDGAHITTLREIKILKSLQHPNVVPLLNMVISRHDNHSENTFIKNEVFMVFPYMDHDLCGLLSNNDFKVNHSGAKCIMKQLLDGMAYIHSNNIIHRDIKTANILVDKHGQIMIADFGLARPWTDNKKMPPHLATEYTNMVVTRWYRAPELLLGWCNYGPAVDIWSIGCVLGEMYLRRPILPGGGDREQLSMIFAKCGPLNEETWSGWQDLPGFPEAHGFAWDKTPRDTSILEESKSWHMDRGGADLLVKLLSLDPSKRPTASEALDHPWFWVSPKPAETINLDFAASHEMSAWHKQPAAAPVQPPPQKAYQTQQAYQSQQTHHAQQIYQPQQPYVAYQSGYGNQQRGHGGYQQQTANATRHNLAMNPYASSQVGNAQGYNQQPYMQAQGVSNMPPGADAYGGINPYGAPVAYNTASLPPPNMAYNGQSSFNGGGGLTGGGGQQYSLPHQPYLPSGPPPMMHGNVNRPSRPPPPTSSEGRPLAAAPFPLAGGGGGGMKTFAPPPPFSLAGGGGGGRGGMPPTMKRPPSDSRRDFGGDHKRQRTEAPLPYD

SEQ ID NO: 60609 - protein, 233 aa, Chamaecyparis obtusa
APFMVNAYPYFAYRDNPKEVSLDYVLFGQSPGVKDPKGFTYNNMLDAQIDSVYSAMAALGHKDSIPVSISETGWPSKGDPADIGVTPENAKNYNTRVIKHVTSNAGTPMRPNRVIDTYIFALFNENQKPGPNTERNFGLLQPDGSKVYDIDLSCGYCGAAAPAPAPPPPAPLPMQWSRPANAGRQPGAIWCIAKPSADPSVLQESLDFSCGQGGADCAAIRQGGPCYSPNTVH

SEQ ID NO: 60610 - protein, 501 aa, Rubrobacter xylanophilus DSM 9941
MGIMRTKSIEQSIRDTDHPDFRLRKALGALDLTLFGIGVIIGTGIFVLTGVAAATNAGPAIALSFVVAGVACALAALCYAEFASTVPVAGSAYTFSYAALGEFLAWIIGWDLVLEFIVGASAVSVGWSGYFNSVLQSFFGITLPESLLAAPGDGGVVNLPAVGIVVLLVIVLVLGITLSSRVNQVITTIKLLVVLFFIVYGIWFVNPENWSPFLPPREPAPAGEGFSFSQTTLWELLFGSAGSFGFTGMITGASIVFFAYIGFDIVATTAEETRNPQRDLPIGILGSLAICTVLYVLVSLIMTGLVPYQQLNTASPMATALSRLGLDWAAGLVSIGAICGLTTVTMILMLGQSRVAFAMSRDRLLPPWFAKVHPRFRTPYRITITTGVVVALLAGFVPLGTLAELVNIGTLFAFVLVSIGVIVLRRTRPDLHRAFRTPLVPVVPILAALVCIYLMLNLAVGTWIRFLVWMAIGLVLYFVYSMHHSRLAVGEDIEEVAEEAR

SEQ ID NO: 60611 - protein, 469 aa, Synechocystis sp. PCC 6803
MLSTEMPLPTTGSTLLKTPASPSPNQNLLPLTAVINKNGELEIGGCSVPALVEQFGSPLYILDETTLRQAAQQYRQSFQAHYPGSSQVIYASKAWSCLAVVAIAAQEGLGFDVVSGGELFTTVSALKQLGWDEAEIAEKIYFHGNNKSVQELQEAIAINCTIIVDNWLELETLTKLAADSGAPVKIMLRLTPGIECHTHEYIKTGHLDSKFGFDPNQLEAVFTYIAQQPSLHCLGLHAHIGSQIFERQPHKDLGEVLVQWFTKGLTYGLPLTELNIGGGLGICYTESDDPPSIEEWAQVAAISVAKACDRQNIPYPKLIAEPGRSLVGSACVTAYRVGGRKVVPNIRTYISVDGGMSDNPRPITYQSVYRVALANRMNDEITETVTVAGKHCESGDILVKDVALPAAEPGDIMVVAATGAYNHSMASNYNRLGRPAAVLVNQGQANLILQRETYTDLLRQDCLPNRLLS

SEQ ID NO: 60612 - protein, 353 aa, Zea mays
MAKYGEGDKRWIVEERADGTNVHNWHWAERDCIEWSRARLSSLLAGLTVLDGEDGLTLRTVALDNLDGEAYVNIRKGKVIPGYELSLTLSWEAEAASESGAVKVAGTAEVPYLADENADEDPDLHITVRGDETPLALRAKDAFLSRGKPMVLEKIREFVAAMAKGGPAKDELDSKKTPAKVAAAAPGAAPAKKEEVVAPAPAAGKKKAKGKDKEGFKTIKMTETFYCRSKDIYEILMDENRWKGFTQSNAKISREVGGEFSLFDGCITGVNEDLQEGKLIAQKWRFGSWPDGLYSSVRLMLDEPESGVTVIKLKQTGVPEEDKYGNSTVVENTERGWRDLIFQRIRGMFGFGI

SEQ ID NO: 60613 - protein, 668 aa, Pasteurella multocida subsp. multocida str. Pm70
MATRRELANAIRFLSMDAVQKAKSGHPGAPMGMADIAEVLWRDFLKHNPSNPHWADRDRFILSNGHGSMLIYSLLHLSGYDLSIEDLKQFRQLHSKTPGHPEYGYAPGVETTTGPLGQGITNAVGFAIAEKTLAHQFNRPGHEIVDHHTYVFLGDGCLMEGISHEACSLAGTLGLGKLIAFYDDNNISIDGHVDGWFTDDTQKRFEAYGWHVIPAVDGHNPEQILEAVKQAQAETTKPTLIICKTIIGYGSPNKANSHDCHGAPLGDDEIAAAREFLKWEHAPFEIPAEIYAQWDAKEKGQVAEKAWEEKLAAYAKAYPELAAEFTRRVNAELPANWAAESQAFIEHLQANPANIASRKASQNAIEAYAKLLPEFLGGSADLASSNLTLWSGSKPIRAVENADGNYINYGVREFGMSAIMNGIALHGGFIPYGATFLMFMEYAHNAVRMAALMKQRSLFVYTHDSIGLGEDGPTHQPVEQTSALRLIPNLETWRPCDQVESAVAWKAAVERKEGPSALIFTRQNLAQMDRTAEQLANVARGGYVLRHCCENQNCPDLILIATGSEVELAMKAADVLDAEGVKVRVVSMPSTNVFDKQDAAYRESVLPSHITKRVAIEAGIADFWYKYVGFEGRVVGMNSFGESAPADQLFKLFGFTVENIVEKAKAIL

SEQ ID NO: 60614 - protein, 170 aa, Synechococcus sp. WH 7805
MTMLFASLSAPLQLLDNGPLAWGLAACGLAQLSKLFIELVIQRRWRPEVLIETGGMPSSHSALVTGTAAAVGWLNGFDSPVFALASTVAFVVMYDASGVRRAAGFTAERVNALPNGLWDPEPEQALKESLGHSRLEVLVGSLLGPAIALPGLVFVGSPLHLIQVLSHAFG

SEQ ID NO: 60615 - protein, 581 aa, Vibrio vulnificus YJ016
MLIKTGHCSRFGLDCLARTTSIIKSICYMAMEQKTADVSFDSLLKIFTIPEGPDSTLTQIEAKLSQNLNKFLGEHIVAEEKPLREIEKDFSSAQIPERPSFVSDHTEHLLNTLVSHSVHTSSPSFIGHMTSALPYFLMPLSKIMIALNQNLVKIETSKAFTPLERQVLGMLHRLIYSQDEAFYSHWMHSAEHSLGAFCSGGTIANITALWVARNNALRAQGDFKGVEKEGLFRAMKHYGYEGLAVLVSERGHYSLKKAADVLGIGQAGLVAIKTDENNRVCPDALEAKIKELQAQNIKAFAVIGVAGTTETGSVDPLAEMAKICQKYGCHFHVDAAWGGATLMSNKYRSLLDGVELADSVTIDAHKQLYIPMGAGMVLFKDPNAMKSIEHHAQYILRKGSKDLGSHTLEGSRSGMAMLVYASMHIISRPGYELLINQSIEKAKYFADLIKQQDDFELISEPELCLLTYRYIPARVKQALAAANAKQQLELNELLNELTKFTQKRQRETGRSFVSRTRLNPAQWSRMNTIVFRVVLANPLTSFDILASVLEEQRNIIVHQAPNLLAKINKLADGIITSTQSS

SEQ ID NO: 60616 - protein, 409 aa, Sphingomonas xenophaga
MRSVAIVGANLAGGRAAEALRQVGFDGRITLIGEEPWRPYERPPLSKEFLWNPAEMSDNFFLQDENWYSDNRIDMLLSTRAEAIDLNAGGVRLSGGQLVAADKVLLATGGHARKLNLAGADCVNVHYLRTRDDAARMALDLRQGARVVIVGMGVIGAEVAASAIKLGCEVTAVEPLAGPMERALGKRFGQWLGEEHRKRGVKTHFNRGVTGFKFADGRVSAVEIDDGTVIPCDAVVVGVGIIPATSLAVDAGLTVNNGIVVDRRCQTSNKAIFAAGDVAEQDGFFGGRFRQETYQNASDQAQAAASAMLGHEVDYCKPMWYWSDQFDLNIQFCGQIPAQAEVVLRGDIESNAFVALFLSGNTIDGLLTVNRAPDMGIGKRLVERRTKASADRLADADVSLRELLMQSAR

SEQ ID NO: 60617 - protein, 573 aa, Cryptococcus neoformans var. neoformans JEC21
MSSPPTPPTPSSPPSYTHLNTPPKAYPQPPTFHPRRSAAAIIPIHSADDSDGTSTPSTSSLSPPSELDDEESVHSQDSCDQPCHPAHALPLHMRSNTLSRVPSNASSLAEEGEATPLLSSGEDDGYRGKWYKGPLFVAAFKLGILFAVFTAIVGITFYWGMPKLDDEDKGIIKLPKSFADLQALNALFQKYKHRYPLKLLACGVVSYLFVQTFSLPGSMYISILFGAAYGIMYGLLLSCICESIGSLFCYSLSAVLAPPLLTLPFYRARVETWRTKIMGDPKKGKKVTWDSIFAILLVLRIAPFPPHWIANFVAPHLGIGMFLFWSSCFIGIAPVSVIHVTIGSSLDDMTSAADFHILSLRNILGLSAVIIAVLIPIGLKRIFKKDLGDLGEAEEALASTRGGDREVNVPAVGQNHGRMYHAIDSGVVLATPSKGNGMDMRRKLVKSQGRVLEIIPDHESDAEDREHVELDDHSPSPLPRQLISFDNIEEPLMDDNAPGPSSRSSLQSTSHKDDYIVFDPANHFHKIQVKPYRPNTQKGYGTIEQPAPVMDDSERTTTAVGMGWWPWARDGVA

SEQ ID NO: 60618 - protein, 203 aa, Cryptococcus neoformans var. neoformans JEC21
MSGRGFSRGGGGGFRGGARGGRGGGRGGFQQRDMGPPDTVLEIGSFQHDVESEMLCSLTAPTKIPYFNAPIYLQNKTQIGKVDEILGPINEVYFTVKMEQGMLASSFKKEDKVYISGEKLLPIERFLPKPKVAGGKERGAQGGRGAPRGRGGAGSRGGRGGFSSRGGPGGRGGARGGAGGRGGFSSRGGGAPRGRGGFRGRGQ

SEQ ID NO: 60619 - protein, 233 aa, Chamaecyparis obtusa
APFMVNAYPYFAYRDNPKEVSLDYVLFGQSPGVKDPKGFTYNNMLDAQIDSVYSAMAALGHNDSIPVSISETGWPSKGDPADIGVTPENAKNYNTRVIKHVSSNAGTPMRPNRVIDTYIFALFNENQKPGPNTERNFGLLQPDGSKVYDIDLSCGYCGAAAPAPAPPPPAPLPMQWSRPANAGRQPGAIWCIAKPSADPSVLQESLDFSCGQGGADCAAIRQGGPCYSPNTVH

SEQ ID NO: 60620 - protein, 530 aa, Candida albicans SC5314
MSSSSSTPQATGLQMSDSIKSSTDRLLYRKNDIVSAKLSSDNGIYLSGQPLQHQPKHEESILDTLSACYKTPDTTESDFIPFKNILNVESIAGSVDEADEVGNSNLLEITYALPFSDLNHDLKIDKIKVDIESGPEIPPSLAQFILTESYGKSIIRPSILVLINPHGGQGHAKTIYKNKILPILQAARANVTYFETKYHGHATEIARELDVNDYDIIVCCSGDGIPHEVINGFYLRPDKGLSAFNKIAVTQLPCGSGNALSLSTHGSKNASVATLYMLKAHKTKLDLMAITQGTGSEKITKLSFLSQCYGIIADSDIGTEHLRWLGPIRFELGVIQKVFSGAKYPCDLFVKYKYDNNSEILNHVNDYLSNNDTENELPIVTEENLQITSPDLDQPVPNDWRHIPQEISHNLNILYVGKMPFVSADTQFFPAALPNDGSMDMIVTDSNNSVWKLTSILLAVESGKHIDDEKVHHTKVLSYRLIPNIKDDSKHYISIDGEDFPFEPFQVEILPGVLTGLLQDGNFVETSFTK

SEQ ID NO: 60621 - protein, 693 aa, Oryza sativa
MATPRGHLPACVAAVAAAAALLTSLLPPPVAGQPLGNFCGDSGNYTANSTYQGNIRSISATLPKNASSSRTLFATATLGAVPDIVYALALCRGDTANATACAGCVAAAFQDAQQLCPYNKDATVFYDACALRFSNQNFLASTNGDNKFLILMNTQNVSAPAKVFDAAVGVLINATADYAAANSSRRFGTGEEGFNGSKIYGLAQCTPDMATATCRSCLGGIVGMMPKYFSGKQGGRVLGLRCNYRYEIYPFFDGVSLLQLPAASLGAPPAPSPAAVNVTPPATTTGTRRRVDITRKCTVILIKISFNMTFDMIWNTTGRVLAIALPIVAAILAAVVICFYIWKRKTERARKPSIADPTDPADIESIDSLILSISTLRVATNNFDDSNKLGEGGFGAVYKGVLPSDQEIAVKRLSQSSRQGIEELKNELVLVAKLQHKNLVRLLGVCLEEHEKLLVYEYMPNKSLDTILFDPDRSNVLDWWKRLKIVNAIARGLQYLHEDSQLKIIHRDLKASNVLLDSDFNPKISDFGLARLFGNDQSQDVTNRVVGTYGYMAPEYAMRGHYSIKSDVFSFGVLILEIVTGRKNNVSYDSEQSVDLLTLVWEHWLAGTVVELADSSMAGHCPGDQILKCVHIGLLCVQEDPTERPMMSMVNVMLSSSTVSLQAPSRPAFCIQKSSVNSDSYSEPFRGANQSTV

SEQ ID NO: 60622 - protein, 175 aa, Triticum aestivum
  misc_feature (165)..(165): Xaa can be any naturally occurring amino acid
MAPTVMASSHTSVAPFQVLKSTAGLPVSRRSSSAGLSSVSNGGRIRCMQVCPIEGIKKFETLSYLPPLSTEALLKQVDYLIRSKWVPCLEFTKVGFVFREHNSSPGYYDGRYRTMWKLPMFGCTDATQVLNEVEEVKKEYPDAYVRVIGFDNIRQVQCVTFIAFXPPGCEESAKA

SEQ ID NO: 60623 - protein, 396 aa, Flavobacteria bacterium BBFL7
MPAISHKGAIMPSSPVRKLVPFAEAAKKRGIHIYPLNIGQPDIKTPNQAIQAVKDTDMEILAYSHSAGNESYRTKLATHYNKLDMGLTVDDIIVSTGGSEALLFTMGSICDYGDEVIIPEPFYANYNGFATASGVTVKPISTNIENNFSLPSISDFEKLITDKTKAILICNPGNPTGYLYTQDEMNQLAALVKKHDLFLVADEVYREFAYDGRKHLSVMNMTGLEQHAIMIDSVSKRYSMCGARIGCMVSKNKEVMATAMKFAQARLSPPTFAQIAAEAALDTPQAYFDEVIGEYIERRNILIEGLKNIPGVQVANPGGAFYCVAQLPVDDTDAFAQWMLESFELDNETIMVAPAAGFYSSPGVGKNQIRIAYVLEKESLIKAVQILAEALKVYQA

SEQ ID NO: 60624 - protein, 194 aa, Oryza sativa (indica cultivar-group)
MAKLCFLLIVSFAVVAAFAFAATDDEAAAGITVAEASSDPENKCVYTIYVRTGTIWKGGTDSVIGVTLLGADGSGVRIRDLERWGGLMGDGHDYYERGNLDIFSGRGPCMRQAPCRMNLTSDGTGPHHGWYCNYLEATVTGPHLGCAQKLFTVEQWLATDASPYRLYAVVDNCNKAKDAAAADDDADEPRVTVL

SEQ ID NO: 60625 - protein, 457 aa, uncultured bacterium 442
MSYSNHFVPPHPKPLPALPALARVLWHGDGNLLELMPGEAYRFDFGNLGYSRRSTVLFNQPELVREILRDDGSRFPKSDLMVNALEPLIGQSIFVTDGARWKRQRGMIDPAFSQLRVSHAFDAMQSAVLDHLDVLDGHADSGDSFSLDMAMSHLTADVICRTIFSTPLAAGVSSDVFEDFTEFEQSVAQVDIFRLIFQKAWAKMPQPPGVLAACQRIRGHLGDLVDPHLENPGAFNDIASDVIAAKDSDTGEAFTREELIDQLGVFFLAGHETSASALTWVFYLLAEQPTLVLRLRNELEHVVGSGPINFNHVKQLPLVRAVFRETLRLYPPITFIPRVALEDCEIGPRKLRRGALVMVSPWTIHRHQRYWSDPDAFIPDRFLVEGESSIQEGAYIPFGVGPHTCIGAGFAQAEAVLIIAELVRRFDFSRADRQSVRPAARLTTRPAQQIKLHCQRL

SEQ ID NO: 60626 - protein, 64 aa, Brassica napus
RPTRPIPQTCPPAPRKPKGVPSRSLKVRNYYKSRRMIILNVSREFDCMFHSTSLCNNIKKARHI

SEQ ID NO: 60627 - protein, 238 aa, Zea mays
  misc_feature (207)..(207): Xaa can be any naturally occurring amino acid
  misc_feature (230)..(230): Xaa can be any naturally occurring amino acid
MSGSASRKLFQTARSIVLSASQRSSFSVLAAEGRTAALANFGRKILPSACSYHRQGSHAASGWGAIAAAVPAAVYMLQDQEAHAAEMERTFIAIKPDGVQRGLISEIVNRFERKGYKLVAIKLIVPSKGFAEKHYHDLKERPFFNGLCDFLSSGPVLAMVWEGEGVIKYGRKLIGATDPQKSEPGTIRGDLGVVVGRNIIHGSDGPXETAKDEIALWFEPKELVSYTSNXENWVLGVN

SEQ ID NO: 60628 - protein, 884 aa, Coprinopsis cinerea okayama7#130
MLARNLSKPGRNLVVCIRREDPKRIWERRAPLTPDDVAALLAKHPNLSIEIQPCNKRVFPIEDYLHAGATLASRAPDIFLGIKETPVPELTWGPQTHLMFSHTHKGQPYNAPLLARFLEQYSKPKHASTPAPRLIDYELLTDPSTGKRTVGFGWFAGVAGVLESLSAMAHHHLEHGVASPFLYTPRPHTVPSLDEARKQLRNIGGLIREYGVPEALGPFIIGLTGRGNVSQGCLSMLEELPLEHIRVKDLDALVKDPNASRHKVYLVHVQPEEYLIDVNGGSYNRDSYYANPESYKSVFHERVAPYLTLLLNGTGWSPSYPRILPTDTLPSVLSHAYSIGGLRATNIGDISCDIEGGIEFMERATTISDPCFKVRVPTAKFAGDRSSTGSPSTTTAVSHKGEIQIMSVDILPASIPLDASKHFSSVLRPYIEAIVEDHSSTNPIFSLDSPVLGSAYSRALDSPPSKRQHPEDTHTTLLNALHRATIAHSGRLARPHKHLKDVVRAHCGPLPFREGRLSLESLLAPNGVATKQSKPERDADGNVLPPYLQPSAEEYNPGVYNIVEKEAKDVEIQVPPSPPSSSSHTTASSSRTTRSSSSSSSLRHSYSPSHTSSASAQARYKHTPRHSAAPTKRILMLGSGMVAGPAVDTIMDTPGMELVVASNSLHELQTLTAPHSVSGRVKYRVVDISKRETYKHLVAESDVVVSLLPAPMHPQIAKTCIEYGKHLVTASYISPEMAALDEAAKSSSTLLLNEIGLDPGIDHCSALDLLCRLKATNQHVVSFTSFCGGLPAYEDSRVPLRYKFSWRPQGVLTAAGNDAKYLVNGQTREIPGSSLLSSKFPKVPVPGFPHILEGLPNRDSLKYASIYGLPTDGSLKTLIRGTLR

SEQ ID NO: 60629 - protein, 198 aa, Coprinopsis cinerea okayama7#130
MDSRRPDLKRKLVVVGDGGCGKTCLLIVYAENRFPEAYIPTVFENYVTQVQFEGKLVELALWDTAGQEEYDRLRPLSYPESNVILIVFSIDFPTSLANVQDKWYPEVAHFCENTPLILVGTKTDLRRDEQTRRMLSAQGQAPITPEQGAAVAKEIGAKYIECSAKAGTGVHEVFELALRESMKGRWGKIVNQKRCVII

SEQ ID NO: 60630 - protein, 772 aa, Coprinopsis cinerea okayama7#130
MASKDDKDSSSIEKVEVIDKERNQPDIAELEALALPDFDDPNIDRDAAIQGVLEDDSPYPEVRSAVANTDDPDIPVSTIRSWTLGLIWAILISGLNQFFFFRYPSVTITGIVAQLLIFPMGRLWYKVVPNVKIFGKELNPGPFSIKEHVLSTIMAIVGAYSAYATDIIAVQRVLYNQNYNFSYQWMLVMSTQLIGFSIGGVARRFLVQPPSMIWPANLVTCALFNTLHAQTYAGMGNRGGLSRERFFLYALIGATCWYFMPGYLFGALSYFNWVCWIAPDNIKVNTMFGYFHGLGMSLVTFDWAQIAYIGSPLATPWWAEANIAVGFVFFFWILAPILYFTNAWDSQYMPISGRGSYDNMQKPYNVTLILNPDATFNQEAYEAYSPLFIPTTFAISYGLSFASITATLTHAFLYFRKQIWTQARRAIHEQPDVHARLMARYPQVPQWWYLIIFLTMFAFGIISIEVWETKFPVQWFILALVIAFFYVIPIGMIQAITNQQVGLNVITELIIGYGLPGRPVAMMMFKTWGYITMAQALTFTSDFKLGHYMKVPPRAMFFAQVIATMIAGTTQLGVQAWMFSNIPNMCTPDQRDGFICPATEVFGTASVIWGVIGPARQFSKGEVYYALVFFFLAGFVTPIIGYFLTRRFPNSWLRYVNFPVIYSGTGYMPPATASNYVPWAIVGFIFQYVIRRRHFSWWTKYNYVLSAALDAGVALAAVIIFFTLQYPKNGDIGVNTIQAWWGNTVPFNTADGRGLSLRNVAPGETFGPRTWK

SEQ ID NO: 60631 - protein, 364 aa, Glycine max
WRSDPATAYNLQSIRPAFSAIRHFSSAAKEITVRDALNSALDEEMSADPKVFLMGEEVGEYQGAYKISKGLLDKYGPERVLDTPITEAGFAGIGVGAAYYGLRPVVEFMTFNFSMQAIDHIINSAAKSNYMSAGQISVPIVFRGPNGAAAGVGAQHSQCYASLYGSCPGLKVLSPYSSEDARGLLKAAIRDPDPVVFLENELLYGESFPVSAEVLDSSFCLPIGKAKIEREGKDVTITAYSKMVGYALKAAETLAKEGISAEVINLRSIRPLDRSTINASVRKTNRLVTVEEGFPQHGVGAEICTSVIEESFGYLDAPVERIAGADVPMPYAANLERMAVPQVEDIVRAAKRACYRSVPLAASA

SEQ ID NO: 60632 - protein, 776 aa, Arabidopsis thaliana
MELLLPHPSNSTPLTVLGFLDRAASVYGDCPSILHTANTVHTWSETHNRCLRIASALTSSSIGIKQGQVVSVVGPNVPSVYELQFAVPMSGAILNNINPRLDAHALSVLLRHSESRLVFVDHRSISLVLEAVSLFTQHEKPHLVLLDDDQENDSSSASDFLDTYEEIMERGNSRFKWIRPQTEWQPMVLNYTSGTTSSPKGVVLSHRAIFMLTVSSLLDWSVPNRPVYLWTLPMFHANGWGYTWGTAAVGATNICTRRVDAPTIYNLIDKHNVTHMCAAPMVLNMLINYPLSTPLKNPVQVHEEKTGSLPVMTSGAPPPATIISRAESLGFNVSHSYGLTETSGPVVSCAWKPKWDHLDPLERARLKSRQGVRTLGFTEVDVRDRKTGKSVKHDGVSVGEIVFRGSSVMLGYYKDPQGTAACMREDGWFYSGDIGVIHKDGYLEIKDRSKDVIICGGENISSAEIETVLYTNPVVKEAAVVAKPDKMWGETPCAFVSLKCDNNGDGSVPVTEREIREFCKTKLPKYMVPRKVIFQEELPKTSTGKIQKFLLRQMAKTLVYVRKKKALSSDDLNGTKVLEATEGTGGEEVIEAASESGGLEAAQKRGSNTRPSDEWVLVPEKVLDTRYSAEGVLEALVQWQGLPTHETSWELNRVYVRKKKALSSDDLNGTKVLEATEGTGGEEVLEAASESGGLEAAQKRVNIDEHGRKSGGGGGDTGWRVAVGAETRECVPKKEDAGEVNDYEDSLFISISFKVQANSGASEEQARAVYAPVAFQ

SEQ ID NO: 60633 - protein, 400 aa, Candidatus Blochmannia floridanus
MVMIKMSDVDLFNKRILIRADLNVPIRNGIITSARRIHASLPTIQLALSRSNQVMVTSHLGRPVEGEYDSQFSLQPVVDYFQKNLSAKIGGVRLVKDYLDGINWISNELLILENVRFNKGEKTDDEVLAKKYASLCDVFVMDAFGSAHRIQSSTHNVSKFVKVACSGLLLEQEIAALHKALSNPVRPMVAIVGGSKVSSKLMVLESLSKVVDYLIVGGGIANTFLAAQGQNVGKSLYEAELISTAKSLLKDCNIPIPTDVRVSSEFSETAQSIMKNVTEIKDDEQILDLGDNSIINILNILNNAKTILWNGPVGVFEFPNFRKGTEMVSNAIANSNAFSIAGGGDTLMAIDLFGIANQISYVSTGGGAFLEFIEGKTLPSIEVLEEHKRMRNGNYSDINY

SEQ ID NO: 60634 - protein, 336 aa, Hyphomonas neptunium ATCC 15444
MTVRVAINGFGRIGRLVLRSIIEHGRTDIEVVAINDLGPVETNAHLLRFDSVHGRFPADVKVDGDKIVINGKPILVTAIRDPKDLPHRELDVDIAMECTGIFTSKDKAEAHLAAGAKRVLVSAPADGADLTVVYGVNHDKLKKEHMVVSNASCTTNCLAPVAFVLNKAVGIDKGMMTTIHSYTNDQPSLDQMHKDLYRARAASLSMIPTSTGAAKAVGLVLPELKGKLDGISVRVPTPNVSLVDLKFIAKKSTTAEEINAAIIAAADAGPLKGILGYTDVPNVSSDFIHDDRSSIFHLDQTKVMDGNFVSIMTWYDNEWGFSTRMADTAIAIAKLI

SEQ ID NO: 60635 - protein, 415 aa, Zea mays
LSHLSKLARDNNTASRTVEADRLHTMFLAMADARAVLIKLADRLHNMNTIEALPLVKQQRFAKETMEIFVPLANRLGIASWKDHLENICFKHLNPEEHKELSSKLLMSFDEALLTSTLHNLDKSLRDEGISYHSLSGRHKSLYSIYSKMIKKNLTMDDVHDIHGLRLVVETEEDCYRALDIVHKLWPRVTGRFKDYICHPELNGYRSLHTVIMCEGVHPFEIQIRTKARDLQAEYGFAAHWRYKEGGCRHSFVLQMVEWARWVLTWQCETLSKERPSSLSSSVGIRPPCPFPLHSEDCSYSYSRQCNYEGPIFVIMLEHDKMSVQELPANSTVVDLMERVGANSPRWSPCSFPLKEELRPRVNHKPISDPNRKLSMGDVVELTPALPDKSLSEYREEIQRMYERGGFALATTPRS

SEQ ID NO: 60636 - protein, 371 aa, Ustilago maydis 521
MVTNHQVLFNKTQPTGLPKPGETTKPGSAELDIDNVALNGGVLTRNIAVSLDPTMRNRMKGNNGYFSAPYVVGQPVTAIGIAEVVRSEVNDFAPGDIVYAWSTGIEDYTIHPAAAAATFRKFDPAQLNNGLSITTYLGAAGMAGMTAYMSLKEIIGDLKPGNKMFVSGAAGAVGQLVVQLCHQAGVGVIASAGSDEKCEFVRSLGAEESINYKTEDLRAKLKAFAADTGIHYYFDNVGGDQLEAYIDNAARYGIIVACGYISGYNAEKPEDVVYPKNLFNVITKELKYQGFIVSSYIPKWLGKFMDEVPKMLADGTIKNREDVTFGVYGAEDAFLRLFTGDNSGKVAVLIDTDRAEKWNLKKQMDASKVWK

SEQ ID NO: 60637 - protein, 281 aa, Rhododendron catawbiense
MSKDVEVAEQPAYSAKDYHDPPPARLIDMEELIKWSFYRAVIAEFIATLLFLYITVLTVIGYKSQTTTDPCGGVGILGIAWAFGGMIFVLVYCTAGISGGHINPAVTFGLFLARKVSLFRAVLYMVAQCLGAICGVGLVKAFQKSYFDRYGGGANEVASGYNKGTALGAEIIGTFVLVYTVFSATDPKRSARDSHVPVLAPLPIGFAVFMVHLATIPITGTGINPARSFGAAVIYNNSKAWDDQWIFWVGPFAGAAIAAFYHQFILRAAAIKALGSFRSNT

SEQ ID NO: 60638 - protein, 398 aa, Gibberella zeae PH-1
MAGSNDLEANGASPRYEGVDSGFIEKAPTQRSASRTHASVYILTWIFFSNATILFNKWLIDTAGFRYPIILTTWHLVFATIATQLLARTTTLLDSRHALPLSRRLYVRTILPIGVLYSASLVFSNIVYLYLSVSFIQMLKATGPVFTLIASWAWGVAQPDAKTFGNIMIIVVGVAIASFGEIEFSVWGFIFQMCGTIAEAVRVVMIQVMLSAEGLRMDPLVGLYYYAPVCTLMNLVVVLFSEGPRFKWEDAATAGYGMLFANAFLAFILNVISVVLIGKTSGLVMTLSGILKSILLVAASVVIWSTHISLLQTLGYSIALMGLVLYSVGYEQLLDAWDGLVAWGTGVNREGEMSPALRKAIMVGCLGFITVIITGALWHYHGLSGTQVARATTSWLGH

SEQ ID NO: 60639 - protein, 486 aa, Rhodopseudomonas palustris CGA009
MNVHQRYAMGDSLAAKHGLWSEEQIDAAARVRRIAEEQGLETIRFSFPDQHGILRGKTLVASEALNCLDNGATITTTMLAKDTSHKTVFPVFQAGGGFGMSEMQGGADVVMLPDPTTFRVLPWAPTTGWVLCDLYFADGRPVQFATRNIYRAALQKLAARGYDYKAGLEVEFHVFKVVDSKMRPEHAGQPGEPPEVSLLSHGYQYLTEQRYDQMEPVLELIRRDVVALGLPLRSIEVEFGPSQCEFTFQPTVGLLPADLMVLFRAAVKQICRRHGYHATFMCRPRIPNVVSSGWHLHQSVVARDGGRNAFMSDSDVLSDFGRHYLAGLMTHARAATVFTTPTINGYKRYRSYSLAPDRAIWGRDNRGVMLRVLGGAGDKATRIENRVGEPAANPYLYMASQILSGLDGVDRALDPGPSADTPYETKADLLPKSLREAIFALRDDPFFRTALGDEFVDYYTFIKNAEIERFQAEVTEWEQREYFEMF

SEQ ID NO: 60640 - protein, 958 aa, Bordetella bronchiseptica RB50
MLETVIKRDRDLGTPARESAQLVTLTIDGQPVSVPAGTSVMRAAAEAGINIPKLCATDSLEPFGSCRLCLVQIEGRRGYPASCTTPVEAGMVVQTENARLRDLRRGVMELYISDHPLDCLTCPANGDCELQDMAGVVGLREVRYGYDGENHLAEAKDESNPYFTYDPSKCIVCNRCVRACEETQGTFALTISGKGFASRVSPGQDQPFMDSECVSCGACVQACPTSTLQEKSIIMLGQAEHSVITTCAYCGVGCGFKAEMKGEEVVRMVPWKDGQANRGHSCVKGRFAWGYTTHKERVLKPMIRQRITDPWREVSWEEAIGHAASEFRRIQAAHGRDAIGGITSSRCTNEETWLVQKLVRAAFGTNNVDTCARVCHSPTGYGLKQTLGESAGTQTFDSVMHTDVVIVMGANPSSAHPVFASRLKRRLREGARLIVIDPRRIELVSAPHVKADFHLQVRPGTNVALLTAMAHVIVTEGLVAESFVAERCEAPSFDMWREFVARAENSPEAMQEVTGVPAQLVRGAARLYATGGNGSIYYGLGVTEHSQGSTTVMAIANLAMATGNIGREGVGVNPLRGQNNVQGSCDMGSFPHELPGYRHISDDAVRGEFERDWGVTLQPEPGLRIPNMFEAALGGSFLGLYCQGEDIVQSDPNTQHVAAALSAMECIVVQDLFLNETAKYAHVFLPGSSFLEKDGTFTNAERRISRVRKVMRPRNGMADWEITMALSNALDYPMHYAHPSEIMDEIARLTPTFAGVTYEKLDRLGSIQWPCNEDAPEGTPTMHIDEFVRGRGRFMLTKYVATDERSTRRYPLLLTTGRILSQYNVGAQTRRTPNVMWHGEDVLEIHPHDAQERGVADGDWVGIQSRAGETVLRATLTDRVQPGVVYTTFHFPESGANVVTTDNSDWATNCPEYKVTAVQVTRVSQPSEWQRQWSRFADVQQKLLHERARETEPALANK

SEQ ID NO: 60641 - protein, 97 aa, Triticum aestivum
  misc_feature (19)..(19): Xaa can be any naturally occurring amino acid
  misc_feature (51)..(51): Xaa can be any naturally occurring amino acid
  misc_feature (64)..(64): Xaa can be any naturally occurring amino acid
SLMRPVSLHIYQGYGISTXEQDAEDLDQLIGNFIHRDNSEGVILLDNITRXQDLMLSMRTDSAXFISGSGVFMQAAVSDREYTVTVPVPGELIDLSA

SEQ ID NO: 60642 - protein, 340 aa, Xanthomonas axonopodis pv. citri str. 306
MKALVKREANKGIWLEQVPVPTPGPNEVLIKLEKTAICGTDLHIYLWDEWSQRTIEPGLTIGHEFVGRVAELGSAVTGYQIGQRVSAEGHIVCGHCRNCRGGRPHLCPNTVGIGVNVNGAFAEYMVMPASNLWPIPDQIPSELAAFFDPYGNAAHCALEFDVIGEDVLITGAGPIGIIAAGICKHIGARNVVVTDVNDFRLKLAADMGATRVVNVSKTSLKDVMADLHMEGFDVGLEMSGNSRAFNDMLDCMYHGGKIAMLGIMPRGAGCDWDKIIFKGLTVQGIYGRKMYETWYKMTQLVLSGFPLHKVLTHQLPIDDFQKGFDLMEEGKAGKVVLSWN

SEQ ID NO: 60643 - protein, 198 aa, Magnetococcus sp. MC-1
MARIATESRTTGETKIQVTLNLDGSGKAQVDTGVGFLDHMLDQIARHGGMDLEIEACGDQHIDDHHTVEDVGITMGQAFRQAIGDRRGITRFGHAYVPLDEALSRVVVDLSNRPSLSWRVKFPTQKVGNFDTELFKEWFAAFAQQGGITMHVESLYGENSHHIAESCFKALARALRSACAVDATLGGVAPSTKGTLSD

SEQ ID NO: 60644 - protein, 693 aa, Xanthomonas axonopodis pv. citri str. 306
MTSSSSRRDFLKRVAALTAAGALPSSIGRALALPANARTGTLRDLEHVVILMQENRSFDHYFGALRGVRGFGDPRALQLRDGHAVWSQPTPDGRRVLPFAFDSQNTCAPLIKSLDHSWKAGHGQDPARWAEYDAWVPYKGELTMGYFQRHDIPYYHALADAFTICDGYYCSLHGPTNPNRMYLFTGTSGPSVGNVGAQAVTNADDGNWTADMARDKPGYAALQWTTYAQRLQAAGVDWRVYQEYDNFGCNSLAYFSHYRDLRTDDERYLRARACVPGSTAGNAATTQAEHLVAAIAADVRANRLPQVSWVIPPTAYCEHPEAPPAYGESLVARLIDALTANPEVWAKTALIINYDENDGFFDHVPAPLPALDARMGRSNVDTHGEVYDGVPIGLGIRVPMLVISPWTRGGWVNSQVFDHTSVLRLLERRFGVAEPNISPWRRAVSGDLTSVFDFRKPDDSALSALPSVDDYRARTAAVRDKPLPSAPAAATMPRQEPGQRPARALPYALQVHARVQEGAAVQLQFVNSGAAAAAFNVYNSAAGGGPWYYTVLPGTQLDDAPIGATHEGAYALRVHGPNGFLREFAGQVPRASAPSAAPWVEARQEGDALVLEIGNAGQRACTVQLRALDYADPSARTLSLAAGQRETIRLALAASDHWYDLVVEQPGSAFRRRLAGHLETGRPSRSDPAFGRV

SEQ ID NO: 60645 - protein, 325 aa, Listeria innocua Clip11262
MAQKTMIQAITDALAVELEKDENVLVFGEDVGKNGGVFRATEGLQEKFGEDRVFDTPLAESGIGGLAIGLALEGFRPVPEIQFFGFVFEVMDSVAGQMARMRYRTGGTRTAPITIRAPFGGGVHTPEMHADNLEGLMAQSPGLKVVIPSTPYDAKGLLISAIRDNDPVIFLEHMKLYRSFREEVPEGEYTVEIGKAAVRREGTDVSIITYGAMVQESMKAAEALEKDGVSVEVIDLRTISPIDVETIIASVKKTNRAVVVQEAQKQAGIAANIVAEINDHAILSLEAPVMRVAAPDSVFPFSQAETVWLPNHNDIIERVKEVIAF

SEQ ID NO: 60646 - protein, 544 aa, Listeria innocua Clip11262
MAYSFKLPDIGEGIHEGEIVKWFVQPGDKIEEDESLFEVQNDKSVEEITSPVSGTIKEIKVAEGTVATVGQVLVTFDGVEGHEDDAEEESAAPKAESTESTPAPAQASGKGIFEFKLPDIGEGIHEGEIVKWFIQPGDKVEEDQSIFEVQNDKSVEEITSPVDGTVKDILVSEGTVATVGQVLVTFEGDFEGEASHESTPESPAEEAELTNNDATSAPATGGNGTPSSKKDPNGLVIAMPSVRKYAREKDVNIAEVAGSGKNNRVVKADIDAFLNGEQPAAATTTAQTEEKAAAPKAEKAAAKQPVASSDAYPETREKLTPTRRAIAKAMVNSKHTAPHVTLMDEIEVTALMAHRKRFKEVAAEKGIKLTFLPYMVKALVATLRDFPVLNTTLDDATEELVYKHYFNVGIAADTDHGLYVPVIKNADKKSVFQISDEINELAGKARDGKLTADEMRHGSATISNIGSAGGQWFTPVINYPEVAILGVGRIAQKPIVKDGEIVAAPVLALSLSFDHRVIDGATAQKAMNNIKRLLNDPELLLMEV

SEQ ID NO: 60647 - protein, 467 aa, Listeria innocua Clip11262
MVVGDFPEERDTIVIGAGPGGYVAAIRAAQLGQKVTIIEKEYYGGVCLNVGCIPSKALITIGHRFKEAGHSDNMGITADNVNLDFTKAQEWKGGVVNKLTSGVKGLLKKNKVEMLEGEAFFVDDHSLRVIHPDSAQTYTFNNVIIATGSRPIEIPGFKYGKRVLSSTGALALTEVPKKLVVIGGGYIGTELGGAFANLGTELTILEGGPEILPTYEKDMVSLVKRNLKSKNVEMVTKALAKSAEETENGVKVTYEANGETKTIEADYVLVTVGRRPNTDEIGLEQAGVKVTERGLVEVDKQGRSNVSNIFAIGDIVPGVPLAHKASYEAKIAAEAIAGEKAENDYTALPAVVFSDPELATVGLTEKEAKEKGFDVKAAKFPFGGNGRALSLDAPEGFVRLVTRKEDGLVIGAQVAGMNASDIISEIGLAIESGITAEDIALTIHAHPSLGELTMEAAELALGRPIHM

SEQ ID NO: 60648 - protein, 222 aa, Candidatus Blochmannia floridanus
MISKDKLKKLVGWEALKYIKSNTIIGVGTGSTVNYFIEALSSIKQQIEGVVSSSQHSSNQLKKLGIPLYNLNNLNDLEIYIDSADEIDLHMQMIKGGGGALTKEKIIAFAAKKFICIVDDSKQVNILGRKGPIPVEVIPMARSVVSKSLICLGGLPEYRNGVITDNGNSILDVYNMNITDASLLEQRINNIPGVVSVGLFAQRKADIALIGTQKGIKILNSN

SEQ ID NO: 60649 - protein, 413 aa, Vibrio angustum S14
MVSTTISVKPEMATFSLKLKKKLLLLGPAFIAAIGYIDPGNFATNIEAGSSFGYQLLWVVLWSNLMAMLIQYLSAKLGIVTGKNLAEHLRDHLPKWAIGPYWIQAEIIAMATDLAEFIGAAVGFQLLFGISLMEGAIITAIVTMTILLLSNKSQKPLEAVIATLLLVVAVVYVIELFFAHPAKSEMIKGLAVPTLNSSHQIYLAAGILGATVMPHVIYLHSALFKNTYGETKAKRLKSTRLDVLIAMVIAGFVNIAIVAMAAAVFHYSGNQDIAGIETAYKTLTPLVGQAASTLFAISLIASGLSSTVVGTMAGDVVMQGFVKFKIPLLLRRLVTMIPSFIVIGLAINTTEILVMSQVVLSFGIALAIIPLLIFTNNEKLMGEFKNNKYVSYAGIVIIALVVAFNIYLMMTLS

SEQ ID NO: 60650 - protein, 473 aa, Prochlorococcus marinus str. NATL2A
MSKTSQDVLRQIKDEGIELIDLKFTDLHGKWQHLTVASDLIEESSFTEGLAFDGSSIRGWKAINESDMAMVPDPSTSWIDPFYHHKTLSLICSIQEPRSGEPYARCPRALAQKALDYLGSTSVADAAFFGPEPEFFIFDDVRYNSGEGSSFYSVDTIEAPWNSGRVEEGGNLGYKIQLKEGYFPVSPNDTAQDMRSEMLLLMGELGIPIEKHHHEVAGAGQHELGMKFAPLINAADNVMIYKYIVRNVAKKYGKTATFMPKPVFNDNGTGMHVHQSLWKGGQPLFYGEGTYANLSQTAKWYIGGILKHAPSFLAFTNPTTNSYKRLVPGFEAPVNLVYSQGNRSAAVRIPLTGPSPKAKRLEFRSGDALANPYIAFSAMMMAGIDGIKNQIDPGDGVDVDLFELPSEELSKIDTVPSSLNDALEALKNDSQYLTEGGVFTEDFINNWIELKYEEVQQLRQRPHPHEFTVYYDA

SEQ ID NO: 60651 - protein, 425 aa, Candidatus Blochmannia floridanus
MHQHVINELLHISNYNKLKELHQKYRGPVWAYDASIIINRINQLKQFDVIRFAQKSCSNIHILKLMNNNGVKIDAVSLGEIERALLAGFKSDNEDSEIVFTADIFENDTLLKIVELGIPVNIGSIDMLIQLGSCSPRHKIWLRINPGFGYGHNYKTNTGGENSKHGIWHEDIPTALFYIRYYNLRLIGFHMHVGSGVHYDHLLKVSYAMVQQVFKYTEDLQAISAGGGLTVPYESHEKPVDVNNYFNIWNKARQEISQCLGHKIQLEIEPGRFLVAESGILITQICAVKRMGRRNFVLIDAGYNDLMRPVMYGSYHHISLIPGDNRNIMFDKLNDIIIGGPLCESGDIFTQNSYGEVLPRKLPDSLKIGDYLIFHDTGAYGASMSSNYNTRPLLPEVLWENGEIRQIRRKQRLEDLFSLEISHTV

SEQ ID NO: 60652 - protein, 620 aa, Actinomadura hibisca
MSGFAGWVDYERDLRREGATTRTMTATMACRGPDAEEVWLSERAAFGHRRLAVLDPKGGRQPMRAEHDGRELAVLAFNGEIYNAGEVRAELAARGHRFRTRSDTEVILEAYLEWGAGCAAKLNGIFAFAVWDPRSEELLLARDQLGAKPVIYYPTPTGVLFASEPKALLAHPWVDAVVDTDGFRELLSQAGTPGAVVFKGMHEVRAGHVVRIGERGIVTEKYWGLEGREHTDDRDATIANVRRLLEESIGRQLRADVPVCSLLSGGLDSSGLTAIAAHILAERGEGPVRTFTVDYAGLAENFVPDQVRTSLDAPYVKDLVAHVGSEHTDVMLDTSDLLDPVMRAETIRARDLPSPLGDMQTGLYLLYRAAAEHSTVALTGQLADSLFGGPAWVQDPEFANADTFPWVALAQRRACPDGLGNGLLAPALRRSLDIPGYVRDRFHEALAEVPHVGEADPQERRMREITYTHLTRYPETLIRNDERLSAYVGLETRVPFCDPELLQYAFNTPWHLQTFDGREKSLLRAAVADLLPESVLKRPKSPFPVSVDPGYAKVLRTELSEILADPSAPVAPFLDPQGARELLDDPNSLAEGWRGRTNVELILQLDTWLRDYGVRLDLDV

SEQ ID NO: 60653 - protein, 591 aa, Vibrio vulnificus YJ016
MMYIKRYLQPISEAVIIFSVSSKTLLRHPMNNDKRPLYIPFAGPALLSTPLLNKGSAFSAEERISFNLEGLLPETTETIQEQVERAYMQYKAFESDMDKHIYLRNIQDTNETLFYRLVQNHITEMMPIIYTPTVGAACENFSNIYRRGRGLFVSYANRDRIDDILNNASNHNVKVIVVTDGERILGLGDQGIGGMGIPIGKLSLYTACGGISPAYTLPIVLDVGTNNPQRLADPMYMGWRHPRITGADYDAFVEEFIQAVQRRWPDALIQFEDFAQKNAMPLLERYKNRICCFNDDIQGTAAVTVGSLMAACQAAGSKLSEQRITFLGAGSAGCGIAEAIIAQMVSEGISDKKARSQVFMVDRWGLLQEGMPNLLDFQQRLVQKHSVTAKWETEANGFSLLDVVKNAKPTVLIGVSGAPGLFTQEVIQEMHKHCPRPIVFPLSNPTSRVEAVPADIIRWTNGDALVATGSPFDPVIHEGKTYPIVQCNNSYIFPGIGLGVLAVNAKRVTDEMLMESSRALATCSPLAINGKGALLPPLEEIHTVSKRIAYAVAKKAIEQGVALEIADDALQVAIEQHFWQPVYRRYKRTAF

SEQ ID NO: 60654 - protein, 81 aa, Glycine max
MLSANGDCRVIGFETPRCSPILYRKIRNVRHLWDHVVGMWLGALFVTQLVKCEPLLEQYLDNMLEKAKAANERRYIDGVDA

SEQ ID NO: 60655 - protein, 139 aa, Glycine max
PRVRFFAAMAGAGAPAVPQAGRPAPNFDVIVVGAGIMGSCTAHAAASRGARVLLLERFDLLHPLGSSHGDSRIIRDAYAQPRYLRMVRLARCLWAAAEAEAGYRVLTPTPYLFMGPRSSASLAAAIANIGAEEVDVDDL

SEQ ID NO: 60656 - protein, 139 aa, Gibberella zeae PH-1
MMSGEAWLFLLSVLINAVNLFLQVFFTIMYSDLECDYINPIDLCNRLNTYIIPEAAVHGFLTFLFLINGYWVPLILNLPLLGWNVKKIVDNTHLLDATEIFRKLNVHKKESFFKLGFHLIMFFFYLYSMIVALIRDESS

SEQ ID NO: 60657 - protein, 1495 aa, Penicillium digitatum
MSPQAETISTEAWSTDSADERPWSGTTNQLDPVFEKEGDSTDISERDRAQIGILARQLTTASTKTGVQGAVSNPFKGSNDPRLDPFSKEFNPKKWVETVLHLNSQNPERYLPRKAGFSFRNLSVHGFGSPVSYQKDFLNIFLQVADMVTGLINSKDQKIQILRNHNGLLRNGEMLLVLGRPGSGVSTFLKTIAGQTKGLYLDEASEFNYQGIPRKKIRGEFRGDVIYQAETDTHFPNLTVGQTLLYAALAKTPQNRLSGVSRDEYARHIRDVTMAVFGLTHTMNTKVGNDFIRGVSGGERKRVSIAEVCLAQSPIQCWDNSTRGLDSATALKFVQTLRLSADITSMATVVALYQASQQSYETFDKVAVLYEGRQIYYGPVELAKNYFVNLGYHCPDRQTTPDFLTSLTNPVERVARSGFEAKVPRSPDDFAKAWEESSLHKELMQDIVEFEKEHPVGGPAVDSFKKSRQAEKASWMTPNSPYTISVPLQVLLCIRRGFRRIQGDMTFFSITIGGNLVISLLLGSVFYMLEDTSASFQSRCILLFFALLFNALNSSLEILSLYAQRSIVEKHATYAFYHPLSEAVASMICDIPSKILSTIAFNIPLYYMANLRTESGHVITYLLIVFSSTLVMSMIFRTIGQSTRTIAEALTPAALMVIAMVLYTGFILPIRNMQGWLRWLHYINPLAYSYEALVANEFHGRNFECAGFIPAGPMYQNITAADRTCSVVGASAGSSVVRRRPLYCYELWVLLLQHVWRNFGILIAFIICFMIGYLLSAEYISSDVGKGEILLFQRSHFSAIKKTQKADEEVGSSGLHEKYRQDETNGEASTGITAQKNIFHWRDLCYEVSIKGKTRRITDHVNGWVKPGKLTALMGASGAGKTTLLDVLANRVTMGVVTGGIYNNGLPRDASFQRRIGYVQQQDLHLETATIREALEFSAFLRQPAHVSKAEKLQSVEEILDLLEMRSYADAVVGVPGEGLNVEQRKRLTIGVELAAKPDLLFFLDEPTSGLDSQTAWSILLLLRKLTDHGQAILCTIHQPSSMLFQQFDRLLLLAAGGRTVYFGDIGENSKTMTGYFERHGADHCDENDNPAEWMLRVIGAAPGSATKIDWPATWLGSQEYADVKEELISLERKDGVETNSSADPSLQFASPFHVQLWACTKRVFEQYWRTPSYLYSKLTMCFVTALFIGLSFLQTKVTELGLQHQMFAVFMLLVIFPFLAYQQMPNYILQRDLYEVRERPSKTYSWITFILAQVIVEIPWNSLAALITFIPFYYLIGMNHNAAPTHQTTERGGLMFLLIWGFLMHCGTFTTMVVASAATAEIGAILALLLFVFCLIFCGVMATPASLPGFWIFMYRVSPLTYIISGMMSTGLANIDVHCSDIETTLVQPPSGETCGSYLGAYLQIAGGAIYNPNATSDCQFCTIADSNVFLESVSSSYTDRWRNFGLIWAYVAFNVAATLILYWYVRVRGSPGLSHVVSWVQKASKHLSWKKAQ

SEQ ID NO: 60658 - protein, 845 aa, Rhodopseudomonas palustris CGA009
MPRKVDLTSCDREPIHIPGSIQPCGCLLACDAQAVRITRISENAGAFFGRETPRVGELLADYFGETEAHALRNALAQSSDPKRPALIFGWRDGLTGRTFDISLHRHDGTSIVEFEPAAADQADNPLRLTRQIIARTKELKSLEEMAARVPRYLQAMLGYHRVMMYRFADDGSGKVIGEAKRSDLESFLGQHFPASDIPQQARLLYLKNAIRVISDSRGISSRIVPERDASGAALDLSFAHLRSVSPIHLEYLRNMGVSASMSLSIIIDGTLWGLIACHHYEPRAVPMAQRVAAEMFADFFSLHFTAAHHQRRFQSSLRTRRTLDSLTSEMSFDASVDDFLRGNLKRIADLIPSDGVGLWMNGVWTAHGSTPPADALPSILHLLTGRAGNEIVATHALTDRIAAATDYAGAAAGMLAIPLSQVAGDYLLFFRKEQVQTLNWAGDPNKTYDTGPLGDRLTPRKSFSIWKEQVDGQSVPWSPDDRDTAATIQVGLREVLLRQSEILSAERKKAEVRQRVLNEELNHRVKNILALIKSLVNQPAGEGKSLEEFASALRGRIMALSFAHDQVVRSDGGGALLDLIQAELSPYPASQITLEGPDVGVDARAYSVLALVLHELATNAAKYGALSRSSGRLKVAWTVGDDGRCDIEWTESCGPPVRPPTRQGFGTVLLSRSIPFDLGGWSEVDYLPGGVVARLGIPGQFVTETLQRLSSVQASGQSTDSSALNIADASILLVEDQLVIALDAEDMLGAIGAKLVTSVASAEEALQTIAQQPPTLAILDVNLGNGSSLPVADELERLGIPFIFATGYGDTAMIPERMRGLPIVRKPYSIDSLRGALSAMLDDRE

SEQ ID NO: 60659 - protein, 443 aa, Arabidopsis thaliana
MHRASSKHTNAKKEAISTSKIRDNNVRVTRSRAKALGVSNSPSKPAFKHETKRVARPSNKRMASDNITVCNQKRRAVLKDVTNTLAESIISTEGNVKQACKRGGKETKQIEEDGLVDVDGEKSKLAEDLSKIRMVESLDASASKQLVDCAEEDRSDVTDCVQIVDIDSGVQDPQFCSLYAASIYDSINVAELEQRPSTSYMVQVQRDIDPTMRGILIDWLVEVSEEYKLVSDTLYLTVNLIDRFMSHNYIEKQKLQLLGITCMLIASKYEEISAPRLEEFCFITDNTYTRLEVLSMEIKVLNSLHFRLSVPTTKTFLRRFIRAAQASDKVPLIEMEYLANYFAELTLTEYTFLRFLPSLIAASAVFLARWTLDQSNHPWNQTLQHYTRYETSALKNTVLAMEELQLNTSGSTLIAIHTKYNQQKFKRVATLTSPERVNTLFSR

SEQ ID NO: 60660 - protein, 1478 aa, Penicillium digitatum
MSLLGTINPNPARSQSVVSHNTPQLPGDHELDAINDPEKDDDEDTVQEDDENKEALVGQLARRLTRQSTRFSVNGALDNPFTNGDSESSINPSSPNFKVRDWMKMLLAIRSRDPDRYPDRTAGISFKNLNVHGFGSPTDYQKDVLNTLLEIGTMFRQLTGMKLQKIQILRNFDGLVKSGETLVVLGKPGSGCSTLLKTIAGEMNGIETSEDSVLNYQGISAKDMQNAFKGEAIYSAETDVHFPQLSVGDTLMFAALARAPRNRLEGVSTEQYARHMRDVVMAMLGLSHTVNTRVGNDFVRGVSGGERKRVSIAEATLSQSPLQCWDNSTRGLDSANALEFCKNLALMSKYSGTTACVAIYQASQSAYDVFDKVTVLYEGRQIFFGPTTEARKYFEDLGYECPDRQTTADFLTSVTSPSERVVRRGFEGRAPITPDDFAEAWKKSTARAKLLGEIEEYEKNYPIKGSSYDAFVDARRAAQAKSQRVKSPYTISVRKQISLCVTRGFQRLRGDYSLTATALIGNFIMSLIVGSVFVNLPNDTSSFYSRGALLFFAVLLNAFSSALEILTLYAQRPIVEKHARYAFHHPFAEALASMLCDVPYKIANSFTFNIPLYFMTHLRREGGPFFTFWIFSVLTTFTMSMIFRTIAASSRSLSQALVPAAVLILGMVIYTGFVIPTRNMLGWSRWMNYIDPVAYAFESFMVNEFRNRHFPCAAIVPSGGAYDSISMENRICSTVGAQSGSSDVSGTLYLEESYGYMTKHLWRNFGILIAFLLFFMSTYLFATEYISEKKSKGEVLLFRRGYQPAHAAGEGDLEKSSQPSAVAKTDESTPSTTAIQRQTAIFQWEDVCYDIKIKGEPRRILDHVNGWVKPGTCTALMGVSGAGKTTLLDVLATRVTMGVVTGQMLVDGNPTDQSFQRKTGYVQQQDLHLSTSTVREALVFSALLRQPATVSRQEKIAYADEVIKLLGMEAYADAVVGVPGEGLNVEQRKRLMIGVELAAKPQLLLFLDEPTSGLDSQTSWSILDLIETLTKHGQAILCTIHQPSAMLFQRFDRLLFLARGGRTIYFGEIGENSSTLSNYFERNGAHHLTPGENPAEWMLDVIGAAPGTHSDIDWPKVWRESPEFGQVKDHLSELKSTLSSKAAVDTSPNAFREFAAPFHVQLLECLKRVFAQYYRTPTYIWSKAALCILTSLYIGFSFFHAQNSIQGLQNQMFSVFMLMTIFGNLVQQIMPNFVTQRSLYEVRERPSKTYSWKAFMISNILVEMPWNTLMAALMYFCWYYPIGLYKNAEPTHAVSERGALMFLLIWSFLLFTSTFAHMVIAGIELAETGGNIATLLFSLCLIFCGVLATKEAMPGFWVFMYRVSPFTYLISAMLSTGVSGADAVCEAVEYLKFNPPANQTCGDYMSAYIKVAGGYLQNPMATTDCAFCTVSTTNMFLSRISSTFSEAWRNFGLMWVYIIFNIAGALFIYWLARVPKGK

SEQ ID NO: 60661 - protein, 377 aa, Synechocystis sp. PCC 6803
MPGDYYQTLGVTRDADKDEIKRAYRRLARKYHPDVNKEPGAEEKFKEINRAYEVLSEPEIRQRYDQFGEAGVSGGGAQGFDVGNMGDFADIFETIFGGFGGGMGGQQRGRRRANGPTRGDDLRLDLQLTFQEAIFGGEKEIRIPHLESCQVCEGTGAKPGTGVKTCGTCNGAGQVRRATRTPFGSFAQVSACPTCNGSGEVIEQKCEACNGVGRKQETKKLKITIPAGVDDGTRLRVGKEGDAGLRGGPAGDLYVFLMVETDKHFVREGMNIRSNLEVSYLQAILGCRLEVDTVDGKAELTIPAGTQPNTVLTLENKGVPKLGNATIRGDHLITVKVQIPTRINSEERELLERLATIKGESHGKGGLEGFLGGLFHK

SEQ ID NO: 60662 - protein, 457 aa, Rubrobacter xylanophilus DSM 9941
MRFPEGFLWGAATAAYQVEGAVGEGGRGPSIWDTFSHTPGRVYRGDTGDVACDHYHRLEEDLDLMARFGLGAYRFSVAWPRIQPEGRGPANRSGLDFYRRLVEGLGERGIEPVLTLYHWDLPQALEDQGGWTSRQTSERFAEYAALVYEALGGSVRFWITLNEPWVSAWMGYGLGVHAPGRRSTADALAATHHLLLGHGLALEALRALGGGGRLGITLNLSPVRAASAEPADAEAARRVDGNANRLYLDPLFRGSYPQDMLEHYRGASDFSFVRDGDLQRISAPVDFLGVNYYMRHTVRAAPGGGVRGPSTGMRFGELGAETVLPEGVGTTAMGWPVEPDGLAEILVRVKEEYRDLPVFVTENGCAVHDYIDPEGEVNDVERVAYLDAHLRAAHAALERGVDLRGYMVWSLLDNFEWAEGYSKRFGLVYVEYGSQRRVPKRSARWYAAVIRRGGPEG

SEQ ID NO: 60663 - protein, 269 aa, Pasteurella multocida subsp. multocida str. Pm70
MDKYAVWGNPIAQSKSPQIHQIFANQTQQQMEYVAMLGDEQDFEQQLRVFFEKGAKGCNITAPFKERAFQLADLHSERCLTAEACNTLKKLDDGRLYGDNTDGAGLVSDLQRLGWLKPEQTILILGAGGATKGVLLPLLQAKQHIVLANRTLSKAEDLAQKFAQYGQIQAVELDNIPVQSFDLIINATSSGLHGQTVQMNPEILQNATALYDMQYAKQADTPFVALCKQLGKQNVSDGFGMLVAQAAHAFHLWRGVMPEFEALLEQEWL

SEQ ID NO: 60664 - protein, 1618 aa, Gibberella zeae PH-1
MIYKSENPEIFFSSKQTVWSWLFDSKTFGSGDNAPGFTDAITKKHISYGLLRDYATSLSSVLVAQYGLKQNDTVIVYGRNSIWWPVATLSTVRVGGVACGVSPDYTIDELAYSLKTSQSKIMFATVDNIDNAQAAAAKVGIPKENVILLEGSAKGCASIQTLLEKSHNVAEVPAFQIPAEKTNAEVCTFLCFSSGTTGLPKAVMISHANIISQCLQVADLTLASHSRILAALPFYHITGIVHQLHFPIFLNANVYVLAKFTLDTLLQTASENKIKELLLVPPIIIRLVRDPKLVAKYDLSHVQRFSSGAAPLSREILTLLEKAFPGTGFKQGYGMTESCSCIVAHPPGKYAYKYADRVGTLVGSTELRIVDIETGKDCEVNKPGEIWARGPQMAMGYLNNPKATQDTFDKDGFLHTGDIGYINEEGFLAITDRLKEMIKVKGIGVAPAELENLLQGQPQVDDVAVCGIPDERAGERPKAFVVLKASHASRPVEAAREIFENVKKETARHKWLEEIEIVSAIPKSPAGKILRRKLQDKSPLSGVNARIFTDVIDRTMQLTRIDYKPTSSQMHPEVPSRIDVPGDHPPTGPRSYIPSVRCGYRLSTNTPTDQLDNMRLSRCQLLTSTAAVGVVVGQSILPSSNHDSTIKGFEAPAMEYRPRFRYWLPDADVDHDILKNDIQDLKKLGAGGLEFVPFYNYGFGGVNDSKLETYAFGSPAFKNVLQIALEATKANGLSIDVALGASQGQGVPSKPLTPGLAVQLVYGKTSVKGGAKFDGALPAADINWNENLGYIHPQEKFGGNRLIGVSAAAVASKNVSGDNTYVSLHEKSLVDLTKHVKDGKITWTAPTDHKEYVLFAHYERYTNQRSADGVPTSVIANGSWVTDHFSATGAKLAAQFWEKNLLSTQIRQLLKEVGKHTWEDSMEIQASLYWSPGFLDNFKTKRGYNVIKYLPLLFHKSTSFQAARAPYNTTFILDNIPDNGQSKYLQDYRTTLNEGYQEYLQEFENWAESLGLSHSCQVGYGVPLDVLADVPIVSVPELESLGFLTPDQMSQFVGPAHLGRRNIISTEIGAVSAGAYSQTIPSLVNLFHEAFAGGVNAMMIHGMTYTGQQLGSTWPGFTPFQFIYTEMWSPKQPAWNYMSAMIDYTARNQFVLQKGVPKKDLVFYLYKNPYGMEDQYNGTDLRTRGFTYEYLSPANSGSKALKVSNKVLDPSGAEYRALVLDQQHFITAEAAQKLVELADAGLPIVVIGSLPNTTIGSNGQDIVSKSVAKLQGSKHSNVAFIKSSDDLFGALDKLSVQPRVKTGSEAAGNLYTVWRSDKGSDYLFLVNQGSSATFEITAEVEQGKVPYRLNAWTGQQVAMVSFKPSSGKVTFEVSLKKDQTAIIAFTSKKSKTSIVSQSKNVIDTSYDSTGDGLTVVLGDTKAASLTLSNGQTKKVPAMSSSDKKKLLNIDISNWNLTLESWVPGPDETKSASIKKAMNLGIQKTLKPWSEISGAQNVSGVGTYTTTFQVPQVPSKDSIVVLQFGPVLNTIQAWVNDKQLPAIDIYDAQVDVSDYLVSGSNTIRVEVASTLFNAVKARVNYVKANGIGPAAPALYTSADWQKHGLVGPVSLKSLRKVNL

SEQ ID NO: 60665 - protein, 241 aa, Cryptococcus neoformans var. neoformans B-3501A
MYHLVKGLHDYLTRKDEYSVVIIGLDNAGKTTLLERIKTMYNPTPGMAPDKIGPTIGQNIGKISLPSTTLLFYDLGGQRDIRTIWEKYYDECHAVVFVLDATDQARLSETWEVFDEVLNSPRLLNLPLLLLANKQDSPSCLSVAEIRESFDAWQRARTNRNQDGNKDDLKEPGKGKAPLKEADEPRETDASRTEGQGWDDGGAKEERMASLDVMGVSALEGTGVSDAINWLYIRVQNARKM

SEQ ID NO: 60666 - protein, 841 aa, Coprinopsis cinerea okayama7#130
MCVISAAGLYWSGFLRFTDATYEDREELFDEENELEAGCGTIDDWVGEWDEKVTSPGSYLAFKELFAIVKGGFLRSLGLNAWTRGRDHDGIDRQQFDGIDESDGPGVAPPKTTKALLRPQGSVMLRRTTLGCRSWRLPQHQQQHGRVLAAGFPNVRLLSAQPGSEAGGKRSAGFDGASGSKGSGYTGPAPRGGHGSTSNSYSTPPGGNGRSRLHKYSKRLVYTGLGLASLYAWDHYSNASAIFRNVRTLWTCLAITLDYKINFTPEKSDQIPQLHERVAERVYNLLTSNGGLYIKIGQAIGANAAVLPKPMQIKFASLFDDAPQVPYKVVEEVIINELGKKPSGRTREEGAFEVFDEKAVASASVAQVHKAKTWPRRVVKEVNGKMMEVEEEGEWVAVKIQKPSVAKQMEWDLAAYRFVMWMFENWAFDLPVYFVVDFISDHLRQELDFVREANNALQTAQFVEKEPSLRDRVHIPKVFPEYSSKRVLTAEWIDGVRLSDKAGIYRLMGEHEPEYNPIAPPEIDPLSATALVSTGPATTSPTTTTTTAFQYPAKPLKGGLSSVMKTMVELFSAQMFSWGWVHCDPHPGNVIVRPSPADPTKAQLVLIDHGLYVRVPEDFKRQWVHLWRSMLSGDYQGVKKAAESWGMGFPEFLASFTLMKPVSLKRGRRRKTPEEEMEEERKREERRKMSQYELSVLMKQKLKEFLIDTDRMPKVLIFLIRNMRMVQGNNQSFGSPVNRIKITADWASRSQFKNANLSVRERITEWWHHLVYRFIMFTIDFAFYKNKFFLWLNQVRDRLLTRDGEAPKKRKEGFEEEMERNMRDFAKDNLGLDVPASTFAG

SEQ ID NO: 60667 - protein, 211 aa, Pseudomonas syringae pv. tomato str. DC3000
MQLKNPILGLCQQATFMLSAAKVDQCPDDEGFEVAFAGRSNAGKSSALNTLTHASLARTSKTPGRTQLLNFFGLDEDRRLVDLPGYGYAKVPIPLKLHWQRHLEAYLGSRESLKGLILMMDIRHPMTDFDLLMLDWAIASHMPMHILLTKADKLTYGAAKNTLLKVQAEIRKGWGDAVSIQLFSAPKRMGLEEAYTVLAGWMELEDKAPAE

SEQ ID NO: 60668 - protein, 239 aa, Lactobacillus acidophilus NCFM
MRVNIMKPNDITELQKDIDQAKHITFLTGAGVSTHSGIPDYRSKNGIYNGIKESPETILSEATLFHRPELFYNFVMENMYFPSAQPNLIHKKIAQLCSQKGDLITQNIDGLDTKAGNTHVTEFHGNLYNIYCTKCHQQVSYSEYANGYLHKNCGGIIRPGIVLYGEAINPEVLNVSINNMQKSDLIIISGTSFVVYPFAQLLAYKKGSAKIYSINKTAIPAPQVTQIIGDALDVFKQLN

SEQ ID NO: 60669 - protein, 402 aa, Zymomonas mobilis subsp. mobilis ZM4
MIGRITMAITPLMPVYPRCAVRPVRGEGCYLFGEQGERYLDFASGIAVNILGHGHPHLVKAIQEQAATLMHVSNMYGSPQGEAFAKRLLSHCFADTVFFTNSGAEAIECAIKTARRFHYANGNPERFKLITFSNAFHGRTMGTISATNQPKMVDGFKPLLPGFQVVEFNDLAAAEAAVDDQTAGFLVEPIQGEGGIRPATDEFMKGLRRICDEKGLMLVLDEVQCGYGRSGTFFAHEQYGIKPDIMAVAKGIGGGFPLGACLATEHAAKGMVFGTHGSTYGGNPLAMAAGQSILDIILEDGFFDHVQKMGNILAEKLETIVKKYPELCLEARGRGLIRGLKLSVPSRDVVAHLRDNHGLLTVAAADNVIRILPPLVIEEKHIDEFMEKLEAGLKSYVPAQAA

SEQ ID NO: 60670 - protein, 395 aa, Cytophaga hutchinsonii ATCC 33406
MKTVDSFNFSGKKALIRVDFNVPLNKSFEITDDTRLKAVLPTVSKVLKDGGSAILMSHLGRPKGGPEEKYSLKHILPYLNKMFGQEVLFAADCIGEDAKAKAAALKPGQVLLLENLRFYPEEEKGDVEFAKKLSVLGDVWVNDAFGTAHRAHASTAVIGQFFKDKVCGYVMQAELDNANKLLKQGEKPITAVMGGSKISDKIMVIENLLDTVDNLIIGGGMSYTFTKALGGKIGKSINEPDKLELALSLIEKAKAKNVKLYLPLDNVVADDFSNDANKQTVKTGEIPDGWEGLDIGPETVKLFSEVVANSKTVLWNGPMGVFEFANFATGTIAIAKAVKEATQKGAFSLIGGGDSAAAINNLGFGNDVSYVSTGGGALLEYFEGKTLPGVAALEK

SEQ ID NO: 60671 - protein, 210 aa, Staphylococcus aureus subsp. aureus Mu50
MTKYKIDFSKGLVPAILQDNQTKQVLMLGYMNQEAFDKTIEDGVVCFYSRSKQRLWTKGETSGHTQLVKDIHVDCDNDTILIDVIPNGPTCHTGSQSCFNTEVPFSVQTLAQTVQDSAQSNNEKSYTKYLLTEGIEKITKKYGEEAFEVVIEAIKGDKKAFVSEVADELYHLFVLMHALGVDFSEIEAELARRHHKRNNFKGERQNIEQW

SEQ ID NO: 60672 - protein, 183 aa, Glycine max
  misc_feature (128)..(128): Xaa can be any naturally occurring amino acid
  misc_feature (135)..(135): Xaa can be any naturally occurring amino acid
  misc_feature (143)..(143): Xaa can be any naturally occurring amino acid
MSTEKEKTSAPSSSSSSSSSSPSVELCKGVNGLEKILLRESRGSSTEVYLYGGHVTSWKNDHGEELLFLSNKAIFKTPKAIRGGIPLCFPQFGGLGTLDQHGFARNRFWAIDDDPPPFPTNTLSKAFXDLILTLXRDTKIWPXSFDFRLRIALGPGGDLMLTSRIRNTNSEGKPFSFTFAYHT

SEQ ID NO: 60673 - protein, 475 aa, Bartonella henselae str. Houston-1
MLNDANNELKRNLQNRHIQMIALGGVIGTGLFYGSKEAIQLAGPSAILAYLIGGLIIYFIMRMLGEMSVEEPSSGAFSFFAYKYWGRLAGFITGWNYWFLYILVSMTELTVIGFYLDHWILIDHWKSSFIVLLLITLVNLFNVRFYGEFEFACALIKVAAVISMIIFGIFLIVTGVGGNQASIHYLWCHGGFFSYGAIGVVLATSVVMFSFGGTELIGIAAGETSNPQKTIPVAIRQVMWRIIIFYIGSISVIMIISPWNMIEKNSSPFVTIFETLGIPAAGHILNFVVIMAAISVYNSGIYSNGRMLYSLAIQKNAPYIFSKLSTARVPYIAILFSSFCTAIIVVINALVPDNSFMRIMALATAAAVITWAIIIIVHLKFRKAHKNKKEDFMYAFGLYPYANYLCLCFLALLFCIMFVSGFGKNGLMTRLFDMIGIKMSFLETYIPMQMPDMSLAVVIIPLWCLFLFLGYKLKR

SEQ ID NO: 60674 - protein, 527 aa, Glycine max
MDSPNALSTAPAAGSRKNATLICVPIMGESVEKMEIDVDKAKAGGADLVEIRLDSLKTFDPYRDLNAFIQHRSLPLLFTYRPKWEGGMYDGDENKRLDALRLAMELGADYIDIELQVAHEFYDSIRGKTFNKTKVIVSSHNYQLTPSIEDLGNLVARIQATGADIVKIATTALDITDVARMFQIMVHSQVPFIGLVMGDRGLISRILSAKFGGYLTFGTLESGVVSAPGQPTLKDLLYLYNLRQLAPDTKVFGIIGKPVGHSKSPILFNEVFKSIGLNGVYLFLLVDDLANFLRTYSSTDFVGFSVTIPHKETALKCCDEVDPVAKSIGAVNCIVRRPTDGKLIGYNTDYVGAITAIENGLRGKHNGSSTTISPLAGKLFVVIGAGGAGKALAYGAKAKGARVVIANRTYDHARKLAYAIGGDALALADLDNYHPEDGMILANTTSIGMQPKVDETPVSKHALKYYSLVFDAVYTPKITRLLKEAEESGATIVTGLEMFMGQAYGQYENFTGLPAPKELFRKIMENY

SEQ ID NO: 60675 - protein, 192 aa, Staphylococcus aureus subsp. aureus Mu50
MIYQKQRNTAETQLNISISDDQSPSHINTGVGFLNHMLTLFTFHSGLSLNIEAQGDIDVDDHHVTEDIGIVIGQLLLEMIKDKKHFVRYGTMYIPMDETLARVVVDISGRPYLSFNASLSKEKVGTFDTELVEEFFRAVVINARLTTHIDLIRGGNTHHEIEAIFKAFSRALGIALTATDDQRVPSSKGVIE

SEQ ID NO: 60676 - protein, 523 aa, Rubrobacter xylanophilus DSM 9941
MGEKVYRTELTPVSFLRRSAFMFPEKTAVVYGDRRYTYREFERRVDRLASGLREAGLRGGDRVAFICPNTPPLLEAHFAVPAAGGVLVAINTRLSPEEVGYILEHSGARFVFADAGLEHLASGAEAQRVRIDDTGAEGDPYEDFLAAAPPEPPESPLKDEEETISLNYTSGTTGRPKGVMYSHRGAYLCALGNVIEAGMGYETRYLWTLPMFHCNGWTYPWAVTAVAGTHVCLRRVEPGRIWRLFKEEGITHYCAAPTVQVGIINDEAAHRLPRPVRAMIAGAPPSPTLIAGLGDLNIDPVHIYGLTETYGPITTSAPRKEWEELPAEERARLLARQGNAYVTADIVRVVDENLQDVPRDGETMGEIVMRGNMVMKGYFENEEATREAFEGGWFHSGDVAVWHPDGYVEIRDRRKDIIISGGENISTIEVEQAVVSHPAVLECAVVAIPDEKWGERPKAFVTLKKGHNATEEEIIEHCKAKIARFKAPSAVEFVEELPKTSTGKVQKFVLREKEWAGQEKRVH

SEQ ID NO: 60677 - protein, 301 aa, Synechocystis sp. PCC 6803
MADFVSTSPFGPVLTAMVTPFNADGGVDYGVAEKLADHLITHGSDGLVVCGTTGESPTLSWEEEHELFRVVKQTVGDRGSVIAGTGSNCTREAMEATQIAAKLGVDGSLQVVPYYNKPPQEGLLAHFQAIANCAPELPLMLYNIPGRTGQSLAPETVYRLAEVENIVAIKEATGSLEQASLIRAHTPDDFAIYAGDDVLTLPLLAVGGAGVVSVASHLVGDRLQAMVQHFAQGATAQALEIHLQLIPLFKILFCATNPIPVKTALGLQGWPVGSFRPPLCALSPGHTEQLRDVLRDLALLP

SEQ ID NO: 60678 - protein, 134 aa, Oceanospirillum sp. MED92
MQIRGYIMSNKSIISTDKAPAAIGTYSQAVKVGNTVYLSGQIPLNPETMEMVTESFEAQAIQVFENLKAVAEAAGGSLNDFVKITVLLSDLEYFAQVNEQMEKYFAAPYPARAAYAVKALPKGADIEIEAVMAV

SEQ ID NO: 60679 - protein, 421 aa, Aspergillus nidulans FGSC A4
MSLTSKLSITDVDLKDKRVLIRVDFNVPLDKNDNTTITNPQRIVGALPTIKYAIDNGAKAVILMSHLGRPDGKKNPKYSLKPVVPKLKELLGRDVIFTEDCVGPEVEETVNKASGGQVILLENLRFHAEEEGSSKDADGNKVKADKDAVAQFRKGLTALGDIYINDAFGTAHRAHSSMVGVDLPQKASGFLVKKELEYFAKALEEPQRPFLAILGGSKVSDKIQLIDNLLPKVNSLIITGGMAFTFKKTLENVKIGSSLFDEAGSKIVGNIIEKAKKHNVKVVLPVDYVTADKFAADAKTGYATDEQGIPDGYMGLDVGEKSVESYKQTIAESKTILWNGPPGVFEMEPFAKATKATLDAAVAAVQNGATVIIGGGDTATVAAKYGAEDKISHVSTGGGASLELLEGKELPGVAALSEKSK

SEQ ID NO: 60680 - protein, 180 aa, Amaranthus hypochondriacus
MASSLMSNAITAVVGASGAQANMVAPFNGLKSIASFPVTRKSNDITSIASNGGRVQCMQVWPPVGKKKFETLSYLPPLSDAQLLAQVQYLLNNGWIPCIEFELEHPFVYRENHRSPGYQDGRYWTMWKLPMYGCTDPAQVLNEVEEAKKAYPSAFIRIIGFDNKRQVQCVSFIAFKPPGY

SEQ ID NO: 60681 - protein, 184 aa, Amaranthus hypochondriacus
MASSMMSNAATAVAVAATSGGAQANMVAPFNGLKSIASFPVTRKSNDITSIASNGGRVQCMQVWPPVGKKKFETLSYLPPLSDAQLLAQVQYLLNKGWIPCIEFELEHPFVYRENHRSPGYQDGRYWTMWKLPMYGCTDPAQVLNEVEEAKKAYPTAFIRIIGFDNKRQVQCVSFIAYKPADSY

SEQ ID NO: 60682 - protein, 348 aa, Prochlorococcus marinus str. AS9601
MKNLLGSSINDLENVALDYGQAAFRGRQIYNWIYNYRNKNKNIDQIEVLPLDFREKLKVDGFKVSELVIKERNLANDGTLKLLLSTEDNESIECVGIPTEKRLTACLSSQVGCPMDCKFCATGKEGLKRSLKASEILDQILFIEYEMNRKVTNIVFMGMGEPLLNIDELLLSIRSINNDFQISQRKITVSTVAIPKMISKLSAKSFQILSNCQFTLAISLHASNQKTRETIIPSAKNYEIKNIIEDCKTFVRETGRRVSFEYLMLSGVNDKLEHACELSNLLKGFQCHVNLIQYNQIDEVEFQRTSLKNLQLFQSRLVNNGIAVSLRKSRGLDKNAACGQLRQNAKSK

SEQ ID NO: 60683 - protein, 254 aa, Hyacinthus orientalis
KSKKLKHKVKDPVRFNPNSEPKSSAAAAEPKAAFDDEWWFSFWNKNCDSGSNIPLDEEAAFKYFFRVSRPTFEYICSLVRDDLVSRPPSGLINIEGRLLSVEKQVAIAMRRLASGESQVSVGGAFGVGQSTVSQVTWRFVESMEERARHHMRWPEPERMEQIKARLEAAFGLPNCCGSIDATHIVMTLPAVESSDDWCDQERNYSMFLQGIVDDEDEGSYMVTGWPGSMTFFRLVEVLGLLQTVPQPGSRLMVP

SEQ ID NO: 60684 - protein, 1121 aa, Pisum sativum
  misc_feature (28)..(28): Xaa can be any naturally occurring amino acid
SNNNNNRNIKRESLSMRKAIAQYTEDAXLHAVFEKSGDSFDYAQSIRVTAATESVPEQQITAYLAKIQRGGFIQPFGSMIAVDETSFRVLAYSENARDMLGIAPQSVPSMEDDSSSSSFFSLGVDVRSLFSASSSVLLEKAFSAREISLMNPIWIHSRSTGKPFYGILHRIDIGVVIDLEPARSEDPALSIAGAVQSQKLAVRAISQLQALPGGDVKLLCDAVVESVRELTGYDRVMVYKFHEDEHGEVVAESKRVDLEPYIGLHYPATDIPQASRFLFKQNRVRMIVDCNASPVRVFQDEALVQPVCLVGSTLRAPHGCHAQYMANMGSIASLAMAVIINGNDEDGGGIGGAARGSMRLWGLVVCHHTSARCIPFPLRYACEFLMQAFGLQLNMELQLAVQSLEKRVLKTQTLLCDMLLRDSHTGIVTQSPSIMDLVKCDGAALYYQGNYHPLGVTPTESQIRDIIDWLLAFHSDSTGLSTDSLADAGYPGAASLGDAVCGMAVAYITEKDFLFWFRSHTAKEIKWGGAKHHPEDKDDGQKMHPRSSFKAFLEVVKIRSMQWDNAEMDAIHSLQLILRDSFKEAENNDSKAVVHTHMAELELQGVDELSSVAREMVRLIETATAPIFAVDVDGRINGWNAKVSELTGLLVEEAMGKSLVHDLVYKESRETVDKLLSHALKGEEDKNVEIKMKTFGPGNQNKAVFIVVNACSSKDYTNNIVGVCFVGQDITGQKVVMDKFINIQGDYKAIVHSPNPLIPPIFASDDNTCCLEWNNAMEKLSGWSRADVIGKLLVGEVFGSFCQLKGSDAMTKFMIVLHNALGGHDTDKFPLSFLDRHGKYVHTFLTANKRVNMDGQIIGAFCFLQIVNPELQQALTVQRQQDSSSLARMKELAYICQEVKNPLSGIRFTNSLLESTCLTDEQKQLLETSVACEKQMLKIVRDIALESIEDGSLELEKQEFLLENVINAVVSQVMLLLRDRKLQLIRDIPEEIKALAVYGDQLRIQQVLADFLMNVVRYAPSPDGWVEIHVFPRIKQISEGLTLLHAEFRMVCPGEGLPPELIQDMFHNSRWVTQEGLGLSMSRKIIKLMNGEVQYVREAERCYFLVLLELPVTRRSSKAIN

SEQ ID NO: 60685 - protein, 468 aa, Pseudomonas syringae pv. tomato str. DC3000
MSKSVQLIKDHDVKWIDLRFTDTKGTQHHVTMPARDALEDDFFEVGKMFDGSSISGWKGIEASDMILLPDDETAVLDPFTEEPTLILVCDIIEPSTMQGYDRDPRAIARRAEEYLKSTGIGDTVFAGPEPEFFIFDEVKFKSDISGSMFKIYSEQGSWMSDQDVEGGNKGHRPGIKGGYFPVPPFDHDHEIRTAMCNALEEMGQTVEVHHHEVATAGQNEIGVKFNTLVKKADEVQTLKYVVHNVADAYGRTATFMPKPLYGDNGSGMHVHMSIAKDGKNTFAGEGYAGLSDIALYFIGGIIKHGKALNGFTNPATNSYKRLVPGFEAPVMLAYSARNRSASIRIPYVNSPRGRRIEARFPDPAANPYLAFAALLMAGLDGIQNKIHPGDAADKNLYDLPPEEAKEIPQVCGSLKEALEELDKGRAFLTKGGVFSDDFIDAYIALKSEEEIRVRTFVHPLEYELYYSC

SEQ ID NO: 60686 - protein, 368 aa, Hyphomonas neptunium ATCC 15444
MKTRAAVAFEAKKPLEIVELDLEGPKAGEVLVEIMATGICHTDAYTLDGLDSEGIFPSVLGHEGAGIVREVGAGVTSVKPGDHVIPLYTPECRQCKSCLSGKTNLCTAIRATQGKGLMPDGTSRFSYKGQTVFHYMGCSTFSNFTVLPEIAVAKIREDAPFDKACYVGCGVTTGVGAVVNTAKVQVGENVVVFGLGGIGLNVIQGARMAGADMIVGVDINPDKEEWGRKFGMTHFVNPKNVSDVVAHIVELTGGGADYSFDCTGNTTVMRQALECCHRGWGTSVVIGVAESGKEISTRPFQLVTGRNWRGTAFGGAKGRTDVPKIVDWYMNGKIEIDPMITHVMTLDKINDAFDLMHEGKSIRSVVVY

SEQ ID NO: 60687 - protein, 264 aa, Oryza sativa (japonica cultivar-group)
MCHMSACALLSYAAIAWLRVVPMQLVRSRVQLAKIAALSLVFCGSVVSGNVSLRYLPVSFNQAVGATTPFFTAVFAYIMTVKRESWVTYLTLVPVVTGVMIASGGEPSFHLFGFIMCIGATAARALKTVLQGILLSSEGEKLNSMNLLLYMAPIAVILLLPATIFMEDNVVGITIELAKKDTTIVWLLLFNSCLAYFVNLTNFLVTKHTSALTLQVLGNAKGAVAVVVSILIFRNPVSVTGMLGYTLTVIGVILYSESKKRNKP

SEQ ID NO: 60688 - protein, 318 aa, Ralstonia eutropha JMP134
MNQLEQLKQFTTVVADTGDFQLMKQYTPQDATTNPSLILKAVQKPEYRGLLEQAVRDYHNEGGVDAVMDGVLIAFGCEILAIVPGRVSTEVDARLSFDTEATVEKARHLIRLYEQRGVARERVLIKIASTWEGIRAAEILQREGIRCNMTLLFSLVQAVACAEAGAQLISPFVGRILDWYKKQAGDQWDAAANAGDNDPGVRSVRQIYDYYKKFGYNTEVMGASFRSTAQIVALAGSDLLTISPDLLEQLARTEGTVERKLSVDLAQAGNIARIPADEPAFRWQLNEDAMATEKLAEGIRLFAADAIKLEKLVAEIAG

SEQ ID NO: 60689 - protein, 189 aa, Methanosarcina mazei Go1
MRELKILVVNNYGQFCHLIHRTVRDLDMDTKIIPNVTPIEEILAEEPDGLILSGGPEMERAGLCFDYVREIDVPILGICLGHQAIALAYGGHVHAGKKGGYAEIEVEVLEEDDILRGLGPKTTVWASHADEVAILPDGFIHLARSDVCEIEAMRHPTKPIYGVQWHPEVSHTKKGEELLMNFFEVCDLY

SEQ ID NO: 60690 - protein, 242 aa, Methanosarcina mazei Go1
MTQIGSFDLEKKTAVVAVILEKPLENSKKAAEKGADILEIRLDLLGIRTPERAAEVIREIKAETGIPIIVTSRSGAEGGKWDGKEEDRTGLLINLLSLKDGPDAIDIELSAGMKERNRVIKAAKDRETAVIVSSHDFLKTPPLQNMRTIIEEMFLAGADIAKLAVMPLSVGDTLNLLRVTLDFKDAGKSVCTIAMGSQGKHTRVVAPFYGSVLTYASIESNASAAPGQLPVDEVKKIMEMLK

SEQ ID NO: 60691 - protein, 280 aa, Methanosarcina mazei Go1
MKQVFGVFGDPVGHSLSPAMHNAAFSALGMDCIYHAFRVTPEKLEKAILGAEAMGFGGINLTVPLKEKALKLDFVKPDPLAKRIGAVNTLVFGKKGDIQGYNTDGPGAKQALLDTGVEIRGSRMVVAGAGGAARAVAFQLAADGADITVINRTEERAVGLAREISAADLPGKIRGTGLSGLKELLRDADVLINTTTLGMHPNTDATIVTAEELHSGLTVFDIVYNPLETRLLREARTSGAKTISGVLMLVYQGAEAFRLWTGVEPPLELMKKTVLEALQA

SEQ ID NO: 60692 - protein, 193 aa, Synechocystis sp. PCC 6803
MFNNILKQVGDYAKESLQAAKYIGQGLAVTFDHMSRRPITVQYPYEKLIPSERFRGRIHFEFDKCIACEVCVRVCPINLPVVDWEFNKAVKKKELKHYSIDFGVCIFCGNCVEYCPTNCLSMTEEYELAAYDRHDLNYDNVALGRLPYKVTEDPMVTPLRELGYLPKGVIEPHNLPKGSQRAGQHPEDLVKAE

SEQ ID NO: 60693 - protein, 334 aa, Thermus thermophilus HB27
MAYRICLIEGDGIGHEVIPAARRVLEATGLPLEFVEAEAGWETFERRGTSVPEETVEKILSCHATLFGAATSPTRKVPGFFGAIRYLRRRLDLYANVRPAKSRPVPGSRPGVDLVIVRENTEGLYVEQERRYLDVAIADAVISKKASERIGRAALRIAEGRPRKTLHIAHKANVLPLTQGLFLDTVKEVAKDFPLVNVQDIIVDNCAMQLVMRPERFDVIVTTNLLGDILSDLAAGLVGGLGLAPSGNIGDTTAVFEPVHGSAPDIAGKGIANPTAAILSAAMMLDYLGEKEAAKRVEKAVDLVLERGPRTPDLGGDATTEAFTEAVVEALKSL

SEQ ID NO: 60694 - protein, 231 aa, Prochlorococcus marinus str. AS9601
MKQVVADAAIREVKSDMILGLGSGSTAALMIKSLADEMRSGKLQNIRGVATSFQSEVLALELNIPLIDLASVSQIDLAIDGADEVDPGFQLIKGGGACHVREKLVASKSDQLLIVVDETKLVQNLNLSFPLPVEVLPNAWKQVQEVISEMNGSSSLRMANKKAGPVVTDQGNLVLDVLFNDGIKNPKDIEKTINNIPGVLENGLFVDLTDKVLVGKIENNTPVVYSPSRVS

SEQ ID NO: 60695 - protein, 500 aa, Mycobacterium smegmatis str. MC2 155
MSEHYSMYIDGKWIDTDEVYEIRSPATEELVATVAKGNTASVDAAVEAAKGAFAEGTWRRTPPAQRAAIINNVAERLGARADELAALQTRENGATIRITGALHVGLSVAQLQYLAAIAENYEWETPGPAIEPVAADGVVVREPLGVVAAIVPWNIPLLTTVWKIGPALVAGNSVVLKPDEHAPLLALELAREFDAAGLPPGVLNVVTGDGEPVGAHLSGHPDVRKVAFTGSTAVGKSILRQSADTVRRVTLELGGKGANIILDDADIDMAVDGALFACMANNGEACEAGTRLLIPASRRDEIVDKLLARASTLRVGDPLDPATHIGPVISQTQRDRILNYFRIAAEEGAIAALGGKARSGPEFDKGYWIEPTIYLDVTNDMRVAREEVFGPVLVVMTYDTDEDALAVANDTNYGLSAGVWGSEERATALARRLEAGMVWVNNWHIIHPAYPFGGYKESGLGREGGPNAIDEYVEEKFIAVDRSGGIENKAFAIVIDPAGD

SEQ ID NO: 60696 - protein, 388 aa, uncultured bacterium 443
MNREFDVIIYGASGFTGRLVAEYMSNTYGRSINWAMAGRNAVKLADVRDEIGASTDTPLVTADADDLDSLRVMVKSAQCVCSTVGPYQLYGSDLVKLCAEEGTHYVDLSGEPGWMHDMIAAHHETARASGARIVHSCGFDSIPFDLGVYFLQQEAIKTTGAPMPRIRGRVRAMNGEFSGGTAASLGATMAALKTNPALINILANPFSLANGFQGPTQPSDAKAYEDEAIGAWVAPFIMAPINTKNVHRSNALLGHLYGENFEYDEMMVTGRGDQGKAVAEMMATSNPLGGDDAPKPGEGPSKESREAGHYDVLFLGTNAQGDSLKASVTGDMDPGYGSTSKMIAESALCIIQDCTDLPGGIYTPAPAMGDKLITRLTSKAGLTFSLED

SEQ ID NO: 60697 - protein, 216 aa, Brassica napus
  misc_feature (129)..(130): Xaa can be any naturally occurring amino acid
  misc_feature (133)..(133): Xaa can be any naturally occurring amino acid
  misc_feature (138)..(138): Xaa can be any naturally occurring amino acid
  misc_feature (144)..(144): Xaa can be any naturally occurring amino acid
  misc_feature (160)..(160): Xaa can be any naturally occurring amino acid
  misc_feature (166)..(166): Xaa can be any naturally occurring amino acid
  misc_feature (173)..(173): Xaa can be any naturally occurring amino acid
  misc_feature (175)..(175): Xaa can be any naturally occurring amino acid
  misc_feature (178)..(179): Xaa can be any naturally occurring amino acid
  misc_feature (187)..(187): Xaa can be any naturally occurring amino acid
  misc_feature (196)..(196): Xaa can be any naturally occurring amino acid
MDSSSWINHPSVISSRRCQSRSDLYIGGGYEDLEGEDESKSEFICPFCADVFDIVGLCCHIDEEHPVEAKNGVCPVCTKRVGLDIVGHITTQHANFFKVQRRRRLRKGGYGSAYLALKKELREANLQSXXGGXTRFTXSTNLDXDPLLSSFMFSSPSTKXVTPVVXGTSATKXSXKEXXKREIQEAXLSGEDQEKXKKSEFVRGLLLSTMLGVGDS

SEQ ID NO: 60698 - protein, 514 aa, Escherichia coli O6
MSVSKKPMVLVILDGYGYREEQQDNAIFSAKTPVMDALWANRPHTLIDASGLEVGLPDRQMGNSEVGHVNLGAGRIVYQDLTRLDVEIKDRAFFANPVLTGAVDKAKNAGKAVHIMGLLSAGGVHSHEDHIMAMVELAAERGAEKIYLHAFLDGRDTPPRSAESSLKKFEEKFAALGKGRVASIIGRYYAMDRDNRWDRVEKAYDLLTLAQGEFQADTTVAGLQAAYARDENDEFVKATVIRAEGQPDAAMEDGDALIFMNFRADRAREITRAFVNADFDGFARKKVVNVDFVMLTEYAADIKTAVAYPPASLVNTFGEWMAKNDKTQLRISETEKYAHVTFFFNGGVEESFKGEDRILINSPKVATYDLQPEMSSAELTEKLVAAIKSGKYDTIICNYPNGDMVGHTGVMEAAVKAVEALDHCVEEVAKAVESVGGQLLITADHGNAEQMRDPATGQAHTAHTNLPVPLIYVGDKNVKAVEGGKLSDIAPTMLSLMGMEIPQEMTGKPLFIVE

SEQ ID NO: 60699 - protein, 955 aa, Oryza sativa (japonica cultivar-group)
MAPLCCCLLRARRLLFFFFFFFFFFFAVAVVLFSSVSVAQIPGFQSIDCGGSGNYTDEVGLEWTGDEAYVGGGAGTTASISSISGQGRRPYRTVRYFPADGRKYCYRVSVKARTRYLVRASFLYGNFDGSRVFPEFDLYVGASRWSTIVIYDESKVVTREMVALAQSGPSLSVCLANATTGHPFISTLELRPLNASLYHTAFEAAFFLSLAARINFGAPTADPVRYPDDPYDRVWESDMARRPNFLVDAAPGTIRVATDNPVFVASGERPPQKVMQTAVVGTLGALTYRLDLNGFPGSGWACSYLAEIEDDAAATARRFKLYIPGLAEVSKPTVDIGENAPGKYRVYQPGYDNISLPFVLPFAFRKTDDSARGPILNAMEIYSYIPILPASPDAVAMDALAARYQQQQHSWAREGGDPCVPAPWSWLTCTSSRVIAIRLDNNMLTGPIPDLSACTNLTVIHLENNQLEGGVPSYLSGLPKLSELYLENNRLSGVIPRALLSRTIVFKYSGNKHVRVGKQEEEERNVIIGICALMGIGLLLAAALCYAYNVSVSGRKQLQGASAGGNSKSKSIVVSAEQKKKATPVAGGGGGEIDNMMAAMAARGPLEFEVRELEEATSKFARKIGSGGFGVVYYGRLGDGREIAVKVASSNESIQGKKQLANEVALLSRIHHRNLVAFLGYCWERDSSSYMLVYEYMHNGSLKEQLQMMSISWLRRLQVAEDAAKGIEYLHCGCTPAIIHRDIKTSNILLDAHMRAKVSDLGLSKSNKATNSTTNTITTHVRGTLGYLDPHYYVSQQLTHKSDLYSFGIILLELISGRPPILLTPGAGAMASLGPWAKSHYESGDIEAIVDPSLRGRYRDVHSVWKVAETAVRCIDADPRGRPSMPEVVKDIQEAIALEMPSSESERPAASFFSPGAGAAGARSSATVRSHDLVMDNLMYDSSFCDSLNLPRTPR

SEQ ID NO: 60700 - protein, 331 aa, Thermus aquaticus
MKVGINGFGRIGRQVFRILHSRGVEVALINDLTDNKTLAHLLKYDSIYHRFPGEVAYDDQYLYVDGKAIRATAVKDPKEIPWAEAGVGVVIESTGVFTDADKAKAHLEGGAKKVIITAPAKGEDITIVMGVNHEAYDPSRHHIISNASCTTNSLAPVMKVLEEAFGVEKALMTTVHSYTNDQRLLDLPHKDLRRARAAAINIIPTTTGAAKATALVLPSLKGRFDGMALRVPTATGSISDITALLKREVTAEEVNAALKAAAEGPLKGILAYTEDEIVLQDIVMDPHSSIVDAKLTKALGNMVKVFAWYDNEWGYANRVADLVELVLRKGV

SEQ ID NO: 60701 - protein, 230 aa, Brassica napus
  misc_feature (213)..(213): Xaa can be any naturally occurring amino acid
  misc_feature (216)..(216): Xaa can be any naturally occurring amino acid
MNIFKKIIAMNIFRKKTTPKDALRTSKREMAVATRGIEREISSLQLEEKRLVAEIKKTAKTGNEAATKILARQLVRLRQQITNLQGSRAQIRGVTTHTQALYASTSISSGMKGATKAMVAMNKQMAPTKQAKVIKDFQKQSAQLDMTIEMMSEAIDETLDKDEAEEETEDLTNQVLDEIGVGVASQLSSTPKGRIATKTAAPPATTTNSNSSXIKXVDELEKRLASLRRI

SEQ ID NO: 60702 - protein, 333 aa, Zygosaccharomyces rouxii
MVNVSVNGFGRIGRLVTRIAISRKDINLVAINDPFISTDYAAYMFKYDSTHGRFDGEVSHDKDHIILNGKKVAVFNEKDPAALPWGKLGVDVAIDSTGIFKEMDSANKHIEAGAKKVVITAPSGSAPMYVMGVNEETYTPDQKIVSNASCTTNCLAPLAKVIHNEFGIKEGLMTTVHSMTATQKTVDGPSHKDWRGGRTASGNIIPSSTGAAKAVGKVLPSLQGKLTGMAFRVPTVDVSVVDLTVNLAKETSYDEIKAALKKASEGSMKGILGYTEDDVVSSDFLGDAHSSIVDAAAGIQLTPTFVKLVSWYDNEFGYSTRVVDLVEHVAKSA

SEQ ID NO: 60703 - protein, 2155 aa, Sclerotinia sclerotiorum
MTRKDGSYRNSSATSSSTGSWKSTDTIKGPGSSYFQGSSTKRGAPMQVKTDRTSRVENDAQVSPTSAGPRNTISPSSSISPNVSPREQRMAADFGNYRRDLAVLETSGGRIPQIHHNPPTAIASTNPITPWMSTGSSATGSPNGFTSFYNDSSDALSQASQLSPIARPGTAVTGHTNTSESPADAFFGDGDERRPSVASITTASSTGSKSSLGRAVGGLHKKLTSFFGEDLPSSSETSLPSQGKEVRSHSFARSHRDRNHSSATDHGHYRDASPAGGSRPRTPVPSSEVVPFLYQNSQDITLYGEAPVRENLSGPDRERYINDSSDKPPKTSSSAKSHHLPGHHLRNRSNDDTRSLRPTVSREESAFSMRFKDRNNNPMGTAAANASNPNLQRPKSPTPSGMSTWSQTTKGGNSDGPSSPRDNNNGTKRSLLNLTGRFKRHKDKDHTPSRLKETPAASRAPINGSSKQDAGKIYESPDLAKYSQDGSITGSELNLPSQSTNGNARPPGGRQGTFPKLPFRKGRGNKGAEDSDQLYDTSDRSGDNVHHLDTNLSNMEGILTKPPPLTPLDNSIFNGEEDEGKEETESLGGLGWNAPDSWAVKKIDDDNMSRLPEIDEAGIPQKAEEKANPYCIRIFKADGTFATLSTSLNTTVTELLAQLNKKTYQADSLDNYQIVMKKHDLQRILAPGERPLVIQRRLLEQAGYQPEDRIEDVGREDNSYLCRFSFLPARQGGYASVSNDNGLGRVQKFSHVDLSGKNLITIPIALYSKTSEMISLNLSRNLSLDLPKDFISSCVNLREIKFLSNEAWKLPASLSRANRLTILDVSNNRLEQLEHAELSRLQGLISLKLANNRLKSLPSYFGMYRSMRTLNLSSNFLEEFPEFLCNMTALIDIDMSFNGISNLPNEIGKLKHLERFVITNNRLKGSLPNTFGELVNLKEVDVRYNMLSSIDIIATLPKVEQISADHNSVSVCECEFAKIRILRLNSNPVTKFEIKNLVPTLTTLNLSNAKLAQIPDAAFDKMPNLNKLVLDINHFVSLPAQIGKLRKLEYFSIARNALSSLPAELGCLTELRYLDIRQNNLKKLPMEIWWANKLEFLNVSSNVLDNFPKPGSRPPQPPGDVGSTNSNNTGANSQNSSFEELGPLDFAHRRPSQASSGLLSVGSSPVPDARKGSVVSVYGKGGRKTSVVSRSTSASTINHQTPTNIRKDSGLSAKLINTFAGSLKILHLADNGLDDDVFDEITLLSELRVLNLSYNDLNDMPSRSIKSWPQLVELYLSGNELTSLPSDDFEEFSLLQVLHINGNKFQTLPAELGKAHRLQVLDCGSNSLKYNVSNWPYDWNWNWNTNLKYLNLSGNKRLEIKPSLPGSAAARDGRDLTDFSALQNLRILGLMDVTLTIPSIPDQTEDRRVRTSGSLAGQLAYGMADSLGKNEHLSIIDMVVPRFNSTETETLLGMFDGQALSSGGSKIAKYLHENFGHIFSEELKRLNALNNETPKDALRRAFLSLNKDLATAATQNTEERSLLSHRGSATPAVLSQADLISGGVATVMFLQQSELYVANVGDAQAMLIHEKDGHRILTRKHDPAEPNERQRIRDAGGWVSRQGKLNDVLEVSRAFGYVQLMPAVQAAPNVEHITIKEQDEMVLIASRELWEYLSPELVVDIARYEKHDLMRAAQRLRDLAIAFGASGKIMVMMMGVSDLKKRAQIRPHRVQSLSFNPNMMMEDGYVPSKRPKKKTDDVDDSMLRRLQAEVQAPVGDIGIVFTDIKSSTALWETYPSAMRSAIKLHNEVMRRQLRIIGGYEVKTEGDAFMVSFPTATSALLWCFAVQSALLEVNWPAEVITSNMGHEVYDSNKNLIFKGLSVRMGAHWGRPVCENDPVTRRMDYFGPMVNRTARISAVADGGQITVSADFISEIQRCLETYSESDRSGSTGSEDAFDSDFISHSIRRELRSLSSQGFEVKDIGERKLKGLENPEYIYLMYPHALAGRIQFQRSLESGEAAVVEEEPATLARDSELSIDTENVWDIWRLSLRLEMLCSTLEEPRGSALQPPETAMLEKMRNRGGEVSDRFLLSFLTHQVSRIETCTAALATRHLVIGQSLISDLDQLRAPMAGIIEGLAADLQELQKYRAMYGPLEPLEPLEPSVYEYEDEDESEDL

SEQ ID NO: 60704 - protein, 183 aa, Panax ginseng
MASSVISSATVAAVSRAVPAQASMVAPFTGLKSTAAFPVTRKVNDITSLPSNGGRVQCMKVWPPLGLKKFETLSYLPQLTQEQLSKEVDYLLRSGWVPCLEFELEHGFVYREHHHSPGYYDGRYWTMWKLPMFGCTDSSQVLKEVEECKKEYPNAYIRIIGFDNVRQVQCISFIAFKPPSAST

SEQ ID NO: 60705 - protein, 293 aa, Glycine max
MVSNFYFLLLLRFLCWLYCIRIVILLMLQLMLWQHCLTFFSFKISKKLCLFMCFSLLQDATIEQLLPIFLSLLKDEFPDVRLNIISKLDQVNQVIGINLLSQSLLPAIVELAEDRHWRVRLAIIEYIPLLASQLGVGFFYDKLGALCMQWLQDKVHSIREAAANNLKRLAEEFGPEWAMQHIIPQVLEMISNPHYLYRMTILHAISLLAPVMGSEITRSELLPIVITASKDRVPNIKFNVAKVLESIFPIVDQSVVEKTIRPSLVELSEDPDVDVRFFSNQALHAMDHVMMSS

SEQ ID NO: 60706 - protein, 541 aa, Colwellia psychrerythraea 34H
MTTINIFEQYLEPNEANYMALTPISFLERAAFVYPDKTATVNGDIRHTWLEVFQRCSRFASALAKRGIGRGDTVSVIAPNISEHFEVHFGVPMSGAVLNSINTRLDAEAIAFILVHAETKVLITDKEFSPIVKKALRMIPHKPLVIDIDDPNFNEGQLIGSLTYDQLLEEGDSDFESIRPKNEWDAISLNYTSGTTGDPKGVVYHYRGAYLNAVSNVMSWSMGEHPVYLWTLPMFHCNGWCFPWSIAATAGTSVSLRHVRAEPIFNLIRSEKVGYFCGAPIVLNMLNGAEPSLKADINHPVKVMTAGAPPPASVIEGMEASGFKVTHTYGLTETYGPSVVCAWHDEWNEESPEKQAKLKSRQGVRSPMLDQLMVADPETLEPMPKDGESVGEIFMRGNLVMKGYLKNPSTTQAAFDGGWLHSGDIAVWHSDGYIEIKDRSKDVIISGGENISSVEVEDILYRHPKVQEVAVVAKKDDKWGETPCAFITPMPNVEITEQEMISFCRDNMAHFKAPKTIIFGELPKTSTGKIQKFVLRQQANE

SEQ ID NO: 60707 - protein, 116 aa, Pasteurella multocida subsp. multocida str. Pm70
MSNIIKQLEQEQLKQNLPSFRPGDTLEVKVWVVEGSKRRLQAFEGVVIAIRNRGLHSAFTLRKVSNGVGVERVFQTHSPIVDSITVKRKGAVRQAKLYYLRERSGKSARIKERLGD

SEQ ID NO: 60708 - protein, 436 aa, Colwellia psychrerythraea 34H
MANKSEKLFNKALKVLPGGVSRNTIFRKPYPFYADKGEGCYVTDVEGVTRIDFANNMASLIHGHAYPAIVDAVTEQLAKGSCFTMATEAEVNYAQLLCDRVPSFDKIRFVNSGTEAVMAMLKASRAYTGKAKIAKVEGAYHGAYDYAEVSQTATPNNWGELDKPNSIPVAVGTPPKALEDVVVIPFNDPERAIKILDQHKDDIACILVDLLPHRVGLIPASNAFINALHQWTRDNKSLLVFDEVITFRTNYSGAQQNYDVAPDLTAMGKVIGGGFPAGALAGCDKVMKVLDPTEPKVLLPHSGTFSANPITMTAGLAAMKDFDQAAVTKLNQLASYAREAITQAMSDVGIKACVTGAGSMFRIHLKAQPPKNYRDGYVDKKESQLITKLLDHLFDNGIMMINTCTATLSTAMTKKEIDHLVCALKDGFELIKPEMA

SEQ ID NO: 60709 - protein, 518 aa, Listeria innocua Clip11262
MFKIMKDFTEQEKIIVLDFGSQYNQLITRRIREFGVYSELHPHTITVEEMKALNPTGIIFSGGPNSVYDEDAFRADERIFDMGIPILGICYGMQLMTTHFGGKVERAKDREYGKADIHVENPSRLFAGLPTDQVVWMSHGDLVVEEPAGFEVTATSKSCPIAGIADEDRLLYGVQFHPEVRHSAYGNELLKNFALNICGCKGDWTMENFSEVEIAKIQEIVGDKKVLLALSGGVDSSVVGVLIHKAIGDQLTCIFVDHGLLRKGEADQVMATLQGEFNMNIIKVDAKKRFMDKLAGVSDPEQKRKIIGNEFIYVFDDEANKLDGVEFLAQGTLYTDIIESGTATAQTIKSHHNVGGLPEDMQFKLIEPLNTLFKDEVRALGTELGMPDAIVWRQPFPGPGLGIRVLGEITEEKLEIVRDSDYILREEIKNAGLEREIWQYFTALPNIRSVGVMGDGRTYDHTVVVRAVTSIDGMTADWARIPWDVLEKISVRIVNEVDHVNRVVYDITSKPPATVEWE

SEQ ID NO: 60710 - protein, 337 aa, Synechocystis sp. PCC 6803
MTRVAINGFGRIGRNFLRCWLGRTDSQLEVVGINDTSDPRTNAHLLRYDSMLGKLDADISADENSITVNGKTIKCVSDRNPLNLPWAEWNVDLVIEATGVFVTHEGATKHVQAGAKKVLITAPGKGPNIGTYVVGVNAHEYKHEEYEVISNASCTTNCLAPIAKVINDNFGIIKGTMTTTHSYTGDQRILDASHRDLRRARAAAVNIVPTSTGAAKAVALVIPELQGKLNGIALRVPTPNVSVVDLVVQVEKNTIAEQVNGVLKEAANTSLKGVLEYTDLELVSSDFRGTDCSSTVDGSLTMVMGGDMVKVIAWYDNEWGYSQRVVDLAEIVAKNWK

SEQ ID NO: 60711 - protein, 271 aa, Streptococcus agalactiae NEM316
MKKKLKTFSLILLTGSLLVACGRGEVSSHSATLWEQIVYAFAKSIQWLSFNHSIGLGIILFTLIIRAIMMPLYNMQMKSSQKMQEIQPRLKELQKKYPGKDPDSRLKLNDEMQSMYKAEGVNPYASVLPLLIQLPVLWALFQALTRVSFLKVGTFLSLELSQPDPYYILPVLAALFTFLSTWLTNKAAVEKNIALTLMTYVMPFIILVTSFNFASGVVLYWTVSNAFQVFQILLLNNPYKIIKVREEAVRVAHEKEQRVKRAKRKASKKRK

SEQ ID NO: 60712 - protein, 447 aa, Thermus thermophilus HB27
MGHLLGEEFPAFLKALTEGKRTYGLRVNTLKLSPEAFQRISPWPLRPIPWCQEGFYYPEEARPGPHPFFYAGLYYIQEPSAQAVGVLLDPKPGERVLDLAAAPGGKTTHLAAHMGGKGLLLANEVDGKRVRGLLENVERWGAPLAVTQAPPRALAEAFGAYFHRVLLDAPCSGEGMFRKDREAVRHWGPSAPKRMAEVQKALLAQAARLVGPGGVLVYSTCTFAPEENEGVVVHFLKAHPEFRLEDARFHPLFAPGVPEWGEGNPELLKTARLWPHRLEGEGHFLARFRKEGGAWSTPRLERPAPLSQEALRAFRGFLEEAGLTLEGPVLDRAGHLYLLPEGLPALLGLRAPAPGLYLGKVQKGRFLPARALALAFGATLPWPEGLPRLALTPEDPRALAFATGEGVAWEGEDHPLALVVLKTAAGEFPLDFGKAKRGVLRPVGMGL

SEQ ID NO: 60713 - protein, 250 aa, Coprinopsis cinerea okayama7#130
MPPTASSSSSGSQPINVKLLLIGNSSVGKSSLLLRFSDEQWLPEDESSATIGVDFRVHKMEVKGKKVKLSIWDTAGQERFRTITSSYYRGAQGIILVYDVANRETFEALPRWYSELETYVSESVVKILVGNKDPPRQEYSRQVPTAEGEKFAQKMNSLFVEASAKTAVGVKEVFQELVERILDTPELWDPKSKGQGHTTAHGNGGVPGGVQVVGLSDDPQEQGGGFITDVVTISGFSVGFPFTIFTLSRI

SEQ ID NO: 60714 - protein, 106 aa, Glycine max
  misc_feature (10)..(10): Xaa can be any naturally occurring amino acid
  misc_feature (66)..(66): Xaa can be any naturally occurring amino acid
  misc_feature (81)..(81): Xaa can be any naturally occurring amino acid
ISSPTITRCXHSQAGMRTPFTVLKYMASFPTIKTNNDITSITTNGGRVQPMHVMTPLLMNKFKTTXYLPNLDDAQLAKEVXYLLKKVCIPCLEFELDHRFLFLEPN

SEQ ID NO: 60715 - protein, 594 aa, Oryza sativa
MGGFEDDEPPSKRARASSVEPASLLDSFSCLKPAAPLGSTMARPLPSQGKEVMVGSKGVIKRDEFVRIITKALYSLGYEKSGAVLEEESGITLHSPTVNLFRRQVLDGNWDSAVVTLKKVGLLDENIVKSAIFLILEQKFLELLRNDNVMGAIRTLQSEITPLGVNKKRVHELSGCIISSPQHVLLGFSKLGIESSNSRLKLLEELQKVLPPTVMVPERRLENLLEQALTVQREACYFHNSIDGLSLYTDHHCGKDQLPSCTVQVLRAHRDEVWFLQFSNNGKYLASASNDKSAIIWKVDEDGELLLKHTLTGHDKPVMMVAWSPDDCQLLTCGMEEVIRCWDVESGKCLHVYEKSGIGLISCGWFPDGKHILSGLTDHNFCLWDLDGKEVDCWKGQRSSKTSDFAVSNDGKLIISMNRESTIRLFDRETKQERLIEEDNTITSFSLSEDGDFLLVNLISEAIHLWNIRNCPIRVNRYAGHKRSRFVIRSCFGGSEQAFIASGSEDSQIYIWHRATGDLIETLPGHTGTVNCVSWNPANPHMLASASDDHTIRIWGLKKANLKRKDVGSSNGIYANGNTPSNGVVHQCNGNSSK

SEQ ID NO: 60716 - protein, 273 aa, Oryza sativa (japonica cultivar-group)
MAAAVRSVWADNFAAESAILRAVAPCAVYAAINVQYPGCVVSAAGGAGDHRCYYDLTAEERYQVVRANADELKPLQLGLAVRTADGGRFAWEFNLNEFDLAADGDMCEPGSVDYLRHRGMDFNALPWSGVGAASLGRLLWSSGLLAARPSWATFAGAYHVAYFARILMLAVAVAGTGGGGAARRLPADVGGFEEMVRSLLGHHVYDVRLLAGELRGPLADVARQLGAAVPADAAAAGLAGAGALMALQAFEALREQCRGVMPHRGLLCGIQAS

SEQ ID NO: 60717 - protein, 254 aa, Thermus thermophilus HB27
MERLEEARKRLEEAKRVAVLTGAGISKPSGIPTFRDAEGLWKNFNPLDYATPEAYARDPEKVWAWYAWRIQKVREAKPNPAHYALVELERRILSRGGSFLLVTQNVDGLHARAGSQNLVELHGNLLRARCEACGKRFPLPEAFAPPPFCPACGHRARPDVVWFGELLPEGAWERAERAFAEADFALVVGTSAEVEPAASLGRIAFASGAYLVEVNPEPTPLTPLAHLSLRTGAVEGMALLLPPSPEDQAEGHLS

SEQ ID NO: 60718 - protein, 332 aa, Aspergillus nidulans FGSC A4
MSGNISTNSNPNPNPKKVWTTLITNSSYIPGLLTLEYSLRRCESKYPFVVLYTDSFPISGHAALDARGIAKKHVPYLLPSIPKDYTNDVRFYDCWSKLTPFSLTEYERVVQLDSDMLILRNMDELMDLQLDGPEMKGEGSRVFGAAHACVCNPLKKPHYPPNWVPSNCVYTDQHSHPELASHIAPPASAALGIPNGGLQVVNPSLEIYNKIIAQLGSAATSSYDFADQSLLGDLFAGRWVALPYVYNALKTMRWRGVHDVIWKDAEVKNVHYILSPKPWEEDPEGRDQDQEQDGVEIRVGNSDTKDPLHDLWWKVNRERLREEKRRGINDRF

SEQ ID NO: 60719 - protein, 287 aa, Zea mays
MAMSDLTATVIPKPDGADDESVEIREVWADNLEEEFALIRDIVDEYPFVAMDTEFPGIVCRPVGAFRSPADYNYATLKANVDMLHLIQLGLTFSGPRGELPALGAGRRRCVWQFNFREFDDARDIFASDSIELLRRSGIDFRRNAERGVDARRFAELLMSSGVVLNDSVYWVTFHAGYDFGYLLKILTCNSLPDTQAGFFKLMKIYFPTVYDIKHLMKFCNSLHGGLNKLAELLDVERVGESHQAGSDSLVTSCAFWKLKDSFFAGSTEKYAGVLYGLNAENGVSAH

SEQ ID NO: 60720 - protein, 458 aa, uncultured bacterium 443
MDETLYTPPKPNSLPAVIALIRSLWKGDGNLLELLPAEAYHFDIGHLGRSRRGTVLFNKPSAVKEIMRDQQGVFPKSDLMVGALDPLIGESMFVTDGPKWRRQRAMIDPAFSLMRLNVAYGAMCAATDDHVAMISRLADTQSPFSLDLAMSHLTADVICRTVFSTPLASDIAEEVFDDFTLFEKSVAQVDILGMILKPAWSETKQVPEVLEACQRIRHHIGGLIDTHLDSHDGEFNDIASAVIEAKDKDTGLPFTREELIDQLGVFFLAGHETTASALTWVFYILAERPEWMVRLREELDPVMVDGALSFDDTKKLPLTRAFFKEVLRLYPPITFVPRVALENVEIEGKRLPRGALVMIAPWTLHRHSKYWENPHAFIPERFLPENEKSLTAGAYIPFGQGPHLCVGAGFAQVESLLIMSELITKFDFEMMPNQQVVPAARLTTRPAEQVMMRVRHRN

SEQ ID NO: 60721 - protein, 482 aa, Thermus thermophilus HB27
MRLFTPEAMREADRKAVERGYPSLLLMEWAGMKAARVYLELFGKAPALVLAGKGNNGGDGLVLARHLLLEGVGVRVYAAGGQTGDALLALQALLAHGVEVRPLEEASFREGEVMVDALFGTGLKGPLTDFYAELVERVNRAGLPVLALDLPSGLPFSPHVRATATVAFAALKTPHLLQREACGKLYLAEIGLPKPLLEREDLPEVASPEALRPLLPRRPLTAHKGSVGRVGVLGGYQGEGLRYAGAPLLAALGAYRMGAGLVHLVVPEGAPLEPLEAVFHPVPSPTLPPLKAEALAVGMGGGPWGRAWALKALEARLPTVLDADALHPEVAEAYRKAGVPAVLTPHAGEAGRLLGISPEEVAKDPLGAARALAERTGLAVVLKGNPTVVAEGERLSVNPTGNPALATGGTGDVLSGAIAALLAAGLSPFDAARLGVFLHGLAGDLLAEEKEVGLLAREVAEALPRARRLLQEGRVPPAFFPR

SEQ ID NO: 60722 - protein, 358 aa, Mycobacterium smegmatis str. MC2 155
MTQIIDRPAAQGDAPEPWGSILTPAAAQAPVPAVTELTMVQAINRALRDAMAADERVLVFGEDVATLGGVFRVTDGLTESFGAERCFDTPLAESAIIGIAVGFAIRGFVPVPEIQFDGFSYPAFDQIASHLAKYRMRTHGDIDMPVTVRIPSFGGIGAVEHHSESTETYWLHTAGLKVVVPSTPSDAYWLLRESISSPDPVIYLEPKRRYWAREAVDTTTPALPIGRAAVRRNGSDVTVITYGGLVATALSAAELAEDRGWSMEVVDLRSLNPLDFDTVADSVRRTGRAVVMHEGPRTLGFGAELAARISEELFYDLEAPVLRATGFDTPYPPARLEKLWLPGVDRLLDCVERAMEQP

SEQ ID NO: 60723 - protein, 183 aa, Candidatus Blochmannia floridanus
MISHTDHQLTLIKENIKFIPNYPKQGILFRDITALLENPHAYSACIKLLADHYKNHQLTKIVGVEARGFLFGSPLALILKLGFIPARKAGRLPRNTISESYVLEYGTGCLEMHNDSIIPGDRVLIVDDLLATGGTIKAVVKLIRRLGGEVYHAAFVIDLEKLGGKLLLEKIGVHPYSLVIFSD

SEQ ID NO: 60724 - protein, 370 aa, Glomus intraradices
FGSGGDDPDGTGVDLENMYYLAKGKKDDNPEAALGDFKAIVGLEEEKGEWGFKALKQSTKLLYLVLHRQADALETYKQLLTYTKSAVTRNYSEKTINNILDYVGGGKGGKIDVDVLEKFYEATRTALKEAKNERLSVKTNLKLAKLWLDRGEYSRLKRLLADLQASTQQGGDEDQSAKGTLLQEIYALEIQMYNVTKNYKKLKEIYYASAQVTSAISHPRVVGVIKECGGKIVDAKKKQWEAKPLKDFFSSFHNYDEAGSPQRIQVLKYLVLAYLLMGSEIDPFDSQETKPYKGNPQIKAVTDLVTAYQRREVHEAEKILRENQSTFTDDPFIKSYIGDLLRALRTQYLIALIKPYTRLDLSFPSKTTEH

SEQ ID NO: 60725 - protein, 213 aa, Hyacinthus orientalis
QLHGESLPAPAAPPQISHLRPAFDFPSSPAGSISIPHPSVPPPPPLPRPGPVAIGAQILRSEGPAALFCGISATVLRQTLYSTTRMGLYDILKTRWSSDGGHLPLHRKIAAGLVAGGIGAAVGNPADVAMVRMQADGRLPPAERRNYRSVVDAIGRMAKGEGVGSLWRGSSLTVNRAMIVTASQLATYDQAKEGIIGSGAMVDGLGTHVTASF

SEQ ID NO: 60726 - protein, 179 aa, Glycine max
  misc_feature (6)..(8): Xaa can be any naturally occurring amino acid
  misc_feature (14)..(14): Xaa can be any naturally occurring amino acid
  misc_feature (23)..(24): Xaa can be any naturally occurring amino acid
  misc_feature (26)..(27): Xaa can be any naturally occurring amino acid
  misc_feature (42)..(42): Xaa can be any naturally occurring amino acid
  misc_feature (52)..(52): Xaa can be any naturally occurring amino acid
  misc_feature (102)..(102): Xaa can be any naturally occurring amino acid
  misc_feature (154)..(154): Xaa can be any naturally occurring amino acid
EEREQXXXEISKDXSSVFERSIXXFXXTEMVGGLMLTLKYFXETKVTINYPXEKGPLSPRFRGEHALRRYPTGEERCIACKLCEAHMTICPAQAITIEAEEXEDGSRRTTRYDIDMTKCIYCGFCQEACPVDAIVEGPNFEFATETHEELLYDXEKLLENGDRWETEIAENLISESLYR

SEQ ID NO: 60727 - protein, 181 aa, Brassica napus
STTRPLSSAAVATSPAQATMVAPFTGLKSSAAFPVTRKSNTDITSITSNGGRVSCMKVWPPVGKKKFETLSYLPDLTDVELAKEVDYLLRNKWIPCVEFELEHGFVYREHGSTPGYYDGRYWTMWKLPLFGCTDSAQVLKEVQECKTEYPNAFIRIIGFDNNRQVQCISFIAYKPPSFTGA

SEQ ID NO: 60728 - protein, 318 aa, Heliobacterium chlorum
NGFGRIGRQSFKAMLEYYPEEFEIVAINDLTDAQTLAHLLRYDSTYGAFDGEVTVTEKAIVVEQDDIRYELLTLAERDPAALPWKELGVDIVIESTGRFTDAEKAKAHLAAGAKKVIITAPAKGEDITICLGVNDAKYDHEKHHIISNASCTTNCLAPVAKVLNDRFGIERGLMTTIHSYTMDQNLQDNVHKDLRRARAAAINMVPTTTGAAKAVALVIPELKGKFHGYAVRVPTPTVSMVDFSVLLSTKTSVEEINQAFIEASESEELEGILGVSHDPLVSTDFIGTTYSSVVDLPLTMSMGDDFFKIVAWYDNEWG

SEQ ID NO: 60729 - protein, 622 aa, Oryza sativa
MRAVLEEWIKQRESWKPFWVRGINMVGYSINGLHPVLFSSQADGDDDGIRAGVAGPDAGPHRRLSCLCHIAVAPFPAPALEMWQQLGRLINGEHNALLLAIPLDGIGSFPPHPPPDPQEQEAAAPPPPPAEPAVPPRHRGHLHLFKKPLHRALSGLAATHGPVLLLHFGSRAVLHVTDPAVAEECLTDHDVTFANRPRLPSSCHLSNGYTTLGSSSYGPNWRNLRRIATVEVFSAHRLLRSADVRGGEVPHMARWLYLAAPADGPSEPARADVKARAFELVLNVVARMVAGKQYYGGEGDAEAETEEAARFREMVREYFAMHGASNLQDFVLLLGLVDIGGAKRRAVKLSRERNTWAQRLIDEHRATATAAAATEARTMVGDLLKMQASEPEAYSDKVITALCLSILQTGTDTSSSTIEWGMALLLNHPAAMAKARAEIDRFVGTGRVVEEADLPNLPYLQCIIRENLRLYPVGPLLAPHESSADCSVSVAGGGRYAVPAGTMLLVNVHAMHRDARFWGPDPESFSPERFEGGRSEGKWMLPFGMGRRRCPGEGLAVKVVGLALATLVQCFEWRRVGDEEVDMTEGSGLTMPKAVPLEALYWPRPEMVPALRGIFFIYNFFY

SEQ ID NO: 60730 - protein, 206 aa, Brassica rapa
MSNEYDYLFKLLLIGDSSVGKSCLLLRFADDAYIDSYISTIGVDFKIRTIEQDGKTIKLQIWDTAGQERFRTITSSYYRGAHGIIIVYDCTEMESFNNVKQWLSEIDRYANDSVCKLLIGNKNDMVESKVVSTETGKALADELGIPFLETSAKDSTNVEQAFLTIAGEIKKKMGSHTNANKTSGSGTVQMKGQPIQQNNGGGCCGQ

SEQ ID NO: 60731 - protein, 165 aa, Triticum aestivum
QVIELSRDYFGMSTLEKTTELGGSLSVHIGDALSPSATVEGGFAGIVVDLFADGEVLPQLQEVDTWLEIAKKLMPDGRIMVNCGAGDAAVSLAADADVSSWVQNPTIKARYDPTMSQLNWKRLSEKESVNYVALTGPLPDLEEWSASVPSELSLRVKQWVPCKLA

SEQ ID NO: 60732 - protein, 314 aa, Stanieria cyanosphaera PCC 7437
NGFGRIGRLVFRAGLNNPNIEFVGINDLVPPGNIAYLLKYDSTHGRFAGTVESQSDGIVVNGKFIPCVSIRNPEELPWSKYGVEYVVESTGLFTTHETASKHLTAVQKRVVISAPTKDPERVKTLLVGVNHQTFDPSKDTIVSNASCTTNCLAPIAKVINDNFGLAEGLMTTVHAMTATQPTVDGPSKKDFRGGRGAAQNIIPASTGAAKAVTLVLPELKGKLTGMAFRVPTPDVSAVDLTFRTEKATSYQEICAAMKQAAEGEMKGILGYTEEPVVSTDFTSDPHSSIFDAGAGIELNSNFFKVVAWYDNEWG

SEQ ID NO: 60733 - protein, 169 aa, Helicosporidium sp. ex Simulium jonesii
ARGGAQELFGIQPDLTTMGKIIGGGLPVGAYGGRSDIMSLVAPAGPMYQAGTLSGNPLAMAAGLKTLQQLTPAVYVHLDMISRRLVDGLAKVAKSTGHDLYTSSVPGMFGFFFCRGPVHNFEEAKRADTVKFAKFFNGMLDQGIYLAPSQFEAGFTSFSHSIEDIDRTS

SEQ ID NO: 60734 - protein, 261 aa, Pasteurella multocida subsp. multocida str. Pm70
MARRPLVMGNWKLNGSKAFTKALIEDLKTELAGVEGCDVAIAPPVMYLAEAEAALKCSCSCGGKAIALGAQNVDVNVQGAFTGDISTEMLKDFGAKYIIIGHSERRTYHKESDEFIAKKFAALKQAGLVPVLCIGESEAENEAGKTEEVCARQIDAVLNTLGAEAFNGAVIAYEPIWAIGTGKSATPAQAQAVHAFIRGHIAKKDNAVAEQVIIQYGGSVNDANAAELFTQPDIDGALVGGASLKAPAFAVIVKAAAKAKN

SEQ ID NO: 60735 - protein, 323 aa, Triticum aestivum
MAAKRELVVSFGEMLIDFVPTVAGVSLAEAPAFVKAPGGAPANVAIAVARLGGGAAFVGKLGDDEFGRMLAKILRENGVDAGGVVFDSGARTALAFVTLRADGEREFMFYRNPSADMLLTADELKVDVIKRAAVFHYGSISLIAEPCRTAHLHAMKVAKEAGALLSYDPNLREALWPSLEEARTKILSIWDQADIVKVSEVELEFLTGINSVEDDVAMKLWRPTFKLMLVTLGDQGCKYYTKDFRGTVPSYKVQQVDTTGAGDAFIGSLLRKIVQDPSALQDKTKLEGAIKFANACGAITATKKGAIPSLPKEDEVLRLMEKA

SEQ ID NO: 60736 - protein, 330 aa, Coprinopsis cinerea okayama7#130
MVFNTTLTPSLYDAMYPATDFSSLSWLEQQWVSWYVTIGNPVLATGLMSFLLHEVVYFGRSIPWIIIDAMPYFRKWKLQPNKIPTPKEQWECTKQVLFSHFTIELPLIWLFHPTAEALGMQTHQVPFPSLKTMAPQVFLFFVFEDFFHFVAHQALHYGPLYKHIHKIHHKYSAPFGLAAEYAHPAEVFILGAGTILGPLIYCFFTQNLHIITVYLWIVLRLFQAIDAHSGYDFPWSLHNILPFWSGAEHHDFHHMAFVNNYSTSFRWWDRIFGTDDKYREYRAKVKAAKKAMKNASADDVKKLEQKLMDEVKAEGLRAEAEVENYKLKMN

SEQ ID NO: 60737 - protein, 594 aa, Oryza sativa (japonica cultivar-group)
MGTYKCCIFFTRRFALSDASTPGDVRMLFTRHAGGAPYMGIDELRRYLAASGEAHVDADTAERIIDRVLQERSRTPRFGKPSLTIDDFQYFLFSEDLNPPICHSKEVHHDMNAPLSHYFIYTGHNSYLTGNQLSSDCSDIPIIKALQIGVRVIELDMWPNSSKDDVDILHGRTLTAPVSLIKCLKSIKEYAFVASPYPVIITLEDHLTSDLQAKVAKMVLEVFGDTLYYPESKHLQEFPSPEALRGRVILSTKPPKEYLESKGGTMKDRDIEPQFSKGQNEEAVWGTEVPDIQDEMQTADKQHENDILYTQRDVEEDDEKKMCQHHPLEYKHLITIKAGKPKGAVVDALKGDPDKVRRLSLSEQELAKVAAHHGRNIVSFTHKNLLRIYPKGTRFNSSNYNPFLGWVHGAQMVAFNMQGYGRSLWLMHGFYKANGGCGYVKKPDFMMQTCPDGNVFDPKADLPVKKTLKVKVYMGEGWQSDFKQTYFDTYSPPDFYAKVGIAGVPSDSVMQKTKAVEDSWVPVWEEEFVFPLTVPEIALLRVEVHEYDVSEDDFGGQTALPVSELRPGIRTVPLFDHKGLKFKSVKLLMRFEFV

SEQ ID NO: 60738 - protein, 255 aa, Hyacinthus orientalis
MAPNSDSPVQTQMAVAVLNQALGSDYYHLSRKSEGKPTGRRRVFVQTDTGCVLGIELDRGDNAHTVKRRLQLALNVSTEESSLTFGDLVLKNDLSAVRNDSPLLLTRNLLHRSSSTPCLSPTAKDLQQRDRSGPIEVLGCSSRCARTKQLVKDAVKAIKSGVDPIPVHSGLGGAYYFRNRRGESVAIVKPTDEEPVCAKQSKGFIGKALGQPGLKRSVTVGETGYREVAAYLLDYDNFANVPPTGLGKITHFGFS

SEQ ID NO: 60739 - protein, 594 aa, Burkholderia sp. 383
MYRYTVFDRALVHSRAAQFRDQLERWQHGTLSEDAFRPLRLQNGWYVQRHAPMLRVAVPYGELSSAQLRVLARIARNYDVPDDAIYRAASDAQALLGTLRLPTRSAHFTTRTNVQFNWIPLAKAADVMDLLATVDMHGIQTSGNCIRNISCDERAGVAPDEIADPRPFAEVMRQWTTLHPEFAFLPRKFKIAITGATEDRAATDWHDVGLKLVRDDAGALGFRVSVGGGMGRTPMIATLLRTFLPWQHVMNYIEAIVRVYNRYGRRDNKYKARIKILVKTEGQRYIDDVEEEFRQIVDHDGGLHTIPQVEFDRVAASFVPPRLKPRTASLRDANQRLSAQAARHPAFARWLARNVADHRDPALRIVTLSFKRRLQAPGDASPDQLDALADLADQFSAGEARVTHTQNVVLPWVHVDDLFLLWENARAIGLASANVGLLTDMIACPGGDFCALANARSIPIADAIAERFQDLDMLHDVGDIDLHISGCINSCGHHHSGHLGILGVDKDGAEWYQVTLGGSDGSTASGPARPGKVIGPSFSADEIVDVVDAIVNAYLDARIDDDGRSERFIDTVRRIGTEPFKAAANDARHQVEHA

SEQ ID NO: 60740 - protein, 99 aa, Glycine max
MSSGAVKGPVKGQMKGLLKGLRYISQIFDEEDEKEIQIGFPTDVKHLAHIGAENAKASQPSWLSEFKELSEGGTVTKGTSEGDASIVEDDANSKGEGSR

SEQ ID NO: 60741 - protein, 470 aa, Gibberella zeae PH-1
MASVARLSNAALRASLRSSPVNGSAFNAIRCYSAKTQTLKERFAELLPEKIEQVKALRKEHGSKVVDKVTLDQVYGGARGIKALVWEGSVLDSEEGIRFRGKTIPECQELLPKAPGGKEPLPEGLFWLLLTGEVPTEQQVRDLSAEWAARSDLPKFVEELIDHCPTDLHPMAQFSLAVTALEHTSSFAKAYAKGINKKEYWGYTFEDSMDLIAKLPNIASRIYQNVFKGGKVAAIQKDKDYSFNFANQLGFADNADFVELMRLYLTIHTDHEGGNVSAHTTHLVGSALSSPFLSLAAGLNGLAGPLHGLANQEVLNWLTEFKKSVGDDLSDKAITDYLWSTLNAGRVVPGYGHAVLRKTDPRYMAQRTFAQEKMPNDPMFKLVSQVYKIAPGVLTEHGKTKNPYPNVDAHSGVLLQYYGLTEANYYTVLFGVSRAIGVLPQLIIDRALGAPIERPKSFSTDKWAELVKKL

SEQ ID NO: 60742 - protein, 569 aa, Clarkia lewisii
MATPALISETEAWKDLKAHLEGIKRTHLRELMGDTERCQSMMVEFDNIFLDYSRQQASPDTINKLYKLAEAAHLKQKIDRMYNGDHINSTENRSVLHVALRAPRNSAICSDGKNVVPDVWNVLDKIKDFSERVRNGSWVGATGKELKDVIAVGIGGSFLGPLFVHTALQTDPEASKNARGRELRFLANVDPIDAARNISGLNPETTLVVVVSKTFTTAETMLNARTLREWISSALGVAAVAKHMVAVSTNLPLVEKFGIDPNNAFAFWDWVGGRYSVCSAVGVLPLSLQYGFAVVEKFLQGAHNIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEELKKENVSEHLIPHKTFTGNRPCLSILLPTLDAYRIGQLLAIYEHRVAVQGFVWGINSFDQWGVELGKSLATQVRKQLHASRVKGEPVEEGFNFSTKTLLTRYLQATTDVPADPSTLLPNI

SEQ ID NO: 60743 - protein, 314 aa, Lyngbya aestuarii PCC 7419
NGFGRIGRLVMRSAIKNPEIEFVAINDLVPAENLAYLFKYDSTHGKLESQVEAKDDHIIVDGHSIRCTSVRNPDQLPWKEMGVDYVVESTGLFTTYDGASNHLSAGAKRVIISAPTKDPDKVKTLLMGVNHEEFNPQDHLIVSNASCTTNCLAPVAKVIQDNFGLAEGLMTTVHSMTATQPTVDGPSKKDFRGGRGAAQDIIPASTGAAKAVTLVLPELKGKLTGMAFRVPTPDVSVVDLTFKTEKSTSYKEICAAMKAASEGPMKGVLGYTEDPVVSTDFITDSHSSIFDADAGMELNSNFFKVVSWYDNEWG

SEQ ID NO: 60744 - protein, 314 aa, Anabaena sp.
NGFGRIGSNFARCWLGRENSNIDLVAVNDTSDPRTNAHLLKYDSMLGKLKDVDITADDNSIIVNGKTIKCVSDRNPENLPWKEWEIDLIIEATGVFTSKEGALKHVNAGAKKVLITAPGKNEDGTFVIGVNHHEYDHNVHHIISNASCTTNCLAPIAKVLHEKFGIIKGTMTTTHSYTGDQRLLDASHRDVRRVRAAAINIVPTSTGAAKAVALVIPELKGKLNGVALRVPTPNVSMVDFVIQVEKRTITEEVNQALKDAAEGPLKGILDYSELPFVSSDYQGSDASSIVDANLTLVMDNDLVKVMAWYDNEWG

SEQ ID NO: 60745 - protein, 315 aa, Stanieria cyanosphaera PCC 7437
NGFGRIGRNFVRCWLGRENSQLELVGINDTPDPRTNAHLLRYDSMLGVLKGVDIEADANSIIVNGKTIKCVSDRNPLNLPWKDWGVDLIIEATGVFVDEAGASKHLEAGAKKVLITAPGKGGGIGTYVIGVNHKDYEHGKDSIVSNASCTTNCLAPVVKVLHENFGIIKGTMTTTHSYTGDQRILDASHRDLRRARAAAINIVPTSTGAAKAVALVLPALKGKLNGIALRVPTPNVSVVDFVAQVEKKTITEEVNEALKRAAEGELKGILGYNDLPLVSCDYRGTDESSIVDASLTLVMDGDMVKVVAWYDNEWG

SEQ ID NO: 60746 - protein, 678 aa, Bordetella bronchiseptica RB50
MSNPTAPKLALADAIRVLAMDAVQKANSGHPGAPMGMAEIAQALWLGNLRHNPADPAWANRDRFVLSNGHGSMLIYALLHLTGYDLPLEELKNFRQLHSRTPGHPEVGITPGVETTTGPLGQGLANAVGMALAEALLAAEFNRAGHTVVDHHTYVFLGDGCLMEGISHEACSLAGTLKLSKLVALYDDNGISIDGHVEHWFADDTATRFEGYGWNVIRGVDGHDVAAVDAAIKQARAQSEKPTLIVCRTVIGKGSPNMAGTHNVHGAPLGNDEIAATRAALGWSAGPFEVPQDIYAAWDSRPAGALAQAAWEDKFQAYAAQYPAEAAEFTRRMKGELPEGFAARFEAFLQATVAKGETVATRKASQFAIAELAGLLPEMLGGSADLTGSNFTDWKGVAPLRAGHHGVHFGRHINYGVREFGMAAIMNGIALHGGYLPFGGTFLTFSDYSRNAIRMAALMKQRVVHVFTHDSIGLGEDGPTHQSIEHAASLRLIPNLSVWRPCDTVETAAAWGAAVTRPASIGMDVHDGGPTALLLSRQNLPFVARDEATQKAIVRGGYVLRDAHDARAAIIATGSEVAIALAAQELLAADGIAVRVVSMPSTDVFDRQDAEWKREVLPAGMPRVAVEAGVTAFWHKYVGLEGAVVGIDRYGESAPAGALFKFFGLTAEKVAEAVKQVL

SEQ ID NO: 60747 - protein, 205 aa, Brassica napus
IEEEEETEEKEKEKVKEHMELNPQTTAKKPTRSFWSAASVLSKKLQKWRQKQKLKKSAAALPVEKSAVRQLRDTQSEVAEYGYGRRSCDTDPRFSIDAGRFSLDAGRVSVDDPRYSFDEPRASFDGYMIGRAAAAAAPPRMPSMLSVVEDSPVSNLVPVEEPPPPPRTPPESVVPGGSEQTREYYNDSSSRGRKSLDRSSSTRKI

SEQ ID NO: 60748 - protein, 159 aa, Magnetococcus sp. MC-1
MLPCLFMLAVFFHQEFTMTIERTFSIIKPDAVAKNVVGEIQSRFEKAGLRIIASKMIRLTPEIAGKFYEVHKARPFYNDLCSYMSSGPVVVQVLEGDGAVLKNRDIMGATNPKDAAPGTIRADFAESIDANAVHGSDAPETAAQEIAFFFSGTELCDRP

SEQ ID NO: 60749 - protein, 314 aa, Fischerella muscicola UTEX 1829
NGFGRIGSNFMRCWLGRENSNIDLVAINDTSDPRTNAHLLKYDSMLGKLKNADITADDNSIIANGKTVKCVSDRNPENLPWKEWEIDLIIEATGVFTAKEGAMKHVNAGAKKVLITAPGKNEDGTFVIGVNHHDYDHDKHHIVSNASCTTNCLAPIAKVLHEKFGIIKGTMTTTHSYTGDQRLLDASHRDVRRARAAAINIVPTSTGAAKAVALVLPDLKGKLNGVALRVPTPNVSMVDFVIQVEKPTIAEEVNAALKSASENELKGILDYSELQLVSSDYQGTDASSIIDASLTLVMGGDMVKVMAWYDNEWG

SEQ ID NO: 60750 - protein, 397 aa, Bordetella bronchiseptica RB50
MSNVNTLSALAKSGALSGKRVFIRADLNVPFDDAGRISEDTRIRASVPGIRLALDAGAAVMVTSHLGRPKEGALTEADSLAPVAQRLSELLGMQVRLVPDWVDGVSVEPGEVVLLENCRGNVGEKKDDEGLSRKMAALCDVYVNDAFGTAHRAEATTHGIARFAPVACAGPLLEAELEALGRALHDPKRSLVAIVGGSKVSTKLSILQSLADKVDQLVVGGGIANTFMLAAGLPIGKSLAEPEQVEQARAVIEIMKRRGAEVPIPTDVVCAKSFGADAAATVKAAADVAEDDMILDIGPQTAQRLADILKAAGTIVWNGPVGVFEFDQFAHGTEVVARAIADSAGFSIAGGGDTLAAIAKYGIADQTGYISTGGGAFLEFLEGKALPAVAVLQARAA

SEQ ID NO: 60751 - protein, 356 aa, Magnetococcus sp. MC-1
MHTPLLDLTGLTREALTSLVVEQLGEKPFRARQLWSWLHVKLAQHLDEMSDLSIDFRRKLSALSTPLRPEVSTHQISRDGTEKWLLRLSDGQQIETVYIPEDERGTLCISSQVGCTLSCPFCHTGAQGFARNLTPSEIVQQVLFARRTLAARDKRVTNIVLMGMGEPLYNYEAVRDAVLILLDDSGLAFGTRKVTLSTAGLLPKMEQAGRELGVNLAISLHAVRDTLRDELVPLNKKYNLQALRAATLRYPLKSGRRVTWEYVMLHGVNDSEDDARLFVSFLKDIPSKINLIPFNPWPGVPYQSSSMTRIAAFQKILYQAGFVTVIRDRRGEDIDAACGQLKGAVQGARPRPPGAS

SEQ ID NO: 60752 - protein, 315 aa, Lyngbya aestuarii PCC 7419
NGFGRIGRNFVRCLLTRENSNLDLVAINDTSDPKTNAHLLKYDSMLGTLKDVDIQADENSLTVNGKTIKCVSDRNPLNLPWADWGVDLIIESTGVFVTEEGASKHLEADAKKVLITAPGKGGKIGTFVMGVNDNTYKHEDYNIVSNASCTTNCLAPFTKVLHEHFGIIKGTMTTTHSYTGDQRILDASHRDLRRARAAAINIVPTSTGAAKAVALVIPEMKDKLTGIAMRVPTPNVSVVDLVVQVEKNTFTEEVNRVLQEAAEGPMKGILEYSDLPLVSSDYRGRDASSIVDASLTMVMGGDMVKVIAWYDNEWG

SEQ ID NO: 60753 - protein, 280 aa, Mycobacterium smegmatis str. MC2 155
MVSSTRSEHSFAGVGGVRIVYDVWTPDTDPRGVVVLAHGYAEHAGRYHHVAQRFGAAGLLVYALDHRGHGRSGGKRVHLRDLSEFVEDFRTLVGIAANDHPTLPRIVLGHSMGGGIVFAYGARYPGEYSAMVLSGPAVNAHDGVSPVLVAVAKVLGKLAPGIPVENLDADAVSRDPEVVAAYKADPMVHHGKLPAGIARALIGLGQSMPQRAAALTAPLLVVHGDKDRLIPVAGSRLLVDRVASEDVHLKVYPGLYHEVFNEPEQKLVLDDVTSWIVSHL

SEQ ID NO: 60754 - protein, 295 aa, Arabidopsis thaliana
LKEARDKAADSDEVQKCDSEIEDLQNLLNNDVLISGVNLESLQPGSSGMTELYKALQEPKFRELDSEDLLTERLLSAEKDWKSTIELLKHATLTLKIINLGSLEQQSKYASTWFEISSTCAQELRHAASIWKQVIKNDVQEEILSKPQGKSYALSVGEIYRVVKILRASTRLYKPWILLAPTSSNVLAVLDECLKLWLSSGLVEALLNSHDDSADQLLESIKYINEVDAFTLYTCITSATSPTCYISGLNTDIVPGIKTVEWNGEHYLLPLANIWANLISRDPPNLPGHHFPIVS

SEQ ID NO: 60755 - protein, 152 aa, Brassica napus
ITALGRTNVASLVQLLASASVRENAVTVISSLAESGGGESWLVSENALPPLIRLLESGTPLAKEKAVISLQRLSFSSETSRAIVGHGGVPPLIEICKTGDSVSQAASACTLKNISSVPEVRQFLAEEGTIITMINVLSCGILLGAKEYAAEC

SEQ ID NO: 60756 - protein, 554 aa, Coprinopsis cinerea okayama7#130
MTWREGTLALVAAWAVWRALKALTSKNPLDKVPGPKPDPFFFGSALRLFDPVGGWDFHAEIASKYPGIARIVGIQGSNILYTFDPKAMHHILVKDHHNVFDESDRFLQMNSLLFGPSLLSVKGDRHRRQRKLLNPVFSIAHMREMTPTFYSVAYRLRDSLHQILKEGQPTEIDIASWMTRTALELIGQSGLGTSFDSLEPDASEHPFATTLKNLLQGLSDIPFARFFLLPRVGHIGPPQFRRWVVERVPSKSIRKVVNMSDVMHRTSSEIYQRKKRALDEGDELDKSVIGILLRENMNASEEDRIPEDEVLAQLSTITFAAMDTTSNALCRVLLLLSGNPEVQERLRQEILDAKEQRGGSDLSYDELVQLPYLDAICRETLRLYPPSPFVTRQARQDTILPLSIPFISTDGKPTHEVLVPKGTLVLVSIMAANKNPELWGPDAHEWKPERWLNPLPETVVNAKMPGVYSHLPGPYFRMTFIGGGRSCIGFKFSQLEIKTILCSLLESFRFTPTGKKIRWQLNGVVQPTVVSEEPGSASAGKALKLQMPLNVSRL

SEQ ID NO: 60757 - protein, 586 aa, Oryza sativa (japonica cultivar-group)
MCGILAVLGAADWLKHRGPDWSGLYQCEGNFLAQQRLAIVSPLSGDQPLYNADRTIVVVANGEIYNHKKIRKQFASKHTFSTGSDCEVIIPLYEEYGEDFVDMLDGVFAFVLYDTRTKTYMAARDAIGVNPLYIGRGSDGAVWISSEMKALNEDCVEFEIFPPGHLYSSAAGGLRRWYKPQWFAENVPATPYQPLLLREAFEKAVIKRLMTDVPFGVLLSGGLDSSLVAAVTKRHLIKTEAAEKFGAELHSFVVGLEGSPDLIAAREVADHLGTIHHEFHFTVQDGIDAIEEVIYHDETYDVTTIRASTPMFLMARKIKALGVKMVLSGEGSDELLGGYLYFHFAPNKEEFHKETCRKVKALHQYDCLRANKATSAWGLEVRVPFLDKEFINVAMSMDPEWKMYNADLGRIEKWVMRKAFDDEEHPYLPKHILYRQKEQFSDGVGYNWIDGLKAFTEQQVSDEMMKNAAKVYPHNTPVNKEAYYYRMIFERLFPQGDGAVGPEHRVQHAGGDRVGGAVEGVARPIRPLIASHNSASASANHTNHANANANGNSNGKANGNCAMAANGTNGVGLVVANGTANGKMEA

SEQ ID NO: 60758 - protein, 443 aa, Streptococcus pneumoniae
MTKRVLANLLGKKLPNPASINEEVIVIAHDLTPSDTAQLDKNFVKAFVTNIGGRTSHSAIMARTLEIAAVLGTNNITEIVKDGDILAVNGITGEVIINPTDEQAAEFKAAGEAYAKQKAEWALLKDAQTVTADGKHFELAANIGTPKDVEGVNNNGAEAVGLYRTEFLYMDSQDFPTEDEQYEAYKAVLEGMNGKPVVVRTMDIGGDKELPYFDMPHEMNPFLGFRALRISISETGDAMFRTQIRALLRASVHGQLRIMFPMVALLKEFRAAKAVFDEEKANLLAEGVAVADNIQVGIMIEIPAAAMLADQFAKEVDFFSIGTNDLIQYTMAADRMNEQVSYLYQPYNPSILRLINNVIKAAHAEGKWAGMCGEMAGDQQAVPLLVGMGLDEFSMSATSVLRTRSLMKKLDTAKMEEYANRALTECSTMEEVLELQKEYVNFD

SEQ ID NO: 60759 - protein, 540 aa, Oryza sativa (japonica cultivar-group)
MQQRRKSVFASAPFAMKQAALGAGVAARRNGAPLSLAAVVFALFVFATFLYNEDIKSIADFPFGAGALRAKSPDLHVLQETVGAAHLAAGSIAKRGEEVIVRVLDAPASTAMAAAAGSSSNNSTIEVDEGQERERDVTLPSVKEGGADEARRREDEEAAEKESSAKAAAATAALRTVVSVPDTCDLYRGNWVYDEVNAPVYKESQCEFLTEQVTCMRNGRRDDSYQKWRWQPTDCDLPRFDARLLLERLRNKRLMFVGDSLNRNQWESMVCLVQSVIPKGKKTLTKFVNGGNSNIFYAHEYNATVEFYWAPFLVESNSDNPQVHSVPDRVIQWHSIAKHAHNWLGVDYLIFNTYIWWLNTLDMKVLKGSFDQGATEYVEVDRPVAYKEVLKTWAKWVDRNIDPNRTTVFFMSMSPNHITPEAWGNYGGIKCAMETLPITNRTTSLDVGTDWRLYAGAQEVLQTFRRVPVHLVDITALSELRKDAHTSVHTLRQGKLLTPEQQSDPKTYADCIHWCLPGLPDTWNQFLYARIASAPWSSDQ

SEQ ID NO: 60760 - protein, 326 aa, Cytophaga hutchinsonii ATCC 33406
MSEIRLDDIRNVVKDDMKDFEKKFRDSMKSKVMLLDKIMSYIVKRNGKQMRPMFVFLSAHLAGNVNDSTQRGAALIELLHTATLVHDDVVDDSDYRRGMFSINALWKNKIAVLVGDYLLSKGLLLSINHGDFHLLKIVSNAVREMSEGELLQIEKARNLNINEEIYFEIIRQKTASLIASCCAVGVSSTGADEALVERAKMFGEKIGMAFQVKDDLFDYETSEMIGKPVGIDIKERKMTLPLIYALNKASWLEKKRIMFIIKNQTHKSAKVKEVLQFVRESGGIEYTRTVMENFREEAYGFLEEFQDSVYKKALRDLVDYTIARKH

SEQ ID NO: 60761 - protein, 667 aa, Streptococcus thermophilus CNRZ1066
MTKTFYITTPIYYPSGKLHIGSAYTTIACDVLARYKRMMNYDVFYLTGLDEHGQKIQQRAEEAGITPQEYVDSMAVGVKDLWQLLDISYDKFIRTTDDYHEKVVAQVFERLLEKGDIYLGEYSGWYSVSDEEFFTESQLAEVYRDEEGNVIGGVAPSGHEVELVSEESYFFKLSNYADRLTAFYKEHPEFIQPDGRMNEMLKNFIEPGLEDLAVSRTTFSWGVKVPSDPKHVVYVWIDALINYITALGYGQNEHGNFDLFWQNDKNHEIIHMIGKDILRFHSIYWPIILMALDLPLPTRLVAHGWFVMKDGKMSKSKGNVIYPEMLVERFGLDPLRYYLMRSLPVGSDGTFTPEDYLARINYELANDLGNLLNRTVAMINKYFDGQVPAYIENVTDYDADLAKVVAENIEEFHKQMNAVDFPRALDAVWNIISRTNKYIDETAPWVLAKEDGDEEQLRAVMAHLAASLRVVAHLIQPFMMSTSNAIMEQLGLPVVFDLENLELSGFPENVTVISKGTPIFPRLDMDEEIAYIQSQMNAGKPQEKEWNPEEVELKSEKDQIKFEDFDKVEIRVAEVKEVEKVEGSDKLLRFRLDAGDGEDRQILSGIAKFYPNEQELVGKKLQVVANLKPRKMMKKYVSQGMILSAEHDGKLTVLTVDPSVPNGSVIG

SEQ ID NO: 60762 - protein, 288 aa, Raphanus sativus
DEFMNEVTLIARLQHINLVQILGCCIDADEKILIYEYLENLSLDSYLFGKTQSPKLNWKERFDITSGVARGLLYLHQDSRFRIIHRDLKVSNILLDKNMIPKISDFGMARIFARDETEASTMKVVGTYGYMSPEYAMNGIFSEKSDVFSFGVIVLEIVTGTRNRGFYNLNYKNNFLSYAWSNWREGRALEIVDPVILDSLSPLTLTFQRQEVLKCIQIGLLCVQELAEDRPTMSTVVWMLGSEATEIPQPKPPDYCVGKSPYETASKQLDDDESWTVNQYTCSVIDAR

SEQ ID NO: 60763 - protein, 288 aa, Raphanus sativus
DEFMNEVTLIARLQHINLVQIIGCCIEADEKILIYEYLENLSLDSYLFGKTQRPKLNWKERFNITNGVARGLLYLHQDSRFRIIHRDLKVSNILLDKNMTPKISDFGMARTFTRDETEANTMKVVGTYGYMSPEYAMYGKFSEKSDVFSFGVIVLEIVSGKKNRGFNYGNNLLSYAWSHWKEGRALGIVDPVIIDSLPSLPLKFGQEEVLKCIQIGLLCVQELAEDRPTMSSVVWMLGSEATEIPQPKPPCHCFERSPYELDPSLSRQCYDDESWTVNQYTCSLIDAR

SEQ ID NO: 60764 - protein, 460 aa, Arabidopsis thaliana
MSNILQNRRSSFSSSTKSSLAKRQAPSSSENSVKLMPAMTKKRAPLSNITNQKIASRLQNSDSVHCSNKSAKLKIAPSVCVNASFSSNLQQSIVPHKVASSPSKSDDGSVSMDETRSSSDSYKSPQVEYIENDDVSAVVSIERKALSNLFITPNSETIDNYCSRDVLSDMKKMDKNQIVNIDSNNGDPQLCATFACDIYKHLRASEAKKRPDVDYMERVQKDVNSSMRGILVDWLIEVSEEYRLVPETLYLTVNYIDRYLSGNVISRQKLQLLGVACMMIAAKYEEICAPQVEEFCYITDNTYLKDEVLDMESDVLNYLKFEMTAPTTKCFLRRFVRAAHGVHEAPLMQLECMANYIAELSLLEYTMLSHSPSLVAASAIFLAKYILDPTRRPWNSTLQHYTQYKAMELRGCVKDLQRLCSTAHGSTLPAVREKYSQHKYKFVAKKFCPSVIPQEFFNNS

SEQ ID NO: 60765 - protein, 291 aa, Raphanus sativus
DEFMNEVTLVARLQHVNLVQILGCCIDADEKMLIYEYLENLSLDSYLFGENRRSKLNWKERFDITNGVARGLLYLHQDSRFRIIHRDLKVSNILLDKNMTPKISDFGMARIFAREETEANTMKVVGTYGYMSPEYAMHGIFSEKSDVFSFGVIILEIITGKRNRGFYNLNYENDLLSYAWSNWKEGRALEIVDPVIIDSFSPLSSTYQPQEVLKCIQIGLLCVQDLAENRPTMSFVVWMLGNEATEIPQPKWPGYCVRRSPYELDPSSSRQCDDDESWTVNQYTCSVIDAR

SEQ ID NO: 60766 - protein, 245 aa, Ligularia fischeri
RYRIRERTDALDAAGNTTAAIGKGFAIGSAALVSLALFGAFASRAEITTVNVLTPKVFIGLLVGAMLPYWFSAMTMKSVGTAALAMVEEVRRQFNTIPGLMEGTAKPDYATCVKISTDASIKEMIPPGCLVMLTPLIVGILFGVETLSGVLAGSLISGVQIAISASNTGGAWDNAKKYIEAGVSDHAKSLGPKGSDAHKAAVIGDTVGDPLKDTSGPSLNILIKLMAVESLVFAPFFAALGHHVN

SEQ ID NO: 60767 - protein, 526 aa, Deinococcus radiodurans R1
MSTLLDGLLPFQHEPYFDFADPAVAEAQTAAYAQARQKYAGQTFPLLVGGQQVKGDGTLTVTNPATGEQLWHFQNATAAQLDEAVRAANEAFQSWRFSDPLQRASIFLRAAQLLRSRRMELNAVMSLENGKNWAEADGEIAECVDHCEVFARETLKWAQGKPVYPMPDEHVTTVYEPLGAVAVISPWNYPSAIPLGMALGALAAGNTVIWKPASETPLSSWLLIRLLFEAGLPRDCVQFLTGSDDVLGDPLVDHKDVRMVAFTGSREIGCRIYERAAKVQPGQKFLKRVIAEMGGKDPTVVCADADLDAAAAGIVASTFGYSGQKCSACSRVIAEASVYDTLLEKVKTLTEALKVGLPEHNAAVGPVIHQGSANRIRQYIENGKGTARLVCGGGEMEVADSGEASANYIQPTIFADVDAKDPLFQEEIFGPVLAFAKADDWRHAIDLANDSDYGLTAAFYSRDPHKLTEARRLMHVGNLYLNRKCTGALSGSHSFGGYGMSGTNAKVGGPDYLFWFLQTKTVAQKY

SEQ ID NO: 60768 - protein, 229 aa, Brassica napus
MGTSSDPIQDGSDEQQKRSEIYTYEAPWQIYAMNWSVRRDKKYRLAITSLLEQYPNRVEIVQLDESNGEIRSDPNLAFEHPYPPTKTIFIPDKECQRPDLLATSSDFLRLWRIADDHSRVELKSCLNSNKNSEFCGPLTSFDWNEAEPRRIGTSSTDTTCTIWDIDREAVDTQLIAHDKEVLDIAWGGVGVFASVSADGSVRVFDLRDKEHSTIIYESSEPDTPLVRLG

SEQ ID NO: 60769 - protein, 501 aa, Candida albicans
MDQQEAPIYYGRSVNKVYNQEFIIDSRFKIVKELGHGAYGIVCSAKYDNGSKKVPDSNNGNASSSANASFVAIKKITNIFSKNILCKRALRELKLLQFFRGHKNITCLYDLDIIPNPMTGEFNEIYLYEELMECDMHQIIRSGQPLSDQHYQSFIYQVLCGLNFIHSADVLHRDLKPGNLLVNADCELKICDFGLARGFSENPDENAGFMTEYVATRWYRAPEIMLSFTNYTKAIDIWSVGCILAELLGGKPLFRGKDYVDQLNQILMILGTPPESTLQRIGSHRAQNYVRSLPITRKASYEELFPDANPLALDLLERMLTLDPRERITVRDALNHKYLELWHDPKEEIECQVKFDFKSFETVDGLDEMKQLIMDEVQKFREFVRKPIEEQQRIQMQLHMQKREEQRQEEEEKELLEQQRQFPAQESMDISQTPYNNLETNIGTPQVEDDYPRPQELDEFTFSNLESSSSMNLFQDMAKPSGEEYIKLEEELGFGLDWCYV

SEQ ID NO: 60770 - protein, 313 aa, Pseudanabaena sp. PCC 6903
NGFGRIGRNFLRCWAGRTDTNIELVGLNDTSDPRTNAHLLKYDSMLGKFAGDVSADDTTITVNGKTIKTVSDRNPDNLPWKDWVIDLVIESTGVFIDKEGASRHINAGAKKVLITAPGKNEDGTYVVGVNEDQYNHDIHNIISNASCTTNCLAPVAKVLLENFGIVKGVMTTTHSYTGDQRLLDASHGDLRRARAAALSIVPTSTGAAKAVALVLPELAGKLNGIALRVPTPNVSVVDFVVEVEKKAIAQEVNEAFRAAAEGPMKGILEYNELPLVSIDYRGTDASSIVDSSLTMVMGGNMVKVVAWYDNEWG

SEQ ID NO: 60771 - protein, 509 aa, Vicia faba
MLQRSRTLPSKIYQGVIEERKDGRHYIELEPLPKMETETKPITIQSKCLDDDGRVKRTGTFWTASAHIITAVIGSGVLSLSWAIAQLGWAVGPVVMVLFAVVNLYTSTLLTQCYRSDDSVAGPRNYTYTDAVKSILGGKKFKICGVIQYVNLFGVAIGYTIAASVSMMAIKRSNCYHESHGNDPCHMSSNVYMIAFGIAEVILSQIPDFDQVWWLSIVAAIMSFTYSAVGLGLGVAKVAENGTFHGRLMGISIGTVTPAGTVTGTQKVWRSLQALGAMAFAYSFSIILIEIQDTIKSPPAEHKTMKKATMLSIMVTTVFYILCGSMGYAAFGDHVPGNLLTGFGFYNPYWLLDIANFAIVVHLVGAYQVFSQPFFAFVEKWSAHKWPKNKFVTEEYDIPIPCIGVYKLNLFRLIWRTIFVLLTTLIAMLLPFFNDVVGLLGAFGFWPLTVYFPIDMYISQKKIGRWTNRWLGLQMLSGCCLIISTLAAVGSIAGVVLDLKTYKPFKTSY

SEQ ID NO: 60772 - protein, 407 aa, Pisum sativum
MAAATASSQLIFSKPYSPSRLCPFQLCVFDAKSVLSSSRRKHVNGSGVRCMAVKEATSETKKRSGYEIITLTSWLLQQEQKGIIDAELTIVLSSISMACKQIASLVQRANISNLTGTQGAVNIQGEDQKKLDVISNEVFSNCLRSSGRTGIIASEEEDVAVAVEESYSGNYIVVFDPLDGSSNLDAAVSTGSIFGIYSPNDECLPDFGDDSDDNTLGTEEQRCIVNVCQPGSNLLAAGYCMYSSSVAFVLTIGKGVFVFTLDPLYGEFVLTQENLQIPKSGEIYSFNEGNYKLWDENLKKYIDDLKEPGPSGKPYSARYIGSLVGDFHRTLLYGGIYGYPRDKKSKNGKLRLLYECAPMSFIVEQAGGKGSDGHQRVLDIQPTEIHQRVPLYIGSTEEVEKVEKYLA

SEQ ID NO: 60773 - protein, 355 aa, Brassica napus
  misc_feature (220)..(220): Xaa can be any naturally occurring amino acid
  misc_feature (307)..(307): Xaa can be any naturally occurring amino acid
MDPNNNPFNTQNSSNFPFNFPNPNNYQFQNQPSNQPQNIPNYGFSPNFFMSSSVQNCPPNYGSMMQYFSQTPPLSSTPTGDANVPRVTEFSEFSTQIALGGMSGASEPIPDANANESAQARRRSPKWTTDQNLVLLNGWIKYGTYNIIGRNQKSEAYWSKISEYYNEHCSFDPPRDGASCRNHFNYMNKNLSKWSGTYDNARRMQQSGWSENDVMAKAHXLYSSGKNEHFNLMSEWLDVRDQPRYGSQVGGNTGSTSSGSKRSRESDVSDSYSVGSSTRPMGREAAKKKAKRKAKAQLWKPSTNSRXEYKQFKEQELERLDKIAKTQEEANRLMEEKTEIKKMKLFLKLCEQENL

SEQ ID NO: 60774 - protein, 409 aa, Arabidopsis thaliana
MTKISDLPRDLAEEVLSRVPVTYLRAIRFTCKKWNTLTKRRSFTKKLIGQEKAEAKVKEFHAIMTLNSRLHLMSVNLDGIHKDENVESSIKQKGKLISLTVADPDRIVISQVYHCDGLLLCITNEINSRLVVWNPYSGQTRWIEPRTSYREWDIYALGYESKNNAKRSYKILRYLDAYEDMGDMSVEPRTRVCEFEIYSLDTNSWKVIEVTTDWDLCFLHRGVTLKGNTYWFAREKIPPPPRERVIEDIPLGEAEINVEIPSFLLCFDFTIEKFGSRLPLPFRPCVDDTITLSSVREEKLAVLYQRWDITWTGIWISNKIEPNAVSWSKLFFPMGRIRPLEAASGTFFVDEENKLVVLFDKGESILNPTRNTAYIVGEDGYIKPVDLGESVHKYCFPLACSYVPSSVQI

SEQ ID NO: 60775 - protein, 828 aa, Methanothermobacter thermautotrophicus str. Delta H
MENIDPMGIHTGESVVVAPAQTLSDEDNQRLRDAAIKIIRALKIEGGCNIQFAVHPETGEYKVIEVNPRVSRSSALASKATGYPIAKIAAKIAVGMTLDEIQNDITKETPASFEPTIDYVVTKIPRWPFDKFKGISREIGVQMKSTGEVMAIGRTLEESLNKAIRSLDIGADGFTETPYTRADLENPTDQRLFQVYTALRDGMSIEEIHGLTQIDPFFLQKISNIAEFESSITRESLEDPRILLKAKRMGFSDSRLASLTGMDESSIRALRLENNIKPVYKMVDTCAAEFEARTPYYYGCYDLEDEVEVSDRRKVLIIGSGPIRIGQGIEFDYCCVHAAMALTEDGYETIMVNNNPETVSTDYDISDKLYFEPLTLEDVLAIIEKEKPEGVVVQFGGQTSINLAVPLAEAGVRILGTPHESIDRVEDRERFTEVLNKLGIPQAPYGIAKSFEDARAVAERIGYPVLVRPSYVLGGRAMEIVYDDVELEEYMREAVRVSPEHPILVDKFLEDAIEVDVDALCDGTDVYIGGIMEHIEEAGVHSGDSACVIPPQSIPEDIIDTIKEYTRKLALELEVVGLINIQYAVKPDSDPSVYILEANPRASRTVPFVSKATGVPLAKMAARLMMGAKLRDLGLTEEKDIEHVAVKESVFPFIKLPGADSVLGPEMKSTGEAMGIDENFGIAYYKSQLSASMDLLNEGKVFISVRDQDKDKIADIVKKADELGFRIMATRGTARAVSDIADIEVVRKVSQGSPNIRDAILDGEVGLIINTPSGKQSADDGYLIRRMAVELGIPYVTTLAGARAALNAIEAVRMGKITVKSLDEYHGM

SEQ ID NO: 60776 - protein, 500 aa, Burkholderia sp. 383
MTDLLSAPEYAALAAALRFPSGPFIDGAFRTASSGDTFATVNPATDAVLAQIGACNAADVDIAVANARQAFEDGRWRKLAPSHRKAVLLKFADLLEQHAHELATMESLDSGKPIRECQTIDVPETIHTIRWHAELIDKIYDNTAPVGGNALALVVREPIGVVGLVLPWNFPLLMLAWKIGPSLAAGCSIVVKPAKETTLTALRVAELAHEAGVPAGVFNVLPGGGREVGEPLGRHADVDMVSFTGSTDTGRKFLKYAAESNLKRIVLECGGKNPAVVLPDAPDLDAVAQHIVNGAFWNMGENCSASSRLIVHADIKDDLLQRIGTQMREWKMGNPLDPAHRIGAMVSKAHFEKVRSYLEQAGAEHLHVAFGGQTDGGIFVEPTVVDGVSPHSRLFREEIFGPVLSVTTFTDIAEAIALANDSVYGLAASVYTGSLNLAIRLSREIRAGVVTVNCFGEGDVTTPFGGYKESGFGGRDKSVWAHDQYTEIKTIWIDVPVDPA

SEQ ID NO: 60777 - protein, 291 aa, Raphanus sativus
DEFMNEVRLVARLQHINLVRILGCCIDADEKMLIYEYLENSSLDSFLFGKKRSSNLNWKDRFDITNGVARGLLYLHQDSRFRIIHRDMKVSNILLDKNMIPKISDFGMARIFAREETEANTKKVVGTYGYMSPEYAMNGIFSEKSDVFSFGVIVLEIVSGKRSRGFYNLNHENNLLSYAWSHWTEGTALEIVDPIIIDSSSSLPSTFQKKEALKCIQIGLLCVQERAEHRPTMSSVVWMLGSEATEIPKPNPPGYYVGRCSYENNPSSSRLCDDYESWTVNQYTCSVIDAR

SEQ ID NO: 60778 - protein, 249 aa, Zymomonas mobilis subsp. mobilis ZM4
MTIRKLIAGNWKMNGSLGMLHELDGIAKATFNHPELDVVICPSFTLIAPAIVRQPDMTFGAQDCHYDESGSHTGCVSAPMLREVGASYVIVGHSERRIEQNETNEEIRAKTTTAIANGLVTIVCIGESRAAHASGQALPIIGAQLDGCIPPDATSDNLVVAYEPIWAIGTGNTPPPESIAEMHASIRDRLCLLLGSEGKKVRILYGGSVTGKNAEELMAIPDVNGTLVGGASLTAEQFVPIIEAGGRLA

SEQ ID NO: 60779 - protein, 289 aa, Raphanus sativus
DEFMNEVTLVARLQHKNLVQILGCCIDANEKMLIYEYLENLSLDSYLFGKTRRPKLNWKERFDITNGVARGLLYLHQDSRFRIIHRDLKVSNILLDKNMIPKISDFGMARIFAREETEANTMNVVGTYGYMSPEYAMHGIFSEKSDVFSFGVIVLEIVTGKRNRGFNNLNYEHNLLNYAWSNWKEGRAIEIVDPDIVDSLSPLSSTFQPQVIKCIQIGLLCVQERAEHRPTMSSVVWMLGSEVTEIPQPKPPGYCVRSSYELDPSSSRQCDDDQSWTVNQYTCSVIDAR

SEQ ID NO: 60780 - protein, 291 aa, Raphanus sativus
DEFMNEVRLIARLQHINLVRILGCCIDADEKLLIYEYLENSSLDSYLFGKKRSCKLNWKHRFDITNGVARGLLYLHQDSRFRIIHRDMKVSNILLDKNMIPKISDFGMARIFGRDTSEASTRNVVGTYGYMSPEYAMYGVFSEKSDVFSFGVIVLEIVSGKRSRGFYQLNNDNNLLSYAWSHWTEGRALEIVDPVIVDSLSSLPSTSQPKEVLKCIQIGLLCVQERAEHRPTMSSVVWMLGSEATEIPQPKPPVYRLAKSFYANNPSSSRHCEDNESWTVNQYTCSVIDAR

SEQ ID NO: 60781 - protein, 561 aa, Burkholderia sp. 383
MSNQDNSPIQPNEPAASVSRRGFLKLAGVSGLATAAGGLAAARAAASNPDGTPEQVHLTWGNDPTSEVVISWASLASAVNPRARIVADGEPARTVHGVQRLYTDGLNGETVFAYHARVHGLKPNTRYRYEITADNDSNAAQPFSANFSTAPRGRAPFRFTSYGDLATPNGAWVLSSPQSRFAVQAVEQFQPLFHLLNGDLCYANLNPAHQPEVWRDFGNNNQTSAANRPWMPCPGNHEIEFNNGPQGLDSYLARYTLPENGTRFQGRWYSFRVSSVLFVSLDADDVVYQDAAAFVGGPAPLVPAASTGRPPIEPGTSFYVRGYSNGEQTRWLEHTLRHAAHDDDIDWIVVQMHQDALSSSKTGNGSDKGIREAWLPLFDRYGVDLVLCGHDHDYERSYPVRGCNHRAGVDATTGEVVETLQPRPVGSNDPDRTKFDTSHGTIHLILGGGGTSAPLDVYGENPATGFARAKVFTKPNRPVPGTAPNTFVREPADALEDAIWSARRDTGTGYGIAVFDHDPGKPGGHTTITMRYYHAPGADQQPTADYELFETIELSKKRNER

SEQ ID NO: 60782 - protein, 288 aa, Raphanus sativus
DEFMNEVRLIARLQHINLVRILGCCIDADEKMLIYEYLENSSLDYFLFGKKRSSNLNWKDRFAITNGVARGLVYLHQDSRFRIIHRDMKAGNILLDKNMIPKISDFGLARIIARDQTEASTDNPIGTYGYMSPEYAMYGILSEKTDVFSFGVIVLEIVTGKRNRGFYQSTPEDNLVCYAWTHWAQGRALEIVDPVIVDSLSSTFQPKEVLKCIQIGLLCIQERAVHRPTMSSVVWMLGSEATAIPQPKPPVYCLIPSFYANNPSSSRPSDNDESWTMNEYTCSVIDAR

SEQ ID NO: 60783 - protein, 291 aa, Cytophaga hutchinsonii ATCC 33406
MEDTMDSATEEILREPQQQERPGKETDMKPRPQSENNAPGNNKLKNKIALITGGDSGIGKAVALLFAKEGADVAIVYLNEHADALETQSIINAKYSKQCLLLPGDISNESFCSKVIDQVIETFGRIDILVNNAGIHYECEDLAELVTEKMIATFETNVYSMFWITKYALPHLKAGSSIINSSSVTAYRGSKHLIDYAATKGAIVSFTRSLSSSLVDKGIRVNGVAPGPIWTPLIPSSFEEDRVAKHGLNAPMHRAGEPSEVAPSYLFLASEDASYITGQFLHPNGGEIING

SEQ ID NO: 60784 - protein, 313 aa, Helicosporidium sp. ex Simulium jonesii
MPTGRDSERLRLTLSNLDMPERLASGRVPLQCSSVLMEHYHTSDDKMQTVLEHNKRWSNEKKESDPSFFHKLSNIQAPEWLWIGCSDSRVPANQLMGLGPGEVFVQRNVGNIVTHHDMNAMSCIEYAVSVLKVKHIIVCGHHNCGAVKAALELPHTTPSLVNLWIQDIRDTRDRNIEQLRKLQGQAQVNRLAEFNIMRQVFSVCTCPVVQAAWAADQPLSVHGVIYALEDGRLREVTQPITGLPDLERYADHKRGVMKHLSGALLTRIQFERQLKRLQTESSTQEEGVEEPELGPLIGASSKPLPGPPGEASP

SEQ ID NO: 60785 - protein, 550 aa, Brassica juncea
MKLLYGLALVFLLAAASCKADEEITCEQNEPFTCGNTDILSSKNFGKDFIFGVASSAYQIEGGRGRGVNVWDGFSHRYPEKSGSDLKNGDTSCESYTRWKKDVEIMGELNATGYRFSLAWSRIIPKGKVSRGVNQGGLDYYHSLIDALLEKNITPFVTLYHWDLPQTLQDEYEGFLDRQIIQDFKDYADLCFKEFGGKVKHWITINQLFTVPTRGYALGTDAPGRCSPMVDSKHRCYGGNSSTEPYIVAHNELLAHAAVVDLYRKNYADQKGKIGPVMITRWFLPYDEADPSCREAADRMNQFFHGWYMEPLTKGKYPDIMRKIVGSRLPNFTEAEAKLVAGSYDFLGLNYYVTQYAQPKANPLLSEKHTAMMDAGVGLTYDNSRGEFIGPLFIEDKIAGNSYYYPKGIYYVMEYFKTQYNDPLIYVTENGFSTPSSENRCEAIADYKRIDYLCSHLCFLRKVIKDRGVNVRGYFAWALGDNYEFCKGFTVRFGLSYVNWDDLDDRNLKESGKWYQRFINGTSKNPTKQDFLRSSLSFLKARRRGLLADA

SEQ ID NO: 60786 - protein, 252 aa, Helicosporidium sp. ex Simulium jonesii
MARKFFVGGNWKCNGTKESVSALVKALSAAKLPSADKVDVVVAPTFLHLSQALSSLPSRVEVSAQNCWIKGGGAFTGEISAEQIVDLGAKWVILGHSERRHIMGESDATVADKVAYALSKGLGVIFCIGEQLSEREANHTMDVCTRQMAALASKISDWSRIVVAYEPVWAIGTGKVATPDQAQEVHGLCRRWVAQHVSPAVAETTRIIYGGSVTAGNCRDLAAQPDIDGFLVGGASLKPEFVDIVASAELKS

SEQ ID NO: 60787 - protein, 533 aa, Magnetococcus sp. MC-1
MSPLAFTLDIAMSDALHSEKILILDYGSQYTQLIARRVRETQVYCEIHGHEMAAEAVRAFNPQGVILSGGHQSVYDVGAAELNDAVMALGVPVLGICYGMQLLGRHFGGTVAPSDKREYGRAEIQACAGQVGALFEGFVEAGAKSTVWMSHGDHVEMLPKGFVTTASTLNAPLAAMANEATHMYGVQFHPEVNHTDNGERLIHNFVRTICGCHGLWTSDGFIEYEVERVRALVGDDKVILGLSGGVDSSVVAALLHRAIGEQLTCVFVDNGLLRLNEGDQVMETFAQNMGVKVIRVDAEARFLGKLAGVSDPEKKRKIIGHTFIEIFDEEAGKIENAKWLAQGTIYPDVVESAGTKTGKATNIKSHHNVGGLPEDMQLKLLEPLRELFKDEVRKVGLELGLPHRMVFRHPFPGPGLGVRILGEVKKEYADLLRRADAIYMDELYASGHYERISQAFTVFLPVKSVGVMGDGRTYDYVVALRAVETKDFMTATWYPMPHDLLSHIANRIINEIDGINRVTYDITSKPPGTIEWE

SEQ ID NO: 60788 - protein, 226 aa, Helicosporidium sp. ex Simulium jonesii
QAHVLGKAKHTFTSAEEAVKALRAGPNGDVISDQWLEPFVIVDSDTQHPVGPIQDGDAVVIFNFRADRVIEISKAFEYAEFSSFDRERWPCTRFAGLMQYDGDLKLPANYLVAPPAITGTSGEIPSDKVPFNQLPLMKAREIAEAGKEALRSGKFDVVRINFANPDMVGHTGDLAATIKAVEVVDVCVKELLDVVDELGGRFLLTSDHGNADDMVQRAKKTLKPLF

SEQ ID NO: 60789 - protein, 445 aa, Porphyromonas gingivalis
MKTQEIMTMLEAKHPGESEFLQAVKEVLLSVEEVYNQHPEFEKNGIIERIVEPDRVFTFRVPWVDDQGKVQVNIGYRVQFNNAIGPYKGGIRFHPSVNLSILKFLGFEQMFKNALTTLPMGGGKGGADFSPKGKSEAEIMRFCQSFMTELWRNIGPDTDIPAGDIGVGGREVGYMFGMYKKLAREHTGTLTGKGFEFGGSRLRPESTGFGAVYFVQNMCKQNGVDYKGKTLAISGFGNVAWGVAQKATELGIKVVTIYGPDGYVYDPDGINTPEKFRCMLDLRDSGNDVVSDYVKRFPNAQFFPGKKPWEQKVDFAMPCATQNEMNLEDAKTLHKNGVTLVAETSNMGCTAEASEYYVANKMLFAPGKAVNAGGVSCSGLEMTQNAMHLVWTNEEVDKWLHQIMQDIHEQCVTYGKDGNYIDYVKGANIAGFMKVAKAMVAQGVC

SEQ ID NO: 60790 - protein, 1074 aa, Magnetococcus sp. MC-1
MPKRTDLKKIMLIGSGPIVIGQACEFDYSGAQACKALKEEGYEVVLVNSNPATIMTDPELADRTYVEPITLASVTRIIAKERPDAILPTMGGQTALNMALNLADAGVLEQYNVELIGASRDAISKAEDRERFKQAMDDIGLEMPKSGFAHSMEEAWEIQTEVGYPTIIRPSFTLGGTGGGIAYNSEEFEEIIRRGLAASPTTEVLVEESVLGWKEFEMEVVRDRLDNAIIVCSIENFDPMGVHTGDSITVAPAQTLTDKEYQILRDVSIAVLREIGVDTGGSNVQFAIHPENGRLVVIEMNPRVSRSSALASKATGFPIAKVAAKLAIGYTLPEIMNDITGVTPASFEPTIDYVVTKIPRFTFEKFPQASALLTTQMKSVGEAMAIGRTFKESLQKALRSMEIGLDGFGEILDVADESWEAVLEERLHNPGPDRILYVAEAFRQGKDLEWLNRVTAIDPWFLDQIQQIVEAEASIRGVSFENISIPRLRELKEMGFSDARLARLTQTSDTAVRTSRLTHGVVPVFKRVDTCGAEFASQTAYLYATYEQVCEAAPSSRKKIMILGGGPNRIGQGIEFDYCCVHAAFALRDVDYETIMVNCNPETVSTDYDTSDRLYFEPLTFEDVMTIVDIEKPDGVIVQFGGQTPLKLAKRLEAAGVPIIGTTPEAIDVAEDRERFQVLLQKLGLRQPPNGIARSEQEAIREAEAIGFPVVVRPSYVLGGRAMEIVHDVKDLERYMRTAVQASPDHPVLIDHFLRDAIEIDVDCIADGKTAVVAGIMEHIEEAGVHSGDSACSLPPYSVGLDLINEIERQTKMLAAALEVKGLMNIQFAIQKGAVYILEVNPRASRTVPFVSKATGVPFAKLAARVMAGESLQELGLTHSPKLGHVAVKEAVFPFEKFMNVDPVLGPEMKSTGEVMGLADTFGAAFAKAQEGAGVYLPMAGKCANQRIFISVKDEDKHAIVMPAKRLVEMGYKLSATSGTARFLEGEGVPVETVNKVTEGRPHIVDQMKSNEVALVFNTTQDKRALEDSFPIRRTALMSKIPYFTTVAGMRAAVSAMEAMRAGDFSCKALQDYY

SEQ ID NO: 60791 - protein, 339 aa, Zea mays
TGRLQSGPDSFSTPPPVSHRARGRGARRCGCSADVRGRAQQQGIRGGREAMGEEAAKKEEVEKPKEAAAAEEKKKDDKPKEVGGGGEKPKDGEEDEKKKEDAPPPPPPPPPEEVEMRVYMHCEGCARKVKKILRRFDGVEDVIADSKAHKVLVKGKKAAADPMKVVERVQKKTGRKVELLSPMPPPPEVEEKKEDEAEKKKDDEKKAEPEPPKPEEKKDAGGAGSEEKKDGKEEEEKKDGGEKNEEKKDGGDGDGDKKDEAGDKDKDPAASLYMHYPRFPFAGGYYQPPAYPPPPGYPYAYQPAYPPPFYAPPHHHLHQQQPMAPQIFSDENPNACSVM

SEQ ID NO: 60792 - protein, 548 aa, Thermus thermophilus HB27
MKPWYAHYDPGVPKEAPAPRLLPEALAETARRFPKKVALEFLGRRLTYAALWREVEAFAKGLQEAGLKPGDRVALMLPNSPQFVIAFYGTLLAGGVGVNTNPMYTPRELHHQLRDAGARFLVILDQLLPRYLEVKGEVPVEKVVRTGIQDYLPFPKNLLYPLLLRRKGEAPKALEGLPWRAFLRPGTPRPVPLDLDDLALLQYTGGTTGLAKGAMLTHRNLSANALQVRAWIPDFREGEEVVLGAIPFFHVYGMTVAMNLALLGGAKLVLLPRPEIKAIVEAIEKHQVTLFPGVPTLYVAFNNFPGIERRDLKSVRACISGSAPLPLEVAERFERLTGAKLVEGYGLTEASPVTHCNPLYGERRLGSVGLPFPGVDAKVVDEEGRELPPGEVGELAVKGPNVMKGYWNRPEETQKTLKDGWLFTGDLAKMDQDGYFYIVDRKKDMIIAGGYNIYPREVEEVLYQHEAVQEAAVVGVPDPYRGETVAAFLVLKPEYQGKVSEKDIERFCRQNLAAYKVPRIIQFRESLPKSSVGKILKRELQKEVAAKR

SEQ ID NO: 60793 - protein, 104 aa, Bdellovibrio bacteriovorus HD100
MGKKIYVGNLSYNVDQDQLGGLFADFGTVDSVNIITDRDTGRSKGFAFVEMSSDSEATAAIDKLNGMDLGGRAMNISEAKPQEPRSGGGPRRNGGGFGGSRRSY

SEQ ID NO: 60794 - protein, 226 aa, Xylella fastidiosa 9a5c
MTVSAPLSFMPEAVIFDMDGLMLDSERVSIECRCRAAFDLEQQIEPDYWLQMVGVSDIACHAQLSARIGAVPATALLARSDALYEAVVTKGVPHRPGIVTLLEWLFARGIPCAVGTSTRRPLALRKLNTAGLLWRFNAVCTASDVAQAKPAPDIYLLAAHTLGIVPGRCLVVEDSPIGVRAALAAGMTPIQVPDLLMPDAQVSALGHRIVASLTEVQSLLEACFDV

SEQ ID NO: 60795 - protein, 180 aa, Glycine max
ASEVAMAIISDFNEEEQKPTHSSPPQPQSSSSSSSSSFSAAFDRSNPIAFLERVFQFVSEHSDFLATESAEKEIALLVRAAGKKKREFLKSEREKAEKKKREDLRDYHEIEKEDKKVEKRLNEEKEDKAEDTNKNESASRVPNKGNGLDLEKYSWTQSLQEVNVNVPVPNGTKSRFVSAT

SEQ ID NO: 60796 - protein, 376 aa, Streptococcus thermophilus CNRZ1066
MTKLFSNYKRAAIDFASAQGNYLTDTTGKTYLDFSSGIGVTNLGYHPRVNQALTDQVGKILHQPNLYYNQLQEDVAGLLTGDKDYLAFFCNSGAEANEAAIKIARKASGKQEIITFQNSFHGRTFGSMSATGQDKIKQGFGEGVPHFSYAIFNDMDSVKALANKETSAIMLELVQGESGVQPADKAFVKALSDYCQETGIYLIVDEVQTGIGRTGKLFAYEHYDIEPDIFTLAKGLANGVPVGAMLAKSSLGGAFSYGSHGSTFGGNKLSMAAAKATLEVMLTPGFLDTALENGNKLQVKLQEVLSDKETVTTVRGLGYMIGIETTGNLSELVQAARDKGLIVLTAGTNVIRLLPPITLSDAEIEKGVAILSEIFD

SEQ ID NO: 60797 - protein, 1095 aa, Arabidopsis thaliana
MTTTSEISLQEEYVTDAVDHRGLAARRSNTGRWRAALFIIGVEVAERFAYYGIGSNLISYLTGPLGESTAVAAANVNAWSGIATLLPVLGAFVADAFLGRYRTIIISSLIYVLGLAFLTLSAFLIPNTTEVTSSTSSFLNVLFFFSLYLVAIGQSGHKPCVQAFGADQFDEKDSQEKSDRSSFFNWWYLSLSAGICFAILVVVYIQEEFSWAFGFGIPCVFMVISLVLFVSGRRIYRYSKRRHEEEINPFTRIGRVFFVALKNQRLSSSDLCKVELEANTSPEKQSFFNKALLVPNDSSQGENASKSSDVEDATALIRLIPVWFTTLAYAIPYAQYMTFFTKQGVTMDRTILPGVKIPPASLQVFIGISIVLFVPIYDRVFVPIARLITKEPCGITTLKRIGTGIVLSTITMVIAALVEFKRLETAKEHGLIDQPEATLPMSIWWLIPQYLLLGLADVYTLVGMQEFFYSQVPTELRSIGLALYLSALGVGSLLSSLLISLIDLATGGDAGNSWFNSNLNRAHLDYFYWLLAIKMTTTSKTSLQEEYVIDAVDHRGFSARRSITGRWRAAWFIIGVEVAERFANYGIGSNLISYLTGPLGQSTAVAAANVNAWSGISTILPLLGAFVADAFLGRYITIIIASFIYVLGLAFLTLSAFLIPNNTEVTSSPSSFLNALFFFSLYLVAIGQSGHKPCVQAFGADQFDEKNPQENSDRSSFFNWWYLSMCAGIGLAILVVVYIQENVSWALGFGIPCVFMVISLVLFVLGRKSYRFSKTRQEEETNPFTRIGRVFFVAFKNQRLNSSDLCKVELIEANRSQESPEELSFLNKALLVPNDSDEGEVACKSRDVEDATALVRLIPVWLTTLAYAIPFAQYMTFFTKQGVTMERTIFPGVEIPPASLQVLISISIVLFVPIYDRVLVPIGRSITKDPCGITTLKRIGTGMVLATLTMVVAALVESKRLETAKEYGLIDQPKTTLPMSIWWLFPQYMLLGLADVHTLVGMQEFFYSQVPTELRSLGLAIYLSAMGVGSLLSSLLIYLIDLATGGDAGNSWFNSNLNRAHLDYFYWLLAVVSAVGFFTFLFISKSYIYRRVDVV

SEQ ID NO: 60798 - protein, 274 aa, Zea mays
MAVHGGDYLRRFVAETEWYNEVVLNAVAPGDWWRGLPHPVQSWMRNCVGGYLLYFISGFLWCFVIYYWKRHAYIPKDAIPTNEAMKKQIAVASKAMPFYCALPTLSEYMIESGWTRCYFNISEMGFSAYLCYMAMYLIFVEFGIYWMHRELHDIKPLYKHLHATHHIYNKENTLSPFAGLAFHPLDGILQAMPHVLALFLFPTHFRTHIALVFLEGVWTTNIHDCIHGKLWPVMGAGYHTIHHTTYRHNYGHYTVWMDWMFGTLREPDDILKKA

SEQ ID NO: 60799 - protein, 654 aa, Clostridium thermocellum ATCC 27405
MDRKTFYITTPIYYPSDKLHIGHSYTTVAADAVARYKRLKGYDVMFLTGTDEHGQKIERKAKEKGVTPKQYVDEIVAGIKELWKLLKITNDRFIRTTDPHHEKTVQKIFKKLYDQGDIYKSEYEGWYCTPCESFWTKTQLVDGKCPDCGREVELTKEESYFFRLSKYQDRLIKHIEENPDFIQPVSRQNEMLNNFLRPGLEDLCVSRTTFDWGIPVSFDDKHVVYVWIDALSNYITALNYMSEDDSDYRKYWPADVHLVGKEIVRFHTIIWPAMLMALGEPLPKQVFGHGWLLLEGGKMSKSKGNVVDPVVLVEKYGVDAIRYFLLREVPFGSDGVFSNEALINRINSDLANDLGNLVSRTVAMIDKYFGGKLPQERQAGEFDDDLIKTVTDTPQKVEELLDRLQFSTALTEIWKAISRTNKYIDETMPWALAKSEENKARLAAVLYNLAESIRIVSILIQPFMPETPEKIWHQLGINDKKYVEWETAKKWGVYPEGAAVNKGEPLFPRIDVKKELEELEKLTLAAAENKEKQSPKQETEKKDAEKNEYITIEDFEKLDLRVGKVLEAQKVENADKLLKLKIEVGNEVRQVVSGIAKYYSPEELKGKYVVLVANLKPVKLRGIESQGMILAASDDKDLVLVTIDKEINSGTKVQ

SEQ ID NO: 60800 - protein, 547 aa, Burkholderia sp. 383
MQDDTWAPASSAYAYPLLIKQLLHTPTKQAASQEIVYRGDLRISYATLRERIGRLANALATAGVRHGDTVAVMDWDSHRYLECYFAVPMMGAVLQTVNVRLSQDEIAYTIDHAHADVLLVHADFLPVVDAIRERLPHVRTFILLDEPDSAPCSHAIPFIGEYEALLAASAVDYAFPDFDENTRATTFYTTGTTGLPKGVHFTHRQLVLHTLAIMAALSSPESGQRFHRGDVYMPLTPMFHVHAWGMPYVATVLGVKQVYPGRYVPERIVKLVQDEGVTFSHCVATILHMLLGCDTAATADLGRWKIVIGGGALPQGLARTALAHGIDIFAGYGMSETCPVLSLAQLPPGAEQLDADEQVRMRCRAGRPVPLVDLRVVDDDMSELPRDGHAYGEIVARAPWLTQSYVKNPEASEILWAGGYLHTQDVGHVDPSGALQITDRIKDVIKSGGEWISSLEIENLISMYPGVAEVAVIGVRDDKWGERPVAVVVCKPGFTLSEEGIRSHVTRFSATGRISKYAVPQVVRFVDALDKTSVGKIDKKALRAQFA

SEQ ID NO: 60801 - protein, 444 aa, Bacteroides fragilis NCTC 9343
MNAAKVLEDLKRRFPNEPEYHQAVEEVLSTIEEEYNKHPEFDKANLIERLCIPDRVYQFRVTWVDDKGNVQTNMGYRVQHNNAIGPYKGGIRFHASVNLGILKFLAFEQTFKNSLTTLPMGGGKGGSDFSPRGKSNAEVMRFTQAFMLELWRHIGPETDVPAGDIGVGGREVGFMFGMYKKLSHEFTGTFTGKGREFGGSLIRPEATGYGNIYFLMEMLKTKETDLKGKVCLISGSGNVAQYTAEKVLELGGKVVTMSDSDGYIYDPDGIDRAKLDYIMELKNLYRGRIREYAETYGCKYVEGARPWGEKGDIALPSATQNELNGDDARKLVANGVIAVSEGANMPSTPEAIKVFQDAKILYAPGKAANAGGVSVSGLEMTQNSIKLSWSSEEVDEKLKSIMKNIHEACVQYGTEPDGYVNYVKGANVAGFMKVAKAMMAQGIV

SEQ ID NO: 60802 - protein, 112 aa, Helicosporidium sp. ex Simulium jonesii
MGGAVIQVTNKTEFDSHLSTAASKGKLVVVDFTATWCGPCKMIAPFFAKLSGEYPDVVFLKVDVDEVEAVAAEHGITAMPTFLFFKDGKQVDSLTGANQERLRAMLTQHAQS

SEQ ID NO: 60803 - protein, 755 aa, Deinococcus radiodurans R1
MSRDPLPFFPPLYLGGPEITTENCEREPIHIPGSIQPHGALLTADGHSGEVLQMSLNAATFLGQEPTVLRGQTLAALLPEQWPALQAALPPGCPDALQYRATLDWPAAGHLSLTVHRVGELLILEFEPTEAWDSTGPHALRNAMFALESAPNLRALAEVATQTVRELTGFDRVMLYKFAPDATGEVIAEARREGLHAFLGHRFPASDIPAQARALYTRHLLRLTADTRAAAVPLDPVLNPQTNAPTPLGGAVLRATSPMHMQYLRNMGVGSSLSVSVVVGGQLWGLIACHHQTPYVLPPDLRTTLEYLGRLLSLQVQVKEAADVAAFRQSLREHHARVALAAAHSLSPHDTLSDPALDLLGLMRAGGLILRFEGRWQTLGEVPPAPAVDALLAWLETQPGALVQTDALGQLWPAGADLAPSAAGLLAISVGEGWSECLVWLRPELRLEVAWGGATPDQAKDDLGPRHSFDTYLEEKRGYAEPWHPGEIEEAQDLRDTLTGALGERLSVIRDLNRALTQSNAEWRQYGFVISHHMQEPVRLISQFAELLTRQPRAQDGSPDSPQTERITGFLLRETSRLRSLTQDLHTYTALLSAPPPVRRPTPLGRVVDDVLQDLEPRIADTGASIEVAPELPVIAADAGLLRDLLLHLIGNALTFGGPEPRIAVRTERQGAGWSIAVSDQGAGIAPEYQERIFLLFQRLGSLDEALGNGLGLPLCRKIAELHGGTLTVESAPGEGSTFRCWLPDAGPLPGAADA

SEQ ID NO: 60804 - protein, 191 aa, Helicosporidium sp. ex Simulium jonesii
MASLLRSSGLAVLGRVRASLASTSDIGGRLVSTTSSSGATTSIDSIVPETPSTNNPPMAPWTPTDQLKKRKTLMKRMEFMIRELEKEQVAAALNTRPIPQFKPGDVLEVLTVVPENKRRVTAFRGVCISQRRKAIRSTFTLRNYLGTAGAVERTFPLHSPQIQEIRVVEERKARRAKLFYLRERAPKVYRV

SEQ ID NO: 60805 - protein, 300 aa, Deinococcus radiodurans R1
MSGSEGTDLPRVLVVGSANLDFVTRLSHLPAPGETVLGESYTTAPGGKGANQAVACARAGGAVAFCGALGTDPFAEPLLASLRESGVQDWTVRASTPTGAAFISVSEAGENCIAVASGANGTLRPEQLPPLTGVGWLVLQLEIPLETVQAAAQAAREAGAQVVLNAAPARTLPPELLRLVDVLIVNEGELRTLIGATDLRAGVRQAQASGPRTVVVTLGERGCLALSGDDWTELPALPVPVRDTTGAGDTFVGVLVAALSRGEPFAAALRWAVAGSALACTREGAQPAMPGREEIQANLG

SEQ ID NO: 60806 - protein, 345 aa, Moorella thermoacetica ATCC 39073
MKALVFEGPNELKLRDVPLPEPGEDEILVKVAACLICGTDLRIFRGAKTRGVRIPSILGHEFAGVVEATGVNVKEFHVGDRVGVAPVIPCHTCFYCKNGLENVCANRTALGYEYEGAFAEYVCIPAPAVKGGNVYHLPSNISLEEAALAEPLACCLNGHHNSKVKLGDVVVILGAGPIGLMHLQLAKSSGASYVIISEPNEHRRAIAKEFGADRVVDPQTEDLNSIVKNVTDGLGADIIFLAIGIPALAQDALTLVKKGGTINFFAGFSVGDKAALDVNLIHYNEIKITGTSAARRDDYRKALDLIAKGKVKASKMITHRFPLDKAEEAFRIAGSSQGIKVAIIP

SEQ ID NO: 60807 - protein, 585 aa, Zea mays
  misc_feature (8)..(8): Xaa can be any naturally occurring amino acid
  misc_feature (14)..(15): Xaa can be any naturally occurring amino acid
  misc_feature (58)..(58): Xaa can be any naturally occurring amino acid
  misc_feature (100)..(100): Xaa can be any naturally occurring amino acid
  misc_feature (447)..(447): Xaa can be any naturally occurring amino acid
RELGALPXFAKLYXXRQQPLPAPIPVELGRLGSLQVLQLGYNQLTGSIPTQAGPPKQXSTVLALQSNQLSGAIPASLGDLPALARLDLSSNQLFGSIPSXKLAEIPRLATLDLRNNTLSGSVPSGLKKLNEGFLYENNPELCGAQFDSLKACPNDGNDDGRTPRKPESTSVIKPQQIQKTADLNRNCGDDGGCSKPSTLSTGAVVAGTVVIVAGAAACGLSAFSWHRRQKQKIGSSSVEHLEGRPSLDRSKEAYERSAVSSLINVEYSSGGWDTSSEGSQSQHGVARLSSAAECGSPSVRFNLEEVECATQYFSDVNLLGKSSFAATYKGVMRDGTAVAVKSISKSSCKSEEADFLRGLRALTSLRHENLVGLKGFCRSRASGGCFLVYEFMTNGSLSRYLDAKESDAADAAAVLDWPTRVSIIKGVAKGIEYLHSSKLAHQSISAXKVLFDHLYAPRLSGAGLHRLLADDVVFAALKDSAAMGYLAPEYATTGRSTDKQGDVYAFGVVVLQVLAGRRAVSPPHLQQGGGGGGRLDDLVDPRLRGRFSRAEAAKLAGVALLCTAEAPAQRPTMTAVLQQLGTSSQ

SEQ ID NO: 60808 - protein, 213 aa, Zea mays
MYADAGFAFAFAAAYSPTLTSSQPQPPPPPFDYAFSSEPPLLSMPAMDHDAYLGNLVQPSMVSEYDLGGEGDLFKAPEAIIEEPLLSLDPVAAAFSMMAGNGSAVMDQTIKDAGTGTIQNDPLLSEVLYECEKELMEKSTIEGELTANVCVTISDLKTEERKQKLSRYRKKKIKRNFGRKIKYACRKALADSQPRVRGRFAKIEECDLLKPSK

SEQ ID NO: 60809 - protein, 692 aa, Hordeum vulgare subsp. vulgare
MLLQPYHMIAPLLLLLVAAGSCHAAIDGGGSDDGRMFVYNGFTGANLSVDGPSLIMPNGLLLVANATGRTGGSLNGHAFRPFPLPFHTASNATGSVRSFSTSFVFGIIRQYEGLGSDGMAFFVSASKEALSTAQPGPSLGLLNDINNRNRNSSARIFAVELHTSRNVQLHDINDNHVGVDVDSSLVPLDSASAGYYDDDEDGGRFQNLSLISRKAMQVWVDYDGRATEITVTIAPLGLAKPKKPLLRTITDLSGVLQSTAYMGFSASTGYRTRHFVLGWNFALDGPAPVLDLSMLPALPTALSNSRSMSITMKIVLALASVALVSVGIGVYIFVRRRLKYSEVHEDWEVPFGPNRFSYKDLFHATEGFSDKNLLGRGGFGSVYKGVLRKSDKEVAVKRLSHDSRQGKKEFIAEVVSIGHLRHQNIARLLGYCRRKGEFLLVYEYMENGSLDKYLHTRNGPTLCWSQRYSIIKGVASSLLYLHEEWEHVVIHRDIKPSNVLLDSKMNGWLGDFGLAKIYGRETAAPATHVAGTIGYLAPELARTGRPTPFTDVYAFGMFLLEVTCGRKPIFTDKQNNRLLLVEWVLEHHRDGSILDTVDPRLQGEFNMEEVTIVLKLGLICTYPLPNMRPIMRKVMQYLVHNQSPPDLSPAYISYMSLMQNQGFNSDNMNTTCPEATTSVATASSATILRDGR

SEQ ID NO: 60810 - protein, 429 aa, Bdellovibrio bacteriovorus HD100
MPSEVHMPKKVVIVGGGFAGLKAARALGNNEDVSVTLIDRRNYHLFQPLLYQVATAGLSPAEISGPIRGILSKYKNVSVFLDNLENVDLTNKKIQVQDRSLEYDYLILACGAKHSYFAHPEWEENAPGLKTLEQATEIRRRLLMAFERAEKETDPEKQKQQLTFVIVGAGPTGVELAGTIGEISRHTLTKDFRHIDPSRTRVILIEAGPRILAAFHPDLSRKAAADLEDLGVQIWTNTRVTDVKSDSVVLGDEVIKAATILWAAGVQPSSINKTLGVPLDRAGRVIIEKDLSLKEHPEVFVLGDQACYLTDKGQALPGLASVAMQQGTHAANQILREIEGKPRLEFKYLDKGQMATIGRRKAIAQISNLKFSGFFAWILWLFIHVYYLIGFKNKVFVIWQWAYAYFTFKRGARLIVDKEWRSKPKPPVS

SEQ ID NO: 60811 - protein, 1000 aa, Oryza sativa (japonica cultivar-group)
MRRERDATQIPENPMEGIPQTAAAAAAAAAAEASEPPRKRARVDGGGGGAGEEEEDRLSDLPDCLLEDILAHLGSRQAVQTSVLSRRWRNLWRGVRVVVIDVGSFRLPGADGDPPRFRLDRIEDFADGVLSPSLHPGAARELDALRMRLDEDAVTTNFQRWIRRALWRRPATVDLYYLPRRSFSWPPAVPLTPVTAVSRLKTLRIFGLRPTVVFGADEFPALEDLHIERCSYAHGTIASPTLKRLALVSPINGCFVREQRLTAPGLTSLRLVLPYSREEGVRVITDAPLTSLVDASITIVDTDPGDPRNRRVNQFKVDFLVAISNLLGRLTSVRNLDLTGLNATALLDNKSQEFPMFPYLTTLLLNECDIGYKYHVLRSILQNAPNLEQLRLHNCKFVGKSRRKAGQTQSKEKTSKCSSSTLSSACSSLKSVEIKHPRVGVHVCTREGLCAYDMLPCKGESFSASLSRGHMYAKNHLKIEKTDKLKRSLERTLSLISWYGPGFCIRFTFTHGIFPRRRNPPITPVQIENARGPRPSRLNPDKVASPSSRSIYGAARRDLPMASAAAAAASDEPPRKRARSAGAEDRLSELPDCLLHDILALVGSRQAVRTSVLSRRWRGLWRSAPRVDIDQREFRRACGGEEGEPVVDCDGFEDFADGILSPTLLGGTGTPPLDAFRLHLLYEGRFITFGRWVRRALTRRPASVDIHVEYGGTVDWPPALTLGDGAGTGRLKRLHLFGVHLGFISGDGGRLAELLPVLEDLRMESCTFGHEPSSPTTTIAIPTLRSLALAVVPRRTARPYALTVASPRVASLRLFLPFSRTRAAAVRVAPAEEGEALASLVTASITVLETDQELNRRMNKHKLDFLASTRNMLDRFPNVRNLDLSGFPTIALLDKASQEFPTLPSLTTLLLSECDVGANCYVLKSVLRNAPNLEHLRLHRCKFLGTPKRKRGNSRSKGKSSSTCLDSLSSKCKSLQSVEIKFRPIDNARHHDLVGLLKEC

SEQ ID NO: 60812 - protein, 437 aa, Legionella pneumophila subsp. pneumophila str. Philadelphia 1
MIGNKTMDMDIKHKPLKRELSLFGATMMGLGSIVGTGVFVSIGIAAGVTGPSVILAIALAALVATCNAFSSAQLAANHAVSGGTYEYGYRYLHPAFGFTAGWMFLCAKSASAATAALGFAGYFIHLSGLETVPVIPIALAVSITLILLVLSGLRRTNTVNIIIVMITLITLTVFIISGLPDFMQRGTANLRPFFPVSKQEGLSHFFYATALMFVAYTGYGRIATLAEEVKNPGKFIPAAIIITLMVSAVLYILVGLVAIGAVGVEKLAQVTETNATPLESAARAIGIPGLSVLVSIGACTAMLGVLLNLILGLSRVALAMGRKGDLPKMFCYVSETRHVPVSAVIGVGVVIIALVLTGSVETTWTFSAFTVLIYYAITNLAALHLPKEEQLYPPLFAIGGLLSCLFLAFWVPIGVWITGISLLFLGLLWKVVANRFL

SEQ ID NO: 60813 - protein, 249 aa, Alkaliphilus metalliredigenes QYMF
MSSVFNGERMKDGVIKLASLIKKSKDTVILTGAGMDTESNIPDFRSEKGWWRSIDPRTVANIDTFYENYSLFHEFYDMRLRLLVGIQPHKGHYILSDLEKKGMIRSIATQNVAGLHVMAGSQNVYELHGNIRKIRCNNCNHEASLERFLAVETCGSCGDKGLRPSVILFGETLPPKAWDSALRDIQKCDLLIVIGTSLEVYPVNHLPMLTKGKKVFINNEERSTDYAFDLTIIGKAKEVLEALNHYLLL

SEQ ID NO: 60814 - protein, 122 aa, Erythrobacter sp. NAP1
MNLIQQIEAEEIGKVEREIPDFRAGDTVRVGVKVKEGNRERVQNFEGVVIARSNRGMGSNFTVRKISFGEGVERVFPLYSPIVDSITVVRRGVVRRAKLYYLRGRTGKRARIAERRENVAKA

SEQ ID NO: 60815 - protein, 470 aa, Zymomonas mobilis subsp. mobilis ZM4
MANSASDLLKLIKEKEIDWVDLRFTDPKGKWQHLTMASTVVGEDDLNDGFMFDGSSIEGWKTINESDMILKPDLDAFYIDPFSASPMLILICDIVEPATGEFYSRDPRSTAKRAEAYVKTLGLGDTVYIGPEAEFFLFDDVRFDSGYNGSFYRVDDIELPTNSGREYDNGNLAHRPGVKGGYFPVAPVDSAVDIRSEMVSTMLEMGLPMDKHHHEVAPAQHELGLTFGTLTQTADRMQVYKYVVHQIAQAYGKTATFMPKPISGDNGSGMHTHISIWDGGKPTFAGSEYAGLSENALYFIGGIIRHAKAINGLTNPSTNSYKRLVPGFEAPVLLAYSARNRSASCRIPYGTGEKSRRVEIRFPDATANPYLCYTALLMAGIDGIQNKIHPGEAMDCNLYDLPPEELAKVPTVAGSLREALDALSEDFDFLTKGDVFTEDQIKSYIEIKRAEVLRWEMAPSPVEFEMYYSL

SEQ ID NO: 60816 - protein, 451 aa, Solanum tuberosum
MAVSDSQNSQTCLDPDASRSVLGIILGGGAGTRLYPLTKKRAKPAVPLGANYRLIDIPVSNCLNSNISKIYVLTQFNSASLNRHLSRAYASNMGGYKNEGFVEVLAAQQSPENPDWFQGTADAVRQYLWLFEEHTVLEYLILAGDHLYRMDYEKFIQAHRETDADITVAALPMDEKRATAFGLMKIDEEGRIIEFAEKPQGEQLQAMKVDTTILGLDDKRAKEMPFIASMGIYVISKDVMLNLLRDKFPGANDFGSEVIPGATSLGMRVQAYLYDGYWEDIGTIEAFYNANLGITKKPVPDFSFYDRSAPIYTQPRYLPPSKMLDADVTDSVIGEGCVIKNCKIHHSVVGLRSCISEGAIIEDSLLMGADYYETDADRKLLAAKGSVPIGIGKNCHIKRAIIDKNARIGDNVKIINKDNVQEAARETDGYFIKSGIVTVIKDALIPSGIII

SEQ ID NO: 60817 - protein, 273 aa, Oryza sativa (japonica cultivar-group)
MQIEGGAEGVIVGGTTGEGHLMSWDEHIMLIGHTVNCFGTKIKVVGNTGSNSTREAIHATEQGFAVGMHAALHINPYYGKTSVEGLISHFEAVLPMGPTIIYNVPSRTGQDIPPAVIEAVSSFSNMAGVKECVGHERVKCYTDKGITIWSGNDDECHDSRWKYGATGVISVASNLIPGLMRKLMYEGENTALNDKLLPLMKWLFCQPNPIALNTALAQLGVARPVFRLPYVPLPLEKRVEFVRIVESIGRENFVGQKEARVLDDDDFVLISRY

SEQ ID NO: 60818 - protein, 141 aa, Yarrowia lipolytica CLIB122
LTSSTMAADAYTFIFAILISLVNLFLQVFFTIMYSDLECDYINPIDLCNRLNNYVLPEAAAHAALTIVFLLTGHWIVLLLNAPIFAYNAHKIYTNTHLLDATEIFRTLKKHKQESFIKLACYLVFFFLYLYCMIAALVRED

SEQ ID NO: 60819 - protein, 283 aa, Brassica napus
MLVAAASTLFSLSSAVFTRRRSFRVSATLSREPSPLLRAAHHTVDSYVKSGMVVGLGSGEASDLAIRYLGHQLRSGSVQDVVGVPMSARSASEAAKYGVPLKHFRDDFQIDFAFHDADAVEEGTLVSVVGRRRTTQEDDYILRQKSIVKAADEAVFMVKEEQYKSGLEGSIPVLVQSLNWLAIAEEIDDLYLGDAEVWRRASVGDAGPLGGDFPIVTSDGHNILDVIFTTPIPSLANVAKSLDNIDGVVDHGLVIKTRCTVVIAGETEVRTVTLQTSAVEDGV

SEQ ID NO: 60820 - protein, 401 aa, Oceanospirillum sp. MED92
MNKSLLSVAEPPIENQTQHLMPITQRPDVVFTKGKGHYLFDASGTAYLDMMQGWAVNTLGHSPNFLKHALLNQAEQLINPGPAFYNKPMIELSNTLCSASVFDHVFFANSGAEANEGAIKLARKWGQLNKQGAFEIITFKNSFHGRTLATMSATGKASFAPLFEPKISGFKKVPFNDPQALINAISSNTTAIMLELVQGEAGVIPAEYDFVKKLETQCKQHNLLLIVDEVQTGVGRTGKLFAYQHYGISPDILTLGKGLGGGVPISALLAKQAVSCFAPGDQGGTFNGNPLMCASALAVLEALEAENILSNVNKMSELLQTEFFELSQKYGLGQIRGQGLLLAIDTGAYDAHQIAASAFRKQLLINAPRSNCIRLMPALNIGPEEIYKAMSVLEDCLSELS

SEQ ID NO: 60821 - protein, 358 aa, Neurospora crassa
MAEFIRAQIFGTTFEITSRYSDLQPVGMGAFGLVCSAKDQLTNQNVAIKKIMKPFSTPVLAKRTYRELKLLKHLRHENVISLSDIFISPLEDIYFVTELLGTDLHRLLTSRPLEKQFIQYFLYQIMRGLKYVHSAGVVHRDLKPSNILVNENCDLKICDFGLARIQDPQMTGYVSTRYYRAPEIMLTWQKYDVEVDIWSAGCIFAEMLEGKPLFPGKDHVNQFSIITELLGTPPDDVINTIASENTLRFVKSLPKRERQPLKNKFKNADSSAVDLLERMLVFDPKKRITATEALSHEYLAPYHDPTDEPVAEEKFDWSFNDADLPVDTWKIMMYSEILDYHNVEASGQMMFQEDVPPQ

SEQ ID NO: 60822 - protein, 368 aa, Streptococcus agalactiae NEM316
MSKKTDTPDYKPSIYSLTRDELIAWAIEHGEKKFRASQIWDWLYKKRVQSFDEMTNISKDFIALLNENFVVNPLKQRIVQESADGTVKYLFELPDGMLIETVLMRQYYGLSVCVTTQVGCNIGCTFCASGLIKKQRDLNNGEITAQIMLVQKYFDERGQGERVSHIVVMGIGEPFDNYTNVLKFLRTVNDDNGLAIGARHITVSTSGLAHKIREFANEGVQVNLAVSLHAPNNELRSSIMRINRSFPLEKLFAAIEYYIETTNRRVTFEYIMLNGVNDTPENAQELADLTKKIRKLSYVNLIPYNPVSEHDQYSRSPKERVEAFYDVLKKNGVNCVVRQEHGTDIDAACGQLRSNTMKRDRQKAKVGR

SEQ ID NO: 60823 - protein, 420 aa, Blastopirellula marina DSM 3645
MQNVLSVILAGGKGSRLEPLTRDRAKPAVPFGGVYRIIDFALSNCLNSGLRHIQLLTQYKGQSLDRHANTGWQRYFCRELGEFIDVIPPQQRIDEQWYQGTADAVYQNIYAMEKHRPDYVMILAGDHIYKMNYASMIDYHIENGADVTIGALRVSTEEAKSFGVMQVDADQRIVGFEEKSPTPKTIPGDPEHCLASMGIYVFNAHFLFEQLCQDATRRDSAHDFGKNIIPSIIDKQRVFAFPFRDENRKQDAYWRDVGTLDAYFEANMDLITVDPQLNLYDQDWPLRTYQPNVPPPKFVFAGSAQEGRRGCALDSIVCGGSIISGGEVERSIIGANVRVNSFAHVEDSILFEGVNIGRHTRIRRAIIDKGVHIPSGTEIGFDLEMDRRRGFTISSGGVVVIAKGDAVESMVRAEQEQVVV

SEQ ID NO: 60824 - protein, 214 aa, Thermus thermophilus HB27
MDLSAVRFDEKGLVPVVVQDARTGEVLTLAYANREALEETLRTRRSTFFSRSRQALWRKGETSGHTQEVVEVLLDCDGDAVVYRVLPQGPACHTGERTCFHRALLEGEKDLGFVVGQVYATIKERLRTLPEGSYVARMHHAGLDRILKKIGEEAGEVILAAKNQNPEELRHEAADLLFHLLLTLAELGLTPEDLAKTLWERHRPRSPYDGSHGN

SEQ ID NO: 60825 - protein, 463 aa, Glycine max
MGAVYFSQSCYKPRQIFNLERESTLVGRCPVVQIRCRRVVSACLNVDVDAPNTGNTTSEKKKTKDVIEMEGMYLVGTYARTPVVLERGEGCKLYDVEGNEYLDLSAGIAVNALGHGDADWLKAVVEQAGTLTHTSNIFHTIPQVELAKRLVASSFADRVFFANSGTEANEAAIKFARKYQRHTTSNGKVPATEFIAFSNCFHGRTLGALALTSKVQYRMPFEPVMPGVTFLEYGNAQAAVELIKQGKIAAVFVEPIQGEGGIYSATKEFLQSLRNACDETGALLVFDEVQCGLGRSGFLWAHEAYGVFPDMMTLAKPLAGGLPIGALLVTERVASAINYGDHGSTFAGSPLVCSAALAVLDKISKPDFLSSVSKKGLYFKELLREKLGENRHVKEIRGVGLIIGIDLDVPASPLVDACRSSGLLVLTAGKGNVVRLVPPLIITEKELEQAAGILCQTLPVLDN

SEQ ID NO: 60826 - protein, 120 aa, Bdellovibrio bacteriovorus HD100
MAKKLYVGNLPYSVDDEALHQHFAQFGAVDSAKVIMDRETGRSKGFGFVEMSDDSAADQAIERGNGIELGGRPINISEARPQAPREGGPRRGGGGFGGGRGGGGGERRGGFGGGGRGGPR

SEQ ID NO: 60827 - protein, 233 aa, Zymomonas mobilis subsp. mobilis ZM4
MSRIPFDFIGFDLDGTLIDSSPDLHAALDYALKQMGRPVPTQEQVEKMMGKGIRRLMEQALEVTGGINQELMVKGFPLMLAYYKKHVLVHTRPYEGVEEILKALQDLGLKLIVYTNKPECLARPIIHQLGWDHYFSDIIGGDSFSVRKPDPKPLLEAIDAMGGGRTAFIGDSITDVKTGHNADLPVILVSFGYSDVPATALGADRVISNYQELIPTLASFSDDMMPDAVVKPD

SEQ ID NO: 60828 - protein, 325 aa, Zea mays
MAPPHSHRSFRGWQNASHVALVLVSVLFLSKARPSAGARSLLELYKPPASALLTYHNGAVLQGRIPVTILWYGRFAPAQKAVVTDFLQSLTTTASPPSPSVSQWWGTIDQLYLSKARSGGGGSAQVALVGQAADEGCSLGKRLALSQLPQLAARAGPAAKGGVALVLTAQDVAVDGFCTSRCGLHGSDAGAGAAYVWVGNAETQCPGQCAWPFHQPLYGPQAPALVPPSGDVGMDGMVVNIASMVAGAVTNPFRDGFYQGDKDAPLEAATACTGVYGSGAYPGFAGNLAVDGTTGASYNANGANGRKYLLPALFDPATSTCSTLV

SEQ ID NO: 60829 - protein, 715 aa, Arabidopsis thaliana
MVVATTIALYASPASTVCSTAHQINAHISCDLDLNSRSSSASSSTSSPTIGGLSLLFSGASVKSSSSSSSSHPSVGEELASIRHDRSEDRTLSGSFCYSPSKFIGSSYLKRDHQSPVSVLHGPISSGNSPPMRISRDRNLDGGSALRVGSSRLFNGFVRKAIGSCVDYDTDSVLVDEQLPFTMDDGFEGERRQPYARDLLRRAQLKHKIFEDESVIKAFYEAEKAHRGQMRATGDPYLQHCVETAMLLADIGANSTVVVAGILHDTLDDSFMSYDYILRTFGSGVADLVEGVSKLSQLSKLARENNTACKTVEADRLHTMFLAMADARAVLIKLADRLHNMMTLYALPPVKRQRFAKETLEIFAPLANRLGISSWKVKLENLCFKHLHPDQHHEMSDMLEDSFDEAMITSAIEKLEQALKKEGISYHVVSGRHKSLYSIYCKMLKKKLTMDEIHDIHGLRLIVDNEKDCYKALGVVHKLWSEVPGKLKDYISHPKFNGYQSLHTVVMGDGTIPLEVQIRTKEMHLQAEFGFAAHWRYKEGDCKHSSFVLQMVEWARWVVTWHFETMSKDGSSICSSEPLCSFPSHAEDCPFSYKPSGNQEGPVYVIVIENEKMTVQEFPENSTVSDLLRRAGPGSSRWSMYSIPAKEELRPRLNQTPVSDLKCKLKMGDVVELTPAIPDKSLTEYREEIQRMYDRGLAFSRPHRAATGTMVGWGS

SEQ ID NO: 60830 - protein, 144 aa, Zea mays
MVHGKLEVLLVSAKGLEDTDFLNNMDPFVILTCRTQEQKSSVANGAGSEPEWNETFVFTVSDDTPQLHLKIMDSDLTNDDFVGEATIPLEAVFQEGSLPPAVHPVVKEEKYCGEVKLALTFTPAAETRHRPDDNEEGPPYSSWS

SEQ ID NO: 60831 - protein, 445 aa, Bacteroides fragilis NCTC 9343
MNIEKIMSSLEAKHPGESEYLQAVKEVLLSIEDIYNQHPEFEKAKIIERLVEPDRIFTFRVTWVDDKGEVQTNLGYRVQFNNAIGPYKGGIRFHASVNLSILKFLGFEQTFKNALTTLPMGGGKGGSDFSPRGKSDAEIMRFCQAFMLELWRHLGPDMDVPAGDIGVGGREVGYMFGMYKKLTREFTGTFTGKGLEFGGSLIRPEATGFGGLYFVNQMLQTKGIDIKGKTVAISGFGNVAWGAATKATELGAKVVTISGPDGYIYDPNGISGEKIDYMLELRASGNDIVAPYADEFPGSTFVAGKRPWEVKADIALPCATQNELNGEDAKNLIDNNVLCVGEISNMGCTPEAIDLFIEHKTMYAPGKAVNAGGVATSGLEMSQNAMHLSWSAAEVDEKLHSIMHGIHAQCVKYGTEPDGYINYVKGANIAGFMKVAHAMMGQGII

SEQ ID NO: 60832 - protein, 320 aa, Oryza sativa (japonica cultivar-group)
MFYAGYGYHGSNFEQTYRCYPASFFDKPHLEGGDKVIMPPSALDRLASLHIEYPMLFELHNDATQRISHCGVLEFVAEEGMIIMPYWMMQNMLLQEGDTVRVKNTTLPKGTYVKLQPHTTDFLDISNPKAILEKTLRKLSCITTGDSIMVAYNNKQYYIDIVETKPASAVSIIETDCEVDFAPPLDYKEPENPQQPSVPASEATAEDENAKVEDELKFKPFTGSGKRLDGKASKLQATEVPSASRSSPSDSNKRVNQETLAPASSGASNSTRQKSGKLVFGSSANNNKEPQKASVKDDESPKKDEPKFQAFSGKSYSLKR

SEQ ID NO: 60833 - protein, 541 aa, Oryza sativa (japonica cultivar-group)
MSMPSSRQAMGEINIEAMARPVSVDHRISIAYYFRIADNLLRQANIYREEKNLVDLYIILLRYSSLLCETIPKHRDYHAFKLREKEFLKKGPHNSDKLLNVVNELETLKPVVLRQIADLNRGVTQEPNSQSGTSAAISQMDHLTQSSCFTQPLVGSPTGLLKMPFSGGKHQVEPTQSGRPDSQLVKSLHIEAHRFKVSSAGWNVGYGNLPYPKEETLSRHSVLGPNGLHGKWTAPVTGIRIQYPSNAELTKSDVSSLVPSILNQDLLYGPSRSQDFPTNKNEDMQSVLSLDDGQLSLPVEEATSVSPGFEEEFSQLNIRQPSPPPVMAQVHPQHRAISTSTVADLGPGIASSSTGRYQNLHVPVTLMECFLRVAEANTANNLETCGILAGTLKKRTFYVTTLIIPKQRSTSDSHSTQKCQATNEEEIFEVQDKGSLFTLGWIHTHPTQTCFLSSIDLHNHYSYQVMLPEAIAIVMAPTDTTRKHGIFHLTDPGGMGVIHDCQESGFHPHEEPLDGTSIYEHCSHVYMNPNVKFDMVDLREL

SEQ ID NO: 60834 - protein, 1172 aa, Arabidopsis thaliana
MVSGVGGSGGGRGGGRGGEEEPSSSHTPNNRRGGEQAQSSGTKSLRPRSNTESMSKAIQQYTVDARLHAVFEQSGESGKSFDYSQSLKTTTYGSSVPEQQITAYLSRIQRGGYIQPFGCMIAVDESSFRIIGYSENAREMLGIMPQSVPTLEKPEILAMGTDVRSLFTSSSSILLERAFVAREITLLNPVWIHSKNTGKPFYAILHRIDVGVVIDLEPARTEDPALSIAGAVQSQKLAVRAISQLQALPGGDIKLLCDTVVESVRDLTGYDRVMVYKFHEDEHGEVVAESKRDDLEPYIGLHYPATDIPQASRFLFKQNRVRMIVDCNATPVLVVQDDRLTQSMCLVGSTLRAPHGCHSQYMANMGSIASLAMAVIINGNEDDGSNVASGRSSMRLWGLVVCHHTSSRCIPFPLRYACEFLMQAFGLQLNMELQLALQMSEKRVLRTQTLLCDMLLRDSPAGIVTQSPSIMDLVKCDGAAFLYHGKYYPLGVAPSEVQIKDVVEWLLANHADSTGLSTDSLGDAGYPGAAALGDAVCGMAVAYITKRDFLFWFRSHTAKEIKWGGAKHHPEDKDDGQRMHPRSSFQAFLEVVKSRSQPWETAEMDAIHSLQLILRDSFKESEAAMNSKVVDGVVQPCRDMAGEQGIDELGAVAREMVRLIETATVPIFAVDAGGCINGWNAKIAELTGLSVEEAMGKSLVSDLIYKENEATVNKLLSRALRGDEEKNVEVKLKTFSPELQGKAVFVVVNACSSKDYLNNIVGVCFVGQDVTSQKIVMDKFINIQGDYKAIVHSPNPLIPPIFAADENTCCLEWNMAMEKLTGWSRSEVIGKMIVGEVFGSCCMLKGPDALTKFMIVLHNAIGGQDTDKFPFPFFDRNGKFVQALLTANKRVSLEGKVIGAFCFLQIPSPELQQALAVQRRQDTECFTKAKELAYICQVIKNPLSGMRFANSLLEATDLNEDQKQLLETSVSCEKQISRIVGDMDLESIEDGSFVLKREEFFLGSVINAIVSQAMFLLRDRGLQLIRDIPEEIKSIEVFGDQIRIQQLLAEFLLSIIRYAPSQEWVEIHLSQLSKQMADGFAAIRTEFRMACPGEGLPPELVRDMFHSSRWTSPEGLGLSVCRKILKLMNGEVQYIRESERSYFLIILELPVPRKRPLSTASGSGDMMLMMPY

SEQ ID NO: 60835 - protein, 343 aa, Oryza sativa (japonica cultivar-group)
MDGEMFGSGHWGGSFPYASIPKESQFVFDAKASPLQLQLFGSAAVPAVGSTGYYNYIANNHLSAMNQERNTNNDVGHEKQLNLQMSLNYFPVENLDRLARIGNPSAVSTGLRLSYENNEHTSITSGSGNMSSLPIMASFVDEVMAELDKENKEFNCYFGLQVEQLVKCMKDVKQRQMVEFLASLERGVGKKLKEKELEVEAMNRKSKELNEQIRQVALEVQSWQSVALHNQSVANSMKSKLMQMVAHSSNLTREGSGDSEVDNTASSQNVNAVPGVFFQSGLLGINSMADGGLGACRLCRMKEAAVLVMPCRHLCLCADCEKNADVCPVCRFPKSCSVEINMS

SEQ ID NO: 60836 - protein, 420 aa, Oryza sativa (japonica cultivar-group)
MAAAAAATNGGFDVIVVGGGIMGSCAAYAAASSSASRCGGARVLLLERFDLLHHRGSSHGESRGIRATYPQARYPPMVRLAARLWGNAEAEAGYRVLTPTPHLDMGPRADPALRAAIQNGGAAEVVGASDDSAASWLWSAVFRLPEGWTAASSELGGVIKATKAVAMFQSLAAKNGAVLRDRTEVIDIAKQGDGSILVKTSSGEEFHGAKCIITVGAWASKLVKSVAGVDLPVQPLHTLICYWKARPGREHELTPESGFPTFASYGDTCIYSTPSMEFPGLIKVCAHGGAPCDPDRRDWCAGGDALADPVARWIDELMPGHVDTAGGPVIRQSCMYSMTPDEDFIIDFVGGEFGKDVVVGAGFSGHGFKMGPAVGRILAEMAMDGEAKTAAEAGVELGYFRIGRFEGNPEGNRAENKVKI

SEQ ID NO: 60837 - protein, 441 aa, Oceanospirillum sp. MED92
MSHTKLPKDWLDWVEINIQRDCDRSGMIEILVEHGFSYEAASEAVFCSEATSPPPPLFIPCAEKIDTHKAEVFYVNNFLSPEECAQMIELIQHHQRPSTTTNETGHYKHYRTSKTCDLSLLESTFVAEIDQRICKMLGIEPSYSEGIQGQWYDIGEEFKPHTDYFEPKSDEFLEHAEARGQRTWTFMIYLNNTQEGGGTFFPELGQRFLPSQGKAVIWNNLTTDGSPNPATLHHGEPVKRGYKAIITKWFRSKGTADSAQNREANENFPCHSQTGFLKSVIPEALFRKLLVFHHSNQNSAITESVPGFIHSKEGEASSLITLSDDMKEEIHATLKPIAEAWSGCLLKPTFVYGIREYHQGAVLEMHRDRLNTHEVSLILNIQQKTQEDWPLTIEDHFYRQHQITMQPGQMLLYEGCRLLHGRPTPLKGSIFANIFVHYSVE

SEQ ID NO: 60838 - protein, 320 aa, Escherichia coli
MIKKIGVLTSGGDAPGMNAAIRGVVRSALTEGLEVMGIYDGYLGLYEDRMVQLDRYSVSDMINRGGTFLGSARCPEFRDENIRAVAIENLKKRGIDALVVIGDGGSYMGAMRLTEMGFPCIGLPGTIDNDIKGTDYTIGFFTALSTVVEAIDRLRDTSSSHQPISVVEVMGRYCGDLTLAAAIAGGCEFVVVPEVEFSREDLVNEIKAGIAKGKKHAIVAITEHMCDVDELAHFIEKETGRETRATVLGHIQRGGSPVPYDRILASRMGAYAIDLLLAGYGGRCVGIQNEQLVHHDIIDAIENMKRPFKGDWLDCAEKMY

SEQ ID NO: 60839 - protein, 887 aa, Oryza sativa (indica cultivar-group)
MAPAAHRDGAAEAVGQRVFHFGKGRSDGNKTMKDLLGGKGANLAEMASIGLSVPPGFTVSTEACQQYQAQKAMPAGLWDEILAALTWVEGNMGAVLGDPRRPLLLSVRSGAAVSMPGMMDTVLNLGLNDHVVAGLAHRSGERFAYDSYRRFLDMFGNVVMDIPHSLFEEKIEAMKAALGLRNDTELTARDLKELVAQYKNVYVEAKGEEFPSDPKKQLHLSVLAVFNSWDSARAKKYRSINQITGLKGTAVNVQCMVFGNMGDTSGTGVLFTRNPSTGERKLYGEFLVNAQGEDVVAGIRTPQDLDTMKDCMPEPYAELVENCKILESHYKEMMDIEFTVQENRLWMLQCRTGKRTGKGAVKIAVDMVNEGLIDRRSAIKMVEPRHLDQLLHPQFESQSSYGDKVIATGLPASPGAAVGQIVFTADDAEAWHAQGKSVILVRTETSPEDVGGMNAAAGILTARGGMTSHAAVVARGWGKCCVAGCSGIRVNDAEKVVLVADKVLCEGEWLSLNGSTGEVILGKLPLSPPALSGDLGEFMSWVDEVKKLKVKANADTPADALTARNNGAEGIGLCRTEHMFFSSDERIKAMRQMIMAETIEHRQIALDRLLPYQRLDFEGIFRAMDGLPVTIRLLDPPLHEFLPEGNVEDMVRLLSSGNVYTQEEILTRIEKLSEVNPMLGFRGCRLGISYPELTAMQARAIFEAAISMTEQGVKVFPEIMVPLIGTPQELAQQVDVIREVAEKVFANAETTISYKIGSMIEVPRAALIADEIAALAEFFSFGTNDLTQMTFGYSRDDVGKFLPTYLSKGILQNDPFEVFDQKGVGELVKVAVERGRKARPDLEVGICGEHGGEPSSVAFFAKVGLNYVSCSPFRVPIARLAAAQVIL

SEQ ID NO: 60840 - protein, 482 aa, Glycine max
MKPGEMFAHIGSIVASLMFVWAMFKQFFPYQLSNQIEKHSQRLVTLVYPYIQITFHEFTGERLMRSEAYSAIENYLSSKASTQAKRLKADIGKNNQSLVLSMDDHEEVADEFNGVKLWWAYGKHISKSQSTISFHHPMSDEKRYYKLTFHKSNRDLILGRYLSHVLKEGKAIKVKNRQRKLYTNSGAYWSHVVFEHPATFQTLAMDPKEKEMIIDDLITFSKAGEFYARIGRAWKRGYLLYGPPGTGKSTMIAAMANFLGYDLYDLELTAVKDNTELRKLLIETSSKSIIVIEDIDCSLDLTGQRRKKKEEVEEKDQRQKQQGMQEREVKSSQVTLSGLLNFIDGLWSACGGERLIVFTTNYVEKLDPALVRKGRMDKHIELSYCGYEAFKLLARNYLNIESHNLFGRICELLKETKITPAEVAEHLMPKNAFRDADLYLKSLIQALELAKEDARKSQHDPHWTENDSEDKATEKSTNYTST

SEQ ID NO: 60841 - protein, 331 aa, Solibacter usitatus Ellin6076
MIETYGYARAGFLGNPSDGYFGKTLSFAMSNFRARVLCYPSARLEIKPSKVDLPVFENLDDLYRITRWRGYYGGIRIIQALIVRLVDYCREHDIELPDRNFTLEYESNVPQRLGLGGSSAIITASLRAICRFHSLDIPLPIQANIALETETRELNVPAGLQDRVVQAYQGLVYMDFAKSLMDARGYGEYENMNPGLLPNVYVAYRTSLSEGTEVFHSNLRERWLRGDTEVVQAMHTWAGYAAEGRACLMERNYDRLNQLVDANFDLRSKIYNIDPGNMEMVQTARAAGATANFAGSGGAIVGTYTDDTMLARLTEKMKGIGIAVIKPKIVS

SEQ ID NO: 60842 - protein, 357 aa, delta proteobacterium MLMS-1
MEIKKQLLAPTERRSLPDEKEFGFGRIFSDHMLVMPYDADLGGWQEPVIKPYENFSLDPAAMVLHYGQAIFEGLKAYRGREHRICLFRPQANLERMNRSAARMCMPPLPLDIAMECLRELVRTDAAWVPDGDQGATLYIRPTMVATEAGLGVRPARQYLFYIILSPVGAYYPEGFNPVRIYVTDTHVRAVPGGVGEAKTAGNYAASIMAAVEAQKLGFTQVLWLDACHRHYVEEVGTMNIFFVLNDCVITPPLTGSILPGITRESVLELLRDWGLRVEERQITIDEVFTANRQGELQEVFGTGTAAVISPVGSLHYQGRDCEINQGQTGKLSRRLFDELTAIQYGHKPDPHGWVTTL

SEQ ID NO: 60843 - protein, 212 aa, Vibrio parahaemolyticus
MQEYNNQDYKQPLRIGVGGPVGSGKTALLEILCKTIRDKYQIAVVTNDIYTQEDAKILTRAQALDADRIIGVETGGCPHTAIREDASMNLAAVEELAKRHKNLDLVFVESGGDNLSATFSPELADLTIYVIDVAEGEKIPRKGGPGITRSDLLVINKIDLAPYVGASLDVMEADTARMRPEKPYVFTNLKEGIGLQKIIDFIVDKGMLPKVD

SEQ ID NO: 60844 - protein, 392 aa, Legionella pneumophila subsp. pneumophila str. Philadelphia 1
MDIALAKRVQKVKPSPTLAVAAKAAQMKAQGLDIIGLGTGEPDFDTPQHIKLAAISAIEAGDTKYTAVDGIVELKEAVKNKFKRDNELDYQLNQILVSVGGKQSCYNLCQAYLNPGDEVIIPAPYWVSYPDMVLLADGVPVIIETTPAQRYKINAQQLEQAITPKTRMIFLNSPSNPSGIAYTQNELKELGDVLKKHPQILIATDDMYEHIIWSQPFTNILNACPELYDRTIVLNGVSKAYAMTGWRIGYAAGPAPLINAMKTIQSQSTSNPCSIAQRAAVAALNGSNESIEEMVNAFHQRHDYVADRLQSIDGIEVIPADGTFYIFPSVQAIIEKRGYANDIEFSEKLLNEVGVALVPGSAFGTEGCIRISFATGIDTLKDALNRLQRFCS

SEQ ID NO: 60845 - protein, 644 aa, Streptomyces coelicolor A3(2)
MCGIAGTYHWPDGKAVTDRLTDVLAHRGPDGAGRYSHPAGEGEVHLGHRRLAVVDLSTTGAQPMVSEGLALSYNGELYNAPELRTELESAGVRFRGTSDTEVVLEAWRRWGTDCLPQLRGMFAFAVFDERTGELVLARDQLGIKPLFLLRRGAGLVFASELKALATATGGKLEVDHAALVASLLYYWVPDSRCALREAEKLPPGSWLRCRPDGRVERGRFWNLRDVAAEGRERARSGERPDLAAVVEESTRRHLLSDVPVATFLSGGLDSSYLTALAARDRPGISAYTIGFRAEDARFEAMPDDLRYARQVAERFGVDLHEIEIAPNVLDLLPRMTYHLDEPIGDPAAINTFLICSAAREAGVKVMLSGMGADELFAGYRKHLANVLALRYQRVPRPLRRGVSAAVGRLPVASSRRGYRSVRFAKRFLSFADLPQETAFRRSYTMYDRQELLDLIDPDLAGTVEDVLTEHADVYEDNDLDDFVNRMCLADARMFLPGLNLAYTDRSSMAASTEVRVPYVDVEVVKAAFAVPGDRKIVGRQGKAVLKEAATSVLPREIVYRPKGLFSAPLRAWMSRDLAPLVREVVNDGELVRSGFLRRDALRRLVAEDAAGQRDFSKHLWHVLTLEYWYRGATSGSGDHSSSTA

SEQ ID NO: 60846 - protein, 345 aa, Yarrowia lipolytica CLIB122
MTSFFVSTFNCGKLTQDTQYYQHLSAELAGIDAPHVLLFGYQELCSIPDGCLGYAVDPLNDLIQQVLKAIRDQPWLERYVVVGQHTFGAMGLVAIASADVLVTDVKLCHVACGMFWSSLKGAVGLRLNVDGNPVVCVAAHLAANEGFLEQRNDDFATIAKEMKFLDPRTGIYDDATVFFLGDLNYRASENEQGLADYKVVDELFYAMRSLDAFWDFQEAEIGFKPTYKFHTGTSEYNTKRIPSWCDRVLYRGAVVPRKYDSIPAVMSSDHKPVYLWASVKLTQSTAVEQGDVPPHILSAAHVSELLHIRTSIMDYIIALGLLGFTTRMGWISIAGFLLFAWALYR

SEQ ID NO: 60847 - protein, 312 aa, Frankia sp. EAN1pec
MAEAPERRRWSAADVPDLNGRTAVVTGANSGIGFEAAKLLAGRGATVVMACRNPVKAQDALDTIRIAVPEADVSVLQMDLSSLTSVRKAADALVTERPVIDLLINNAGVMLLPQGKTEDGFEQHFGINHLGHFAFTGLVLEAVTASDAGRIVTVSSNGHRMGKIDFDDLDLAQKYRPFRAYARSKLANLLFTYELQRRLTAAGGSARSVAAHPGGANTEVGGNPSPVQRKLKKVVDHIPNPIVHSAFKGSLPLLRAAVDPSTRGGEYYGPSGLLKMTGHPVLVTSNAASRDTGTAERLWELSERLTMVTYPL

SEQ ID NO: 60848 - protein, 186 aa, Oryza sativa (japonica cultivar-group)
MADRLELQGRHGKSRVRVSRVWRRPAAAGGHVIVEWNVAVSVVSDCLPSYTSDDNSAIVATDSIKNTVYVKAKECTEIVSMEEFAVILGRHFTSLYPQVSEATVTIAERPWERVVVDGKPHSHGFKLGVEKHVTEVIVKKSGNLLINSGIQGYSLLKTTQVFLPDANLSHWGCLGSLVKTVYVLYF

SEQ ID NO: 60849 - protein, 164 aa, Cucurbita pepo
DRGEMMSMVYNWPADQVDVIVVTDGSRILGLGDLGVHGIGIAIGKLDLYVAAAGINPQRVLPVMIDVGTNNEKLLKDPLYLGLQQNRLDGDEYLAIIDEFMEAVFTRWPHVIVQFEDFQSKWAFKLLQRYRNTYRMFNDDVQGTAGVAIAGLLGAVRAQGRPMI

SEQ ID NO: 60850 - protein, 335 aa, Campylobacter lari RM2100
MKSLILAIESSCDDSSIAIIDKNTYECKFHKKISQEQEHSQYGGVVPELAARLHTQALPNILSQCEKYFNNLCAIAVTNEPGLSVSLIGGVAMAKILAISLNLPLIAINHLKGHIYSMFLGKKACFDMGVLLVSGGHTMVLFIDNQGQITEIARTNDDSFGESFDKVAKMMNLGYPGGVIIENLAKNAKESNLEFSIPLLHSKELAYSFSGLKNQVRLEILKEELTQSRKNQIAFAFQKTAIAHIMNKLEKIFKEYKFKRFGIVGGASANLSLRSQIEHLCQSYQCELLLAPLEYCSDNALMIARAACEAYERKEFVSIEDDLISPKVKNLQGVL

SEQ ID NO: 60851 - protein, 325 aa, Shewanella sp. MR-7
MVDQSQLRQWGCKVIDIEKSALDNLYQYVDSVEFAQACELILNCTGKVIVMGMGKSGHIGNKISATLASTGTPAFFVHPGEASHGDLGVLSDNDVILAISNSGESSEILALMPVIQRKAIPVIAMTGKPESTMARLSKIHLCIEVPEEACPLGLAPTSSTTATLVMGDAIAIALLQAKGFTREDFAMSHPGGALGRKLLLKVSNVMHSGDDLPLVKHDICITEALYEISKKGLGMTAVIDEQNKLVGIFTDGDLRRVIDAQVNLRTTPIADVMTRNCVTITENVLAAQALQVMDSKNINGLIVIDKEHHPVGALNMLDMVKAGVI

SEQ ID NO: 60852 - protein, 162 aa, Bradyrhizobium sp. BTAi1
MKLLEHLDIKTTQWEVASVYEKFEQVVVLILTGLIIVVIASAVWHLAIKILFGLVLASFDPTDPAVFQTVFGMMFTVIIALEFKHSILIMVKREQSVVQVRTVVLIAMLAVIRKFIIIDLSSATANQMFALAAGVIALGAVYWLVRDQDRKAEIAERERPAT

SEQ ID NO: 60853 - protein, 549 aa, Escherichia coli
MKNINPTQTAAWQALQKHFDEMKDVTIADLFAKDGDRFSKFSATFDDQMLVDYSKNRITEETLAKLQDLAKECDLAGAIKSMFSGEKINRTENRAVLHVALRNRSNTPILVDGKDVMPEVNAVLEKMKTFSEAIISGEWKGYTGKAITDVVNIGIGGSDLGPYMVTEALRPYKNHLNMHFVSNVDGTHIAEVLKKVNPETTLFLVASKTFTTQETMTNAHSARDWFLKAAGDEKHVAKHFAALSTNAKAVGEFGIDTANMFEFWDWVGGRYSLWSAIGLSIVLSIGFDNFVELLSGAHAMDKHFSTTPAEKNLPVLVALIGIWYNNFFGAETEAILPYDQYMHRFAAYFQQGNMESNGKYVDRNGNVVDYQTGPIIWGEPGTNGQHAFYQLIHQGTKMVPCDFIAPAITHNPLSDHHQKLLSNFFAQTEALAFGKSREVVEQEYRDQGKDPATLDYVVPFKVFEGNRPTNSILLREITPFSLGALIALYEHKIFTQGVILNIFTFDQWGVELGKQLANRILPELKDDKEISSHDSSTNGLINRYKAWRG

SEQ ID NO: 60854 - protein, 411 aa, Methanothermobacter thermautotrophicus str. Delta H
MMVIPVSFKFKTMDDIEVTGKTVLVRVDINSPVDPNDGTILDDTRMRLHAETIRELSDRGARTVVMAHQSRPGKNDFTTLEQHARALSGILRRPVKYVEDIFGSAARENISGLGDGEIILLENVRFYSEEVLKRDPEEQAETHLVRKLAPLLDYFINDAFAAAHRSQPSLVGFALRVPSAAGRVMERELRTLQGALENVERPCVYVLGGVKVDDSIMVMKNVLENGSADLVLTTGLVANIFLAGCGVKIGKVNMDFIKSRGYCDFIKVAKKLKKRFPERIVVPVDVAVCRDGKRVDVPVKKIPNHPIQDIGMETIKLYARRIREARTLFANGPAGVFENPDFSIGTEDILNAISSSEGFSIIGGGHLAAAAVKMGFEDSINHISSGGGASISLLAGEELPAVRVLEESRHP

SEQ ID NO: 60855 - protein, 508 aa, Oryza sativa (japonica cultivar-group)
MQMQQRRKPPPAAAPVAAKQPSPRRTPGPLSFAGALLSLLVVATFLYINDHGNMMPPHASPDPDLRLLQEAAHQKVNSILLSRHAPAPPPRTNTNTSSSDQHLRLINIPMSSDLDLELGGNSTSSSGVEIQFEQQQQQEEKNLRGCELYKGRWVYDAAGREAPLYRESECGFLTEQVTCMRNGRRDDSYQRWRWQPEGCDLPSFDARALLERLRNKRMMFVGDSLNRNQWESMVCLVQSAIPYGQKTLTKFVNNGSLNVFRAHEYNATVEFYWAPFLVQSNSDDPQVHSVRDRVIAWRSIAKHAANWKGVHYLVFNTYIWWLNNFQIKVLKSRGAPFAGSGGWSSRYALVDRAIAYREVLKTWAKWVDRRIDPNKTHVFFMAMSPNHFMPEAWGGSAGAVKCAMETQPIVNRTSGGLDIGTDWRLHGVARGVLRSMRRVGVRFVDITALSELRKDAHTSVHTLRQGKLLTPEQQADPRTYADCIHWCLPGLPDTWNHFLYAHIVAHAA

SEQ ID NO: 60856 - protein, 415 aa, Solibacter usitatus Ellin6076
MRKLLSRFRYHLVVFFAVLGPGFITAVVDNDSGGIFTYSAAGARFGYLPLWTLLPITIVLIITQEMCSRMGAVTGKGLSDLIREEFGLRITFLLMGVLVLANMTNVMAEFAGVASSLELFHISRYISVPLAAIAVWFVVVKGNYQSVEKIFLFACVFYVTYVISGFLVKPDWKEAAINSVKPVLMLEPGYIYMLIGMVGTTIAPWMQFYLQAAVVEKGITAKEYKQSRVEVVVGCIMTSVIAFFIIVACAGAIYTVRPRDIQDASEAALGLKPFGEYAFLLFSAGLFNASIFAACILPLSTAYSVCEGLGFEAGVNKRMKEAPIFYGLYTLLIAVGAGVILIPKFPLVQMILLSQVLNGILLPFVLIFMVLLINKHELMGEWTNSRAANLVSWITVVIMIGLTLALVGITVRGMH

SEQ ID NO: 60857 - protein, 469 aa, Solibacter usitatus Ellin6076
MSPISIEICSPATGELLGKVPDFDAEAVDCAVAAARASFENKTWRGLDPSKRERILWNIGELLLKYRDELSRLISQETGKTLREAAGADVAPAADCFHYYAGWVRKQYGETIPVDGPYLNYTLREPVGVVGAIVPWNFPLQTAAWKVAPALACGCSVVLKPSELTPLSALRFGEICAEAGLPAGVLVVATGYGETTGEALALHEDVDKISFTGSVTTARKLLQNSAVSNLKRLSLELGGKSPNIVFPDADFDAAVRAALWGIYGNKGEMCTAGSRLLLHEEIHDRFVEELASKARKLRLGNPLDPATQMGPQISGRQLDRILDYIEAGKTEGARLVCGGERDTEGDKAHGFFVKPTIFAGVHPDMRIAREEIFGPVLSVMRFRDAEEAVRIANATTYGLASAVWTNDLKLAHRMAAALKAGSVWVNTYNAFDSGSPFGGYKQSGFGRDLGSYALDQYTNVKSVWIALGK

SEQ ID NO: 60858 - protein, 502 aa, Rhodococcus sp. RHA1
MTVLDTAPHTLQFVPVADRILVAGQWRQANGPAFAVTDPSTGETLQVIHQATADDADEAVRKGRAAADDPAWRALLPHQRAKYLHRIADAIEANTSRLALLQSYNTGKTVAETTALVGSAAGTFRYFAAVLETADDDLTTPRGNFLTMSVLEPIGVVGAIAPWNSPVASDAQKIAPALAAGNAVVLKPAEWTPLVSLELARLIDQTQLPAGLLSVLPGKGSVVGDAIVTHPGVGKVTFTGGTNTGRSIAHAAADKLMPVSLELGGKSPTIVLDDADLDAAVNGVMYGIFSSTGQSCIAGSRLFVDRRIYDEFLEKLVAKTQQLRLGPGRDPGTQVGPMVHRKHRDSVAAYVDLAREEGGRVLCGGAIPDDERLRDGAYYLPTIIDGLANSSRTCQEEIFGPVLVVLPFDGDADLVAQANDSVFGLASGIWTGDYRRAWKLARRLQAGTVWINTYKQFSISTPFGGVKESGLGVEKGRSGIAAYSRQKSIYWGLDEEPNPWAE

SEQ ID NO: 60859 - protein, 476 aa, Mycobacterium bovis AF2122/97
MVLRSLASPAALTDPKRCASVVGVAAFAVRREHAPDALGGPPGLPAPRGFRAAFAAAYAVAYLAGGERRMLRLIRRYGPIMTMPILSLGDVAIVSDSALAKEVFTAPTDVLLGGEGVGPAAAIYGSGSMFVQEEPQHLRRRKLLTPPLHGAALDRYVPIIENSTRAAMHTWPVDRPFAMLTVARSLMLDVIVKVIFGVDDPEEVRRLGRPFERLLNLGVSEQLTVRYALRRLGALRVWPARARANTEIDDVVMALIAQRRADPRLGERHDVLSLLVSARGESGEQLSDSEIRDDLITLVLAGHETTATTLAWAFDLLLHHPDALRRVRAEAVGGGEAFTTAVINETLRVRPPAPLTARVAAQPLTIGGYRVEAGTRIVVHIIAINRSAEVYEHPHEFRPERFLGTRPQTYAWVPFGGGVKRCLGANFSMRELITVLHVLLREGEFTAVDDEPERIVRRSIMLVPRRGTRVRFRPAR

SEQ ID NO: 60860 - protein, 744 aa, Erythrobacter sp. NAP1
MTNASPVSVPPSAVGVAHADKLQEERFPPFLRVTVRRWTKWYLEGTETFWPFSDVVVRFFIGMWFLRSGLVKVADWETALYLAANEYPVSWMSPANAAMTGLAIELIGPILLIAGFFTRPAALAMAALTIVSQAVYIPTTTNLIVSAMLVWYVFHGPGALSMDRVLASGFKASALPFARPTVNAWEFSREHIAPVVMAAIRVWFAVTLLVAAGLFEPPIVVQTWLPISIFSGFPAWLSILWAAFFFTGFGAVIVSYALFFLIAFFMIAGAHPNITLFPFLFLAIYEAKGAGWLSVDRAILKWLEKNILFDRDYAEIPDRWPHVVVVGAGFGGLAAVERLKRLPVRITLIDKRNYHLFQPLLYQIATATLNPADIATPIRSLFKADGNVRVIKGEVKGVDKEARTITYCTSETDHEQHLTFDKLVLATGATHSYFGKDEWGPYAPGLKTIEDGVAVRASILNAFEEAEASGDPERIKRLLTFVIVGAGPTGVELAGAIAELARVSVEREFRTCDPSTAQVILVQSGDRVLPAFPEELSTEAMASLEKLGVEVRLGGRVTEIAERHVRIGEDTVIETETVLWAAGVAASPAAKWLDAKADRAGRIEVNHNLRVLRPNGAAIEDVFAIGDTAGSMAWDGKPVPGLAPAAKQAGVHVSRVIEAELLGKPCPGPFAYKHQGSLATIGRKSAVADFGLFKLSGALAWWLWGLVHVGFLTGARNRVTVTVNWAWSFFAKHSGVRLITEKQV

SEQ ID NO: 60861 - protein, 176 aa, Cucurbita pepo
RVGLSGKGIPVGKLSLYTALGGVRPSACLPITIDVGTNNEKLLNDEFYIGLKQRRATGEEYYELLHEFMTAVKQNYGEKVLIQFEDFANHNAFELLAKYRTTHLVFNDDIQGTASVVLAGAVSALKLIGGTLADHTFLFLGAGEAGTGIAELIALEISKQTNAQLRRPARRFGWWT

SEQ ID NO: 60862 - protein, 759 aa, Aspergillus nidulans FGSC A4
MGSVETIPTVDISAWLDPSSAEEDRQNVVNAMRHACTTYGFLSLVGHGVSLEEQKQAMDCAKLFFTLSEEEKMDVWIGKSKGRSFRGYEPPGIQVHQEGLLPDTKECFIIGHEVPEDHPDSGTFSTGPNLWPKSLPEDQFRIPIMKYQARMVQLVKVLLKILARGLPSEWNCPPDALDALAENEPSIPMRLLHYAPQPVRDERQFGVGDHTDFGCITILLQEMGTEGLEVWYPPTETWIPVPPQENAYVINIGDMIQKFTGGYYRSARHRVITFTEKHRYSVPFFLNGQLKLKCTALDGSGVETIVGEHIRGRLIETMGKTDRIDDLALSSSLSVTWTMFLTGNDDLATALQAANSDPNDIDTCIQYEITFEGSIMIGSRSNISQPKCDKYRNVQLDTLSGLNRVVAVFHGEQFSSLPLTIVKWEGLSNVLSQRDSLAKNESHTTTPEPGLLFAFGSEALTYRWPTGPFLEGLQRVCLDANVKRCSNEDCYAMKAKAKNAPTCNWASFREWALTILTCRLAPSKTKSDNSTAITMALNFTNFALQSRKEPLTELESEIYDVLSWLAQVDQVQSIDIRRNLPDNAVFEALGTARSLGICENRLWNLIAQVWSSFINVSANDVTCFNSLCTRLGATVALGLGGLVITALGHICVPAVPYIAISHVWSDGTGAGVQKEGFVNRCLFYFKEAVRELGCEAIWWATISIPREPAARRKAIRRMDNDFESAKCTLMHDQYLVDVPWAEDGSPCLALLLSPWFTRV

SEQ ID NO: 60863 - protein, 123 aa, Streptomyces coelicolor A3(2)
MSIDKPEVDFPGGEPPADLEIKDIWEGDGPVAEAGQTVTVHYVGVTFSTGEEFDASWNRGAPFRFPLGGGRVIKGWDQGVQGMKVGGRRQLTIPAHLAYGDQSPAPAIPPGSTLIFVVDLLGV

SEQ ID NO: 60864 - protein, 82 aa, Zea mays
  misc_feature (41)..(41): Xaa can be any naturally occurring amino acid
MKAGRKNLRRACDEGAAVTLAEGESIMQVLTLRGSNVIEGXFVVVDASGRDQALESGSKIACVVSRVLFHEQVRALQKSGNW

SEQ ID NO: 60865 - protein, 322 aa, Marinobacter sp. ELB17
MSNKLEQLKTMTTVVADTGDLDAIAAWRPQDATTNPSLLLKAVESDAYQPMVDKAIAAAKRQAGASSGRPGLATDILAVLAGGEILRLIPGVVSTEVDARLSFDTIGTLSRARRMVALYDQQGIDTQRVLVKIAATWEGIKAAEQLEKEGIRCNLTLLFSFAQAVACAQAGVTLISPFVGRIMDWHLADSGRDSFPASEDPGVLSVARIYNYYKTNDFNTAVMGASFRNIGQIEMLAGCDRLTISPALMQALQNETGLLECKLSPEGARSKDKRSHMDEKQFRWDSNNDAMATEKLADGIRLFAADQLKLEARIRQRAEAAK

SEQ ID NO: 60866 - protein, 399 aa, Erythrobacter sp. NAP1
MADSKDTNKETREFDIIVYGATGYTGRLVAEYLNSHYGNSDNAPKWAMAGRNQAKLEDVRTLIGAPDDTPLVVADADSREAMEAMAKRTKVVLTTVGPYQLYGDELVAACARVGTDYADLCGEPAWMADKIKELHDVAKESGARITFSSGFDSIPFDLGVMMTQKAAHDRWGAPSSRIKGRVRAMAGTFSGGTAASLGATMKAAAKNPSIFKTLANPFALTGDFEGPSQPSGMVPTYESGLGKWAAPFVMAPINTKNVHRTNYLLGHPYGEDFKYDEMMLTSPGDAGKQMAEAAVQMMKNPFGAKPPKPGEGPTAEEREKGFYDVVFVAEGPNDETLNFGVKGKYDPGYGSTSRMLAETGIALLSCDAEGGVGTPGAFLGEALVDRLQEHAEISFTLES

SEQ ID NO: 60867 - protein, 214 aa, Zea mays
MAAAASAITAVSGVVLPQTFLSHRLPPPQVLAVASSFRRLSLCASPHRITHIIPRADASAEAGEPEPATASAESEEEVAEGSVAVAEAEEPTPPSKPKVKFGEIIGILNKQFIEEAEKVKTVPDLRPGDIIELRMQRPNKRRLSLFKGIIIAKHKAGVHTTIRVRRIIAGVGVEITFPVYSPRIKEITVIRHKKVRRAKLYYLKDKLPRFSTFK

SEQ ID NO: 60868 - protein, 157 aa, Glycine max
LKRNIRFILSLIQSSSLREEAMARTKQTARKSTGGKAPRKQLATKAARKSAPTTGGVKKPHRYRPGTVALREIRKYQKSTELLIRKLPFQRLVREIAQDFKTDLRFQSHAVLALQEAAEAYLVGLFEDTNLCAIHAKRVTIMPKDIQLARRIRGERA

SEQ ID NO: 60869 - protein, 706 aa, Nocardia farcinica IFM 10152
MVQPDHSPSDVTPLGVWPGNAYPLGATYDGAGTNFSLFSEVAEAVDLCLIDRDGAETRVRLDEVDGYVWHAYLPTIGPGQRYGFRVHGPYDPERGLRCDPSKLLLDPYGKAFDGDFDDDPSLYTFGLDSLGHTMTGVVINPFFDWGADRAPNRPYHETVIYEAHVKGMTMTHPDVPEELRGTYAGIAHPAVVEHLKSLGITAIELMPVHQFLHDRVLLDQGLRNYWGYNSFGYLAPHNGYAASPRGGAAVTEFKAMVRALHAEGIEVILDVVYNHTAEGNHLGPTIAFRGIDNAAYYRLVEDDPSKYMDYTGTGNSLNVRHPHTLQLIMDSLRYWILDMHVDGFRFDLAATLARELHDVDRLSTFFDLVQQDPVVSQVKLIAEPWDVGEGGYQVGNFPGLWTEWNGKYRDTVRDYWRGEPATLGEFASRLTGSSDLYEATGRRPSASINFITAHDGFTLRDLVSYNEKHNEANGEDNRDGESHNRSWNCGVEGPTDDPEILALRAKQSRNLLATLILSQGTPMLAHGDEMGRTQQGNNNVYCQDSPLSWMDWSLAETNADLLEFTRRVIGLRTEHPVFRRRRFLAGRPIRSAGAARDIAWLTPGGEEMTPADWDSGFGKSLAVYLNGQGIPEPGPRGERITDDSFLLCFNAHHDPMDFVLPGPGYGGPWLVALDCSAPDGRAEAQYDAAATVTVPARCLLVLRCPE

SEQ ID NO: 60870 - protein, 427 aa, Nocardia farcinica IFM 10152
MALTPDQITAIDAAHVWHPYGGFPATTEPLVVASASGVRLTLADGRELVDGMSSWWAAVHGYRHPVLDAALVAQSQRMSHVMFGGLTHEPAARLTELLVQLTPEGLDKVFLCDSGSVSVEVAVKMCLQYWRSLGKPGKRRLLTWRGGYHGDTFTPMSVCDPEGGMHALWTDVLAEQVFVGMPPAEYRPGYVAELEAALAAHADELAAVVVEPVVQGAGGMRFHDPRYLADLRRLCDAHDVLLVFDEIATGFGRTGELFAAEHAGVRPDVMCVGKALTGGYLTLAAALCTTRIAETISAAHGGLMHGPTFMGNPLACAVAVASVELLLARDWRGEVRGIEDGLRAGLAPVRDLPGVVDVRVLGAIGVVELDRPVDMRAATAAAVAAGVWLRPFRNLVYTMPPFISTAADVAAITRGIAAAVAAGDVPS

SEQ ID NO: 60871 - protein, 792 aa, Streptococcus pyogenes MGAS10394
MKTKKVIILVGLLLSSQLTLISCQSRGYGTYPIKTKQSRKGMTSNKIKPIKKSKKTNKTHKGVAGVDFPTDDGFILTKDSKILSKTDQGIVVDHDGHSHFIFYADLKGSLFEYLIPKGASLAKPAVAQQAASQGTSKVADPHHHYEFNPADIVAEDALGYTIRHDDHFHYILKSSLSGQTQAQAKQVATRLPQTSSPVSTATANGIPGLHFPTSDGFQFNGQGIVGVTKDSILVDHDGHLHPISFADLRQGGWAHVADQYDPAKKAEKPAETHHTPELSEREKEYQEKLAYLAEKLGIDPSTIKRVETQDGKLGLEYPHHDHAHVLMLSDIEIGKDIPDPHAIEHARELEKHKVGMDTLRALGFDEEVILDIVRTHDAPTPFPSNEKDPNKMKDWLATVIKLDLGSRKDPLQRKGLSLLPNLEILGLGFTPIKDISPVLQFKKLKQLLMTKTGVTDYRFLDNMPQLEGIDISQNNLKDISFLSKYKNLTLVAAADNSIEDIKPLGQLPNLKFLVLSNNKISDLSPLASLHQLQELHIDNNQITDLSPVSHKESLTVVDLSRNADVDLATLQAPKLETLMVNDTKVSHLDFLKNNPNLSSLSINRAQLQSLEGIEASSVIVRVEAEGNQIKSLVLKDKQGSLTFLDVTGNQLTSLEGVNNFTALDILSVSKNQLTNVNLSKPNKTVTNIDISHNNIPLADLKLNEQHIPEAIAKNFPAVYEGSMVGNGTAEEKAAMATKAKESAQEAPESHDYNHNHTYEDEEGHAHEHRDKDDHDYEHEDENEAKDEQNHAD

SEQ ID NO: 60872 - protein, 325 aa, Xylella fastidiosa 9a5c
MALASTSCQAAGSPGVEHRTQAFLEDLAKGGGAPIETLSPANARQVLVNAQKGAKLPPADVSDKTITIDGKQIVLNIVRPAGVKGILPGFIFVHGGGWVLGDFQTHERLVRDLVSDSGAVAIFVNYTPSPEARYPVAINEIYAATQWVAEHGAQINVDGQRLAIVGNSVGGNMATVVAQMAKEKGTPALRAQVLFWPVTDTNFENTSYNEFANGHFLTKNMMKWFWDAYTTDSKQRQDIYASPLLATSEQLKGLPPTLIQTAEKDVLRDEGEAYGRKLDGAGVDVVVTRYNGMIHDFGLLNVLADLPATRAALHQASEELKVHLR

SEQ ID NO: 60873 - protein, 363 aa, Shewanella oneidensis MR-1
MEIKYDLKPASERRTEQFKPEGNVGFGSLRTDHMFLMDYHDGEWRDPRIVPYGPFEMAPGAMALHYGQSIFEGAKAFMHEDGEIYTFRINKNAERMNRSADIVCIPNIDEQMQIDAINALIDVDRLWFPMQEGACLYIRPFIFATEDRLSVSPSSRYTFCVVLSPSGAYYAAGVNKGIRLLISKTYHRAVSGGTGASKAAGNYAASLRAGKAAAQFGASQVLYLDANNQQIEEAGAMNHFHILKDGTVIIPTFTDTILKSITSQSIMELSELLGCEVRQETVMLDKFIADIESGEIIEAGGFGTAAVVSAVGSYIFEDGRVVTVGNGEVGEHIQRIYKLYTDIQKGHVQGPEGWVKRVERVAP

SEQ ID NO: 60874 - protein, 441 aa, Streptomyces coelicolor A3(2)
MNAEELGLPRSRQANERLHALVPGGAHTYAKGDDQYPENLAPVISHGRGAHVWDVDGNRYVEYGSGLRSVSLGHAHPRVTEAVRRELDRGSNFVRPSIVEVDAAERFLATVPTAEMVKFAKNGSDATTAAVRLARAATGRPRVAVCADHPFFSVDDWFIGTTPMSAGIPAATNELTVAFPYGDLAATEDLLARHEGEVACLILEPATHTEPPPGYLAGLRELADRHGCVLVFDEMITGFRWSEAGAQGLYGVVPDLSTFGKALGNGFAVAALAGRRELMELGGLRHSGDRVFLLSTTHGAETHALAAAMAVQGTYVEEGVTARLHALGDRLAAGVREAAASMGVGDHVVVRGRASNLVFATLDENGQPSQRYRTLFLRQLLAGGVLAPSFVVSSALGDADLDHTVDVVAEACAVYRKALDAADPTPWMAGRPVKPVFRRLV

SEQ ID NO: 60875 - protein, 436 aa, Streptococcus thermophilus CNRZ1066
MYRVFKEYFDIVNNVKYDVNDMPKVGLLVGLSFQHLFAMFGATVLVPILVGIDPAIALFSSGLGTLAHLTVTKYKIPAYMGSSFAYIAAMQMLMKTDGIGAVAQGAMAGGLVYLIVALVVKYVGNAWIDRVLPPIVVGPIIIVIGLSLAANAVKDATMVNDTYSIFSLVISMVTLFSVILFNMYGKKIIGVIPILLGLIVGYIFSVVLGWLTGHEFVQFSKVAAAHWFQVPSFDIPFVNYDFKLYPSAILTMAPIAFVTMTEHFGHVMVLNSLTGRDYFKDPGLDRTLTGDGLAQIIAGFFGAPPVTSYGENIGVMALSKVYSVYVIAGAAVIAVLMSFIGKVSALLSSIPTAVLGGISIALFGVIAASGLKILVEHKIDFDNKKNILIASVILVSGIGGLMIDLGGFQITGVASSTILGILLYQILPDPNKGSKN

SEQ ID NO: 60876 - protein, 300 aa, Arabidopsis thaliana
MADEQVVLPVLWTCCNSQQESHNNETNQYEVGSSEIPVFGTQRCQESHEKRYASRVAIARKKWAAKEDIVLISAWLNTSKDPVVGNEQKAPAFWKRIASYVAASPDLDGVPKRASAQCKQRWAKMNELVMKFVGCYATTTNQKASGQTENDVMLFANELFKNDMKKKFSLDHAWRLLRHDQKWLISNAPKGKGIAKRRKVRVGTQAASSQPIDLEDDDVMRRPPGVKAAKAKAKMTPTVKGEEVNSVEHLTSLWDLKEKDWDRKDKQSKNQMLESLLSRTEPLSECDLVLKKKLIEELFS

SEQ ID NO: 60877 - protein, 1169 aa, Arabidopsis thaliana
MNSFPNDDLVYEILLRLPAKSVARCSCVSKLRRSILSRQDFTELFLTKSSARPRLLFGVKRANGEGLFFSSTQPRNSYEKSSLVVAADFHTKFSEVISREICSYASGLIYLSDMRISVNDEDVVRAICNPITGNYLGFDPIDKQFKVLFMAYPSGPDDHKILTLGTRRMRWRKIHCPLTHDPFCEGICINGVLYYLAIQIDEPLGKLGGIDWKHGNANGSRTFELSMWVLEDVEKHEWSKYDCTFLEYEVMFYNISLAVGMTATCEIVLSEKFASKSFYVFYFNPERETLQRVEIQGLENHCRVYTITDHVEDLNVNDAKQLNVRQIKPKEEEAETHILKMGKVGVINLTHAYERVFPLQLRMTVLEDFEKQEWSTYVYTLMAENIVVKYVSVVGMTATGDIVLVKTNACKPFYVFYFNPGRNTLLSVEIQGVGEDHKCLNFHTVCAFVDHAAKKILVALDQKRKATSAPKVFLAVKSEKNPEEEVEIHCATETVANILVNEFDEPILGVELLLLSLASESLGKSSLVVAADFHMKFSKDISPNSCSYASSLIYFPIIQISKEWDDEVRAICNPSTRQYAILPPDLRTTYQNFGPLLGFDPIGKQFKVLVFNCRVGNELVYHILTLGTENVRWREIICPFTYEPRWKRSICINGILYYLAVNSNVSSSVINYKLINYKGKLGLVDLEKDYDAGYLLGLRTLSEVLKSKVLEKRKNGLTIIQFINYFVDHVEDLRFDGMKTTYVAPSLSPPEQSTSSSSEDPCSLGTRSFRSSEENTDSIPIDLILDILSRLPSKSIARCRCVSKLWESMIRQSYFTELFLTRSSSRPHLLIAVEQEGEWKFFSLPQPKNYLGKSSLVVAANLHLKFFEDKRPQHGCSYASSLIYFPNMTIRKKGDDHLGVICNPSTGQYGYVILPPLLDFKSVPYGKFLGFDPIDKQFKVLIPIFDFDKHQTDHHILTLGAETVGWRKIQSPLRYLPHSNGTICINGILYYLAKINYAMDKNVLVCFDVRSENFVFLRLNTYCSSTKLVNYKGKLGMINQEYVDDGGFPLKLSVWVLEDVGKEEWSTYVYTLRDDNKVDQVKYNLSVVGVTASGEIVLVKKTQTLKPFYVLYFNPDKNTLLTVEVKGLHRGLYAVHRIYAFVDHVEDLEFNIMKTTYAAKSKFSQEDRF

SEQ ID NO: 60878 - protein, 922 aa, Candidatus Kuenenia stuttgartiensis
MAPKYVYFFGEGKADGKADMKHLLGGKGANLAEMTNIGIPVPPGFTITTEVCDAYYKNKQQYPKGLDKEIAQNLSMLEKLMGAKLGDSNNPLLVSVRSGAAASMPGMMDTVLNLGLNPETVMGLIKKTGNERFTWDAYRRFISMFGDVVMGIERHYFEEILDKYKKKSRVKNDTDLTTEQLKNIVEEYKEIYKKNAREPFPNNPAEQLHRAIQAVFASWNNPRAIKYRQLYEIKGLIGTAVNVQAMVFGNMGDHSATGVCFTRNPSTGENKFYGEFLINAQGEDVVAGIRTPEPIANLEKEMPAVYKQLFKYKNILEKHFKDVQDIEFTIQENRLFMLQTRNGKRTAPAAIKIAVDMVKEKLIDKKTAISRIDPNQLDQLLHPTFDPKAKREVIAEGLPASPGAATGRVVFSAEQAERLAEKNEQVILVRKETSPEDIGGMHVSQGILTTSGGMTSHAAVVARGMGKCCIAGCSAIHVDYKKQLFKVDGKVIREGTFISLDGSSGEVMMGNVATLVPKLSDDFATLMTWADEIRKLKVRTNADTKIDARKAREFGAEGIGLCRTEHMFFGENRIDFVRQMILSAPDVKNLKTKIAYIQKEISNAQNNKINVLKKDLARAQNEIKYPMTAYMSALKKLLPMQRRDFEQIFKEMDGLPVTIRLLDPPLHEFLPQEENNQREIAKRMKISFQEIQEKVSALHELNPMLGHRGCRLGITYPEIYEMQVQAIIEAACNMKKKGIIIYPEIMLPLISTEKELIILKELIQKNAKEIMEKKGVKVNYLIGTMIELPRAALIADNIARHAEFFSFGTNDLTQMTFGFSRDDVGSFVPEYIDNEILEKDPFQVLDQEGVGKLIQIGINGGRSTRKELKIGICGEHGGNPQTVSFCHGIGMDYVSCSPFRVPIARLAAAHAALEQPVSRATI

SEQ ID NO: 60879 - protein, 216 aa, Legionella pneumophila subsp. pneumophila str. Philadelphia 1
MSELKIKAAKAAIAYIEDDMVIGVGTGSTVNFFIKELAAIKHKIEACVASSKATEALLRAEGIPVIDLNSVQDLPIYVDGADEVNERGEMIKGGGGALTREKIVANVATQFICIVDESKVVKRLGEFPVAVEVIPMARSFVARQIVKLGGDPEYREGFVTDNGNIILDVFNLSFSTPMALEDSLNVIPGVVENGVFAKRLADKVLVASASGVNNLK

SEQ ID NO: 60880 - protein, 482 aa, Alkaliphilus metalliredigenes QYMF
MIKFTAFLRETIKEFIDEKHSLLNLIDGLGSPLNIIFPEEINQNIEEFKEVFNKHFVSGKVFYAHKTNKSNSIVRQASFEAVNIDVASENELKSALKNGFTGDRIEATGPKNRNFITLGLQHNIIFNIDNLQELDQVMELKKAIDFQNTKKVKILLRFSGFKSESIKVLSKNSKFGIPASGIYQALEKLSQYREDIHFWGFSFHVDTIDLKEKVIAIENCIDFFDIARDHDFEPRVLDIGGGFKVSYIEDAKEWNDSISYLKESILGYQEGVTWNNQTFGIQQEKGVLKGTLNIYNYHDNLTGPKYLDALLSTRLPKFENRTIGTILSENMIDLFIEPGKALVNQLGLSAAKVNFIKQSSDDEILIGLDLKRTDVVMGDQELFIDPIIIHRSKVTDLQEDKGVYFIGNLCLESDLIFKHKIFINQLPANGDIVIFPNTAGYFMDFNATDSIMQPIAKKVAVVKQKSEFKWFIDELYNPVNTH

SEQ ID NO: 60881 - protein, 523 aa, Zea mays
GSSKTSPLQTATRRTPRPAPLDRLAPTVPPRRAASSGTHLADRHMDPTAAPGSGGTPADSDATSPTNTTVTLPPLTLRDVPRLASSSPAAAAAAAVPNPISRHPYFHPPANFYISPGDVSLRHAFFDLVSAAPTPLVAYRRGGPRRDLAVDPAAARAALVTCGGLCPGLNTVLRELVVGLQELYGVRHVFGVAAGYRGFYGADEDHVRLHPAAVDDWHKKGGTVLKTTRGGFDLGKIVDGIVARGYTQIYAIGGDGTMRGALAIFEEFKRRGLNISITGIPKTVDNDIGIIDRSFGFQTAVEVAQQAIDAAHVEAVSAVNGAGIVKLMGRSTGHIALHATLSSRDVDCCLIPEVDFYLEGKGGLFEFLYERIKKKGHAVVVVAEGAGQELIPRTDDQKREQDESGNTVFLDVGPWLKSELGRWWKREHPDELFTVKYIDPTYMIRAVPANASDNLYCTLLAHSAIHGVMAGFTGFVPGPINGTYSYIPLEDVAVAKNPVDVNDHKWAWVRSVTNQPDFLKSQA

SEQ ID NO: 60882 - protein, 400 aa, Oryza sativa
LVWILGYEVKRPLLGPKDLPLCINKLPPMIDREPAGSSRHGSNMDPSINIPVNRDAITEEVAAAFAESEVIPERYCRPDEVHDGIVVGHDDDEAYELPVVDMEKLLDPELAEAEIAKLGSACQDWGFFQLVNHGVDEQVVNEMKDSTVKFFSLPLESKRTVEIQDNGFEGFGHHYRRASGKLDWAESVILLTQPIQERNPEMWPTNPSSFRDALDKYSAEMTKLAMRIASIMATDLGVDQEALVGAFRDKQQSMAIHHYPPCRHPDKVIGITPHSDGLGLTLLLQLDDTPGLQIRKDGRWLPVRPRPGTFIINVADILEVLTNGAYKSVEHRVLADAEKGRTTIVTFHEAYVDGMVKPIPEVLKLNGAEARYKSIERIEYIKGNFVALSEGTRFLESLKI

SEQ ID NO: 60883 - protein, 437 aa, Rhodococcus erythropolis
EFGRNTADLSDRENVQFHWIEVENVPEIWKRLEAVGLKTTEACGDCPRVVLGSPLAGESLDEVLDPTPAIDEIVRRYIGDPKYSNLPRKFKTAISGQQDVVHEINDIAFIGVNHPEHGPGLDLWVGGGLSTNPMLAQRVGAWIPLDEVPDVWEGVVSIFRDYGYRRLRAKARLKFLIKDWGIEKFREVLETEYLERPLIDGPAPEKPKRPIDHVGIQKTRNGHNAVGFAPIAGRVSGDILAQVADAAEKAGSDRIRFTPYQKLIILDVADETLEPLIADLDALGLPARPSHWRKNLMACSGIEFCKLSFAETRKRSQVLVPELEQRLADINSQLDVPITININGCPNSCARSQIADIGFKGQLVDDGEGNQVEGFQVHLGGSLGFDSAFGRKLRQHKVTSVEMGDYIDRVVRQFVKNRNEGERFAEWAVRADEGDLR

SEQ ID NO: 60884 - protein, 1125 aa, Oryza sativa (japonica cultivar-group)
MQMLMSVFVIIIGCDTAIDWITDIVIFIIKGVWRAKKNKISALRDASGTVHHLTNVMEQMATDYFKTLFSADPNLDHSRVTTLIQEKIGPLKAPGPDGFPARFFQRNWGLLKEEVVKAVKEFFNTGVMPAGVNETAIVLIPKVDQPIELRDYRPISLCNVLYKVVSKCLVNRLRPILDELISPNQSAFVPGRMITDNALIAFECFHSIQKNKKLSSATCAYKLDLSKAYDRVDWKFLEQSMYKLGFAHCWVNWIMSCITSVRYSVKFNGTLLSTFAPSRGLRQGDPLSPFLFLFVVDGLSLLLEERVAQGALSPVHICRRAPGISNLLFTDDTLLFFKATSEQANVVMNVLADYAWCTGQLINQEKCSIMFGEASPPDVQESVRSVLQVGSTSFDDKYLGFPTPEGRMNKGKFQSLQEKLCKRIMQWDQNGSWDRDVISQLFWPLDGEIIKSIRLSSRQDEDFIAWYPDKMGQFSIRSAYMLAVQLANAGESSSSSGNDTKKVWNHVWKCNIPQKVKVFSWRAISNCLPTMVNKKKRNPELSDVCSFCGLEPEDVAHALWRCPHARRYWDLMSSEMQVQRILYGSGEGSDWILDFLESISEDDRPVFLMSLWRIWYTRNEITHDKAAPPVEVSKRFVRSYVNSLKEIKARPNANLGSGKHVIGEDRPKCKKQSVLAKWEKPPSGWMKLNVDGSYQEDNIGEISAILRNSTGDVIFAACGFVEQCQSALEAEILACKEGIGLALQWTLLPIIIESDCAEALQLILSEGKLRSVNKFLVREIQGMVKGAREMKLKKVNRNCNHISHVLANKGRLSINNYNAELVSFQGTPPSFQVLSMGRSHRLPALQDNKKRQLISSRQVKAAKTEVRRATRTNWTEEENLRLISAWLSNSVDPTDGNDKKGEYYWKDVADEFNNNRPTNGHKRTVKQLKTHWGNVKKDIGKFCGVYAQVRRTCTSGHSDDMIMEKAHLWYKNQSNQKKPFTLEYMWRELKDQPKWRSIIKKEENKNKRTKISESGAYTSSSNQETEEESSNKERHPEGQKKAKERLKGKGKGKAQSSPLGNQPSQNIVLYNEAMKIKAEALLKSAEATAKSAEAKREQIRMEKWQAYIKLEEKDTSNFSGEAEKA

SEQ ID NO: 60885 - protein, 475 aa, Erythrobacter sp. NAP1
MVTQYKNLINGKMVDTGEWMDVVNPANEEVIGQVPACGEAQLDEAVAAARAAFKTWKKSTFEERQAACMAISGAIKENADELFRLLTSEQGKPHAQAKGEIFGAAGISAAQSTLQLEEEIIQDDDTRLHRHRRVPVGVVGGIVPWNFPVMMAIQKIVPALMAGCTIVLKPSPFTPLATLRIAELIADKVPAGTVNIITGEDSLGPLITGHPDIDKITFTGSTATGKKIMEGAAGDLKRITLELGGNDASIVLPDADPKKVAEQLFWSSFQNAGQVCIAAKRVYIHEDIYDELSAAIAEYAKSVVVGDGSEQGTGVGPIQNKKQYERVLELIQDAKDNGYKFLTGGDKDPSGSGYYVPITILDNPPEDARIVAEEQFGPVMPLMKFSSEDEVIERANNSDYGLAGAVWTADHDKGVEIAEQLETGTVWINEFMHLSPFAPFGGHKQSGFGAEYGKEGLKEFTYPQVITVKKDNVVA

SEQ ID NO: 60886 - protein, 817 aa, Pyrococcus furiosus DSM 3638
MAYRFIKWFEELSKNDVPLVGGKGANLGEMTNAGIPVPPGFCVTAEAYKYFVENVKVSKEDVKRILGEKVNKGTISEVLAQAPDEPRPLQDWIMDIISKTDVDDSKMLQENTEAIRTLIKSLDMPSEIAEEIKQAYKELSQRFGQEEVYVAVRSSATAEDLPEASFAGQQETYLDVLGADDVIDKVKRCWASLWTARATFYRAKQGFDHSKVYLSAVVQKMVNSEKSGVMFTANPVTNNRNEIMINASWGLGEAVVSGAVTPDEYIVEKGTWKIKEKVIAKKEVMVIRNPETGRGTVMVKVAEYLGPEWVEKQVLTDEQIIEVAKMGQKIEDHYGWPQDIEWAYDKDDGKLYIVQSRPITTLKEEATAEEAEEVEEAEVILKGLGASPGIGAGRVVVIFDASEIDKVKEGDILVTTMTNPDMVPAMKRAAAIVTDEGGRTSHAAIVSRELGIPCVVGTKEATKKLKTGMYVTVDGTRGLVYKGIVKSLVKKKEEAKAEGGQVVVAGAPLVTGTMVKVNVSMPEVAERAAATGADGVGLLRAEHMILSIGQHPIKFIKEGKEEELVEKLAEGIEKVAAAFYPRPVWYRTLDAPTNEFREMPGGEDEPEERNPMLGWRGIRRGLDQPELLRAEFKAIKKVVEKGYNNIGVMLPLVSHPEQIREAKRIAREVGLEPHKDVAWGVMIEVPAAAIIIEDLIKEGIDFVSFGTNDLTQYTLAIDRDNERVAKLYDETHPAVLKLIKHVIKVCKRYGVETSICGQAGSDPKMARILVRLGIDSISANPDAVQLIRQVVAQEERKLMLEAARKQLFEEEEEEELF

SEQ ID NO: 60887 - protein, 371 aa, Coxiella burnetii RSA 493
MKQISKINWLNVSFIILTGLVGITGTILFIVFGLVHWPTWVLAGAMLIACGLSITAGYHRLAAHKSYKAAWPIRLFFALFGAAAFEGSIVEWATDHRKHHRYTDTDQDPYSIKKGFWYAHIGWLFTLDPSKRDFSNVQDLLDDPIYRFQHRFFPIIAILMGFGLPMAIGALWGDPLSALVIAGALRITVVYQMTFFINSLCHMIGKQTYKNSSARDNWVTALLTMGEGFHNFHHQFPIDYRNGVRFFHFDPTKWLIYLLSRMGLVSGLKRVEQRRIIKYRLQTDTQRLALLSAERVEVVKPLYERIHHLLGRLEELEKSYLALKEAQFKAYKNRLREIRQKLKATERELRTFLTLWSKVARPLQTCQLSGS

SEQ ID NO: 60888 - protein, 329 aa, Zea mays
MVASTASRLSPPRFSTPSPSLHPPNRRSRFSPVRAAKLEAVLSIGAHLIPHPRKAASGGEDAFFANSDAGGVFAIADGVSGWAEKNVNPALFSRELMRNSSNFLNDEAVSHDPQILLMKAHAATSSIGSATVIIAMLEKTGTLKIASVGDCGLKVIRKGQVMFSISPQEHYFDCPYQISSEAEGQTYKDALVCSVNLMEGDIIVSGSDGLFDNIFDQEIVSIISESPSVDEAAKALAELARKHSVDVRFDSPYSMEARSRGFDVPWWKKLLGGKLIGGKMDDITVVVAQVKTVVVPEDEVQGGDTEEQKGNEQGAAAVVAYKMNDEEVA

SEQ ID NO: 60889 - protein, 487 aa, Oryza sativa (japonica cultivar-group)
TPLPLSLADTWTPPLPTPATPTAARPPTPPPRPTPPSPSRRSPSETCPCSRRRRRRPTRSPTRSPATPTSTRRPPSTSPRVTSPSATPSSTSPPRRRPRSSPTARAGPRAGVAVDPARARAAVVTCGGLCPGLNTVLRELVVGLRELYGVRDVFGVAAGYRGFYGPDADHARLDLAAVDDWHKKGGTVLKTTRGGFDLNKIVDGIVARGYTQVYAIGGDGTMRGAVAIFNEFKRRGLNISITGIPKTVDNDIGIIDRSFGFQTAVEIAQQAIDAAHVEAVSAVNGIGLVKLMGRSTGHIALHATLSSRDVDCCLIPEVDFYLEGKGGLFEFLYERIKQKGHAVVVVAEGAGQELIPRTDDQKREQDESGNIVFLDVGPWLKSELGKWWKREHPSELFTVKYIDPTYMIRAVPANATDNLYCTLLAHSAIHGIMAGYTGFVPGPINGNYSYIPLEDVAVAKNPVDVNDHKWAWVRSVTNQPDFMKPKY

SEQ ID NO: 60890 - protein, 475 aa, Streptococcus pyogenes MGAS10394
MAKQYKNLVNGEWKLSENEITIYAPATGEELGSVPAMTQAEVDAVYASAKKALSDWRALSYVERAAYLHKAADILVRDAEKIGAILSKEVAKGHKAAVSEVIRTAEIINYAAEEGLRMEGEVLEGGSFEAASKKKIAIVRREPVGLVLAISPFNYPVNLAGSKIAPALIAGNVVALKPPTQGSISGLLLAEAFAEAGIPAGVFNTITGRGSVIGDYIVEHEAVNFINFTGSTPIGEGIGKLAGMRPIMLELGGKDSAIVLEDADLALAAKIIVAGAFGYSGQRCTAVKRVLVMDKVADQLAAEIKTLVEKLSVGMPEDDADITPLIDTSAADFVEGLIKDATDKGATALTAFNREGNLISPVLFDHVTTDMRLAWEEPFGPVLPIIRVTTVEEAIKISNESEYGLQASIFTTNFPKAFGIAEQLEVGTVHLNNKTQRGTDNFPFLGAKKSGAGVQGVKYSIEAMTTVKSVVFDIQ

SEQ ID NO: 60891 - protein, 489 aa, Dechloromonas aromatica RCB
MSQPQRIHHFINGEFTASPDPRYFDKRSPVDGRVIAHIAEAGQADVDAAVTAARAALKGEWGKLSTDQRVDLLYGVANEITRRFDDFVAAEMADTGQPSHVQTHVFIPRGAANFKVFADVIKNVAAESFRMATPDGKGALNYAIRNPKGVIGVISPWNAPFLLMTWKVGPALACGNTVVVKPSEETPLTATLLGEVMNSVGIPKGVYNVINGFGPDSAGAYLTQHPGVDAITFTGETRTGTAIMKAAAEGMRDVSFELGGKNAGIVFADCNFEAAVDGIFRSAFLNTGQVCLGTERVYVERPIFENFVQALKAKVEGVRYGRPEDHTSTYGPLISQEHRDKVLSYYKKAVDEGATVVTGGGVPDMPAELAGGSWVQPTIWTGLPETAAVVREEIFGPCCHIRPFDSEEEVIELANANDYGLATTIWTENLSRAHRVAERVEVGVTWVNSWFLRDLRTPFGGSKQSGIGREGGVHSLEFYTETRNVCIKL

SEQ ID NO: 60892 - protein, 338 aa, Arabidopsis thaliana
MNGEETTPFKRRQMTILMLPNDLLFNCLARISRLYYPTLSLVSTRFRSLLASTELYQTRTHLGRTERCLYVCFRLFTESDQLRWFTLCQGPFNSKKILVPISSPNFPSASWSDAAIVGPNIYAIGGLVNKNYSSSVMVMDCYSHTWREAPSMHVARLSHSVCVHDGKIYVTGGCKNLDSTNWMEVFDTQTQTWEFLQIPSEEIFGGSKYRSVEYEGTVYVKSEAKDVTYKLHKENVFYRYTDRRIEWYDSEKRLWTTLKGVEKLRSFSRVNLVNYGGKMAVVSVEYVFGKKEAKIWWAEIAIEKRQTGEIWGMLEWLDIVFRTNDKSYSLERALATTI

SEQ ID NO: 60893 - protein, 387 aa, Glycine max
MEDKLATTSEGQPIRCKAAICRKPGSPLSIEEIIVAPPMPREARIRVICTSLCHSDVTFWKMEVPPAICPRILGHEAVGVVESVGEDVTEVTKGDVVVPIFLPDCGECIDCKSSKSNLCSKFPFEVSPWMPRHATSRFTDLKGDIIHHFLFVSSFSEYTVVDIAHLTKIDPAIPPNRACLLSCGVSTGVGAAWRTAGVEPGSTVVIFGLGSIGLAVAEGARLCGATRIIGVDVNPEKYETGKKFGLTDFVHAGESENKSVSQVIIKMTGGGADYCFECVGMATLVQEAYASCRKGWGKAIVLGVEKPGSMLSLSCNEVLHSGKSLVGCLFGGLKPKSDVPILLKRYMDKELNLDEFVTHEVEFKDINKAFDLLIEGQCLRCVIWMDR

SEQ ID NO: 60894 - protein, 473 aa, Yarrowia lipolytica CLIB122
MRIFKQARPQVGLRAVRAAFGGPGKPAIRAPLHPRFFRHSARLQMQDPYKALGVESNASAKEIKKSYYQLAKKYHPDVNKEEDAKKKFEEVQKAYELLSNEEERKKYDTFGPAAFGEGGQPGGQGYGGNPFAGGGNPFAGFGGAGFGGGGFGAQGINLDDLFSAAFGGQGGGRGGFGRQQPYVQEFEGNDIQLNVEISLEDVARGVTRDLKYQAVTSCNTCEGSGMKKDAKKNTCSACGGTGARVHVVNGGFQMSTTCEVCRGSGEQIPKDGECGSCHSNGVVRETRETSINIPPGVDNGTILRVSGMGDAPEAQAGPTVRLHNGDLLVRIHVKPSKTFVRQRSDLVYKKEIPMTTAALGGTVLIPTLLGGKLRIKVPAGTQPGAQIAIPEQGLPKGRNGFGDLKVIYDVKITAPTDKTQTAVLETLADLTHDESARRSDGHVKSEPEAPAEDEKKHTPFLKKLFNRLKHHNE

SEQ ID NO: 60895 - protein, 480 aa, Aspergillus oryzae
MVLIHSSKAAPLATLGTFTSRCGVGTPLNNVSKCRLRVRSVSTSVLAETKGAPNVTLPPLSALPTSMLLRSLLVAAITSKPYLLKPSLSILSRLSKSGNSLLLSVDRNIILHTILKWTFYKQFCAGENGRETQATVQMFKDLGFRGTLLTYAKETVFDHSTKSQQGLGVTTDQGKGQDGNGKRYCEHIEAWREGTVKTVDLLGEDDYLAMKLTGAGPAATEAFAAGELPPVQMIEALEEICQKCKDKGARILIDAESQHFQKGIARVTIDLMRKYNRDGYALVYNTYQAYLKSTPTTLATHLAAAGEEGFTLGLKLVRGAYMATDDRSLIHDTKQNTDDAYNSIAQGALRQELGEFGATNGRAFPSVNLFLASHNKESVMAAHHLHQQRLAAKLPTVPVGFAQLHGMSDDVSFSLLQLKGPDGSPQVYKCSTWGGMGECLAYLLRRAIENRDAVSRTQDEYRALKGEVGRRLKSLVTFST

SEQ ID NO: 60896 - protein, 385 aa, Zea mays
  misc_feature (99)..(99): Xaa can be any naturally occurring amino acid
  misc_feature (124)..(124): Xaa can be any naturally occurring amino acid
  misc_feature (163)..(163): Xaa can be any naturally occurring amino acid
  misc_feature (195)..(195): Xaa can be any naturally occurring amino acid
  misc_feature (262)..(262): Xaa can be any naturally occurring amino acid
  misc_feature (271)..(271): Xaa can be any naturally occurring amino acid
SESESEAASGRQGEMGKGAQGSDAAAAGGEVEENMAAWLVAKNTLKIMPFKLPPVGPYDVRVRMKAVGICGSDVHYLREMRIAHFVVKEPMVIGHECAXGVVEEVGAGVTHLSVGDRVALEPGXSCWRCRHCKGGRYNLCEDMKFFATPPVHGSLANQVVHPXDLCFKLPDGVSLEEGAMCEPLSVGVHACRRAXAGPRRACLVVGAGPHRPWCRCWAARAFGAPRVVVVDVDDHRPGPWARSLGAGRGRAGCRPRAEDPGXEVERIRRGXMGSDIDVSLDCAGFSKTMSTALEATRPGGKVCLVGMGHNEMTLPLTAAAAREVDVVGVFRYKDTWPLCIDFLRSGKVDVKPLITHRFGFSQRDVEEAFEVSARGRDAIKVMFNL

SEQ ID NO: 60897 - protein, 117 aa, Zea mays
MSICQDKTCLKDAYIIYLNADESIDATRKGNLARFINHSCQPNCETRKWNVLGEVRVGIFAKQNIPFGTELSYDYNFEWYGGVMVRCLCGAASCSGFLGAKSRGFQEATYLWEDDDD

SEQ ID NO: 60898 - protein, 238 aa, Arabidopsis lyrata subsp. lyrata
CKAAVAWEAGKPLVMEEVEVAPPQKHEVRIKILFTSLCHTDVYFWEAKGHTPLFPRIFGHEAGGIVESVGEGVTDLQPGDHVLPIFTGECGDCPHCHSEESNMCDLLRINTERGGMIHDGESRFSINGKPIHHFLGTSTFSEYTVVHSGQVAKINPDAPLDKVCIVSCGLSTGLGATLNVAKPKKGQSVAIFGLGAVGLAAAEGARIAGASRIIGVDLNSQRFDQAKEFGVTEFVNPR

SEQ ID NO: 60899 - protein, 797 aa, Alkaliphilus metalliredigenes QYMF
MNVSINWLKEYVKIDESIKVFADQMTMSGSKVEMVEEVAKDMKGIVVGHIEKILPHPNADKLVIVKVNIGDEMLQIVTGATNINEGDYVPVAVHGAQLAGDLKIKKGKLRGEVSEGMLCSLDELGFGKSVIPEEVKDGIWILDQAYPLGSDALEVLSLTDQVAEFEITSNRPDCLSMMGMAREAAATFRKELNYPNINLTETKEKSGDYVQVKIENNEKCPRYLARVIKNVKIGPSPIWLQLKLMKSGVRPINNIVDVTNYVMLEYGQPLHAFDIDAVAGDEIIIRNATSGEEMKTLDGVQRKLNESMLMITDKEKLLAIAGVMGGEESEITPKTTTVLLESANFEADGIRKTSKTLGLRTEASSKYEKGLDPNLVQIAAERACQLIAELGAGEILMGAVDVYITPKGNRQLNVSVEKINGLLGTQVSPEEMIALLKPLEIKAENMNGRLELTIPTFRDDLVEEADIAEEIARMYGYDKIISTMAKGNIVAGGKTNGQKIEDFTKDILNAMGFNEILTFSFVSPKSVDKIELREDSLKRRFVKLLNPLGDETSVMRTTLLPNMLEVLSRNINRNVKFVRAFEMGNIFLPKDEALEILPSEIPNLVMGMYGEEDFFTLKGAIEALLEQLGIEDIQVEVENYHPTFHPGRCASILVGQHTIGTFGEIHPKVLENYDIDERCYCAEIDFSVLLELSRMERLYEPLPKYPAITRDFAVVLKNDITVKQIEGIIKDNGGNILESFTLFDIYQGSQIPEGHKSVAYSITYRDKERTLTDDDVNILHDQILTQIREKLEGILRD

SEQ ID NO: 60900 - protein, 243 aa, Candidatus Kuenenia stuttgartiensis
MGFQIIDQGTRFPLTAGMFTTPPRRVERLQHTAKDKRIEENKDNLQEREQRENKKQKPRSSSTLMYQKTEYPHQRNSLHANQIMSSPVVTILPDTRLDEAWEIIREHRFRHLPILTPNKKVAGIISDRDLLREAAQSEASGDKQPVNTPAQKWYEADAHYTDAGFYHDNIYTFPKKKTVLDICKTRILTATPDTELREIAKILIEEHIGSMPIVDENNHLLGIITRSDILRTIVANGAIDLLI

SEQ ID NO: 60901 - protein, 357 aa, Arabidopsis lyrata subsp. lyrata
AVAWEAGKPLVMEEVEVAPPQKHEVRIKILFTSLCHTDVYFWEAKGHTPLFPRIFGHEAGGIVESVGEGVTDLQPGDHVLPIFTGECGDCPHCHSEESNMCDLLRINTERGGMIHDGESRFSINGKPIHHFLGTSTFSEYTVVHSGQVAKINPDAPLDKVCIVSCGLSTGLGATLNVAKPKKGQSVAIFGLGAVGLAAAEGARIAGASRIIGVDLNSQRFDQAKEFGVTEFVNPRDHDKPVQQVIAEMTNGGVDRSVECTGSVQAMIQAFECVHDGWGVAVLVGVPSKDDAFKTHPMNLLNERTLKGTFFGNYKPKTDIPGVVEKYMNKELELEKFITHTLPFSEINKAFDYMLKGE

SEQ ID NO: 60902 - protein, 1556 aa, Yarrowia lipolytica CLIB122
MFAEGQIQKVPILGKESIHIGYKMQDHIVSEIVANIKSSTYILVTDTNIEDLGYVESLKTKFEAAFAKDGIKSRLLTYTVAPGETSKSRATKAAIEDWMLSKGCTRDTVILAVGGGVIGDMIGYVAATFMRGVRFVQIPTTLLAMVDSSIGGKTAIDTPLGKNLVGAFWQPVNIFIDTSFLETLPVREFINGMAEVIKTAAFYDAEEFTRLESASEIFLSTIKKRDAKDPRRVDLSPITDTIGRIVLGSARIKAAVVSADEREGGLRNLLNFGHSIGHAYEAILTPYILHGECVAIGMVKEAELSRYLGILSPVAVARLAKCIKAYELPVSLDDATVKARSHGKKCPVDDLLRIMGVDKKNDGSTKKIVILSAIGKTHEQKASSVADKDIRFVLSEEVIVGEAPVGDKKSYTVTPPGSKSISNRAFVLTALGKGPCKLRNLLHSDDTQHMLEAIELLGGASFEWEADGETLLVTGNGGKLTAPAQELYLGNAGTASRFLTTAATLVQKGDKDHVILTGNKRMQERPIGPLVDALRSNGADIAFQNAEGSLPLKIEAGVGLKGGLIEVAATVSSQYVSSLLMCAPYAQTPVTLSLVGGKPISQFYIDMTIAMMADFGVVVTKDETKEHTYHIPQGVYTNPEEYVVESDASSATYPLAYAAMTGHTVTVPNIGSKSLQGDARFAIDVLKAMGCTVEQTATSTTVTGVPNLKAIAVDMEPMTDAFLTACVVAAVSEGTTVITGIANQRVKECNRIEAMRVQLAKYGVVCRELEDGIEVDGISRSDLKTPVSVHSYDDHRVAMSFSLLSSIMAAPVAIEERRCVEKTWPGWWDVLSGVFNVPLEGVTLAKTVSKAESGLSKPSIFIVGMRGAGKTHLGAQAANHLGYEFIDLDQLLEKDLDTTIPQLIADKGWDHFRAEELRLLKQCLNDKSEGYVISCGGGVVETPAARDALQTFKGVGGIVLHVHRPVSRILEYLNKDQSRPAFVDDLEAVWQRRKELYRSVSSNVFFAPHCDSAEATAKVQQMLGAFLDRVTGKSEFVIPHKDQFTSFLSLTFPDVSIAATMLPSLSEGCSALELRVDLLNENDEAIPSEEYVLSQLAILRQNVDLPILYTVRTKAQGGRFPDDKPVELANLVNLGLKTAVELLDVELTYPAELVSSVGASRGYTKLLGSHHDFPGALNWSSLEWENMYARAEAVPVDVVKLVGMAKSFSDNFALENFREAHTSSPLLAINMGSHGQLSRVTNTLLTPVTHADLPVAAAPGQLSVEEINQTRSTIGMFNKNLSFFIVGTPIGHSKSPILHNTMFKKLGLPYEYSRFKTDDAAAVNAKARALLAQGNLGGISVTIPLKQDIIPFLDEVSPLAQQIGAVNTIIPGPNGTLKGDNTDILGLVNALTRFGANSLDKKTALIVGAGGTSLAAVHGLRSLGFAKILIANRTLSKAEAIADKFDNVEAVTLDSFVANKYTPSVIVSCVPATTFSMLDESNKLVSAALAASPKGLVLEAAYSAEATPLLKQVMDVEGWEFISGLYMLTEQGFEQFRLWTGIPAPKEVGEKAVLGN

SEQ ID NO: 60903 - protein, 199 aa, Campylobacter lari RM2100
MQEDFKEHAELFESLKNKQNPHTLFIGCADSRVIPNLITNTGPGELFVVRNIGNIVPPYRVGDDFLATTSAIEYAFNSLHIKNIIVCGHSNCGGCAALYANENDLKNMPNVKTWLTLLEPIKNKVLKIAGSDLAMRAWMTEKMNLVNSLQNLLTYPGVEEALNKKEIELHAWYYIIETGEIYEYDFNFENFVLIQERRS

SEQ ID NO: 60904 - protein, 215 aa, Brassica napus
  misc_feature (176)..(176): Xaa can be any naturally occurring amino acid
  misc_feature (187)..(188): Xaa can be any naturally occurring amino acid
  misc_feature (204)..(204): Xaa can be any naturally occurring amino acid
ASLPRPSGISSSVMNVEPVKTASAASLPRPSGISPTLNAEPVKSASTASFPRPLGTISSSKAEPVKTALAAALPRPSGIISAPKADLVKTGHAVSLPRPSGITSSTKAELMKTASAASSPRPESMPSAPKGEPLKSVSAATTKTQVVGPLSARNAANGPFNKPSPMALFSKGPTIXKIFQFLPRFAXXSRLAPTQRVNATTVMXQNGEPHLPPLL

SEQ ID NO: 60905 - protein, 550 aa, Zea mays
  misc_feature (184)..(184): Xaa can be any naturally occurring amino acid
MAPRKKPPTRDPSICRTPPNSQTITRSVDMDKAYIAALSAAALFLLHYLLGRRAGGEGKAKAKGSRRRLPPSPPAIPFLGHLHLVKAPFHGALARLAARHGPVFSMRLGTRRAVVVSSPDCARECFTEHDVNFANRPLFPSMRLASFDGAMLSVSSYGPYWRNLRRVAAVQLLSAHRVGVHGPXSKPQVRAMVRRMDRAAAAGGGGVARVQLKRRLFELSLSVLMETIAHTKTSRAEADADSDMSTEAHEFKQIVDELVPYIGTANRWDYLPVLRWFDVFGVRNKILDAVGRRDAFLGRLIDGERRRLDAGDESESKSMIAVLLTLQKSEPEVYTDTVITALCANLFGAGTETTSTTTEWAMSLLLNHREALKKAQAEIDAAVGTSRLVTADDVPHLTYLQCIVDETLRLHPAAPLLLPHESAADCTVGGYDVPRGTMLLVNVHAVHRDPAVWEDPDRFVPERFEGAGGKAEGRLLMPFGMGRRKCPGETLALRTVGLVLATLLQCFDWDTVDGAQVDMKASGGLTMPRAVPLEAMCRPRTAMRGVLKRL

SEQ ID NO: 60906 - protein, 490 aa, Oryza sativa (indica cultivar-group)
MERALDSLTYKGSIPDAILQSRRDNKLFVVYISDPQKAIPSISVIGQNGVMLWCHEGYISSKDLKENIEKAWATLHLQGTAAAFLTASLASRMTEPVNTTPTTLPTQGGSSAAENPSTSSNQSTGTSGASGFANPTDSVAQPPRSTSRDETPSISEKESSNLDSSPGNRTVQERPDSDSAQVKGSLPDHPRSSNIEGCANPVQSGNTASLKQKNKVDDGFTKVSSESVPTRVASRGKSSKVAVDQDKATTTSTPIEPAPVRSNDIQLVVRIPDGPSLQIKLTKDDNLRKVKNFVDENRANGAGSYDLAMLYPRKVFTEQDMEATLHELGIETRQALTIVPHHKTIRAAKRQSSSSPHEGDNNMDADSSGGSGYFGYLRTALSFVNPLSYLRANAAPSNPDQLANQGSPQYRPSTGPWNRPGEDTASESRIPDSASQQAARDTSSGSTLRRRPRQFGGNVHSLRSDDQGPSDDRNVYWNGNSTEFGGEDKK

SEQ ID NO: 60907 - protein, 330 aa, Shewanella sp. MR-7
MQTLAQHLTSKAVNESLSQLILTLADTSKAISHAVRHGALAGVLGATEQENVQGETQKKLDIITNDMLKDALKADGTVRGLASEEEDHVVEVSANGQYLVCFDPLDGSSNIDINSLVGTIFSVLPAPAGELTETSFLQSGRNQLAAGYVLYGPSTMLALTTGQGVQLFTLHPETNEFLLTNAAMSISPDTQEFAINMSNQRFWEAPMQTYIADLLLGKIGPREKSFNMRWIAAMVGDVHRVLSRGGIFTYPTDNKDPKKPYKLRLMYEANPMALLVEQAGGKASTGYETILDIQPTQIHQRVAVILGSANEVDACLSYHGIDYSEEPTLD

SEQ ID NO: 60908 - protein, 1526 aa, Aspergillus nidulans FGSC A4
MADGLNMGSLTLNDSQHAPAPGGPPSGGRAAYIPPHLRQRQVNANGDGASAPPPGPTGGSWGGPRGPRGGNWANANAPDFNPRGPNGNTNTNSGWTATEAGRPLFNPNAYGNPGHGGGYAGASARGSGDGQWRDGKHIPGPPNPRLERELFGVPNDPTKQNTGINFANYDDIPVEASGHDVPEPVNTFTNPPLDDHLISNIALARYQTPTPVQKYSIPIVMNGRDLMACAQTGSGKTGGFLFPILSQAYQNGPAAPPPSAAGQFGRQRKAYPTSLILAPTRELVSQIFDEARKFAYRSWVRPCVVYGGADIGSQLRQIERGCDLLVATPGRLVDLIERGRISLVNIKYLILDEADRMLDMGFEPQIRRIVEGEDMPNVNDRQTLMFSATFPRDIQMLARDFLKDYVFLSVGRVGSTSENITQKVEYVEDHDKRSVLLDILHTHGTTGLTLIFVETKRMADALSEFLINQRFPATAIHGDRTQRERERALEMFRSGRYPILVATAVAARGLDIPNVTHVINYDLPTDIDDYVHRIGRTGRAGNTGIATAFFNRGNRGVVRDLIDLLKEAHQEVPSFLESIAREGSGYGGRGGRGGRGRGANATRDMRRMGGGMGGPPSYGGGSGFGAPASNYGGGYGGAPSYGGAGYGGGYGGGGYGNPSGSTGPSSWWCLVEADIERNLSDVLIITRIRGGCWELLRWHYSWLNGVIYHCILTFDELSLNAVGHHTLTFNEIFNPSYINASAAQYVMADVESAGVDDSFAQSEPHDEQQIHNMTVGTRRQPNGTIGSVYSGNKIRHLKKEDGIPLWRKDIQYQFLKLVFEDKTPVFTRWPDGQKNMDFADIYIDAMARSSKTSKILKDKLQSDKQAAINMAMVCLLVNFGRMNTTLNFFPEMRAQLRTYHSIPSLQAHQDPNAYKQLQDAPRLKSILKGASEDVDQPNTLDKIKRENVPRTNPVNLIFVLAQYAPKVSEMHFFPPRDFFDLVMRSTLSSKSRAKAFLWLMWWYLESDFSREAALNNPFGPGLEGEGTGGLPIKVPSFEILTEEQANEENVDTQSEIEYGEEKRLERKRILEEEEPTPRAPKRPKKMPYWEFQYLKQMEPGTKIPSRQFSNKGDAYRAAADSDDLIEFRNPDGSIRSTLKMPRDEDYAYQSGSLDGPSPRIVLRTKAENTPDAASPAPPGSGYPILNRFVTEASPHHQGSSRRPRPLTQHQLAVERNRRQRIEYILAKRKGEAYRLLRAKRLTEIPFARYGRLLQNLPDGYDTDDDKSWGKGGLLPNPEEEEDFGECANYFLSVIRKASRRLDRWDYEHANGPRRDRKKEREERQKAREEAMDFDGDVDGKVSSRSSRARAQRNAKRKLARAAAAASSTPSASTPKTAAARSKGNRSRNPRDEKVAAATSLGANTGLETPSRDDALSPVQGDLEGEESLDDIDRELLGEGSGDEDDIPPRGLEPSRPAELGYDDSFLGGDADDALSSDEEEEEAEDEELDEMDVEGDDNLSAPGGEGRYAASDVSGPEMANGKPGWN

SEQ ID NO: 60909 - protein, 515 aa, uncultured bacterium
MSLNLAHFLYLTAREHPEKTAVVLDDYRFSYQEVLTYARRVASLLHAKGIRRGDKVAMMIPNSPHFPVIYFGALLAGAVVVPVNCLLKGHEIHYYLEDSDARLFFTWIDFLDESIKAMEEALTCQHLVVVSYPNDREDPVAGESFTKLLEEASPDFDMVETMPDDTAVLLYTSGTTGHPKGAELTHFNMFFNAYYTMHRILYATADDVSLGVLPLFHSFGQTCVQNATLMAGGTMVLVPRFEAQRVLEVIQRDRVSVIAMVPTMYFWMLHEKRNGTYDLSSVRMAVSGGSALPVETLTHFESEFGVRILEGYGLSETSPVASFNVIERPCKPGSIGLPVWGCEMRILRDDGTFADVGEVGEIVMRGHNVMKGYYNKQVATEEAFEGGWFHTGDLARMDEDGYFFIVDRKKDLIIRSGMNVYPREVEEILYGHPAVLEAAVVGVPDEARGEEVKAFVTLKSGSEASAGELLAYCRERMAKFKCPKSLEFLPSLPKGPTGKILKRQLRNGASAGTAG

SEQ ID NO: 60910 - protein, 1129 aa, Avena sativa
MSSSRPASSSSSRNRQSSQARVLAQTTLDAELNAEYEESGDSFDYSKLVEAQRDGPPVQQGRSEKVIAYLQHIQKGKLIQTFGCLLALDEKSFNVIAFSENAPEMLTTVSHAVPSVDDPPRLGIGTNVRSLFSDQGATALHKALGFADVSLLNPILVQCKTSGKPFYAIVHRATGCLVVDFEPVKPTEFPATAAGALQSYKLAAKAISKIQSLPGGSMEVLCNTVVKEVFDLTGYDRVMAYKFHEDDHGEVFSEITKPGLEPYLGLHYPATDIPQAARFLFMKNKVRMICDCRARSIKVIEAEALPFDISLCGSALRAPHSCHLQYMENMNSIASLVMAVVVNENEEDDEAESEQPAQQQKKKKLWGLLVCHHESPRYVPFPLRYACEFLAQVFAVHVNREFELEKQLREKNILKMQTMLSDMLFREASPLTIVSGTPNIMDLVKCDGAALLYGGKVWRLRNAPTESQIHDIAFWLSDVHRDSTGLSTDSLHDAGYPGAAALGDMICGMAVAKINSKDILFWFRSHTAAEIRWGGAKNDPSDMDDSRRMHPRLSFKAFLEVVKMKSLPWSDYEMDAIHSLQLILRGTLNDASKPKREASLDNQIGDLKLDGLAELQAVTSEMVRLMETATVPILAVDGNGLVNGWNQKAAELTGLRVDDAIGRHILTLVEDSSVPVVQRMLYLALQGKEEKEVRFEVKTHGPKRDDGPVILVVNACASRDLHDHVVGVCFVAQDMTVHKLVMDKFTRVEGDYKAIIHNPNPLIPPIFGADEFGWCSEWNAAMTKLTGWNRDEVLDKMLLGEVFDSSNASCPLKNRDAFVSLCVLINSALAGEETEKAPFGFFDRSGKYIECLLSANRKENEGGLITGVFCFIHVASHELQHALQVQQASEQTSLKRLKAFSYMRHAINNPLSGMLYSRKALKNTDLNEEQMKQIHVGDNCHHQINKILADLDQDSITEKSSCLDLEMAEFLLQDVVVAAVSQVLITCQGKGIRISCNLPERFMKQSVYGDGVRLQQILSDFLFISVKFSPVGGSVEISSKLTKNSIGENLHLIDLELRIKHQGLGVPAELMAQMFEEDNKEQSEEGLSLLVSRNLLRLMNGDVRHLREAGVSTFIITAELASAPTAMGQ

SEQ ID NO: 60911 - protein, 127 aa, Shewanella oneidensis MR-1
MAEKIIIATENAPAAIGTYSQAVKVGNTVYLSGQIPLVPSTMQIVSDDFEAQVVQVFENLTAVCTAAGGTINDIVKLNIFLTDLSHFAKVNEIMSRYFSQPYPARAAIGVKQLPKDSQVEMDGVMEL

SEQ ID NO: 60912 - protein, 1543 aa, Filobasidiella neoformans
MSATGVPAELNNLGAPITATTQNPSGLANSQVTSGPASSATQHDEHRSSAGNTLADEENDKAVESEKAEVIDAAADGKQKRLAADSSENIVTELEPHHVSIHRGKEEFAALERRYSTLSQQSQHELHRPTTRHSVRSSFSRKDRVVSRLTQDDAEKAKEGEGEFNLVDVLRSGRENQDEAGIKRKAVGVIWEDLEVIGAGGMRINIRNFSSAIIEQFMMPAFKILSIFGVNPFAPKPKAILHPSSGLLKPGEMCLVLGRPGAGCTTFLKTITNQRAGFMEIKGNVEYAGVGWKEMRKRYGGEVVYNQEDDDHLPTLTVAQTIRFAPATKTPKKKIPGVSAKQFQDDMLDLLLSMLNIKHTANTIVGNAYVRGVSGGERKRVSIAEMFCSGATVCSWDNSTRGLDASTALDYAKSLRLLTDIMGQTTFVSLYQAGEGIYDQFDKVLVLNEGHVAYFGPAKEARQYMIGLGYRDLPRQTTADYLSGCTDVNERRFADGRDETNVPATPEEMDKAYKESEVCARMTREREEYKQLMAEDATAREDFRQAVLEQKHKGVSKKSPYTVSFLQQVFIIFKRQLRLKFQDHFGISTGYATAIISALIVGSVYFRLPETASGAFTRGGLLFLGLLFNALTSFSELPSQMLGRSVLYRQNEYRFYRPAAFALAAVLADVPYNASVIFLFSIVLYFMGGLYSSGGAFFMFFLFVFLTFMVMSAFFRTLGVATSDYNVAARLASVLISFMVTYTGYMIPVQRMKRWLFWIFYLNPLSYGYEAIFANEFSRINLTCDSSYTIPRNIPEAGITGYPDTLGPNQMCSIFGSTPGDPNVSGSDYMATGYSYYKAHIWRNFGILLGFFAFFMFLQMLFIEVLEQGAKHFSINVYKKEDKDLKAKNERLAERLEAFRAGELEQDLSELKMRPEPFTWEVLNYTVPVPGGHRQLLNDIYGYVKPGSLTALMGASGAGKTTVLDVRASRKNIGVIEGDVLMNGRPIGTGFQRGCGYAEQQDTHEWTTTVREALRYSAYLRQPQHVPKQEKDDYVEDIIELLELQELADAMIGFPGYGLSVEARKRVTIGVELAAKPELLLFLDEPTSGLDGQSAYNIVRFLKKLCAAGQKILCTIHQPNALLFQSFDRLLLLQRGGECVYFGDIGPDSKVLIDYLERNGAKVPHDANPAEFMLEAIGAGSRKRIGSDWGEKWRNSPEFAEVKREIQELKAEALAKPVEEKSNRTEYATSFFFQLKTVLRRTNVALWRNADYQWTRLFAHLAIGLIVTLTFLQLDNSVQSLQYRVFAIFFATVLPALILAQIEPQYIMSRMTFNREASSKMYSSTVFALTQLLSEMPYSLGCAVSFFLLLYYGVGFPYASSRAGYFFLMILVTEVYAVTLGQAVAALSPTILIAALFNPFLLVLFSIFCGVTAPPPTLPYFWRKWMWPLDPFTRLISGLVSTVLQDQEVVCKDGEYQVFPAPSGQTCQQWAGAFAEAIGGYINNPDSTGDCQFCQYRTGQAFFTPLEISFSTRWRDFGIFICYVVFNILVLLIAARFLKWQRR

SEQ ID NO: 60913 - protein, 1488 aa, Ashbya gossypii ATCC 10895
MLSHHPSTCPDPQRYMIEATGPQWAKTEGHDSRTSLSGSSAPELVAYGSEAGAEERERLSRVMTLQSMGEARAALDPGMAQKVESLARTLSQHTVRDGRLVVDPADFDMKAILSGLVSASQRQDIPMRQTGVLVEGVTVQGVDSSCVEGHDYGDVLALPLTAVRAVRQAMRRRYRNILESVTLLARPGEMVLVLGRPGAGCTSLLKTVAGETDQFHSVEGAISYDGIPQREMMRRYRAEVVYNSEIDVHFPHLTVKQTLDFALACKTPHMRVNNVSRAEYITLMRELYATVFGLRHTYDTKVGNDYIRGVSGGERKRVSIAEALAANASVYCWDNATRGLDASTALEYAQAMRIMTNLLQSTSLVTLYQASENIYETFDKVLVLFEGRQIYFGDVMSAKAYFEEMGYTCPPRQSTTEFLTALTDTNGYHVVKPGHEATVPRLPEEFEQYWLNSKEYRSLLSEIEDYRREVDAHETRDQLEKFKLKGKSKYTHKRSPFMISFFEQVKLCTIRGFQRIYGDKSFTVINVVSAVVQALITGSLYFSSPSNTSGAFSRGGILYYAILYFSLMGLANINFSNRPILQKHKMYTLYHPSAEALASTISACVFRMIALTLFLIVLYFLSGLTVEAWRFFSIYLFLVLASEGINAMFEVITALSTSLSQANAVAGLVMFGISIYSTYMIQKPSMHPWFAWISYILPIRYAFESMLNAEFHGRHMDCADTYVPTGPGYEGVTPENRVCAFIGSKPSQSWVLGDDYLSVNYEYEYENQWRNLGILIAFWIGFLTLKCLATEYKRPMKGGGDSLVFKKGTLAKRKVQDDSESRNVSGAAESKMVASTVGTDDVFDGLKNDDVFIWRDISFSITHNGDKKKLLDQITGYCIPGTLTALMGESGAGKTTLLNTLAQRNVGVITGDMLVNGLPIDASFERRTGYVQQQDVHVKEMTVRESLQFSARLRRPESVSEAEKMNYVEKIIEILGMSDFADALVGDAGYGLNVEQRKKLSIGVELVAKPSLLLFLDEPTSGLDSQSSWAIVQLLKRLAQSGQAILCTIHQPSATLFEQFDRLLLLQKGGQTVYFGDIGEESRTLLDYFQRNGARPCTPSENPAEYILESIGAGATATTTEDWAELWRNSPECARENEIVNKLVNELSEKYLSNAPAPISKYATSYFYQFRYVVSRTMLIFYRDLDYLLSKQFLFLSAGLFIGFTFYDVGTSYTGLRNTMFAVFMSIITSAPAMNQIQARAIKMKDLYIVRESKSNLFHWSLLLITQYLAELPYQFLFSTIYFLCMFFPMKLGLSARENGIFFLNFCIVFQAYFVGLGLAVLYLAPNLESANVILGVFLSFLISFCGVVQPYYLMPGFWKFMYRLSPYTYFTQNFLGIMLHDRPVRCNSREFSFLDPPNGVTCGEYMQPFVNSVSGYVDNPDATSNCAYCIYRVGDEYLASIGAKYSYLWRNFGILWGYVAFNIIAMLSLYWLFRVKKVTIKNPFKRD

SEQ ID NO: 60914 - protein, 177 aa, Glycine max
  misc_feature (25)..(25): Xaa can be any naturally occurring amino acid
MPSPSDHHRPQPKPNPNLLSLFLKXIIMLFLTSLFFLFLGFAAFLLLNLFLLGGAFHRLRFRPSVTTAPTSSNGLPPREINKLPRFRVANGSETRPDSNCVVCLDAFHNAQWCRKLAACGHVFHRRCVDTWLLKVAACPTCRTPVGFNAGATVHDPPQRSDHLHTCGTDSNALTTLL

SEQ ID NO: 60915 - protein, 226 aa, Marinobacter sp. ELB17
MGQLDYLLEKNRAWAEGIKAQDPQFFDRLSNQQAPEYLWIGCADSRVPANQIVDLMPGELFVHRNVANVVVHTDFNCLSVLQFAIDVLKVKHVLLVGHYGCGGVKAALLNEGFGLIANWLRHVQDVRDRYRHILEPITSVQDRADRLCELNVIEQVDHVCQNSIVQDAWKRGQDLTVHGFVYDLRDGIMRDMGIPISNAVTSEYARQQSVDEMVLRPVRSGRLIKA

SEQ ID NO: 60916 - protein, 430 aa, Deinococcus radiodurans R1
MSNVFYRSSKPYPVAVRGEGVFLYDDAGRRYLDGSSGALVANIGHGRAEVGERMAAQAARLPFVHGSQFSSDVLEEYAGRLARFVGLPTFRFWAVSGGSEATESAVKLARQYHVERGEPGRFKVITRVPSYHGASLGSLAASGMGARRELYTPLMRPEAWPKLPKPDPARNGAEDAEGLRALLEREGPETVAAFMAEPVVGASDAALAPAPGYYERVRDICDEAGIIFIADEVMSGMGRCGSPLALSRWSGVTPDIAVLGKGLAAGYAPLAGLLAAPQVYETVMGGSGAFMHGFTYAGHPVSVAAGLSVLDIVEREDLTGAAKERGAQLLAGLQALQARFPQMMQVRGTGLLLGVVLGDLATGQAFETPGIASRIGAAALKRGLITYPGSGAEPNGRGDHLLLGPPLSITAAEVDELLALLAGALEDVLG

SEQ ID NO: 60917 - protein, 495 aa, Deinococcus radiodurans R1
MTAEPQVSPAPTPPPAAPLLVRDRLFIGGEWVTPCGQGTLEVVNSATEEVMGTVPEGTPEDAERAILAARAAFDSWSQTPAEERAALLERISRGLNERQSEIAALVAQEVGMPFVLSNVIQVGLPAVTFMSMAEEIRQLPAEETLASSLLLREPVGVVAAITPWNYPLHQIAAKVAPALAAGCTVVLKPSEVAPLNAFVLAEIIEAAGAPAGVFNLVTGTGPVVGEVLAAHPEVDMVSFTGSTAAGKRVSELAARTVKRVALELGGKSPYLILDDADLSGEALVQAVMNGIQGCYLNSGQTCSALTRMLVPRSRLPEVEAVAQAVVSQVKVGSPFDAATTLGPLVSDVQRERVRGHIRQGVAEGARLIAGGAESPEGLERGYYVQPTIFSDVTPEMTIAREEIFGPVLVIQPYEDEEDAVRIANATHYGLAGGVWSSDRERAVRVARRLRTGQVSINGGAFNPVAPFGGYKQSGNGREFGRLGLEEFMEVKALQF

SEQ ID NO: 60918 - protein, 227 aa, Pyrococcus furiosus DSM 3638
MVEVKKHKFPGVYVVIDDDGSEKIATKNLVPGQRVYGERVIKWEGEEYRIWNPHRSKLGAAIVNGLKNFPIKPGKSVLYLGIASGTTASHVSDIVGWEGKIYGIEFSPRVLRELVPIVEERRNIIPILGDATKPEEYRALVTKVDVIFEDVAQPTQAKILIDNAKAYLKRGGYGMIAVKSRSIDVTKEPEQVFKEVERELSEYFEVIERLNLEPYEKDHALFVVRKP

SEQ ID NO: 60919 - protein, 512 aa, Arabidopsis thaliana
MSFSVVAALPVLVAVVVLWTWRIVKWVWIKPKMLESSLKRQGLTGTPYTPLVGDIKRNVDMMMEARSKPINVTDDITPRLLPLALKMLNSHGKTFFIWIGPLPTIVITNPEQIKEVFNKVNDFEKASTFPLIRLLAGGLASYKGDKWASHRRIINPAFHLEKIKNMIPAFYHCCSEVVCQWEKLFTDKESPLEVDVWPWLVNMTADVISHTAFGSSYKEGQRIFQLQGELAELIAQAFKKSYIPGSRFYPTKSNRRMKAIDREVDVILRGIVSKREKAREAGEPANDDLLGILLESNSEESQGNGMSVEDVMKECKLFYFAGQETTSVLLVWTMVLLSHHQDWQARAREEVMQVLGENNKPDMESLNNLKVMTMIFNEVLRLYPPVAQLKRVVNKEMKLGELTLPAGIQIYLPTILVQRDTELWGDDAADFKPERFRDGLSKATKNQVSFFPFGWGPRICIGQNFAMLEAKMAMALILQKFSFELSPSYVHAPQTVMTTRPQFGAHLILHKL

SEQ ID NO: 60920 - protein, 480 aa, Candida glabrata CBS 138
MKVLLTHTTRSLHTSRILSSSTASSLKQRLKEVIPDKREKFTKIKKNYSDVKVGDITIGSVIGGMRGNQSMFWQGTSLDPEEGIRFQGLSIPECMDQMAGISEIHGGSKSLLPESMLWLLMTGELPTKEQTNSLSKELAERGKILPQSVNTIVSNLPKDMHPMTQLAIGLASLNQYSQFAKEYEKGSIGKNDYWDFIYEDVLNLIASLPHLTGQIYANITNEGKPLGEFNENADWAYNISSLLGMTTEASSANKQNLSEKRAQDFADLVRLYTAIHVDHEGGNVSAHATHLVGSALGDPFISYASGIMGLAGPLHGLAAQEVVRFLVEMNASISSPENVPEIENYLWSILNSRRVVPGYGHAVLRKPDPRFNAMLNFAKERPDEFQSDKNVLLMENLSTIAPKVLQEHGKCKNPFPNVDSASGILFHHYGIQETLFFTVIFGCSRAIGSLTQLVWDRILGLPIERPRSLDMAALERLCNK

SEQ ID NO: 60921 - protein, 926 aa, Arabidopsis thaliana
  misc_feature (21)..(21): Xaa can be any naturally occurring amino acid
MLSSIGCNMFVPSTFCSVSSXEFVSIDCGCSSNYTDPRTGLGWVSDSEIIKQGKPVTLANTNWNSMQYRRRRDFPTDNKKYCYRLSTKERRRYIVRTTFLYGGLGSEEAYPKFQLYLDATKWATVTIQEVSRVYVEELIVRATSSYVDVCVCCAITGSPFMSTLELRPLNLSMYATDYEDNFFLKVAARVNFGAPNMDALRYPDDPYDRIWESDINKRPNYLVGVAPGTTRINTSKTINTLTREYPPMKVMQTAVVGTQGLISYRLNLEDFPANARAYAYFAEIEELGANETRKFKLVQPYFPDYSNAVVNIAENANGSYTLYEPSYMNVTLDFVLTFSFGKTKDSTQGPLLNAIEISKYLPISVKTDRSDVSVLDAIRSMSPDSDWASEGGDPCIPVLWSWVNCSSTSPPRVTKIALSRKNLRGEIPPGINYMEALTELWLDDNELTGTLPDMSKLVNLKIMHLENNQLSGSLPPYLAHLPNLQELSIENNSFKGKIPSALLKGKVLFKYNNNPELQNEAQRKHFWQILGISIAAVAILLLLVGGSLVLLCALRKTKRADKGDSTETKKKGLVAYSAVRGGHLLDEGVAYFISLPVLEEATDNFSKKVGRGSFGSVYYGRMKDGKEVAVKITADPSSHLNRQFVTEVALLSRIHHRNLVPLIGYCEEADRRILVYEYMHNGSLGDHLHGSSDYKPLDWLTRLQIAQDAAKGLEYLHTGCNPSIIHRDVKSSNILLDINMRAKVSDFGLSRQTEEDLTHVSSVAKGTVGYLDPEYYASQQLTEKSDVYSFGVVLFELLSGKKPVSAEDFGPELNIVHWARSLIRKGDVCGIIDPCIASNVKIESVWRVAEVANQCVEQRGHNRPRMQEVIVAIQDAIRIERGNENGLKSSSSSSSKAQSSRKTLLTSFLELESPDISRNSLAPAAR

SEQ ID NO: 60922 - protein, 465 aa, Mesorhizobium loti MAFF303099
MHLPNAWTGALPARSLATPKELDVAGAQAFLEQADVRYVLAQFVDLYGVAKSKAVPVQHLDCLLTEGAGFAGGAPCGLGLLPHEAEYMVVCELDTLTVTPWAPGYARMLGVGTVKGAPHPVDTRNVLKTQVASLAERDWTLNTGLEPEFLLLRREPDGKLSPFDRTDTLTKPAYDYRGLMRGRNVLERVTECLQAVGIDVYQIDHEDANGQYEINFKYADALKTADQIVFFKMAVSEIAHDLGAICSFMPKPRSSSTGNGMHIHCSIADGDGRNLFHDDADPNGMGLSKLAYHFLGGVLAHAKGLTALLAPTVNSYKRLVVGGTVSGATWAPACIVYGYNNRTAMVRIPYGRLEIRTGDSSMNPYLATAALIAAGLDGIEQKLEPGAPRNVNFYGLTLEAIKEMGVDLLPQTLTEALDALEADQLFAGTLGKPVIEQFLSLKRSEWLEYHCHVSDWEVERYLNFF

SEQ ID NO: 60923 - protein, 308 aa, uncultured archaeon
MTEKKEYYKTLGVDRGSSQDEIKRAYRRLAKKYHPDLNKENHKESEEKFKEVSEAYEVLSDTQKRANYDKFGSAGVDFGRGGFEWSNFTRFSDVEDIFGGLFKDLFGGNFGRAQGGSSMFDDLFGRGHTGADAGYRPERGSDIQYDLEIDLEDAAMGMEEEISIARLDFCPNCSGTGANAGGLETCATCRGTGQVKRVQRQGFAQFISIGSCPRCRGTGKEIKDPCENCNGNGKIKVNKKILVKMPAGVDTGSRLRIAGEGNAGERGGPPGDLYVMIHVREHEFFKERATTCFVMLLFTSRRRCLAMR

SEQ ID NO: 60924 - protein, 459 aa, Cryphonectria parasitica
MADVSQRTQQAVDTAMAGAAEMSRYGRRLLNMLWDPEPTNDRSLNRPVWCLGCSYTNEPTTVDRPDQDASSTVRATLPTTPSTTTLPYPLKAVPTTPPESSSSSFSSSLAYDELLEDAGWPIAFLDDFESRVWMTYRSEFEPISKSNDPRASAALSFAMRLRTLADQGGFSSDTGWGCMIRSGQSLLANTLVICQLGRDWRRGKAARQEREILARFADDPRAPYSLHNFVRHGAVACGKFPGEWFGPSATARCIQALANSNESSLRVYSTGDLPDVYEDSFMAVAKPDGETFHPTLILVGTRLGIDKINQVYWEALTATLQMPQSVGIAGGRPSASHYFIGAQRSGDAYEPGSYLFYLDPHCTRPALPFHEDVDQYTSDDINTCHTRRLRRLHVRDMDPSMLIGFLIKDEDDWDMWKDSVKYVQGKTIINVADHDPARGMPAEREAAIDEVETLKGEFV

SEQ ID NO: 60925 - protein, 335 aa, Shewanella sp. MR-7
MRNRVLCFGEALIDFLTIGNSEDDGLKLPSFRQYPGGAPANAAVAVAKLGGDARFAGLVGNDKFGDFLAEALARYGVDISLLGRHDTAPTSLAFVHLDDTGERSFSFYRDGGADTLFDATTVDSNWFENTSILHLCSNTLTTTQCAETTLEIAERAVTTGVTLCVDVNLRHNLWSQGKACKETVMRLVSKAHVLKFAKEELEYLAGKEATQFIDMLLSLGCRLVLVTDGGNPISAYANQRSLTLTPPKVKVADTTAGGDGFIGGLLYRISSCGLDALLADETALKQALTFAIACGALAVSRPGAFPALPVLAEAEGFSTELGALFADKTFTDFIF

SEQ ID NO: 60926 - protein, 109 aa, Lactobacillus reuteri
MCGIVAFVDNEKPQIKDQLIKKMKDRIIHRGPDAEGQYVDDDVALGFRRLSFIDVKSGNQPIFNEDSSKAIEFNGEIYNFEELREELISKGHTFKTHADTEVIDHCQQV

SEQ ID NO: 60927 - protein, 576 aa, Oryza sativa (indica cultivar-group)
MAVEGRRRVPLPLPPPTRRGKQQQQQGGERARRVQAGDALPLPIRHTNLIFSALFAASLAYLMRRWREKIRTSTPLHVVGLAEILAICGLVASLIYLLSFFGIAFVQSVVSNSDDEEEEEDFLIDSRAAGPVAAQATPPPAPAPCSLLGSACAAPKKMPEEDEEIVAEVVAGKIPSYVLETRLGDCRRAAGIRREALRRTTGREIRGLPLDGFDYASILGQCCELPVGYVQLPVGVAGPLVLDGERFYVPMATTEGCLVASTNRGCKAIAESGGATSVVLQDGMTRAPVARFPSARRAAELKGFLENPANFDTLAMVFNRSSRFARLQRVKCAVAGRNLYMRFSCSTGDAMGMNMVSKGVQNVLDYLQDDFPDMDVISISGNFCSDKKSAAVNWIEGRGKSVVCEAVIKEEVVKKVLKTNVQSLVELNVIKNLAGSAVAGALGGFNAHASNIVTAIFIATGQDPAQNVESSQCITMLEAVNDGKDLHISVTMPSIEVGTVGGGTQLASQSACLDLLGVKGANRESPGSNARLLAAVVAGAVLAGELSLISAQAAGHLVQSHMKYNRSSKDMSKVAS

SEQ ID NO: 60928 - protein, 131 aa, Triticum aestivum
  misc_feature (70)..(70): Xaa can be any naturally occurring amino acid
  misc_feature (81)..(81): Xaa can be any naturally occurring amino acid
  misc_feature (90)..(90): Xaa can be any naturally occurring amino acid
  misc_feature (99)..(99): Xaa can be any naturally occurring amino acid
  misc_feature (101)..(101): Xaa can be any naturally occurring amino acid
MAPTVMASSATSVAPFQGLKSTAGLPVSRRSSSAGLGSVSNGGRIRCMQVWPIEGIKNSETLSYLPPSPXEASLKQVDYLXRSNWVPCLXFNKLVPFPXRXHSPGYMAILAWNCYFGSTKVSVRRYLSVTA

SEQ ID NO: 60929 - protein, 135 aa, Arabidopsis thaliana
  misc_feature (25)..(25): Xaa can be any naturally occurring amino acid
  misc_feature (88)..(88): Xaa can be any naturally occurring amino acid
  misc_feature (108)..(108): Xaa can be any naturally occurring amino acid
VPQAGRIYSFPEGNFPMWGDKLKKXLFFFKAPGPIGNPFSPRDIGSLVGNFPRAFLYGGIYGDPRDPKSKNGKLRLLYKGAPISFFFXQTGGKGFYGPFKGLKIPPPXKHQRVPLSLGSPKEVKNLGKDLALVMD

SEQ ID NO: 60930 - protein, 218 aa, Vitis vinifera
MNTTSPPYSDPHPLVCNWDSLNLPDSDGGSEELMLASTHPKKRAGRKKFRETRHPVYRGVRRRNSGKWVCEVREPNKTSRIWLGTFPTAEMAARAHDVAALALRGRGACLNFADSAWRLHVPSSRDAKDIQKAAAEAAEAFRPMENDGVMQDERREESEVRTPDNVFVMDEEDVFGMPGLLVNMAEGLLMPPPHSVADGYGGDDMAADADMSLWSYSI

SEQ ID NO: 60931 - protein, 224 aa, Arabidopsis thaliana
MDSSMSTKKKTKLSVRNQTCFKKSSLSSSSTAKKTTNLSMREETMFKKALELSTLCDIEVCVIYYGRDGELIKTWPEDQSKVRDMAERFSKLHERERRKKRTNLSLFLRKKILDDNKLSEKVLEMKDSLESGLRVLQDKLLLLQPENQTELGQSRAVSSTTNPLSSPEDHHHQQWTEPLVTGVSNTEQDLSTSPLSNHQSKYSVFVYNHDSGSFYQVPDSICFG

SEQ ID NO: 60932 - protein, 266 aa, Sinorhizobium meliloti 1021
MSHGISNGAEEGPALESSSSRRDLRPVPHRSPWRFLPISLLLAGGVLGYAYGLQDYVSLSALADQRETLAAHVAAHPVSSALVFFAIYVAVVVFSIPAASVLTISAGFLFGCLAGAAITVLAATLGACLLFIAARGAFSDILRRRAGGVLERLADGFRDNAFLYLLILRLAPIFPFFLINIAPAFFEVKLRTYALATLIGIIPGTLAYTWLGRGLGDVIALAAASGREFTVADFATRDISLALVALASIAALPLAFRVIQSRRKGA

SEQ ID NO: 60933 - protein, 293 aa, Erythrobacter sp. NAP1
MFSGSIPALATPFRDGSFDESAFRKLVDWQIENGSSGLVPCGTTGEASTLSNAEHHRVIEVCIEQAAGRVPVIAGCGSNDTRNAALHMNFAKKAGAAAGLCVAPYYNRPSQAGLIAHFSYLAESCDLPIVLYNVPSRTVTDLEDETVVELVNRFPDKIIAIKDASGDLSRVADHRMGIGREFCQLSGNDELWLPHSAAGGRGAISVTANVAPALCSEFHAAIAANDLKKARELNDRLFPLHYAMFSDASPAPVKYALSRVHDWFSPAVRLPIVEASEASRKAVDDALEHAGLI

SEQ ID NO: 60934 - protein, 428 aa, Geobacillus kaustophilus HTA426
MQWTKSEQLYKEALQHIVGGVNSPSRSYKAVGGGAPVVMERAQGAYFWDVDGNKYIDYLAAYGPIIAGHAHPHIAEAIRRAAETGVLYGTPTPHEITFAKMLKEAIPSLEKVRFVNSGTEAVMTTIRVARAYTGRSKIVKFEGCYHGHSDLVLVAAGSGPSTLGTPDSAGVPPSIAQEVITVPYNDVESFREAMNVWGEQVAAVLVEPIVGNFGIVLPKPGFLEAINEIAHKEGALVIYDEVITAFRFMYGGAQNLLGVEPDLTAMGKIIGGGLPIGAYGGRQDIMEQVAPLGPAYQAGTMAGNPASVLAGIACLEVLKQEGVYEHLDRLGAMLEEGILAHARQCGLPVTVNRLKGALTVFFTDEKVENYKQAQRSDGELFAKFFKLMLKQGINLAPSKYEAWFITLAHTEDDIAYTIDAVGKAFRQL

SEQ ID NO: 60935 - protein, 385 aa, Arabidopsis thaliana
MAGEEIEREKKSAASARTHTRNNTQQSSSSGYLKTLLLVTFVGVLAWVYQTIQPPPAKIVGSPGGPTVTSPRIKLRDGRHLAYTEFGIPRDEAKFKIINIHGFDSCMRDSHFANFLSPALVEELRIYIVSFDRPGYGESDPNLNGSPRSIALDIEELADGLGLGPQFYLFGYSMGGEITWACLNYIPHRLAGAALVAPAINYWWRNLPGDLTREAFSLMHPADQWSLRVAHYAPWLTYWWNTQKWFPISNVIAGNPIIFSRQDMEILSKLGFVNPNRAYIRQQGEYVSLHRDLNVAFSSWEFDPLDLQDPFPNNNGSVHVWNGDEDKFVPVKLQRYVASKLPWIRYHEISGSGHFVPFVEGMTDKIIKSLLVGEEDVSESREASV

SEQ ID NO: 60936 - protein, 555 aa, Yarrowia lipolytica CLIB122
MSKQPTNPLMRSKKYDSPLRRDRPSLRPQMRKGPINIPARPGHKFIQSTPGVKKEENEPKYKEYSLVAASKDELKDLRYHIMRLHSIKNVDPGADFTPPIKLHRKDPRNLQFQATQEEQAAESNADSGAEEGTEPVKREQADLSKIAPDGGARHAKKNQFNKKAKQVIHRDEDAKKLRYEEYYPWVMEDYSGKNTWVGNYEAAQSDSYCVFVFHGNGFKMVPVEKFYKFTPRNQYATLTLEEAEKRMADSVKAGTPRWLMKHMSPEMQQSRMRDQRPRKFQTVDSGGPVDDDDGLSRRRERDDEDLDFDHVFDDDEEAPIMDGDEEDQKEVERKMKNEHRSAAVLKDDNHDDMGDLFGEEEEEKMDKEGRKLKKYLRSLEKNAHYDSDDDENPYASSSEDDDDEEDGIKKEDPVKKEEDLAIKEEPMPLFVKKNITGLPRGMAVIQLPPHVLAKFTRGVWNPNAKRPREAGGESGDAKRPRTADADLPPPFGPNDTVLSDDIILNTLRSRPPMAVQDLLRILMPIMRKDADNKARLTACLKKHAKVQNGVLVLRE

SEQ ID NO: 60937 - protein, 456 aa, Bacillus licheniformis ATCC 14580
MANKELKRGLGARHIQMIALGGTIGVGLFMGSSSTIKWTGPSVLLAYAICGIFIFFIMRAMGEMLYVEPSTGSFATFGHQYIHPLAGYMTAWSNWFQWVIVGMSEIIAVGEYMKYWFPDLPAWIPGIIAMAILGGANLVSVKSFGEFEFWFAMIKIVTIVLMIAAGFGIIFFGFGNGGQAIGFSNLWSHGGFFTGGFSGFFFALSLVIAAYQGVELIGITAGEAKDPQNTLRHAIQSIIWRILIFYIGAIFVIVTVYPWDELNAIGSPFVSTFAKVGITAAAGIINFVVMTAAMSGCNSGIFSAGRMLYTLGVNGQAPKFFTKISRNGVPLYGTIAVLIGLAIGVVLNYIAPPNIFVYVYSASVLPGMIPWFVILLSHIGFRKAKGAEIDKHPFKMPFAPVTNYLTIGFLLMVLVGMWFNNDTRVSLIVGVIFLAVVAASYYVFGIGKRASADGNK

SEQ ID NO: 60938 - protein, 416 aa, Erythrobacter sp. NAP1
MADTTLMTIPGQVDPVPVARDITPRADGRIDLIGLPRPRIRELFAEAGLDERQAKLRAKQVFHWLYHRGVTDFEAMTDISKTMRPWLAERFVIGRPNIVEAQHSSDGTRKWLLQTDDGHDFEMVFIPDADRGTLCVSSQVGCTLNCTFCHTGTMRLVRNLTPGEIVGQVMLARDALGEWPKGVMDGLDEAEDVGHYTADGRLLTNIVMMGMGEPLYNFDHVRDALNLVMDGDGLALSKRRITLSTSGVVPAMERCGEEIGVNLAVSLHAVTKDVRDEIVPLNKKYGIEELLQACADYPGASNARRITFEYVMLKDKNDSDEDARELVRLLRKFDLPAKVNLIPFNPWPGANYECSTPERIKAFSNIVFEGGISAPVRTPRGRDIDAACGQLKTAAQKKSRAERDREAAAAALASED

SEQ ID NO: 60939 - protein, 321 aa, Glycine max
MMMMMSRSGANRVANTAMFVAKGLSGEVGGLRALYGGGVRSESTLALSEKEKIEKKVGLSSAGGNKEEKVIVSYWGIQPSKITKKDGTEWKWNCFRAWGTYKADLSIDLEKHMPPTTFLDKMAFWTVKVLRYPTDVFFQRRYGCRAMMLETVAAVPGMVAGMLLHCKSLRRFEHSGGWFKALLEEAENERMHLMTFMEVAKPKWYERALVITVQGVFFNAYFLGYLLSPKFAHRMVGYLEEEAIHSYTEFLKELDKGNIENVPAPAIAIDYWQLPPGSTLRDVVMVVRADEAHHRDVNHFASDIHYQGRELREAAAPIGYH

SEQ ID NO: 60940 - protein, 175 aa, Streptomyces coelicolor A3(2)
MQQLHTPHVVVVMGVAGTGKTTIGPLLAARLGVPYAEGDDFHPPANIAKMTAGTPLTDEDRWPWLDAIGGWAHGRAGLGGVVSSSALKRSYRDRLRAAAPGVVFVHLTGSRELIEDRMSHRQGHFMPTALLDSQFATLQPLQPDEAGVAVDVAGTPEEITERAVDALKGLPGPVQ

SEQ ID NO: 60941 - protein, 695 aa, Oryza sativa (indica cultivar-group)
MGWWGEPAALHSERGFPVEGSVAAWNFGRLLRCSVYIWSRSGCLIGSRDCGTDTAGILLEMGGYEYATNGYHRGMEDDYEDEYYSEDPYDEEGEGAGQEYAEEDDEPPEGQQEFLQIRERLKEQIRRKAQAASASAAGRSSSSHDRKPQSTFGSFFGPSKPVISQRVIEERKSLKELQNTASMSRDRRPSAKEIPSSSKVQSKTNGHHHKQKIVNEAKRKAEALKDNRDYSFLLSDDADISPSPMEKPVARSSLSQKSDRESTHSAVKSRAPTGQTARLSNGYGLKNTSSSQRHTEGRVDSNRKVAGANRERVVLPDNGRMHSVVRNGSTQATTSKAASQKLPSKAPIANRPPIKSVSDQSLRANHSASKQLLSQNGRPQSSQSQRMQSTSHGQRPHQPVQSQRPLQSLQGRRPQQSPQNTRPQLMSKSQRPQQSLQRQRPQLSSQNERLESSERQRPPSQSYRPQSSQGQRPSSVQGRQYSEQRRIQANDRVKSAERQIRPPSKPMPSRQIPSNGMRDAHAKKKQPMKRRFNDLSEDEEDPLAMIRSMFRYDPSKYAGRDDDDSDMEADFATIEMEEQRSARIAKEEDDEQLRLIEEEERREQERKRRKMAWNHAYAALPAVPPSRSIRSVPEMAEGIGRSLDLQYGLGEDSYTNVLLAFESLPWRCRCMRASTVMKYADHVQNFRYSATPRRF

SEQ ID NO: 60942 - protein, 253 aa, Streptomyces coelicolor A3(2)
MTAHPLFDIGGRTALVTGSSRGIGLALARGLAEAGCRVILNGRDGDRLAKAAAGLPGEVHTAVFDVTDGPSVTAGIAEAEERVGPLDILVNNAGMQLRAPLLEFADADWHRILDTNLTTAFLVGREAARRMTERGHGKIVNICSLQSEVVRPGIAPYAATKGALKMLTKGMCADWGPYGVQVNGLGPGYIETELTRPLVEDEEFSTWVRGRTPAGRWGRTEDLVGGLLFLASPAADFVGGQILYVDGGMTSVL

SEQ ID NO: 60943 - protein, 358 aa, Streptomyces coelicolor A3(2)
MSAGERVPEEFVPGCVIHGAGDLRVTDVPVRPPGPGEALVAVRYGGVCGSDLHYWRHGGVGDFHLREPMLLGHEVVGTVVAYGSPDTPGPAAGTSVAVHPATPCGVCPECVDRRRNVCRDTRYLGSAARFPHVQGGFAARIVVPAGQLRPLPAGLDPRRAALAEPLSVALHAVRRAGDPAGRHVLVTGAGPIGCLVVAAAKAAGAAHVTVTDLLPAALEYARAAGADTLVRADDPDDAGWPVEVDTAVEASGVAAGLDTCLRLVRRGGVVVQLGMLPPGQSPFAGNLLVSREIELRGAFRFDGEFDDALRLLAAEPAFDALVSAVVPVRDAASAFELAADRSRSCKVLLDFGAAPAAV

SEQ ID NO: 60944 - protein, 628 aa, Coccidioides immitis RS
MALMLSACAGTPPTGQPPPLNPRDILLHYDIVGHLRRRGGREVGNDLTESRGRELQLSSSHQVNGLAEGVNLFVLSCSPSFGNPCFLLEYHARSAAERPTWPTSNNKRDKSLSFYSSQWRVTTVQSFDRVFAFSGMFALFSAGLVVAFFIYDASTYANEPVVEDIPVSEMALNPRRGGPKSLPIADVLIDDSDSDDKEAQKDKPKLVILGTGWGSVALLKSLNPGDYHVTVVSPTNYFLFTPMLPSATVGTLGLRSLVEPIRLIVQRVRGHFLRAEAVDLDFGEKLVEVSQVDCNGVRQNFYLPYDKLVIGVGSTTNPHGVKGLEHCNFLKSIDDARQIKNKILHNLELACLPTTSDAERKRLLSFVICGGGPTGVEFAAELFDMLNEDLFRSFPKILRNEISVHLIQSRSHILNTYDETVSLYAERRFAHDQVEVLTNSRVKEVRPDRILFTQMENGKPVTKEIPMGFCLWSTGVSQTEFCQKISKKLKGQNNRHALETDTHLRLLGAPAGDVYAIGDCSTVQNKVADHLVSFLRTVAWEKGRDPEKVHLTFKEWRDVASRVKKRFPQASNHLRRLDRLFEQYDKDRSGTLDFDELHELLSQIDTKLTSLPATAQRANQQVFILLKA

SEQ ID NO: 60945 - protein, 386 aa, Pseudomonas fluorescens PfO-1
MERCEALVIGLGAMGAATVYQMAKAGVNVVGIDRHHPPHTFGSSHGDTRITRLSVGEGAQYVPIVRNSHRIWRELEALSGESLFEQSGLLVLTSSPDLDPADETDFTLRTIALAQTYGIEHEVFDAAQIRQRFPQFAQVRDDAIGYFEPEGGFVRPERCIDVQLRLAEQHGATLYKGETVTHISSDEQGVTVTTDQRTVRAAKLVVTAGNWAGGLLGAPFDRLLSVYRQKLFWFETEPDAGLVGHSPTFIFTHGPDDDFYGFPALPGEGSLKVATAQYHSTSTPETLDRTVSAEEEREMYEQQVKGRIAGLTDRVVKSAVCAYTVTPDRHFIIDEHPRLQHTLVVSACSGHGFKHSAALGEAFAQWCLRGESELDLSLFSVGRFEA

SEQ ID NO: 60946 - protein, 156 aa, Oryza sativa (japonica cultivar-group)
MAGSGSGTPCASCKLLRRRCTSECVFAPYFPAEEAQRFAMVHRVFGASNVSKMLLDVPPPQRPDAVSSLVYEANARMRDPVYGCVAAISFLQNQVSQLQMQLALAHAETAALQLQLQQQHQDQDDHHHQQCILENAAAHHQLMLQEAFLKKESMWT

SEQ ID NO: 60947 - protein, 290 aa, Dechloromonas aromatica RCB
MAPSQLTAGSPAPDAMQTSPSTTLQQQDLSIAGPAGPLALRLYRPSLARVVLPVVLYFHGGGFVGGSLDDADAAAGFIAEHTPALVVAVDYALAPARPFPAAPEDAHAAALWTAAHAAELGGDPARLAVAGDDAGGNLAAALTLIARDRNGPAIAAQALVGPMLDPSMTRLGDGVRLNSDLSAATCASCYSQYLPQSRQRLHPYASPLASVRQAGLPPALIVTAECDVLHNEAEKYAAALIAAGVPTQVVRFAGVNHATLASHRPALAEIAHFLRRRLWDAEAPAHPLNL

SEQ ID NO: 60948 - protein, 437 aa, Coxiella burnetii RSA 493
MHSRFQKGKIPNSVLKRDLGLIGATMMGLGSIVGTGIFVSIGVAAGVTGPSVVLAIVLAALVATCNALSSAQLAASHPVSGGTHEYGYRYLHPALGFTAGWMFLCAKIASAATAALGFAGYLLHLLGITSISMIPIAVSIAILLTLLVLSGLKKSNLANLIIVSIILISLITFVLSGLPHLFSMGLPHFKPFFPTAAPSGLRNFLYATALMFVAYTGYARIATLGEEVKNPKRFIPQAIILTLIISAVLYIAVAVVAISIVGADHLSQAAQNRATPLETAARALNRRGLDIILAFGACTAMLGVLLNLMLGLSRMALAMGRKRDLPSMFGTLSKKQRTPSAAILGVGLAIIGLSLIGNVEITWAFSAFTVLIYYFITNLAALQLPKADRLYPRIFPVGGLIACLFLAFWVPLMIWSIGIGLIAVGLAWKYFMARLWI

SEQ ID NO: 60949 - protein, 383 aa, Oryza sativa (indica cultivar-group)
MEAERSRPYGPTAKDRIDETTPICATHLSRLGPVNYIFARSRRELRPPFAPLLYRCCQAHHRKSCKKPMGNSKTPQPSKKSRIMLSDTDGHQLDNDEFSSESASNQMVLFNPETVAKGQDELGENHSPSLQKSANNPNRGMPSIGAFTVQCAKCFKWRLIPTKEKYEEIRECIIQEPFECERAREWRPDVTCNDPEDISQDGSRLWAIDKPNIALPPPGWERQIRIRGEGGTKFADVYYTSPTGRKLRSLVEIDRYLLENPDYVAQGVTLTQFSFQIPRPLRQDYVKKRPKIVNPNDEASVVTTKSVKPEEVSPIAWAAPSVHQEGEAGKRASHADEPPEAEELELTRKRKAESPLFEEAHSNHVSDEPKTKLEDTQNGGPSA

SEQ ID NO: 60950 - protein, 461 aa, Xylella fastidiosa 9a5c
MGPELFCESRYRDDNPMVLWYCSLLWLLTGPMTAIAKIYAREILDSRGNPTLEAEVTLENAVCGRAAVPSGASTGTKEAVELRDGDKTRYLGKGVRAAVDNVNGVIAAALVGFDGADQTGLDHRLINLDGTENKGRLGANALLGVSLATAHAVAAARKQPLWMYLSTLGESKVSLPVPMMNIINGGAHADNNVDFQEFMVLPVGFASFSEALRAGTEIFHALKSVLKGQGLSTAVGDEGGFAPDLRSNVEALDAILEAIGRAGYIAGEDVLLGLDVASSEFRDNGKYNLVGENKRLTSEQFVDFLDDWVTQYPIISIEDGLAEDDWAGWKQLTERIGHKVQLVGDDLFVTNPKVFQEGITSGIANAILIKLNQIGTLTETLESIAMAHRAQYAAIVSHRSGETEDTSIADIAVATTATQIKTGSLCRSDRVAKYNQLLRIEQALGVGARYAGRDAFVSLKS

SEQ ID NO: 60951 - protein, 377 aa, Arabidopsis thaliana
MADGEDIQPLVCDNGTGMVKAGFAGDDAPRAVFPSIVGRPRHTGVMVGMGQKDAYVGDEAQSKRGILTLKYPIEHGIVNNWDDMEKIWHHTFYNELRVAPEEHPILLTEAPLNPKANREKMTQIMFETFNAPAMYVAIQAVLSLYASGRTTGIVLDSGDGVSHTVPIYEGYALPHAILRLDLAGRDLTDALMKILTERGYSFTTTAEREIVRDIKEKLCYIALDYEQELETAKTSSSVEKNYELPDGQVITIGSERFRCPEVLYQPSMIGMENAGIHETTYNSIMKCDVDIRKDLYGNIVLSGGTTMFPGIADRMSKEITALAPSSMKIKVVAPPERKYSVWIGGSILASLSTLQQMWIAKAEYDESGPSIVHRKCF

SEQ ID NO: 60952 - protein, 200 aa, Legionella pneumophila subsp. pneumophila str. Philadelphia 1
MPINLYSKAVFLKSAARVNQLPEDSGYEVAFAGRSNAGKSSALNCLTNNKNLARTSKTPGRTQLINLFSLDEQRRLVDLPGYGYAKVAMEVKLEWQKNLAHYLEARQCLRGLILLMDVRHPLKDLDQILVNWALHRELPVHILLTKADKLSRSEVKNAVLKVRQYYELAEHLVSVQAFSSVKKDGVEELISLLDRWYEWN

SEQ ID NO: 60953 - protein, 294 aa, Triticum aestivum
  misc_feature (224)..(224): Xaa can be any naturally occurring amino acid
  misc_feature (237)..(237): Xaa can be any naturally occurring amino acid
HSITSLYKKAGWYRSGIPGISSTHASAGSTKVGQMVQQQVSARFGKCLLELSGNNAIIVMDDADIPLAVRSVLFAAVGTAGQRCTTCRRLLLHESIYQTFLDQLVEVYKQVRIGDPMEKGTLLGPLHTTTSKESFLKGIQTIKSQGGKILLGGSAIESEGNFVQPTIVEISPDAPVVREELFGPVLYAMKFLTLKEAIEINNSVPQGLSSSIFTRKPDAIFKWXGHHGSDCGIVIVXMFIPTNGAEIGGAFGGEKATGGGREAGSDSWKQYMRRATCTINYGSELPLAQGINFG

SEQ ID NO: 60954 - protein, 253 aa, Arabidopsis thaliana
MASNFWTSTHYKELKDPEEVNVVHPLDAQRGISVEDFRLIKLHMSNYISKLAQHIKIRQRVVATAVTYMRRVYTRKSLTEYEPRLVAPTCLYLACKAEESVVHAKLLVFYMKKLYADEKFRYEIKDILEMEMKVLEALNFYLVVFHPYRSLPEFLQDSGINDTSMTHLTWGLVNDTYRMDLILIHPPFLITLACIYIASVHKEKDIKTWFEELSVDMNIVKNIAMEILDFYENHRLFTEERVHAAFNKLATNP

SEQ ID NO: 60955 - protein, 305 aa, Miscanthus sinensis var. condensatus
IESVGEGVTDVAPGDHVLPVFTGECKECAHCRSAESNMCDLLRINTDRGVMIGDGKSRFSINGKPIYHFVGTSTFSEYTVMHVGCVAKINPEAPLDKVCVLSCGISTGLGASINVAKPPKGSTVAIFGLGAVGLAAAEGARIAGASRIIGVDLNPSRFEEARKFGCTEFLNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSVPFAEINKAFDLMAKGEGIRCIIRMEN

SEQ ID NO: 60956 - protein, 916 aa, Candidatus Kuenenia stuttgartiensis
MNSSLLFRNRKIKNPLLKNVHNRLDEAIEVIREKDPVFYKNCHKLFPVLKTPEHVWKIPLEFYTDGGVKLVLRITVVFHNLALGPPKGGILLIPPHILGDGFFELFDQLRKQKTSLDEIREFCFEWVSEGIEALSIVTTLKLALYSLPLGGGMCGIFLGKPEYDRGELFLKSIDLTNNEKRRLVREVGYLLTKEGIMGYDAYSPGPDIGTDGAMMDSIADGHFRALTEMEKIREKGLLEKLKSIRDAEIVWTVDLPYLKTAAAFAKEIKIPAEAKRSVPELGAVTFKTHGGLAGRGEATAFAAVEITNILVWHNEDPKDYLKVRIGRERKNYLAEKTVVIHGFDNIGLNASQFFSRKGAKVVAVSEYERREKKLVAVYNYEGIDVDALIRHKETCGGIYGFRGASVYAEPYQLLNEKVDIVFLAAIENQIHDHNAESIQARYVISAANAGISQEGYHILIKKGKIVARDSIVKSGGIIASYLEKIQNAQNDYWEKEYVFKDIISRIENVLKNNVFKNLVEKHSIDLSVAGDVAAIKRITSTMEAKNAPQKKMKDKKPLIIGIFDSGQGGIIVTEKLNRILPVGNIKLLLFTDKANFPFGQKSKEEINDITFRAVHEINERCKTMHQSNGFFYRFIYNTPYFLKTVFIWLGIIPRDVIVCFACNTVDTMVNHKKLRIRFPHIQFIGPVKKTLLKINALPKDARIGIIGTVGTIKSGIYEKRIREAGYHVLAKPTPLLAVLSEMLYKKSFDTEEKQKEFYKTARDLIYVNLKEFIKKNTISHLCLACTHYDYLKSTLKDLFGEVEFISTVETVIEEVQDIINQIPLQMGERELEFIKRARKGKDLDRLILEDIISSQNLSPEEKVKLGDREDQIKNILQNKLEGITADEIEEMKFFDSNSVKVKYNGKERLVSLFHLQ

SEQ ID NO: 60957 - protein, 305 aa, Miscanthus sinensis var. condensatus
IESVGEGVTDVAPGDHVLPVFTGECKECAHCRSAESNMCDLLRINTDRGVMIGDGKSRFSINGKPIYHLVGTSTFSEYTVMHVGCVAKINPEAPLDKVCVLSCGISTGLGASINVAKPPKGSTVAIFGLGAVGLAAAEGARIAGASRIIGVDLNPSRFEEARKFGCTEFLNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSVPFAEINKAFDLMAKGEGIRCIIRMEN

SEQ ID NO: 60958 - protein, 392 aa, Triticum aestivum
GLVWFGFGVQEEARGVGRLRHRRLANLIGYCCDGDERLLVAEFMPNDTLAKHVFHWENQTIEWAMRLRVAYHIAEALDYCSNEGRPLYHDLNAYRVLFDENGDPRLSCFGLMKNSRDGKSYSTNLAYTPPEYLRTGRVTPESVIFSFGTVLLDLLSGKRIPPSHALDMMRGNNIQMLMDSHLEGNYSTEEATALVDLASQCLQYEARDRPNTKKLVNILEPLQTKLEVPSYEMLGIPKHEEEVPPPPTPQPPQHPLSPCLNTIKWELEGGNELSFQEWTQQMRDMLDARKRGDLAFRDKDFKTAIECYTQFVDVGTMVSPTVYARRSLCHLMCDQPDAALRDAMQAQCVYPEWPTAFYMQAVALSKLDMQSDAKDMLSEASQLEEKKQKNSR

SEQ ID NO: 60959 - protein, 115 aa, Acidobacteria bacterium Ellin345
MSNSQVIEKLLAKAKRTDLPSFAPGDTVRVHVKIKEGDKERLQAFEGVVIGKSNGLQPSFTVRKISFGQGVERIFPTNSKVIDKIEVLRSAKVRRAKLYYLRALRGKAARLKEAE

SEQ ID NO: 60960 - protein, 530 aa, Aspergillus oryzae
MGFMLKKPDDATGSAAPAIVIGLFVAFGGVLFGYDTGTISGILAMPYWRKLFSTGYINPSDNYPDVTSSQSSMIVSLLSAGTFFGALGAAPIADYFGRRLAMIINTFVFCFGVILQTAATAIPLFVAGRFFAGLGVGLLSATIPLYQSETAPKWIRGTIVGAYQLAITIGLLLAAIVNNSTKGRDDTGSYRIPVAVQFAWAIILVVGMIVLPETPRFLIKKGKHEAAAKALSRLRRIDVNDPAIVEELAEIQANHEYELSVGNASYLSILRGSIGKRLATGCAVQGLQQLAGVNFIFYYGTTFFEHSGIKDGFIITLITNIVNVVSTFPGLYMVEKWGRRPLLLFGAVGMCVSQLIVAIVGTATTSDVANKVLIAFVCVYIFFFACSWGCTAWVVTGELFPLKARAKCLSITTATNWLLNWAIAYATPYMVNSGPGNANLQSKVFFIWGGFCFIAGIFVYTCIYETKGLTLEQVDELYAKIPVAWRSHEFVPSVSYADVRDVAAGKVSGNLADLEADAQMKRDMEHVEKA

SEQ ID NO: 60961 - protein, 424 aa, Campylobacter lari RM2100
MMENAGIELANLIKKKSKKLKNPKILFLLGTGGNGADGLVAIRHLKKAFAYVMPYKKNTMFIRQEQILKNIGFNFLKKEPKFKDFDIIVDCVFGSGLNKALDENLQRIFKKITKSKALKIACDVPSGLGQELCFKADYTLCMGVIKEILLEDFAKEFAGKIKIANLGLKSYIQNTSSFLLEKKDLKLIAKKANSNKGDFGHVYIFANKSAGTLAGLGALEFGAGLVSLVAKESFSPLIMLKDDIESKINAAAIGMGLDDLSILKDERLKNIPLVLDANCFQSENLPSYLNREDVVLTPHPKEFSMLLKLCFNEDVNVEEIQNNRFFYARKFSSKFQCVLVLKGANPIITQKEKLFVVNCGNEALAKGGSGDVLSGMIAALLGVKFNALEAAKNAVLAHALVAKNYKKNKISFDALKLIKGLKCL

SEQ ID NO: 60962 - protein, 225 aa, Coccidioides immitis RS
MSLLRPGRININAGCARAARLAYPVNARFVSSSAPRQLDEKAPKTSPEDAPTDVSRGGSMIRRESPSEAMARHQPDYNATVDQATSLFSPVPKRVMDGSEPGDIVAAAVLSGAPTDLQARTVRIYRPAKPATQSGTWHDHHWRMDWDVLSKGHRWENPLMGWQSSADAMQGTHINFKSKEDAIRFAEKQGYEYYVQEPNERAFHPKAYANNFLHVPKKLKHIRTK

SEQ ID NO: 60963 - protein, 468 aa, Pseudomonas fluorescens PfO-1
MNSLNSKDLNGQLAQGFKPRHVTMLSIAGIIGAGLFVGSGHAIAAAGPAVLLAYLFSGLLVVLVMRMLGEMAVAHPDTGSFSTYADQAIGRWAGFTIGWLYWWFWVLVIPIEALAAGHVLNQWFPQVDAWLFALLSIILLVVTNLFSVSKYGEFEFWFAMAKVVAIIGFIGLGFAVLMGWIPGREASGLSRLMEEHGGFAPNGLSAVVGAFITIMFSFIGTEAVTIAAAESSNPAQNIAKATRSVIWRIGVFYLLSIFVVISVVPWNDPLLASVGSYQRALELMNIPNAKFLVDVVVLIAVASCMNSSIYISSRMLFSLGRRGDAPQPLKVTSAAGVPRAAVIASTVIGAGVTLFSYFMPGGLFQFLLASSGAIALLVYLVIAISQLRMRRMLRRQNVELTFRMWLFPWLTWLVIAFICAALAVMMVTPEHRLEVTSTIGLALTISFIGLVTTRQHGQMRAVVSAGKA

SEQ ID NO: 60964 - protein, 639 aa, Salinibacter ruber DSM 13855
MGVIPYIGSPSTRRLPGSPPRILTARHTTEIMAQVDVEMPKMGESITEGTVIAWHKQPGDEVEQDEILLEIGTDKVDTEVPSPKGGVLTETLVEEGDTVEVGTIIATLDTDTAAAEVDADDEPPAEAPSDDEAAADEAKEAAPDADAEDEAEATPPETDSEEAASPAPSGDEVEVVMPKMGESITEGTVVAWYKDIGEAVAIDETILEIGTDKVDTEVPSPAEGVLTEKLVEEGETVEVGTVVALLASEAEAGSVEPPASDEPDTTQETAPEADEAELPSTPPSGDGAVPDADEPQRAPEETITRRGDDGRFYSPLVRSIAKEEGLRMSELESLEGSGRGGRVTKEDVLAYLDEREEAPAAPASAPERPPRPGRSDEAPPARGDYTVDEGPSDEELRQQYGDRIEVQPMDRMRKMTAEHMVRSKATSAHVTSFAEADVTGLVQLREANKEAFREREGVKLTYTPFFVKAAVEALREHPLLNASVEGDKIVIKHDFHVGIAVAIGNKGLLAPVIRNAGDYNVSGLARKAANVAERARNKELQPDELQGGTFTVTNIGSLGSLMGTPIINQPQVGILATGAIQKRPVVVENDGLGDAISVRHMMYLSLSYDHRIIDGAMGSSFLQRVVTELESFSADADLF

SEQ ID NO: 60965 - protein, 464 aa, Triticum aestivum
  misc_feature (319)..(319): Xaa can be any naturally occurring amino acid
  misc_feature (334)..(334): Xaa can be any naturally occurring amino acid
MAASPTASASGSTAAAAAAASEANDGPTLSVVTKRLRALRKKQNRIAQMEEAVAAGKTLNQEQKEVMRSKPTLAAVIDELERLRTPLAVAVAEEVSVAPAPAPAPEPSGSDSSVQDLLALVYFGALFDVKPQSDFIATMVAREHERSSCITYDCVGDDTVDLLVEGDLDVVSAVAALAAARPASAVGVSHRDALQACAHHARLWLARADEPIHPGSSVTYAAVRAKLDRIMASDYYTAAAVGGGSYGAEGVQAQESMTASPEASAVEENLAAEGHKEEKEDSHATEIYNDHQSDSADVQNVGREPPVNPTEEYPGFEAXQATFHMEDQDERDAXQKSSSCQHPRRSHQNQRGGGRGRRGAYPNGRGGRGGGRGMGGGYQNGRGYQGGGGGYQGGGGGYQNGRGGGGGYYNNNNNEEGYYQPRNFNNNRGRGGRSGGGNSHYSNQGGGGAQGGGHAYAERVEANA

SEQ ID NO: 60966 - protein, 305 aa, Miscanthus sinensis var. condensatus
IESVGEGVTDVAPGDHVLPVFTGECKECAHCRSAESNMCDLLRINTDRGVMIGDGKSRFSINGKPIYHFVGTSTFSEYTVMHVGCVAKINPEAPLDKVCVLSCGISTGLGASINVAKPPKGSTVAIFGLGAVGLAAAEGARIAGASRIIGVDLNPSRFEEARKFGCTEFLNPKDHKKPVQEVLAEMTNGGVDRSVECTGNINAMIQAFECVHDGWGVAVLVGVPHKDAEFKTHPMSFLNERTLKGTFFGNFKPRTDLPNVVELYMKKELEVEKFITHSVPFAEINKAFDLMAKGEGIRCIIRMEN

SEQ ID NO: 60967 - protein, 481 aa, Pseudomonas putida GB-1
MTLEESPMQTQMLINGQLVAGQGPAWTVLDPAQGTALAQINEATEAQVDSAVRAADLAFDSWSQTSPKERSQALLALADAIEAHGDELARLESQNCGKPLSAALNDEIPAIADVFRYFAGAARCLGGLAAGEYLPGHTSMIRRDPLGVVASIAPWNYPLMMLAWKIAPALAAGNTVVIKPSEMTPLTALRLGELAQDLLPPGVLNILFGRGQTVGNPLVNHPKVRMVSLTGSIPTGAHIISATADSVKRMHMELGGKAPVLVFDDADIDAAIDGIRTFGFYNAGQDCTAACRLYVQDGIYERFVERLGEAVASLKPGLQEAEDTELGPLISAQHRDKVAGLVQRAIAQPHIRLVTGGKAIDGNGFFFEPTVLADALQDDEIVRNEVFGPVVSVTRFTDEAQALEWANDSNYGLASSVWTRDTGRAHRLAARLQYGCTWVNTHFMLVSEMPHGGQKHSGYGKDMSMYGLEDYTCVRHVMIKH

SEQ ID NO: 60968 - protein, 305 aa, Miscanthus sinensis var. condensatus
IESVGEGVTDVAPGDHVLPVFTGECKECAHCRSAESNMCDLLRINTDRGVTIGDGKSRFSINGKPIYHFVGTSTFSEYTVMHVGCVAKINPEAPLDKVCVLSCGISTGLGASINVAKPPKGSTVAIFGLGAVGLAAAEGARIAGASRIIGVDLNPSRFEEARKFGCTEFLNPKDHKKPVQEVLAEMTNGGVDRSVECTGNINAMIQAFECVHDGWGVAVLVGVPHKDAEFKTHPMNFLNERTLKGTFFGNFKPRTDLPNVVELYVKKELEVEKFITHSVPFAEINKAFDLMAKGEGIRCIIRMEN

SEQ ID NO: 60969 - protein, 305 aa, Miscanthus sinensis var. condensatus
IESVGEGVTDVAPGDHVLPVFTGECKECAHCRSAESNMCDLLRINTDRGVKIGDGKSRFSINGKPIYHFVGTSTFSEYTVMHVGCVAKINPEAPLDKVCVLSCGISTGLGASINVAKPPKGSTVAIFGLGAVGLAAAEGARIAGASRIIGVDLNPSRFEEARKFGCTEFLNPKDHKKPVQEVLAEMTNGGVDRSVECTGNINAMIQAFECVHDGWGVAVLVGVPHKDAEFKTHPMSFLNERTLKGTFFGNFKPRTDLPNVVELYMKKELEVEKFITHSVPFAEINKAFDLMAKGEGIRCIIRMEN

SEQ ID NO: 60970 - protein, 396 aa, Legionella pneumophila subsp. pneumophila str. Philadelphia 1
MNLIKMSDIDLSGKRVLIREDLNVPIKDGMITSDQRLQAALPTIKSALDSGAAVIVLSHLGRPEEGKYEKKFSLEPVADYLRENLEYPVRFVKDYLSGVGVNPGELVVCENVRFNPGEKANDEALAKKLASLCDVFVMDAFGTAHRAQASTYGVAQYAPVAVAGPLLIRELEALNQVLKAPKKPIVAIVGGAKVSSKLSLLKQLVGMVDVLIPGGGIANTFLKAQGFEIGISLYEPDLLDEARHILILAKEKGCQIPLPTDVVVGKTFSETCPAFNKSLSNVAADDMILDIGPETIRDYVDLIHDANTIIWNGPVGVFEFPQFAYGTRAIAIAIAESDAFSIAGGGDTLAAVDLYDLNQQISYISTGGGAFLECLEGKTLPAVAILQERAKHVKTN

SEQ ID NO: 60971 - protein, 342 aa, Legionella pneumophila subsp. pneumophila str. Philadelphia 1
MSMEVTLTRRSSMTIRVAINGYGRIGRCILRSIFEYNRQNEFEVVAINDLSGIDVTAHLTRYDSTHGPFRSDVSIEGNMLIVDGHGIQVIAERDPAKLPWKQLDIDIVFECTGFFTSRDAAMGHINAGAKKVLISAPAKGVDTTVVYGVNHSVIKASDVIVSNASCTTNCLAPVVKVLNDAIGIESGLVNTVHAYTKDQMLLDGSHKDLRRARSATQSIIPTKTGAAAAVGLVLPELAGKLDGFAMRVPVLNVSVVDLTFQAKRATSVEEINDIMRKAKNRILQINEDPLVSCDFNHNPASAIFDTTETKVIGNLVKVVAWYDNEWGFSNRMIDTAHQMMNC

SEQ ID NO: 60972 - protein, 305 aa, Miscanthus sinensis var. condensatus
IESVGEGVTDVAPGDHVLPVFTGECKECAHCRSAESIMCDLLRINTDRGVMIGDGKSRFSINGKPIYHFVGTSTFSEYTVMHVGCVAKINPEAPLDKVCVLSCGISTGLGASINVAKPPKGSTVAIFGLGAVGLAAAEGARIAGASRIIGVDLNPSRFEEARKFGCTEFLNPKDHKKPVQEVLAEMTNGGVDRSVECTGNINAMIQAFECVHDGWGVAVLVGVPHKDAEFKTHPMNLLNERTLKGTFFGNFKPRTDLPNVVELYMKKELEVEKFITHSVPFAEINKAFDLMAKGEGIRCIIRMEN

SEQ ID NO: 60973 - protein, 692 aa, Legionella pneumophila subsp. pneumophila str. Philadelphia 1
MNGLLADLCLLSDNSASVKCKRVGMNSFTELANAVRMLSIDAVNQAQSGHPGMPLGMADIATVLWKKFLKFNPKNPHWFNRDRFVLSNGHGSMLLYSLLHLTGYNLDISELKNFRQLHSKTPGHPEHGHTPGVETTTGPLGQGLANSVGMALAERVLASTFNHDHFNLVDHYTYTFAGDGCLMEGISHEACSLAGTLGLGKLIVFYDDNGISIDGKVESWFTDDTTSRFKAYNWQVIGPIDGHDADQIEQAISAARENTTQPSLIICKTVIGLGSSVAGSEKAHGSPLSAQDINNVREFFNWKHAPFEIPDSIYKQWDHREQGEKEEQQWLQLLHEYRQQHPSEHDEFLRRANGDLPDDWQEISAGFLKQCLNNEKAIATRKASQQCIEFFAPILPEMFGGSADLTGSNNTDWSGSKAITAHNFSGNYLYYGVREFAMAAIMNGLAVHGGFIPYGGTFLVFADYARNAIRLSALMKQRVIYVLTHDSIGLGEDGPTHQPIEHIAMLRMTPGMTVWRPADLMETAVAWQQSLEHHNGPSALLLSRQNLPALAHGTDAADLIKKGGYIIADCEGKPDAILIATGSEVQLAITAAEKAKARGLQVRVVSMPCAERFLAQSDDYKNQVLPGQVRTRIAIEAASSAYWHQFVGFDGAVIGLDCFGVSAPATDAFNYLGITVEKIINTLDTLTKQTMV

SEQ ID NO: 60974 - protein, 684 aa, Aspergillus niger
MGYNDVDQLAINTIRTLAVDATFKANSGHPGAPMGMAPVSHVLFNKFMSFNPQNPDWANRDRFVLSNGHGCMLQYALLHLFGYQVSMDDLKSFRQLDSITPGHPEAHDTPGVEVTTGPLGQGFANAVGLAIAERHSAAVFNKPGYTLFNNYTYCFFGDGCAMEGIASEAASMAGHLKLGNLIAIYDDNGISIDGDTKCAFTEDVMKRFEPYGWHTEYVKDGDHDLEGIEAAIKKCQAVTDKPSVIRLTTTIGFGSKLQGTGGVHGNPLKADDCEGVKQLLGFDPKQTFVVPQQVYDLYHKHAAEGAAKEQEWNQLLQKYASEYPKEHAELTRRLSGKLAEGWEKSLPVYKPTDAAVATRKLSEAVLEKIHDVVPELLSGSADLTGSNNTRWKNAVDFQPPEYNIGDWSGRYLRYGVREHAMAAVMNGLAAYGTVIPAGGTFLNFVSYAAGAVRLSALSRVRTIYVATHDSIGLGEDGPTHQPIETLAHFRALPNCMVWRPADGNETSAAYYSALTSKHTPSILALTRQNLPQLEASTIEKALKGAYVALEAPDAAVTLISTGSEVSICIEAATYLKEKHGIAARVVSVPCFEVFDAQDKAYKLQVLPDNIPVLSVEALTTMGWERYAHEQFGLNRFGPSGPYKDVYKKFEFTPEGISKRAVATIDFYKGHTVRSPINRAFQQIL

SEQ ID NO: 60975 - protein, 305 aa, Miscanthus sinensis var. condensatus
IESVGEGVTDVAPGDHVLPVFTGECKECAHCRSAESNMCDLLRTNTDRGVMIGDGKSRFSINGKPIYHFVGTSTFSEYTVMHVGCVAKINPEAPLDKVCVLSWGISTGLGASINVAKPPKGSTVAIFGLGAVGLAAAEGARIAGASRIIGVDLNPSGFEEARKFGCTEFLNPKDHKKPVQEVLAEMTNGGVDRSVECTGNINAMIQAFECVHDGWGVAVLVGVPHKDAEFKTHPMNLLNERTLKGTFFGNFKPRTDLPNVVELYMKKELEVEKFITHSVPFAEINKAFDLMAKGEGIRCIIRMEN

SEQ ID NO: 60976 - protein, 547 aa, Glycine max
MASHLLNHSSKMRNASKLLHHERALLVRWFSGDAHSSLNRNRDVWKTQFHESSARSSVFEPASCFNKHSFGMQKRNIFMATIKRGSIIGSEFNGEISRSSQVLSRRCYASASDLPPHQEIGMPSLSPTMTEGNIARWLKKEGDKISPGEVLCEVETDKATVEMECMEEGYLAKIIRGDGAKEIKVGEVIAVTVEDEGDIAKFKDYQPSASEPSAAPAKEISAPPTPKKEEEVEEPGREPEPKVSKPSAPPSSGDRTFASPLARKLGEEKNVPLSSIKGTGPEGLIVKADIDDYLASGAKEVSASSKAKVATDAALDYTDIPVSQIRKVTASRLLLSKQTIPHYYLTVDTCVDKLTSLRTQLNSLQEASGGSRISVNDLVIKAAALALRKVPQCNSSWANDYIRQYNNVNINVAVQTDNGLFVPVIRDADKKGLSTIGEEVKQLAKKAKENSLKPQDYEGGTFTVSNLGGPFGVRQFCAIINPPQAGILAVGSSERRVVPGSGAEEFKFASFMSVTLSCDHRVIDGAIGAEWLKAFKGYIENPETMLL

SEQ ID NO: 60977 - protein, 461 aa, Arabidopsis thaliana
MDRYKLIKEVGDGTFGSVWRAINKQTGEVVAIKKMKKKYYSWDECINLREVKSLRRMNHPNIVKLKEVIRENDILYFVFEYMECNLYQLMKDRQKLFAEADIKNWCFQVFQGLSYMHQRGYFHRDLKPENLLVSKDIIKIADFGLAREVNSSPPFTEYVSTRWYRAPEVLLQSYVYTSKVDMWAMGAIMAELLSLRPIFPGASEADEIYKICSVIGTPTEETWLEGLNLANTINYQFPQLPGVPLSSLMPSASEDAINLIERLCSWDPSSRPTAAEVLQHPFFQSCFYVPPSLRPKPSVARTPPPVGPRGSFEHQSVKRYPVSLANAKPFNSYVSPKSNAAFGSGVQRKLDMVNQDGTRNTKPVRSSVRDSKYRPPGKKSPPAASLNKNRVTRSSVSETADKLANMTIGATGSRRHSVSVVGQHQQLKPPPMKAGWVGETRDMFLRPTQPTTNAYSRKVAG

SEQ ID NO: 60978 - protein, 433 aa, Marinobacter sp. ELB17
MSQHANESVNDANKEPVDESFHEPVWKQALAGSQMLLVAFGALVLMPLITGMDPNVALFTAGLGTIIFHVVTGGQIPIFLASSFAFIAPVIASKGKFGMEETMGGLMAAGILYIILSALVKVRGTGFITRLLPPVVIGPVIMVIGLGLAPVAVHMASGRAGDGSVQLIAENTALWIAMISLVCTVGASVWAKGIFRLIPIMFGVLVGYGLSAILGLVDTTPVQQAPWLAIPNFTAPQFSWGAILFMIPVAIAPAIEHIGDVLAIGNVTRKNYLDKPGLHRTLLGDGLATSAASLLGGPPNTTYSEVTGAVMLTRNFNPKTMWWAAVIAIVLAFVGKFGAVLQTIPVPVMGGILCLLFGSIAVVGMSTLIRHQVDLNLPRNLVIVGVTLVFGIGGMVLGHLAGIALCAIVAIALNLILPGSREAWGKAIYEKKD

SEQ ID NO: 60979 - protein, 368 aa, Acidobacteria bacterium Ellin345
MSDIKKIAINTGGGDAPGLNAVIHGAVYAARRLGWEVFGIRDGYDGILEPHRYPNGGLIQLNRGVVRDISHVGGTILGTTNRGNPFRRVITAADGTKHETDCSDQILNFFRDRGIDALISIGGDGSLTIANGLAKKGLRVVGVPKTIDNDLESTAMTFGFNTAVSFATECIDRLHSTALSHQRILVVEVMGRYAGWIALHCGVAGRADAILIPEIPYKIENVANALKLRHQDGKPYSIVVVAEGAKAHGKDVTIREREVGKAERLGGIGEQVTQQLQSLTGKESRTVVLGHLLRGGSPTALDRNLGVTFGAGAVEALAEGRSTVMVALHPPHLAFVPLEEAIAKLRLVPPDSDLVLTARAIGIAFGDE

SEQ ID NO: 60980 - protein, 560 aa, Listeria monocytogenes str. 4b F2365
MSNKVKSDIEIASKAEILPVTTIAEHLGLDADALELYGKYKAKLSYDTIHSLKDKEPGKLVLVTAINPTPAGEGKSTVTVGLGDALSKKDKKTVIALREPSLGPTMGIKGGATGGGYAQVIPMEDINLHFTGDFHAITAANNALSAFIDNHMQQGNDLDIDGRRIVWKRVVDLNDRALRKVVVGLGGPIQGVPREDGFDITVASEIMAIICLASDLKDLKKRLSEIVIGYNYKKEPITVGEMGYEGALTLLLKDALKPNLVQTLEHTPAIVHGGPFANIAHGCNSVSATSTALRLGEYVVTEAGFGADLGAEKFLDIKVPALGKAPDCVVIVATIRALKMHGGALKTELSEENVDALAKGFTNLQKHTESIQTFGIPYVVAINKFITDSDAEVAKLEALCEEHGIPFSLTEVWEKGGDGGLELADKVIAAVESGEADYKRIYDDAWSIEEKLEAIVTKVYGGIGVELSSKAQKQIVEFKKYGWDRYPICMAKTQYSLSDDPTLLGRPTDFVIHIREFIPKLGAGFVVALTGDVMTMPGLPKKPAALNMDVDENGNAQGLF

SEQ ID NO: 60981 - protein, 396 aa, Solanum lycopersicum
MDGSVPQTDTMMSDVAAPPAQQPPPPSQPLAGMDNIPATLSHGGRFIQYNIFGNIFEVTAKYKPPIMPIGKGAYGIVCSALNSETNESVAIKKIANAFDNKIDAKRTLREIKLLRHMDHENIVAIRDIIPPPQREAFNDVYIAYELMDTDLHQIIRSNQGLSEEHCQYFLYQILRGLKYIHSANVLHRDLKPSNLLLNANCDLKICDFGLARVTSETDFMTEYVVTRWYRPPELLLNSSDYTAAIDVWSVGCIFMELMDRKPLFPGRDHVHQLRLIMELIGTPSEAEMEFLNENAKRYIRQLPLYRRQSFTEKFPHVNPAAIDLVEKMLTFDPRRRITVEDALAHPYLTSLHDISDEPICMTPFSFDFEQHALTEEQMKELIYRESIAFNPEYQRM

SEQ ID NO: 60982 - protein, 221 aa, Helicobacter pylori
  misc_feature (115)..(115): Xaa can be any naturally occurring amino acid
  misc_feature (209)..(209): Xaa can be any naturally occurring amino acid
  misc_feature (212)..(212): Xaa can be any naturally occurring amino acid
MKAFLGALEFQENEYEELKELYESLKTKQKPHTLFISCVDSRVVPNLITGTKPGELYVIRNMGNVIPPKTSHKESLSTMASIEYAIVHVGVQNLIICGHSDCGACGSTHLINDGXTKAKTPYIADWIQFLEPIKEELKNHPQFSNHFAKRSWLTERLNVRLQLNNLLSYDFIQERVVNNELKIFGWHYIIETGRIYNYNFESHFFEPIXETXKQRKSHENF

SEQ ID NO: 60983 - protein, 1007 aa, Medicago truncatula
MEQEPAMEQESTTLGKRSEPEPVSTADGGDTSSQPKKCRSSECTCVHEVAVPINYTSTKDESLHGTLSNPLHNGTMAKTYPFTLDPFQQVSIACLERNESVLVSAHTSAGKTAIAEYAIAMSFRDKQRVIYTSPLKALSNQKYRELSQEFTDVGLMTGDVTLSPNATCLVMTTEILRGMLYRGSEVLKEVAWVIFDEIHYMKDRERGVVWEESIIFLPPAIKMVFLSATMSNATEFAEWICNIHKQPCHVVYTDFRPTPLQHYVFPIGGSGLYLVVDENEQFREDNFLKVEDTFVKQKLGEGKGGKTNGRFGKGGSASGGSDIYKIVKMIMERKFQPVIIFSFSRRECEQHAMSMSKLDFNSQEEKDTVEHVFQNAMLCLNEEDRSLPAIELMLPLLQRGIAVHHSGLLPVIKELVELLFQEGLVKALFATETFAMGLNMPAKTVVFTAVKKWDGDSHRYIGSGEYIQMSGRAGRRGKDERGICIIMIDEQMEMNNLKDMVLGKPAPLVSTFRLSYYSILNLMSRAEGQFTAEHVIRNSFHQFQYEKTLPDVGKRVSMLEQEVALLDAAGEAEVSEYHKLKLDLAQLEKKMMSQIIRPEMILYFLVPGRLIKVREGGTDWGWGVVVNVVKKPVGGYIVDTLLHCSPGSNENSIRPKPCPPRPGEKGEMHVVPVQLPLISALSKLRIYVPPDLRPLEARQSILLAVQELGNRFPQGLPKLNPVKDMDVRDSEIVELVNQIEELEKKLFDHPMHKIQDVDQIKCFERKAEVNHEIQQLKAKMRDSQLQKFREELKNRSRVLKKLGHIDSDSVVQLKGRAACLIDTGDELLVTELMFNGTFNDLDHHQVAALASCFIPIEKSSEQIQLRSELARPLQQLQDSARRIAEIEHECKLEVNVNEYVESTVRPFLMDVIYSWSKGSSFADVTQMTDIFEGSIIRAARRLDEFLNQLRAAADAVGEADLEKKFAAASESLRRGGIFLLYVYLQNPLSALGLEEWGSNEITVKGSR

SEQ ID NO: 60984 - protein, 435 aa, uncultured archaeon
MNSNSSTVKREEKELEKISFAEGVNVKKLKQLLGAGRVVIPRNAKRAEESDITLKAIGAGMSMKVNVNVGTSKDYVSAEEEVRKAKVAVEYGADAIMDLSTGGDLNETRRTILKEVDVPVGTVPIYQAALEKADVRAVVDMSSDDMFNAVRNHAKDGIDFVTIHAGVNQNSLARLKLSGRILDVVSRGGAFLVAWMIHNERENPFYEEYDYLLEIANEYDLTLSLGDGMRPGCISDASDRAKFAEAITLGELVKRAREEGVQAMVEGPGHVPLDEIEASVKIIKHVTDFAPLYLLGPLVTDIAPGYDHFVSAIGGAVAGMYGADFLCMVSPSEHLALPSVDDIKEGTIVTKIAAHVADLVKDGQRERARGLDDEMAYARRKLDWKKQFEIAMTAEEAQRIRNRRPSESDACSICGDLCAIKMVKECLEKHEIPQD

SEQ ID NO: 60985 - protein, 536 aa, Aspergillus niger
MPSFSQATELSAWKELQEHHNSVGRNIVLKDCFQKDPQRFEKFSRTFKNTVDNSEVLFDFSKNFLTEETLALLVKLAKEANVEELRDAMFKGEHINFTEDRAVYHAALRNVSNEPMQVNGKSVVEDVNAVLEHMKEFTEQVRSGEWKGYTGKKIDTVINIGIGGSDLGPVMVTEALKPYGAPDMKLHFVSNIDGTHIAEALKNSNPETTLFLIASWFLETAKEDSHIAKHFVALSTNEEEVTKFGIDKKNMFGFESWVGGRYSVWSAIGLSVALYIGYDNFHQFLAGAHAMDKHFREAPLEQNIPVLGGLLSVWYSDFFGAQTHLVAPFDQYLHRFPAYLQQLSMESNGKAITRTGEYVKYTTGPILFGEPATNAQHSFFQLLHQGTKLIPSDFIMAAESHNPVEGGKHQRMLASNFLAQSEALMVGKTPEQVKAEGAPENLVSHKTFLGNRPTTSILAQKITPSTLGALITYYEHLTFTEGAIWNINSFDQWGVELGKVLAKKIQKELETADAGSDHDASTSGLLLAFKKKANLA

SEQ ID NO: 60986 - protein, 420 aa, Oryza sativa (indica cultivar-group)
MAAAANNGGEGGDGFDVIVVGAGIMGSCAAYAASTRGGARVLLLERFDLLHHRGSSHGESRTIRATYPQAHYPPMVRLAARLWDDAQRDAGYRVLTPTPHLDMGPRADPALRASIVNGAATEVASDAASDAAAPWPWSGVFRLPEGWTAATSEIGGVMKATKAVAMFQSLAAKNGAVVRDRTEVVGIAKQGDGSIVVKTSSGEEFHGAKCIITVGAWASKLVRSVAGVDLPVQPLHTLICYWRARPGREHELTPESGFPTFASYGDPYIYSTPSMEFPGLIKVAAHGGPPCDPDRRDWLAGAGAGLVEPVARWIDEVMPGHVDTAGGPVIRQPCMYSMTPDEDFIIDFVGGELGKDVVVGAGFSGHGFKMGPAVGRILAEMALDGEARTAAEAGVELRHFRIGRFEDNPEGNLAENKVKN

SEQ ID NO: 60987 - protein, 305 aa, Miscanthus sinensis var. condensatus
IESVGEGVTDVAPGDHVLPVFTGECKECAHCRSAESNMCDLLRINTDRGVMIGDGKSRFSINGKPIYHFVGTSTFSEYTVMHVGCVAKIDPEAPLDKVCVLSCGISTGLGASINVAKPPKGSTVAIFGLGAVGLAAAEGARIAGASRIIGVDLNPSRFEEARKFGCTEFLNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSVPFAEINKAFDLMAKGEGIRCIIRMEN

SEQ ID NO: 60988 - protein, 305 aa, Miscanthus sinensis var. condensatus
IESVGEGVTDVAPGDHVLPVFTGECKECAHCRSAESNMCDLLRINTDRGVMIGDGKSRFSINGKPIYHFVGTSTFSEYTVMHVGCVAKIDPEAPLDKVCVLSCGISTGLGASINVAKPPKGSTVAIFGLGAVGLAAAEGARIAGASRIIGVDLNPSRFEEARKFGCTEFLNPKDHKKPVQEVLAEMTNGGVDRSVECTGNINAMIQAFECVHDGWGVAVLVGVPRKDAEFKTHPMNFLNERTLKGTFFGNFKPRTDLPNVVELYMKKELEVEKFITHSVPFAEINKAFDLMAKGEGIRCIIRMEN

SEQ ID NO: 60989 - protein, 305 aa, Miscanthus sinensis var. condensatus
IESVGEGVTDVAPGDHVLPVFTGECKECAHCRSAESNMCDLLRINTDRGVMIGDGKSRFSINGKPIYHFVGTSTFSEYTVMHVGCVAKINPEAPLDKVCVLSCGISTGLGASINVAKPPKGSTVAIFGLGAVGLAAAEGARIAGASRIIGVDLNPSRFEEARKFGCTEFLNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSIPFAEINKAFDLMAKGEGIRCIIRMEN

SEQ ID NO: 60990 - protein, 305 aa, Miscanthus floridulus
IESVGEGVTDVAPGDHVLPVFTGECKECAHCRSAESNMCDLLRINTDRGVMIGDGKSRFSINGKPIYHFVGTSTFSEYTVMHVGCVAKINPEAPLDKVCVLSCGISTGLGASINVAKPPKGSTVAIFGLGAVGLAAAEGARTAGASRIIGVDLNPSRFEEARKFGCTEFLNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSVPFAEINKAFELMAKGEGIRCIIRMEN

SEQ ID NO: 60991 - protein, 273 aa, Candidatus Kuenenia stuttgartiensis
MLLVPQLKYLSLLNSCSATNLVALQRTIFRFKRLKCYPFFSTIFTRCQTVKFVAFGSLISLSYIILLQHPQHINTSYMKKRIAKIERKTKETQIELVLNIDGEGICNVSTGIGFLDHMLELLTKHALFNLDITAHGDIQVDGHHTVEDIGICLGLGIKEALGDKKGIRRFSNASIPMQETLANVAIDISGRSALVFNANFHNEKIGNFDVELIREFLEAFTTNAGVNLHINISYGTNSHHMAEAVFKGMAKVLCEAVRLDERITGIPSTKGVL

SEQ ID NO: 60992 - protein, 308 aa, Sinorhizobium meliloti 1021
MIVCCGEALIDMLPRETTAGESAFAPYAGGAIFNTAVALGRLGVPTGFFTGLSDDMFGDILRATLKAANVDFAPCATLPLHTTLAFVKLVDGHASYAFFDENTAGRMITAEHLPALGDFCEALHFGAISLIPEPCGSTYEALMAREHEKRVISFDPNIRPGFIKDREAHVGRMNRMAAMSDIVKFSDEDLAWFGMEGSHDALAAEWLKRGPKLVLITRGADGAVGYTNGHKVEVASERVEVVDTVGAGDTFDAGVLASLKFNNLLTKERVASLTDEAIRQALTLAAKAAAVTVSRAGANPPWRHELGL

SEQ ID NO: 60993 - protein, 541 aa, Sinorhizobium meliloti 1021
MKALVENLKATARETDATDIRAAFAADPNRFSRFSTAFDDLLFDYSKCAVNDRIIDGLEALAKAAKVEEKRDAMFRGDIINITEERAVLHTALRNRSNRPVLVDGKDVMPDVNAVLEAMGKFADDIRSGALKGATGKKITDVVNIGIGGSDLGPVMATLALAPFHDGPRLHFVSNVDGAHIADTLTLLDPETSLFIVASKTFTTIETMTNAATARAFIAGKLGEAAVGHHFAAVSTALDKVGAFGIDAARVFGFWDWVGGRYSIWSAIGLPLMIAIGKENFGRFLDGGHAIDEHFRSAPLRQNIPMLLGLIGFYNRNVLGYPSRAILPYDQRLTRFPAYLQQLDMESNGKGVTLDSQPVEFSTGPVVWGEPGTNGQHAFYQLIHQGTDVIPAEFMIAANGHEKDLRHQHQLLMANCLAQSEALMKGRTLAEAKAQLTSKGMDDAKADKIAPHRVFTGNRPSLTIVYDQLDPFALGRLIALYEHRVFVEGALFNINSFDQWGVELGKELATGLLPVIEGKESAEGHDSSTAGLVAALLKAAR

SEQ ID NO: 60994 - protein, 295 aa, Acinetobacter calcoaceticus
MNKKLEALFRENVKGKVALITGASSGIGLTIAKRIAAAGAHVLLVARTQETLEEVKAAIEQQGGQASIFPCDLTDMNAIDQLSQQIMASVDHVDFLINNAGRSIRRAVHESFDRFHDFERTMQLNYFGAVRLVLNLLPHMIKRKNGQIINISSIGVLANATRFSAYVASKAALDAFSRCLSAEVLKHKISITSIYMPLVRTPMIAPTKIYKYVPTLSPEEAADLIVYAIVKRPTRIATHLGRLASITYAIAPDINNILMSIGFNLFPSSTAALGEQEKLNLLQRAYARLFPGEHW

SEQ ID NO: 60995 - protein, 394 aa, Solanum lycopersicum
MDGSAPQTDTVMSDAAAGQQPAMPPLPMAGMENIPATLSHGGRFIQYNIFGNIFEVTAKYKPPIMPIGKGAYGIVCSALNSETNEHVAIKKIANAFDNKIDAKRTLREIKLLRHMDHENIVAIRDIIPPPQREAFNDVYIAYELMDTDLHQIIRSNQGLSEEHCQYFLYQILRGLKYIHSANVLHRDLKPSNLLLNANCDLKICDFGLARVTSETDFMTEYVVTRWYRPPELLLNSSDYTAAIDVWSVGCIFMELMDRKPLFPGRDHVHQLRLLMELIGTPSEAEMEFLNENAKRYIRQLPLYRRQSFVEKFPHVNPAAIDLVEKMLTFDPRRRLTVEDALAHPYLTSLHDISDEPVCMTPFSFDFEQHALTEEQMKELIYREGLAFNPEYQHM

SEQ ID NO: 60996 - protein, 138 aa, Coccidioides immitis RS
MSGEAWLYLLAVLINAVNLFLQVFFTIMYSDLECDYINPIDLCNRLNAYIVPEAAVHAFLTFLFIINGYWLAILLNLPLLAFNAKKIFDNQHLLDATEIFRKLNVHKKESFIKLGFHLIMFFFYLYSMIVALIRDESH

SEQ ID NO: 60997 - protein, 294 aa, Medicago truncatula
MEALASLHHRHQPLCSSLHPSLSSTTASSLFLSQPSPSTSPSSSIRALSSPSPPSSESLQNLQYPETKIPQFFNPLVKVPNFDPPRQNPEPKSPQFFNPISKFPSFVTVTVAASAFLFLGCCQNGFNKPITSLSSVVSVEEKALDEKSDIEEFLGNKPDHIESVLYLKMKERIRVVHSFKKIKTDDDEAWEVLRAEVVSCSENLELIKVGFEEILEKDMDCNKSHQGRVLEYLEMVDECNGLLKGIKVAMDRCEREDADINRYLRLFGKVVDRIRVLEGDMVGALKYFKQLEQE

SEQ ID NO: 60998 - protein, 421 aa, Triticum aestivum
  misc_feature (117)..(117): Xaa can be any naturally occurring amino acid
  misc_feature (129)..(129): Xaa can be any naturally occurring amino acid
GTRRVTITKPALVREVLSNKSGDFEKLKLGRLQRMLHNGIGSHEGEKWAKHRRIINPAFHLEKLKRMLPAFAACCTDLVHRWEGLALAAGDAPCEVDVWPDMQNLTGDVISRAAFGXSSYLEGRRVFQXLRGSKLELAVPAMNKMHIPGYLFFPTKANRRMRQIAAEIERILKGIIAKRENALRAGEATSDDLLGLLLESNMAHTRAGGNSKAGITTDDVIGECKLFYFAGMETTSVLLTWTMIVLCMHPEWQDRAREEVLHVFGDRTPDYDGLSRLRIVTMVLYEVLRLYTPLTALQRKTYRPTELGGVRYPAGVVLMLPLLSVHHDKEVWGADAHEFRPERFSEGISKASVDAPAFFPFGWGPRICVGQSFALLEAKMGLAMILQRFSFDLSPSYTHAPFTVGLLQPEHGAQVRLKRLH

SEQ ID NO: 60999 - protein, 143 aa, Pseudomonas fluorescens PfO-1
MQTNAQIQSAAKPFLGEENVIFTDKAPLPLGTYSQGIKVSHGQTIYLSAQTPVSALNNEVLAKDFEGQLRQTLDNLAQMAEAAGGSLANVVKVTAFITDLSEFPTLNRVMEEYFTPPYPARTTAGASALARNTLVAIDAIMVV

SEQ ID NO: 61000 - protein, 260 aa, Dechloromonas aromatica RCB
MTLRVFITGASSGIGEALAVYYAAQGARLGLVARRNEFLEALNQRLGGQHACYTLDVSDAPALHAAAADFLARFGAPDIIIANAGVSAGTLTECEEDLAVFRRVMDTNVFGMAATFAPFIPAMKAAASGGRKTQRLVGIASVAGIRGLPGAEAYSASKAAAITYLESLRLEMRPYGIKVVTIAPGYIETPMTAVNPYQMPFLLPVDQAAERFAATIERGTSYAVIPWQMGVVAKLLRVLPNWLYDRLFTSAPRKPRGLLK

SEQ ID NO: 61001 - protein, 305 aa, Miscanthus sinensis var. formosanus
IESVGEGVTDVAPGDHVLPVSTGECKECPHCKSAESNMCDLLRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASRIIGVDLNPSRFEEARKFGCTEFVNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSVPFAEINKAFDLMAKGEGIRCIIRMEN

SEQ ID NO: 61002 - protein, 305 aa, Miscanthus sinensis var. formosanus
IESVGEGVTDVAPGDHVLPVFTGECKECAHCRSAESNMCDLLMINTDRGVMIGDGKSRFSINGKPIYHFVGTSTFSEYTVMHVGCVAKINPEAPLDKVCVLSCGISTGLGASINVAKPPKGSTVAIFGLGAVGLAAAEGARIAGASRIIGVDLNPSRFEEARKFGCTEFVNPKDHKKPVQEVLAEMTNGGVDRSVECTGNINAMIQAFVCVHDGWGVAVLVGVPHKDAEFKTHPMNFLNERTLKGTFFGNFKPRTDLPNVVELYMKKELEVEKFITHSVPFAEINKAFDLMAKGEGIRCIIRMEN

SEQ ID NO: 61003 - protein, 630 aa, Coprinopsis cinerea okayama7#130
MDAIKSLLSPLGMNTGALQDTLKLVVIGGTVETARRASVSAWNGFVDSFFLTAHFSQEDYPYDCREFDITTRAVGRNSLAQSTAGDLEEDEDEDDGLVHGRRKRKVQFMPSVDTTHTIYYRGHWLRITRTKRYPDSYGHGASLKISVVARNNDILKKLVLEAKREYEKDSEHRVHIFLADTSYACWRFNGSRQKRPMSSIVLQPGVKDMLLADCKDFLNSEEWYAERGIPFRRGYLLHGVPGSGKTSLIHSLAGELGLDIYVVSLSSKGMSDNTLTTLMSHVPSRCILLLEDLDAAFTRGVSRDSTSTGAPPPASSSSSTTSTTTTKETEASDGSTLSLSGLLNSLDGVAAAEGRLLFATTNHIERLDPALSRPGRMDVWINFTHATKWQAEGIFKCFFPSKPSGATESKAEEDSKEKDASQKNLPGSKRKSHKHAIPLLSEEEISELAKRFADAIPENELSVASLQGYLLKNKTRPRECVDEVAAWVQQERETREKIKQEKEKAEREAQEKKKAEEKEKEEKEKKEKEEKEAKEKQDRKGKKKARSEPKVDPSVSSDSADSSKSTSSSEGETTGADADTESVTSEEESDKEKATPSEDKKDKWVSVKGQSTSTSSAQTDSEANTSDSAT

SEQ ID NO: 61004 - protein, 305 aa, Miscanthus sinensis var. formosanus
IESVGEGVTDVAPGDHVLPVFTGECKECPHCKSAESNMYDLLRINTDRGVMIGDGKSRFSINGKPIYHFVGTSTFSEYTVMHVGCVAKINPQAPLDKVCVLSCGISTGLGASINVAKPPKGSTVAIFGLGAAGLAAAEGARIAGASRIIGVDLNPSRFEEARKFGCTEFVNPKDHKKPVQEVLAEMTNGGVDRNVECTGNINAMIQAFECVHDGWGVAVLVGVPHKDAEFKTHPMNFLNERTLKGTFFGNFKPRTDLPNVVELYMKKELEVEKFITHSVPFAEINKAFDLMAKGEGIRCIIRMEN

SEQ ID NO: 61005 - protein, 490 aa, Thermobifida fusca YX
MRTAHIVETVRAAEGALLAQLPEGTLMRRAAFGLASVCVRILPRVSGARVVLLVGSGDNGGDALFAGAELARRGAAVTAVGAGRTLHERGLAALRAAGGRTASVEQAAALVAGADLVVDGLVGIGVRGALREPHASLAALTESTDAAVVAVDLPSGVDADTGAVPGASVRADVTVTFGTYKPGLLVDPGAGRAGVVEFVDIGLAPQLPDPDLVSFQAEDVAALLPRPTAESDKYRRGVLALAAGSNRYRGAAVLAAGGALRTGVGLLRYVGEPEVAREVVARWPETVASALDPVDPVASLPQRVAAWVIGPGRGLHPAALAELEAVLASDVPVLVDADALTLLARNPALVRERTAPTLLTPHAGELTRLLPGVERADVEAHRLDYARRAAAEYGCTVLVKGSTTLVAEPNRAVAANPTGTPLLATAGSGDVLAGMIGALLATGLPPWEAAACGAYLHGMAARLAHGGAPISASDLFDAIPRAISAVVYRE

SEQ ID NO: 61006 - protein, 305 aa, Miscanthus sinensis var. formosanus
IESVGEGVTDVAPGDHVLPVFTGECKECAHCRLAESNMCDLLRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASRIIGVDLNPSRFEEARKFGCTGFVNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSVPFAEINKAFDLMAKGEGIRCIIRMEN

SEQ ID NO: 61007 - protein, 489 aa, Mycobacterium sp. JLS
MAILANGESRLLIDGKLVAGTAGTFPTVNPATEEVLGVAADADSDDMGRAIAAARSAFDDTDWSTNTELRVRCLRQLKDALREHVEEMRDITIAEVGAPRMLTSGAQLEGPIDDLSFAADTAETYEWRTDLGHATPQGIPTRRTLAREAVGVVGAITPWNFPHQINLAKVGPALAAGNTLILKPAPDTPWCAAAVGEIIAEHTDFPPGVINVVTSSDHAVGALLSQDPRVDMVSFTGSTATGRAVMTDAAATIKKVFLELGGKSAFLVLDDADLAGACSMAAFTAAMHAGQGCAITTRLVVPRAKYDDAVEAAAATMASIKPGDPTSKRTVCGPVISARQRDRIQGYLDLALQEGGRFACGGGRPADRDTGFFIEPTVIAGLDNNARVAREEIFGPVLTVIAHDGDDDAVRIANDSPYGLSGTVFSGDDARAQAVAARMRVGTVNVNGGIWYSADAPFGGYKQSGIGREMGVAGFEEYTEIKLIATAAN

SEQ ID NO: 61008 - protein, 305 aa, Miscanthus sinensis var. formosanus
IESVGEGVTDVAPGDHVLPVFTGECKECAHCRSAESNMCDLPRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASRIIGVDLNPSRFEEARKFGCTEFVNPKDHKKPVQEVLAEMTNGGVDRGVECTGNINAMIQAFECVHDGWGVAVLVGVPHKDAEFKTHPMNFLNERTLKGTFFGNFKPRTDLPNVVELYMKKELEVEKFITHSIPFAEINKAFDLMAKGEGIRCIIRMEN

SEQ ID NO: 61009 - protein, 70 aa, Brassica napus
MAFVVTSLIFAVVGIIASIFTRICFNKGPSSNLLHFTLVITATVCCWLMWAIVYIAQMKPLIVPILSEVE

SEQ ID NO: 61010 - protein, 398 aa, Myxococcus xanthus DK 1622
MAVEIKVPPLGESITEAVVGKWNKKPGDAVTADEPLVVLETDKVTIDVPAPSAGSLSSIAFKEGDKVRVGEVLGLLEAGAGAPAARPAAAPAPAAAPAPAAEVPAASDARSTPTARKVAEENRLDISQVKGSGAGGRVHKDDVLGQLNRPATPAAPAQPAGPRPNAAREERVRMTPLRKRVAERLIQAQSTAAMLTTFNEVDMGEVMALRKKYNDKFQQKHGVKLGFMSFFIRASVEALKAFPQINAEIDGEDVIFKHYYDIGVAVSGSRGLVVPVVRNADKQGLAELEKSVGELGTKARNDKLALADLQGGTFTITNGGIFGSMLSTPILNPPQTGILGMHNIVERPVARDGQVVIRPIMYIALTYDHRLVDGREAVQFLVRVKECIEDPERLLLDV

SEQ ID NO: 61011 - protein, 243 aa, Triticum aestivum
FLALTSTSTFSSPINSFSSLLLSNHYPLPTTSTAPWNDSSNSNHAQQLQDPWNNLFMPTNGELANDEERHKTLEGQALFPATTTGEGEEGDGSSAAGHIYSNTARHGSSLAGDEFQLVMSSPSPWSRGVQHYHHNTLQQQASSASTSSLGNNILDFSNNGSPRECTSTASGAAFKKARTQEPSPAQSTVKVRKEKLGDRITALHQLVSPFGKTDTASVLLEAIGYIRFLHGQIEVQQKEKSSI

SEQ ID NO: 61012 - protein, 353 aa, Caulobacter crescentus CB15
MTLFDSPDFEGHEGVHAFFDEKTGLKSIIAVHSTARGPAAGGCRMWDYSSADAALTDALRLSRGMSYKNAMADLDFGGGKAVIIGDSRSQKTPELFEAFGRAVDSLGGQYWTAEDVGVSPSDLESTRKTTRFVAGLEGHAAASGDPSPVTAEGVFRGVRLCVERALNRDLKGVRVAIQGVGHVGAYLAEKLHAAGAELIIADVNQVALAEVAAKTGATIVPTDAIFDVEADVFAPCALGGAISNATLPRLKVKVIAGGANNQLADAMIGQTVFDRGILYAPDYVINGGGIINVAAEIRALEAGGAFDGGWVASKLDRLAQTLAEVIDQSISEKRPANLVADEIARARIAAARG

SEQ ID NO: 61013 - protein, 479 aa, Triticum aestivum
  misc_feature (240)..(240): Xaa can be any naturally occurring amino acid
MGKKGKWLGAVKKVFSPESKEKKEEKLRKKLAARDPSPPDLTPSTSLEVNVSMPPPPPAVPSPHQTEEVQVRDVELEQEQEQSKHVTVEAAPDAPAQTSAALPPGVSREELAAIKIQTAFRGYLARRALRALRGLVRLKSLVEGNSVKRQAASTLRCMQTLARVQSQIRSRRLKMSEENQALQRQLLLKQELDSLRMGEHWDDTTQSKEKIEASLISRPEAAIRRERAPPFPFPPQGKTXQSRSSNPMFVDPNNPHWGWSWLERWMAAKPSEAGRTGTGKESNIDQGSVKSTSLNLGEGEITKAFNRRGSKPDKSSPTTPKLTRPASRLSPSTPTAKVTPIVVKKKSATPKNGISQVDDDARSVLSVQSERPRRHSIATSTVRDDESLASSPSVPSYMAATKSARAKSRLQGSPLIDSAETTPEKGGSVSVGSAKKRLSFPAGGVPPSPMRRHSGPPKVESMVKDIPEAPQPEALAISG

SEQ ID NO: 61014 - protein, 316 aa, Medicago truncatula
MSSSSIDAFPAIQETLLEFRAGKMSLEGKRVVPDARKGLVRIARGEEGLVHFQWLDRTLNVVEDDQIIFPNEAIFEQVNQTSGRVYILKFNSDDRKFFFWMQESNADNDSQLCSSVNDYLNRPLELLGEEEPDVSLPLEVSEDMVEDDISSRAANLVVPNFGVDATSDVTSSGPVKLADLQRILSNIGPAADSILDPDEGFELGDILKPDLILPLMETLPLEQRLASYLPEGTWSPEDILELLQSPPFRQQVDSFTYVLRTGQIDLSQFGIDPSKYKFTVLSFLEALEDSVSKSEESRQDDQELISQSCTPMDESK

SEQ ID NO: 61015 - protein, 156 aa, Oryza sativa (japonica cultivar-group)
MAARRGRGRGREWEDDDLGVGGGQPPHLAAPVVCLARSAGDLAAGAFVGSLVGYGQGLLTNKVINAGVAGCCTGLALSFPGAPQAMFHSCVTFAAFSCIMDGLNKQQAAMAATLASKPSTIKHQEGDVLPPFTLPPLLNASDALASCCQAFLKPKD

SEQ ID NO: 61016 - protein, 358 aa, Mycobacterium avium 104
MGTPEVDVVILVGGKGTRLRPLTLSAPKPMLPTAGLPFLTHLLSRIAAAGIEHVILSTSYQAAVFEAEFGDGSKLGLQIEYVTEERPLGTGGGIANVAGQLRHDTVMVFNGDVLSGADLGQMLDFHAAQQADVTLHLVRVSDPRAFGCVTTEDGRVTAFLEKTQDPPTDQINAGCYVFARRVIDRIPRGREVSVEREVFPALLSDPDVTVCGYVDATYWRDMGTPEDFVRGSADLVRGIAPSPALHGHRGEQLVHDGAAVSPGAVLIGGTVVGRGAEIGPGVRLDGAVIFDGVKVEAGSVIERSIVGFGARIGPRALIRDGVIGDGADIGARCELLRGARVWPGVSIPDGGIRYSSDV

SEQ ID NO: 61017 - protein, 302 aa, Myxococcus xanthus DK 1622
MNASSDTEAMGVQVREGTVRLRDGRRLAYVESGDLSGLPVFFIHGNPGSRHMRHPDDRLTHALGVRLITPDRPGYGLSDYQPGRTLLDFPNDLEQLANALRVGRFALFGVSAGGPYVAASAWKLGERITRAALVSGAAPLARPGAMEGVNRDYRNAYAMAAWPEWLLHPLMAMHDRQVRANPSRALAGLRSQASADDRAVLADPRIAAQVQGWRYEATRKGVAGIRREAHILAQPWNVPLEEIRTEVDLWYWEGDSIVPPQMGRYLANRIPRAVPRFFPGGGHFSIFSHWTDILTPLVRQGS

SEQ ID NO: 61018 - protein, 523 aa, Oryza sativa
MDLLRDRRLGALLVVVLVLVSGAAVEASIHTYDREPFRGGGERVPPLRGAREGVVADGADLAAPRLLLHQMLGFLTVRFTNVTFWRTPESAESHAKMAHSTGLVQAILFEAADRDNIGGSAYGGQRSICCTPDLAKLEGCKQGEVIRRPSSDDPDWPYVLDTHFSGSHLSVKLEDEVVRITKTGMYNLFFISCDPKLRGLSMSGKTVWRNPGGYLPGRMAPLMKFYVFMSLAYLLVMVVWSSQYIRFWRDIMPIQNWITLIIALGLFEMTLWYFEYLNFNSSGVRPIGITTWVVTVGAIRKTISRLLILSISMGYGVVRPTLGGLTSKVLLLGLTYFLASELLDIAENVGTINDISGKARLFLVLPDAFLDAFLILWIFTSLSRTLEKLQARRSSVKLDIYRKFTNALAVSVIASVAWIGYEVYFKATDPFSERWQSAWIITAFWDVLAFVLLLVICYLWAPSQSSQRYAYSGEAADDDDEESQSLTKGTDGDVGMVKVDKDRSGGVSSAFSLEDEAEEDKRE

SEQ ID NO: 61019 - protein, 953 aa, Flaveria trinervia
MMSSLSVEGMLLKSARESCLPARVNQRRNGDLRRLNHHRQSSFVRCLTPARVSRPELRSSGLTPPRAVLNPVSPPVTTAKKRVFTFGKGRSEGNRDMKSLLGGKGANLAEMSSIGLSVPPGLTISTEACEEYQQNGKSLPPGLWDEISEGLDYVQKEMSASLGDPSKPLLLSVRSGAAISMPGMMDTVLNLGLNDEVVAGLAGKSGARFAYDSYRRFLDMFGNVVMGIPHSLFDEKLEQMKAEKGIHLDTDLTAADLKDLVEKYKNVYVEAKGEKFPTDPKKQLELAVNAVFDSWDSPRANKYRSINQITGLKGTAVNIQSMVFGNMGNTSGTGVLFTRNPSTGEKKLYGEFLINAQGEDVVAGIRTPEDLGTMETCMPEAYKELVENCEILERHYKDMMDIEFTVQENRLWMLQCRTGKRTGKGAVRIAVDMVNEGLIDTRTAIKRVETQHLDQLLHPQFEDPSAYKSHVVATGLPASPGAAVGQVCFSAEDAETWHAQGKSAILVRTETSPEDVGGMHAAAGILTARGGMTSHAAVVARGWGKCCVSGCADIRVNDDMKIFTIGDRVIKEGDWLSLNGTTGEVILGKQLLAPPAMSNDLEIFMSWADQARRLKVMANADTPNDALTARNNGAQGIGLCRTEHMFFASDERIKAVRKMIMAVTPEQRKVALDLLLPYQRSDFEGIFRAMDGLPVTIRLLDPPLHEFLPEGDLEHIVNELAVDTGMSADEIYSKIENLSEVNPMLGFRGCRLGISYPELTEMQVRAIFQAAVSMTNQGVTVIPEIMVPLVGTPQELRHQISVIRGVAANVFAEMGVTLEYKVGTMIEIPRAALIAEEIGKEADFFSFGTNDLTQMTFGYSRDDVGKFLQIYLAQGILQHDPFEVIDQKGVGQLIKMATEKGRAANPSLKVGICGEHGGEPSSVAFFDGVGLDYVSCSPFRVPIARLAAAQVIV

SEQ ID NO: 61020 - protein, 319 aa, Wolbachia endosymbiont of Drosophila simulans
MGEEVAEYDGAYKVTKGLLKEFGENRVVDTPITEHGFAGLAVGAAFAGLKPIVEFMTFNFSMQAIDQIVNSAAKTNYMSGGQLGCPIVFRGPNGAAARVAAQHSQCFAAWYSHIPGLKVIAPYFASDCRGLLKAAIRDPNPVIFLENEIAYGHEHEVSDSELSNKDYLLEIGKAAVIREGKDVTITAFSLKLMDALNAADLLSSEGIEAEVIDLRTLRPLDTQTVINSIQKTNRLVSVEEGWPFAGIGAELSAVVMEQGFDYLDAPVVRVTGKDIPLPYAANLEKKALPQVEDIVEAVHQVCFRKNSSFLCLLFRIGPS

SEQ ID NO: 61021 - protein, 695 aa, Candida glabrata CBS 138
MSNAAIIDSFLDSLDYEKSQDIELVESLLKQIPLKGLSRLGLAISNLTVTNSRTGLAGKLVIELAQTQSTPVSSDLKNGDIVIIKPYSKKEDNDQQCQGVVVKISNAESNSTSPTSLAIAIDESQENIATTMIHSNEKFYVMKTVNTVTYDRMNSTLRKLKEFKEKSISNPIIDILLPTEGVKKLRASIPNAKKSNIQFFDENLNDSQKYAIRFSMENKLSIIHGPPGTGKTYTVVELIRQLISKDSTSRVLVCAPSNIAVDTILERLSKSIKDKRWLLRIGHPARLLKTNWYHSLDILSKEGTDSASIINDISMEITKTIASIKSIKSSGERRKAWAEVKQLRKELRLRERKVINDLIKQSRVVVATLHGSSSRELCNYYKSIEEGENDNLFDYVIIDEVSQSLEPQCWIPLISHLQSKITKLVLAGDSKQLPPTIKTNNNDKVMKVLGTTLFDRLVNMYGDEFKNLLNIQYRMNAKIMEFSSKAMYNGELKADSSVENIVLSDLPGVDSNEETDEPIIWYDTQGDDFPEVDEEEDELKSKSAKFLYSSKLNTNEAYLVLHHVRKLIESNVQQDCIGIISPYNAQVSLLKKLVNGTEDSPVYPLIEISSVDGFQGREKECIILSLVRSNDKAEVGFLKEQRRLNVAMTRPKRQLCVIGNIETLQRSGNSFLKDWTEWSEDNADLRYPDVGEIYE

SEQ ID NO: 61022 - protein, 613 aa, Acidobacteria bacterium Ellin345
MATSGYNAPRILRSRIPRVCVAVIGATPEEMIAKAEGIIRENPFLEFRLDYLTNPAAALPKVKRLLETRPDAVIIGTCRRAVNGGKFKGSASAQLEILAKAAAAGCQLLDVELETAESVKASELQKLREAASIILSFHDFKATKKLDDILARMVKIHVEYYKVVSTATSLYDNVQMMKFLEKHGHDYWLIGLCMGEQGIISRVLSVRAGSVFTFAAASAGEETAPGQVTYRDLRSTFRIDHVDAATHVYGVAGDPVAHSLSPAMMNLAFRRENVNGVYLALHTKKTDDLMACIRDIPLRGLSITMPHKEEMVKHLANTDDLVRKIGAVNTIVRAQDGKLYGFNTDVAGIVGPLSDRITVTGAKILVVGAGGAARAAVFGLAARGAHISIVNRTVPKAQKLAKEAGAKVVKRADLKKLDFDVIINATSVGMMNPKVSPLEADELRARIVFDMVYNPVNTRLIQLAKAKGLATIPGYEMFVQQGARQFEIWSGKPAPVEEMRGIVMKALGESPVLEAPTPVPPPLPAEAPKPAVAAKPVAGKTAPVTKSVLAAKPAAAKSALVAKPAPVTKHVPVAANHNGTGKKAAPVAKKPEPKPVAKKAAPPAKKKVVAKKK

SEQ ID NO: 61023 - protein, 124 aa, uncultured archaeon
MIHMIDLDNMKYDNDGLIAAISQDYKTGEVLMIAYMDREALENTIETGHGHYWSRSRQKQWKKGESSGHVQIIHDIRVDCDMDAILLQVEQIGGACHMGFRSCFYRTIEGDVVGEKVFDPDEVY

SEQ ID NO: 61024 - protein, 371 aa, Arabidopsis thaliana
MPTLYKKAGCLGIREFMAIRSLPSSSRCSSSSSSSSYSLASTSLSNRLETIFKKASELCTLCDIEACVIYYGPDGELKTWPPEREKVEDIALRYSQLNEALRRKKSVTLYDFLNKKKDKTNLEKKAKITDNDDLKTCLKNVNILKYPLADHYSPDQVSQLIQSLEPHVSKVRERIRFVESQKHKETKPDHQSLASSSLNHQTQSLNPSQFSLFMYNHGDNTLSQIPVSASNFNQDYFSALLEQSELKSQIMKQDLCGYEQNMCMSNHGDATLSQIPLSASNLNQDFSALLQDESGLMQQELCGYDQNMFMNNNNFQHSFVSNTQDHSAPVVQESVNNNYGLMPHVPCGYDQNLFTSDITNNNLLINNSMFL

SEQ ID NO: 61025 - protein, 229 aa, Zea mays
  misc_feature (185)..(185): Xaa can be any naturally occurring amino acid
MMMAEVANHSKRNHTDSYFSGKAVAVPAAAATSSEEFGSMSSKKPRNASPRLAPVSPKVRTHARTVRCQCPLSPVRTYVRLRSPMAICLAQVFFLVGAAAAAATTVQEKKDKIGERVAALQQLVSPFGKTDTASVLQEASGYIKFLHQQLEVLSSPYMRAPPAAGAAPEVSFRRPSSSSPLMSSXRKPDPQRYSLRSRGLCLVPVDLTLQLTQSNGADLWAPAHTARRR

SEQ ID NO: 61026 - protein, 396 aa, Pyrococcus furiosus DSM 3638
MSEDEAQFHGNYDDYVTYLKRRIRQLELQVRMLEADKERLERELSRLRSEMSRLRQPPAFAGSVIEVLDDDRAIVQNYNGPRFVVRIAPWIDKSKLRPGTRVALDQRTMAIIEILPASKDPAVLGFEVVERPNVTYNDIGGLKKQLQELREAIELPLKHPELFEEVGIDPPKGVLLYGPPGCGKTLMAKAIAHEVNATFIRVVGSELVRKYIGEGARLVHELFELAKEKAPTIIFIDEIDAIGAKRLDETTGGEREVNRTLMQLLAEMDGFDPRGNVKVIAATNRPDILDPALLRPGRFDRLIEVPLPDFEGRLEILKVHTRRMKLRGVDLRLIAELTEGASGADLKAIATEAGMFAIRERRTYVTQEDFLKAIDKVLGNEKKIIQQIMSHEVIYG

SEQ ID NO: 61027 - protein, 506 aa, Dechloromonas aromatica RCB
MRILRLLKIASVASRFGLDEMVLEHEPSGRLVRIANALQFWRDLSTPRAVRLRLALESLGPIFVKFGQVLSTRRDLMPPDIADELARLQDRVPPFDSALALAEIEKAYGRPASEVFAEFDATPIASASIAQVHFAKLREEDGGHEVAVKILRPNMLSVIEHDLALMDNLAMLLEKLWSDGKRLKPREVVAEFAKYLRDELDLMREAANASQLRRNFTDSQLLIVPEVHWDFCTSTVMVMERMKGTPISQIDKLRADGIDLSKLSAAGVEIFFTQVFRDGFFHADMHPGNIFVAPDGRYIALDFGIVGTLTDSDKNYLAQNFLAFFRRDYKRVAEAHIESGWAPKDTRVDEFEAAIRAVCEPIFDRPLKDISFGKILLRLFQTSRRFNVEIQPQLVMLQKTLLNIEGLGRQLDPELDLWKTAKPFLERWMSEQIGWRGLIKTFKQEAPYLARTIPQLPRLVHQALSNPTKADLQPQLAQLIAAQHQQNRWLAIIALLLALLVGALFA

SEQ ID NO: 61028 - protein, 214 aa, Aspergillus nidulans FGSC A4
MTSLKSLFLSFFLVVALGLALVNASEPRGPKITNKVYFDIQHGDESLGRIVLGLYGKTVPETAENFRALATGEKGFGYEGSNFHRVIKDFMIQGGDFTRGDGTGGKSIYGAKFKDENFKLRHTKTGLLSMANAGKDTNGSQFFITTAVTPWLDGKHVVFGEVLEGYDIVDKIQNVPKGRNDRPLKDVKIVKSGELEMEADVANEGDKKGSHNEL

SEQ ID NO: 61029 - protein, 570 aa, Oryza sativa (japonica cultivar-group)
MGNQCQNGTLGSDYHNRFPREHAVGYVQGDSYLDLKKFDDTWPEVNNFKPTAASILRRGLDPTSINVLGRKTADLREHYIIGRKLGQGQFGTTYLCTEINTGCEYACKTIPKRKLITKEDVEDVRREIQIMHHLSGHKNVVAIKDVYEDGQAVHIVMELCAGGELFDRIQEKGHYSERKAAELIRIIVSIVAMCHSLGVMHRDLKPENFLLLDKDDDLSIKAIDFGLSVFFKPGQVFTELVGSPYYVAPEVLHKRYGPESDVWSAGVILYVLLSGVPPFWAETQQGIFDAVLKGHIDFQSDPWPKISDSAKDLIRKMLSHCPSERLKAHEVLRHPWICENGVATDQALDPSVISRLKQFSAMNKLKKLALRVIAERLSEEEIAGLREMFKAVDTKNRGVITFGELREGLRRFGAEFKDTEIGDIMEAAHNDNNVTIHYEEFIAATLPLNKIEREEHLLAAFTYFDKDGSGYITVDKLQRACGEHNMEDSLLEEIISEVDQNNDGQIDYAEFVAMMQGSNVGLGWQTMESSLNVALRDAPQCQAAEATDEPVKVKVKVKCSNQIRRRRRQV

SEQ ID NO: 61030 - protein, 526 aa, Salinibacter ruber DSM 13855
MHDKIVVLDFGSQYTQLIARRVRETGVYSEIRPCTVEADAIDALNPSGVILSGGPCSVYDEAGPALDPALLELERPDGTPVPLLGICYGLQAMAHQFGGEVARADRREFGRAQLQVPPDGQEKSLLFEGVPSGSTVWMSHSDHLTDLPDGYEVIARTDNAPVAAVRDTDGPYYGVQFHPEVVHTDYGRQILENFAHAICGCSGDWTPASFVEEQTETIRDRVGDRHVILGLSGGVDSSVAAALLQRALGDQLHCIFVNNGLLRKGEWNQVQDTFRGHFEMDLRTTDATDRFLERLDGVTDPEEKRTIVGNTFIEVFEEQTEAIAADLGHRPTYLAQGTLYPDLIESVSFKGPSVTIKTHHNVGGLPEELDFDLIEPFRELFKDEVREIGRLLDVPDPIVGRHPFPGPGLAIRILGQITRERLALLREADAIFIEELRANDLYDEVWQAFAVLLPVQAVGVMGDERTYENVCALRAVTSVDGMTADWAHLPHDFLGHVSNRIVNEVPGINRIVYDVSSKPPATIEWE

SEQ ID NO: 61031 - protein, 714 aa, Oryza sativa (japonica cultivar-group)
MGYAAADLGAWKNTRQQYSPSSPISLGSSVFSESSLELSTTTADGSTANAVLAAIVASIGNLLQGWDNAAIAGAIMYIKNEFNLQNDPMMEGLILAMSLIGATIITALSGMITNSIGKRPLLSVAAILYSISALIMFQASNEYMLLLARLIYGFGSGLVVTYAPLYISETAPTNMRGLLNTLPQFNGSLGMLLSYIMVFLMSLTLNPNWRIMLGSLSIPSFVFLLLCIFYLPESPVFLVSKGKIEEAKNVMKRLRGTNEVSSEIAFLIQGLTVDQDNYIEDYMIGHNNDEFDDQSISNTETTKLYGHEEGVTWFARPFKGKNVVESDHSPIPNLLDPIVTLFDSIHGNILNTPEFTSSGNMSNDIEQPKTDLESQEDLDTDYEDDLGHPLLFHQGSYMEGIDDACVNGGWHIAWKFVQRENEFGQTQDDFQQIFLQGDILQAGRVSHATALVSTPSFHHSIGPAMVHPSKFNLSTEGQSWSDLLQPGVKQGLIVGVTIQILQQLAGISGILYYTPQILEQAGAGILLKWFNVSSSSSSILTSALTTFTMLPSIGIAMKCMDRYGRRSLLLYTIPMLIVSLIILIVVNVMNLEAIFGAILSTFGVIIYVCCFVMGFGPIPNVLCSELFPPSCRNRCMSICTLTFWIVSIIVTYAFPVMLSSIGLIGVCGIYAVVCIVSFIFVLIKVPETKGMPLAVIANSLAVGARLSVKRNENI

SEQ ID NO: 61032 - protein, 305 aa, Miscanthus sinensis f. glaber
IESVGEGVTDVAPGDHVLPVFTGECKECPHCKSAESNMCDLLRINTDRGVMIGDGKSLFSINGKPIYHFVGTSTFSEYTVMHVGCVAKINPQAPLDKVCVLSCGISTGLGASINVAKPPKGSTVAIFGLGAVGLAAAEGARIAGASRIIGVDLNPSRFEEARKFGCTEFVNPKDHKKPVQEVLAEMTNGGVDRSVECTGNISAMIQAFECVHDGWGVAVLVGVPHKDAELKTHPMNFLNERTLKGTFFGDFKPRTDLPNVVELYMKKELEVEKFITHSVPFAEINKAFDLMAKGEGIRCIIRMEN

SEQ ID NO: 61033 - protein, 305 aa, Miscanthus sinensis f. glaber
IESVGEGVTVVAPGDHVLPVFTGECKECPHCKSAESNMCDLLRINTDRGVMIGDGKSRFSINGKPIYHFVGTSTFSEYTVMHVGCVAKINPQAPLDKVCVLSCGISTGLGASINVAKPPKGSTVAIFGLGAVGLTAAEGARIAGGSRIIGVDLNPSRFEEARKFGCTEFVNPKDHKKPVQEVLAEMTNGGVDRSVECTGNINAMVQAFECVHDGWGVAVLVGVPHKDAELKTHPMNFLNERTLKGTFFGDFKPRTDLPNVVELYMKKELEVEKFITHSVPFAEINKAFDLMAKGEGIRCIIRMEN

SEQ ID NO: 61034 - protein, 482 aa, Staphylococcus aureus subsp. aureus NCTC 8325
MGSFFNKIARKEDPAIYQNKDGHLKRTLRVRDFLALGVGTIVSTSIFTLPGIVAAEHAGPAVALSFLLAAIVAGLVAFTYAEMAAAMPFAGSAYSWVNVLFGEFFGWVAGWALLAEYFIAVAFVASGFSANLRGLVKPIGIELPAALSNPFGTNGGFIDIIAAIVILLTALLLSRGMSEAARMENILVILKVLAIILFVIVGLTAINVSNYVPFIPEHKVTATGDFGGWQGIYAGVSMIFLAYIGFDSIAANSAEALDPQKTMPRGILGSLSVAIVLFIAVALVLVGMFHYSQYANNAEPVGWALRQSGHGVVAAIVQAISVIGMFTALIGMMLAGSRLLYSFGRDGLLPSWVSHLNDKHLPNRALVILTIIGVLIGSMFPFAFLAQLISAGTLVAFMFVSLAMYRLRKREGKDLPIPAFKLPLYPVLPAITFVLVLLVFWGLGFEAKLYTLIWFIVGIILYLSYGLRHSKKNDVAEYHPPK

SEQ ID NO: 61035 - protein, 305 aa, Miscanthus sinensis f. glaber
IESVGEGVTDVAPGDHVLPVLTGECKECAHCRSAESNMCDLLRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASRIIGVDLNPSRFEEARKFGCTEFVNPKDHKKPVQEVLAEMTNGGVDRNVECTGNINAMIQAFECVHDGWGVAVLVGVPHKDAEFKTHPMNFLNERTLKGTFFGNFKPRTDLPNVVELCMKKELEVEKFITHSVPFAEISKAFDLMAKGEGIRCIIRIEN

SEQ ID NO: 61036 - protein, 427 aa, Zea mays
  misc_feature (279)..(279): Xaa can be any naturally occurring amino acid
MSSSMESSYLPATTESLAQAQEAKDASESISILYRVIQDPSSSADALRTKEVAITNLTNYLTKENRAEELRNLLTQLRPFFAVIPKAKTAKIVRGIIDAVAKIPGTSDLQISLCKEMVEWTRAEKRTFLRQRVEARLAALLLENQEYTEALTLLTSLIKEVRRLDDKLLLVDIDLLESKLHFSLRNLPKAKASLTAARTAANAIYVPPAQQGTIDLQSGILHAEEKDYKTAYSYFFEAFEAFSALEDPKAIFSLKYMLLCKIMVNQADDVAGIISSKAXGLKYLGPDVDAMKAVADAYSKRSLKYFETALRDYKSQLEEDPIVHRHLSSLYDTLLEQNLCRLIEPYSRVEIAHIAEMIELPIDHVEKKLSQMILDKKFAGTLDQGAGCLIIFEDSKTEEIFPATLETISNVGKVVDSLYVRSAKIMA

SEQ ID NO: 61037 - protein, 305 aa, Miscanthus sinensis f. glaber
IESVGEDVTDVAPGDHVLPVFTGECKERAHCRSAESNMCDLLRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASRIIGVDLNPSRFEEARKFGCTEFVNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSILFAEISKAFDLMAKGEGIRCIIRMEN

SEQ ID NO: 61038 - protein, 297 aa, Bacteroides fragilis YCH46
MIQTRLKGMGVALITPFKEDESVDYDALMRLVDYLLQNNADFLCVLGTTAETPTLSEEEKKKIKKMVIDRVNGKIPILLGVGSNNTRAVVETLKNDDFTGVDAILSVVPYYNKPSQEGIYQHYKAIASATELPIVLYNVPGRTGVNMTAETTLRIAKDFQNVIAIKEASGNITQMDDIIKNKPANFDVISGDDGITFPLITLGAVGVISVIGNAFPREFSRMTRLALQGDFANALTIHHKFTELFNLLFVDGNPAGVKSMLNAMGMIENKLRLPLVPTRITTFEAIRKVLNELNIKC

SEQ ID NO: 61039 - protein, 305 aa, Miscanthus sinensis var. sinensis
IESVGEGVTDVAPGDHVLPVFTGECKECPHCKSAESNMCDLLRINTDRGVMIGDGKSRFSINGKPICHFVGTSTFSEYTVMHVGCVAKINPQAPLDKVCVLSCGISTGLGASINVAKPPKGSTVAIFSLGAVGLAAAEGARIAGASRIIGVDLNPSRFEEARKFGCTEFVNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSIPFAEINKAFDLMAKGEGIRCIIRMEN

SEQ ID NO: 61040 - protein, 231 aa, Burkholderia xenovorans LB400
MTQDELKQLVGQAAADYVNANVPEGSVIGVGTGSTANCFIDALAAGKTRYRGAVSSSLATTARLQSHGFKVLDLNEIDSLPVYVDGADEIDHSGAMIKGGGGALTREKIVASVSDVFVCIADASKLVETLGSFPLPIEVVPMARTSIGRRVTALGGVPVVRVTKEGVPFITDNGNEIIDVKGLRISDPRTLETHVNAWPGVVTVGLFASRGADLCLLGTDTGVDTIRFSKG

SEQ ID NO: 61041 - protein, 589 aa, Aspergillus oryzae
MEKDEIEAKAEPRGAAFESPPPLYGDSEPTQAGLGRRIWDSFKRDPNAHVTGGHGSSGADGKSFDIENAAQKTASSPLQRSLKGRHLQMIAIGGSIGTGLFVGSGKVLATGGPASVLIAYALIGCMLYCTVHALGEMAVLFPVAGSFAHYSTRFIDPAWGFAMGWNYALQWLVVLPLEIVAASITVDYWQSDISNAAWVAIFWVLIVSINLFGVRGYGEAEFVFSLIKVVAVIGFIILGIVLNCGGGPQGGYIGGKYWSDPGAFHNGFKGLCSVFVNAAFAFAGTELVGLAAAETANPRKSLPTAVKQVFWRICLFYIVSLTLVGLLVPWNDERLLDGSSSADAKASPFVIAIKNAGISVLDSIMNVVIMIAVLSVGNSSVYGSSRTLAALAEQGQAPKFLSYIDRKGRPLWAILIASALGLLSFLAASDKQEVAFEWMMAISGLSSIFTWGSVCLAHIRFRRGWKAQGHSLNELAFQSQPGVIGSWIGFLFNCLVLVAQFWVGFAPIGYATKTAGELVEAWFSVYLAAPVVLLFYIPYKLWFKTPFIRAKDMDLQTGRRDLDLQYLIEQERAEQAEWPAWKKVYKFFC

SEQ ID NO: 61042 - protein, 364 aa, Acidobacteria bacterium Ellin345
MKLKIAVLGGDGVGPEVTAEAVRVLRAIANVNGYEFQFTEAEVGGVAIRKHGSPLPEKTLHTCLESDAVLLGAVGHPEFDSMPRDKKPETGLLALRQALGGFANLRPVQAYAALSDSSPIKQELVFGADVMIVRELLGGLYFGEPRGIKDDTATNTMSYSRYEIERVAHIAFQQARNRRKKVTSVDKANVLECSQLWRLVVTEVAKQYSDVKLEHAYVDSFAMRLIQAPTAFDVVLTENLFGDILSDEAAVIGGSLGLLASATIGGEVDLYEPVHGSAPDIAGKGIANPVGAINSVAMLLRHTAKLEQDARLIESAVNAVLLDGYRTKDLVPSARKFNTTAEVGSAIERQCADMAISHYAYHAV

SEQ ID NO: 61043 - protein, 641 aa, Oryza sativa (japonica cultivar-group)
MPPPRLPCLAAFLALALVVVVCAAEPDADRAALLDFLAGLGGGRGRINWASSPRVCGNWTGVTCSGDGSRVVALRLPGLGLSGPVPRGTLGRLTALQVLSLRANSLSGEFPEELLSLASLTGLHLQLNAFSGALPPELARLRALQVLDLSFNGFNGTLPAALSNLTQLVALNLSNNSLSGRVPDLGLPALQFLNLSNNHLDGPVPTSLLRFNDTAFAGNNVTRPASASPAGTPPSGSPAAAGAPAKRRVRLSQAAILAIVVGGCVAVSAVIAVFLIAFCNRSGGGGDEEVSRVVSGKSGEKKGRESPESKAVIGKAGDGNRIVFFEGPALAFDLEDLLRASAEVLGKGAFGTAYRAVLEDATTVVVKRLKEVSAGRRDFEQQMELVGRIRHANVAELRAYYYSKDEKLLVYDFYSRGSVSNMLHGKRGEDRTPLNWETRVRIALGAARGIAHIHTENNGKFVHGNIKASNVFLNNQQYGCVSDLGLASLMNPITARSRSLGYCAPEVTDSRKASQCSDVYSFGVFILELLTGRSPVQITGGGNEVVHLVRWVQSVVREEWTAEVFDVELMRYPNIEEEMVEMLQIAMACVSRTPERRPKMSDVVRMLEDVRRTDTGTRTSTEASTPVVDVQNKAESSSAAH

SEQ ID NO: 61044 - protein, 328 aa, Glycine max
MAPNITTVKTTITDAQAKVATDHGRAYVTFLAGNGDYVKGVVGLAKGLRKVKSMYPLVVAVLPDVPQDHRNILTSQGCIVREIEPVYPPENQTQFAMAYYVINYSKLRIWEFVEYSKMIYLDGDIQVFDNIDHLFDLPDNYFYAVMDCFCEPTWGHTKQYQIGYCQQCPHKVQWPTHFGPKPPLYFNAGMFVYEPNLATYRDLLQTVQVTQPTSFAEQDFLNIYFKDKYRPIPNVYNLVLAMLWRHPENVELDKVKVVHYCAAGSKPWRYTGKEENMEREDIKMLVKKWWDIYEDETLDYNNPLNVDKFTAALMEVGEVKFVRAPSAA

SEQ ID NO: 61045 - protein, 354 aa, Fagopyrum esculentum
MTSEMAPQNITNAERGAEQVKPSSQPSRAYVTFLAGNGDYVKGVIGLAKGLRKTQSGYPLVVAVLPDVPQEHRRMLVAQGCIIKEIQPVNPPDNQTQFAMAYYVINYSKLRIWEFIEYSKMIYLDGDIQVYDNIDHLFDLPDGYLYGAMDCFCEKTWSHSLPYKIGYCQQCPDRVQWPERLGPKPTLYFNAGMFIFEPSVSTYNDLLHTLEITPPTPFAEQDFLNMYFKDVYRPIPNVYNLVLALLWYHPGLMKLDEVKVVHYCADGSKPWRYTGKGDNMDREDVRMLVKKWWEIYDDQSLDPQPKMVEGKKFDKLEEYSESLDHPPKVAEEDKLEKPMAAMTGFSYVHAPSAA

SEQ ID NO: 61046 - protein, 255 aa, Fagopyrum esculentum
AHAYYVINYSKLRIWEFIEYSKMIYLDGDIQVYDNIDHLFDLPDGYLYGAMDCFCEKTWSHSLPYKIGYCQQCPDRVQWPERLGPKPTLYFNAGMFIFEPSVSTYNDLLHTLEITPPTPFAEQDFLNMYFKDVYRPIPNVYNLVLALLWYHPGLMNLDEVKVVHYCADGSKPWRYTGKGDNMDREDVRMLVKKWWEIYDDQSLDPQPKVVEGKKFDKLEYSESLDHPPKVAEEDKLEKPMAAMTGFSYVHAPSAA

SEQ ID NO: 61047 - protein, 604 aa, Nicotiana sylvestris
MDVRRRSEKPAYPTKEFAAGEKPLKPHKQQQEQDNSLLIASDALPLPLYLTNGLFFTMFFSVMYYLLSRWREKIRNSTPLHVVTFSELVAIASLIASVIYLLGFFGIGFVQSFVSRDNNDECWDEEDENDEQFLLEEDSRRGPATTLGCTAVPPPPALQIVPMVPPQPSKVAAMSEKPAPLVTPAASEEDEEIIKSVVQGKMPSYSLESKLGDCKRAASIRKEALQRITGKSLEGLPLEGFDYESILGQCCEMPIGYVQIPVGIAGPLLLDGREYSVPMATTEGCLVASTNRGCKAIYASGGATSVLLRDGMTRAPCVRFGTAKRAAELKFFVEDPVKFETLAAVFNQSSRFARLQRIQCAIAGKNLYMRFVCSTGDAMGMNMVSKGVQNVLDYLQNEYPDMDVIGISGNFCSDKKPAAVNWIEGRGKSVVCEAIITEEVVKKVLKTEVAALVELNMLKNLTGSAMAGALGGFNAHASNIVSAVYIATGQDPAQNIESSHCITMMEAVNDGKDLHVSVTMPSIEVGTVGGGTQLASQSACLNLLGVKGANREVPGSNARLLATIVAGSVLAGELSLMSAISAGQLVKSHMKYNRSTKDVTKASS

SEQ ID NO: 61048 - protein, 422 aa, Acidobacteria bacterium Ellin345
MTTAEQFDKELNPWEQQAARFDTATTKLKLDEGLISVLRVPAREVTVNIPVSMDTGKIRMFTGYRVQHSFARGPAKGGVRFSPEVSLDEVRALAAWMTWKCAVVNIPFGGAKGGIICDPKTMSMGELERMTRRYTAELMEFIGPEKDVPAPDVNTNEQTMAWMMDTYSMHMRMTVNAVVTGKPLNMGGSRGRREATGRGVMITADQCLKKFNMSRESTRVIVQGFGNVGSNAAQLMHQAGYKVIGIGEWDGGLHNVNGIDINALVDYKAHNGSIHGFPGAEKAATADLMIADCDVLIPAATENVITTKNAEKVKARIIVEGANGPTTSGADEILNDKKVFVMPDILANAGGVTVSYFEWVQDRQGYFWKESVVNEQLEHIMVSSFEDVVNMSEQHNVPNRIGAYMLAIDRVAYTIRQRGIYA

SEQ ID NO: 61049 - protein, 125 aa, Zea mays
  misc_feature (89)..(89): Xaa can be any naturally occurring amino acid
  misc_feature (94)..(94): Xaa can be any naturally occurring amino acid
  misc_feature (110)..(110): Xaa can be any naturally occurring amino acid
MARGGGDRSREDDPFSDGGTTGTDSDESSPRGVGARGPGSTSNPILTRLAVSRPWGGAGGPAAPGVCLLRFAWESAAGSLVGAAVGFGXGLVPXKGFQGSFAAAASSAVXFAVLAGVLCLVACSL

SEQ ID NO: 61050 - protein, 339 aa, Brassica napus
ISSDDVVALPYSSGTTGLPKGVMLTHKGLVTSVAQQVDGDNPNLYFHSDDVILCVLPRSEHASLELIQRCKVTVAPMVPPIVLAMAKSPETEKYDLSSIRVVKSGAAPLGKELEDAVSAKFPNAKLGQGYGMTEAGPVLAMSLGFAKEPFPVKSGACGTVVRNAEMKIIDPDTGDSLSKNKPGEICIRGHQIMKGYLNNPAATAETIDKDGWLHTGDIGLIDDDDELFIVDRLKELIKYKGFQVAPAELEALLIGHQDITDVAVVAMKEEAAGEVPVAFVVKSKDSELSEDDVKQFVAKQVVFYKRINKVFFVESIPKAPSGKILRKDLRAKLANGLVN

SEQ ID NO: 61051 - protein, 301 aa, Zea mays
MSHFGRSGPPDIRDTFSLLVLNISFREGDLTLAPPAPPTLPTLSLPLSLIASFSYPSPPRFTGTTADDLFPLFERYGKVVDVFIPRDRRFCSSVARRTGDSRGFAFVRYKYADEAQKAIDRLDGRDVDGRNIMVQFAKYGPNAEPIRKGRVKEGVEKSQDRSRSRSPRPRHRDRDHRSQSRSRSRERHVRDRDRGYRRRSRSRSRSLSSSPDNRSHHRARDDDRRKSMSKSRSRSRSTSRSRSYYSASPARHSASPRKSPPPQRSPTPAKHANGKVAPLSRCVSPLPKRATSRSPGSDGKE

SEQ ID NO: 61052 - protein, 350 aa, Pseudomonas fluorescens PfO-1
MPHTSKITALPILDLSLLDGTPSQRQAFLDDLRHAARDVGFFYLTGHGIDAGLLEQVQDYARQFFALPDSEKNAVGMINSPHFRGYNRAASEITRGQPDQREQFDLGAERDVLPLNADSPLWARLQGPNQWPGALPQLKPLLLDWQQAMTQMSLRLLRAFAQALSLPEDAFDRLYGDKPNEHIKLMRYPGQASTASNQGVGAHKDSGFLSFLLQDQQAGLQVEIEEGRWIDALPRDNTLVVNIGELLELATNGYLRATVHRVVSPPVGSERLSIAFFLGAQLDAVVPLYPLPTALLREARGPASDPLNPLFRDVGWNYLKGRLRSHPDVAQRFYADASNTSTPLRKTANA

SEQ ID NO: 61053 - protein, 109 aa, Oryza sativa (japonica cultivar-group)
MEAAAAAGVQLGTSKPQIATQAEMSEARLPLPYRDQCAHLLIPLNKCRVAEYYLPWKCEPERHAYEKCQYELVMERMIQMQKIREAQEAKSKGAATIGVPLIPSTAKLS

SEQ ID NO: 61054 - protein, 2036 aa, Arabidopsis thaliana
MESSLPQVAALDRSTLLKAFDETKTGVKGLIDAGITEIPSIFRAPPATLTSPKPPSSSDFSIPTIDLKGGGTDSITRRSLVEKIGDAAEKWGFFQVINHGIPMDVLEKMIDGIREFHEQDTEVKKGFYSRDPASKMVYSSNFDLFSSPAANWRDTLGCYTAPDPPRPEDLPATCGFLRPHYSLVCLKDFGGHFFREMMIEYSKEVMKLGKLLFELLSEALGLNTNHLKDMDCTNSLLLLGHYYPPCPQPDLTLGLTKHSDNSFLTILLQDHIGGLQVLHDQYWVDVPPVPGALVLITNDKFISVEHRVLANVAGPRISVACFFSSYLMANPRVYGPIKEILSEENPPNYRDTTITEYAKFYRSKGFDACLIRVLGTLIICVMPSFMTVKAMHETVTRSIFGYIIGLCVNSRQLNHLMFQVLLFISMDAKKLDTGPRDAINWLPDEILGKILSLLATKQAVSTSVLSKKWRTLFKLVDTLEFDDSVSGMGEQEASYVFPESFKDLVDRTVALQCDYPIRKLSLKCHVGRDDEQRKACVGRWISNVVGRGVSEVVLRINDRGLHFLSPQLLTCKTLVKLTLGTRLFLGKLPSYVSLPSLKFLFIHSVFFDDFGELSNVLLAGCPVVEALYLNQNGESMPYTISSPTLKRLSVHYEYHFESVISFDLPNLEYLDYSDYALYGYPQVNLESLVEAYLNLDKAEHVESPDVTKLIMGIRNVEILSLSPDSVGVIYSCCKYGLLLPVFNNLVSLSFGTKKTRAWKLLADILKQSPKLETLIIEDLNGYPLDVSMPLNQVKELQILEYGESDDERLQSRLESKNKLGSFDFEKFLFPIPPPIKITVSPHPSDSGGDGSNSKSSSDDEFVSLDSSTSGLCSSSGKFFDLIKFLIALSVLRETKTMESTKIAPSFDRASELKAFDETKTGVKGLVDSGISKIPRIFHHSSVELANPKPLPSDLLHLKTIPTIDLGGRDFQDAIKHKNAIEGIKEAAAKWGFFQVINHGVSLELLEKMKDGVRDFHEQPPEVRKDLYSRDFGRKFIYLSNFDLYTAAAANWRDTFYCYMAPDPPEPQDLPEICRDVMMEYSKQVMILGEFLFELLSEALGLNPNHLKDMECLKGLRMLCHYFPPCPEPDLTFGTSKHSDGSFLTVLLPDNIEGLQVCREGYWFDVPHVPGALIINIGDLLQASLRNQYMFASSDFTSLFTMLDLFKKSSSWFKLITNDKFISLKHRVLANRATRARVSVACFFHTHVKPNPRVYGPIKELVSEENPPKYRETTIRDYATYFNGKGLGGTSALLDFKQLVPSLNLRKMFHSCSVIREAKTMETKNIAPSFDRASELKAFDETKTGVKGLVDSGISQIPRIFHHSSVKLANPEPVSSDLLHLKTIPTIDLGGRVFEDELKHKNAIEKIKEAAEKWGFFQVINHGVSLELLEKMKDGVRGFHEQSPEVRKDFYSRDLTRKFQYSSMSPFLILDLMCNLYSYMVNCFRDVTIEYSEQVMNLGEFLFTLLSEALGLNPNHLNDMDCSKGLIMLCHYYPPCPEPDLTLGTSQHADNTFLTVLLPDQIEGLQVLREGYWFNVPHVPGALIINIGDLLQASLHNQYIFLLCFAELITNDKFVSLEHRVLANRATRARVSVAETKTMEMMKIDPLFDRASELKAFDETKTGVKGLVDSGVSQVPRIFHHPTVKLSTPKPLPSDLLHLKTIPTIDLGGRDFQDAIKRNNAIEEIKEAAAKWGFFQVINHGVSLELLEKMKKGVRDFHEQSQEVRKEFYSRDFSRRFLYLSNFDLFSSPAANWRDTFSCTMAPDTPKPQDLPEICRDIMMEYSKQVMNLGKFLFELLSEALGLEPNHLNDMDCSKGLLMLSHYYPPCPEPDLTLGTSQHSDNSFLTVLLPDQIEGLQVRREGHWFDVPHVSGALIINIGDLLQASSLMHFCSVLHCITYLPYCSFLGFVVLMQLITNDKFISLEHRVLANRATRARVSVACFFTTGVRPNPRMYGPIRELVSEENPPKYRETTIKDYATYFNAKGLDGTSALLHFKI

SEQ ID NO: 61055 - protein, 281 aa, Pyrococcus furiosus DSM 3638
MERAFIEWYPRGYGVAFKIKKKIYEKLSKYQKIEVYETEGFGRLLALDGTVQLVTLGERSYHEPLVHPAMLAHPKPKRVLVIGGGDGGTVREVLQHDVDEVIMVEIDEDVIMVSKDLIKIDNGLLEAMLNGKHEKAKLTIGDGFEFIKNNRGFDVIIADSTDPVGPAKVLFSEEFYRYVYDALNNPGIYVTQAGSVYLFTDELISAYKEMKKVFDRVYYYSFPVIGYASPWAFLVGVKGDIDFTKIDRERAKKLQLEYYDPLMHETLFQMPKYIRETLQRL

SEQ ID NO: 61056 - protein, 305 aa, Miscanthus sinensis var. sinensis
IESVGEGVTGVAPGDHVLPVFTGECKECPHCKSAESNMCDLLRINTDRGVMIGDGKSRFSINGKPIYHFVGTSTFSEYTVMHVGRVAKINPQAPLDKVCVLSCGISTGLGASINAAKPPKGSTVAIFGLGAVGLAAAEGARIAGASRIIGVDLNPSRFEEARKFGCTEFVNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSIPFAEINKAFDLMAKGEGIRCIIRMEN

SEQ ID NO: 61057 - protein, 388 aa, Arabidopsis thaliana
MTTISDLPYDLVKEIFSWVPFTSLRAVRSTCKTWNALSKNQIFGKKSVARNQFLELMILDSRVCSLRFDLQKIRNEDEEDLVDPSMKQISIPNNDDQVEISRVYHCDGLLLCIPKDNSSLMLWNPYLGQTKRIRPKNTFHRDDSFALGYNNRNHKILRLNEENESHIDVYDFSSDSWRTVPDDNPYRDELIYQSGVSLKGNAYFFDREVTTEAEVGTEDLLITGIEDYLRCFDFTTERFGPRLPLPFILPSPSFEYLALSWARDDKLAVLYSHYDTFDIIEIWISTKIEPNAVSWSSFLTVDMSLVNGLPDHFSMYFEAKSFFIDEEKKVVVLFDSKEIKTCRYQMAYIVGDDGYFKSVNIGVSPNSQRKPGRLVCSSYVPSLVQLQD

SEQ ID NO: 61058 - protein, 305 aa, Miscanthus sinensis var. sinensis
IESVGEGVTDVAPGDHVLPVFTGECKECPHCKSAESNMCDLLRINTDRGVMIGDGKSRFSINGKPICHFVGTSTFSEYTVMHVGCVAKINPQAPLDKVCVLSCGISTGLGASINVAKPPKGSTVAIFSLGAVGLAAAEGARIAGASRIIGVDLNPSRFEEARKFGCTEFLNPKDHKKPVQEVLAEMTNGGVDRSVECTGNIYAMIQAFECVYDGWGVAVLVGVPHKDAEFKTHPMNFLNERTLKGTFFGNFKPRTDLPNVVELYMKKELEVEKFITHSIPFAEINKAFDLMAKGEGIRCIIRMEN

SEQ ID NO: 61059 - protein, 106 aa, Candidatus Phytoplasma solani
QNQHQLKEIPFFKAGDIVQVFIKIDEGNRKRVQIFEGLVIKRQGRLMSETSTVRKIFAGVGVELTFPVHSPNNEKIEVVRRGIVRRAKSHYVRNLSSKASRIKEKR

SEQ ID NO: 61060 - protein, 521 aa, Azoarcus sp. EbN1
MAHQKILILDFGSQVTQLIARRVREQQVYCEIHPFDVSDDFVREFAPAGVILSGGPNSVYEAVGWHAPQSVFELGVPVLGICYGMQTMAQQLGGSVESSGKREFGYAEIRARGHSELFRSIEDRTNDEGHGLLDVWMSHGDKVTALPPGFKVIASNESCPVAGMADEVRKFYAVQFHPEVTHTIKGRDMLARFVHEICGCGRDWNMPDYVNEAIEKVRAQVGQEEVILGLSGGVDSSVVAALLHRAIGEQLTCVFVDNGLLRLNEAEQVMLTFARNLGVKVIHVDATEQFMGHLKGVSDPEAKRKIIGREFVEVFQAEANKLPNAKWLAQGTIYPDVIESAGSKTGKAHTIKSHHNVGGLPETLNLKLLEPLRELFKDEVRELGIALGLPHEMVYRHPFPGPGLGVRILGEVKQEFAELLRRADAIFIDELRAADWYDKTSQAFAVFLPVKSVGVMGDGRTYEYVVALRAVETQDFMTAHWAELPHSLLGKVSNRIINEVRGINRVVYDISGKPPATIEWE

SEQ ID NO: 61061 - protein, 305 aa, Miscanthus sinensis var. sinensis
IESVGEGVTDVAPGDHVLPVFTGECKECPHCKSAESNMCDLLRINTDRGVMIGDGKSRFSINGKPIYHFVGTSTFSEYTVMHVGCVAKINPQAPLDKVCVLSCGISTGLGASINVAKPLKGSTVAIFGLGAVGLAAAEGARIAGASRIIGVDLNPSRFEEARKFGCTEFLNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSIPFAEINKAFDLMAKGEGIRCIIRMEN

SEQ ID NO: 61062 - protein, 309 aa, Oryza sativa (indica cultivar-group)
MAANFWTSSHCEGSKQLLDQEDVDKVPQADSDRGITPEEFRLVKIHMSFLLQIKANHLMISDIWRLAQQVKVRQRVIATAVTYFRRVYTRWPYFPIKLINALRIMWNIKLLEFCSDAGYVYRKSMTEYDPRLVAPTCLYLASKVEESTVQARLLVFYIKKMCASDEKYRFEIKDILEMGMKLLEALDYYLVVYHPYRPLLQCFDFRLLQDAGITDLTQFAWGIVNDTYKMDLILIHPPYMIALACIYIASVLKDKDITLWFEELRVDMNIVKNISMEILDFYDTYKIDPQRGLPEDKIAPVMNKLPSKA

SEQ ID NO: 61063 - protein, 509 aa, Oceanicola granulosus HTCC2516
MRGPHNILRLIRTGATFERTGAMQVVMDALAAPRLVRIVMRGLVWPFRWLGYPGDSAMPPVTRALTALGPAYIKFGQILSTRPDVVGTDLAQQLRVLQDKLPPFGRDVALTEFEREIGRPVDTTFSSFSEPVAAASIAQVHKAILADTGEPIAVKVLRPGIERAFRRDIDAFYFAARVVEVLSPSSRRLRPLDVIKHFEGVVLGELDLRLESSAASEFASNTAQDDGFQVPDIRWHLSGRRVMTQTWAEGIGLGDIAALDAAGHDRRRLAARVLELFLSHALRDGMFHADMHQGNLKVAANGDIIAFDFGIMGHIDEYTRRVYAQIIFGFIRRDYRRVAEVHFEAGYVPYDRDVDEFARALRAVGEPIFGMDASRISMARLLAYLFEVTERFGMETRTELILLQRTMVVVEGVARSLDPHMNIWEVARPVVEGYIRKHLGPAAFAKDLARTVQVLARFGPRLPDLAQAALIERSREVHEESPDRRWPLVAAGLGGATLVALGVLIGASF

SEQ ID NO: 61064 - protein, 305 aa, Miscanthus sinensis var. sinensis
IESVGEGVTDVAPGDHVLPVFTGECKECPHCKSAESNMCDLLRINTDRGVMIGDGKSRFSINGKPIYHFVGTSTFSEYTVMHVGCVAKINPQAPLDKVCVLSCGISTGLGASINVAKPLKGSTVAIFGLGAVGLAAAEGARIAGASRIIGVDLNPSRFEEARKFGCTEFANPKDHKKPVQEVLAEMTNGGVDRSVECTGNINAMIQAFECVHDGWGVAVLVGVPHKDAEFKTHPMNFLNERTLKGTFFGNFKPHTDLPNVVELYMKKELEVEKFITHSIPFAEINKAFDLMAKGEGIRCIIRMEN

SEQ ID NO: 61065 - protein, 305 aa, Miscanthus sinensis var. sinensis
IESVGEGVTDVAPGDHVLPVFTGECKECAHCRSAESNMCDLRRINTDRGVMIGDGKSRFSINGKPIYHFVGTSTFSEYTVMHVGCVAKINPEAPLDKVCVLSCGISTGLGASINVAKPPKGSTVAIFGLGAVGLAAAEGARIAGASRIIGVDLDPSRFEIARKFGCTEFLNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSIPFAEINKAFDLMAKGEGIRCIIRMEN

SEQ ID NO: 61066 - protein, 317 aa, Arabidopsis thaliana
MGNDQADKKKFSWVIKNFSSLQSEKIYSDQFVIDGCRWRLLAFPKGNDTKSDHLSLYLDVAESESLPCGWRRHAQFSFTIVNHIPEKCSQRKETIHWFCEKVSDWGFTNLVPLIELKAEDSGFLVKGELKIVVEIEVLEVIGLLNVSESESMDVNGFHVLPSQAKYVKSLFEIHPDIATKFRIKNQYLKTGYMNVLLCLIETVRRSPKEISKNDLADAYVALESLTDHGFKLDWLKKKLDQVTQKKEKEAAGETRMHEIGEELKDLKLKCSDLEAQLDKVKWKCSDLEAQLVKEKADVLAAIAPLGSSDDGVFDDFF

SEQ ID NO: 61067 - protein, 715 aa, Streptomyces coelicolor A3(2)
MTRARPNWKGSPVWSGHPYPLEAAYDGQGTNFALFSEVAERVDLVLVDDDGNHSTVPLPDVDGFVWHCYLPGVGPGQRYGYRVHGPWAPAVGHRCNPAKLLLDPYTRAVDGLVDNHASLFERARGKADPGDSAGHTMLGVVTDPFFDWGDDRPPRRPYSESVIYEAHVRGLSRTHPDVPEELRGTYAGLAHPAVVDHLTSLGVTAVELMPVHQFVHDGVLLDRGLSNYWGYNTIGFFAPHNGYAALGTRGQQVSEFKSMVKTLHEAGLEVILDVVYNHTAEGNERGPTLSFRGIDNASYYRLVDGDWQHYYDTTGTGNSLLMRHPYVLQLIMDSLRYWVTEMHVDGFRFDLAATLARQFHEVDRLSAFFDLIQQDPVISRVKLIAEPWDVGEGGYQVGNFPQLWSEWNGKYRDAVRDFWRAEDHSLGEFASRLTGSSDLYQHSRRRPRASVNFVTAHDGFTLRDLVSYNDKHNEANGEDNRDGESHNRSWNCGAEGGTKDPAVRELRGRQQRNFLATLLLSQGIPMICHGDELGRTQRGNNNAYCQDNEISWIDWRLDGEQRALLDFARRLIALRADHPVLRRRRFFHGETLTHADQPLPDLVWLLPDAREMTDDDWQRSDAHTVGVFLNGDAIAEPDPRGRPVVDDSFLLLLNSHWEPADFRLPDAGYGERWTALVDTGDPDGVPDEAEHKAGTRLTVEQRSLVLLSRPSRTGR

SEQ ID NO: 61068 - protein, 193 aa, Streptomyces avermitilis MA-4680
MQPLIDHARAHGQRPEEFAQLAEGQSPQALFITCSDSRVVPALITGARPGELFELRTAGNIVPPYAASQHPTSEAATIEYAVEVLKVTDVVVCGHSHCGAVGALVRGDDLTAVPAVRDWLAHAAPRPAGAVEDPAVTEAVQSHVLTQLLRLRSYPCVSAKLTSGQLRLHAWFYEVHTGSVLAHRPQTDTFTAL

SEQ ID NO: 61069 - protein, 433 aa, Synechocystis sp. PCC 6803
MVNATPFITTKSEEIFAAAQHLMPGGVSSPVRAFKSVGGQPIVFDRVEGAQIWDVDGNQYIDYVGTWGPAICGHAHPDVISALKQALDKGTSFGAPCAQENVLAEMVIDAVPSIEMVRFVNSGTEACMSVLRLMRAFTGREKIIKFEGCYHGHADMFLVKAGSGVATLGLPDSPGVPSNTTKATLTAPYNDLEAVKALFVENPDSIAGVILEPVVGNAGFILPDAGFLEGLRELTKEYGALLVFDEVMTGFRVSYGGAQARFGITPDLTTLGKVIGGGLPVGAYGGREEIMAMVAPAGPMYQAGTLSGNPLAMTAGIKTLEILQKPGSYEYLDKITKRLVDGLLAAAQDAGHEVCGGSISAMFGIFFAPGPVRNYEDAKLADTNKFARFHRGMLERGIYLAPSQYEAGFPSLAHTQEQIDQTIAVAKEVFATL

SEQ ID NO: 61070 - protein, 426 aa, Methanocaldococcus jannaschii
MALKMDKSKELFEEAKKYLVGGVNSPVRYFKPYPFFVEKAKDCYLFDVDGNCYIDYCLAYGPMVLGHANDAVIKAVKEQLELGSAYGCPTEKEIILAKEVVKRVPCAEMVRFVNSGTEATMSAIRLARGVTGRKKIIKFDGAYHGAHDYVLVKSGSGALTHGHPNSPGIPEETTKNTILIPFNDEDAVKKAINENKDEIACIIVEPIMGNVGCILPKEGYLEFLREITEENDILLIFDEVITGFRLAKGGAQEYFGVVPDIATLGKILGGGFPIGAIVGRRELMEQFSPLGAIYQAGTFNGNPISITAGIATLKQLDDRFYKETARTAKILADTLRELADKHNIKAKVYNIASMFQIYFNDKEVVNYEIAKQSDTEKFMKYFWRLLEKGVFVPPSQFECCFTSIKHDDEVVDKTIKAMEDVFEGLE

SEQ ID NO: 61071 - protein, 465 aa, Oryza sativa (japonica cultivar-group)
MAELPLAAGLLDLRPCKLAPPPPPPLPVSPSPRHHRRPHSTATACRAAPDLHSSTELADGSIVFRFARPRDDDDEEQQQRRADAVAPEAAAVVESGLDGDAAAAAEPEARDGGGEGEVTATATGLDAEEVVASGGAEATATSGLEDAGEEASDGSTARDSDTDVDTESSASTAADDDQPAEFAVPPPPAEEVCNKVDWEKDTSEVKNTDRMVPVASSTLVLASGAAILPHPSKAATGGEDAYFIACDGWFGVADGVGQWSFEGINAGLYARELMDGCKKFIMENQGAADIKPEQVLSKAADEAHSPGSSTVLVAHFDGQFLNASNIGDSGFLVIRNGEVYQKSKPMVYGFNFPLQIEKGDNPLKLVQNYTIELEDGDVIVTASDGLFDNVYEQEVATMVSKSLQADLKPTEIAEHLAAKAQEVGRSAAGSTPFSDAALAVGYLGFSGGKLDDIAVVVSIVRKSEI

SEQ ID NO: 61072 - protein, 748 aa, Oryza sativa
MVRGKQSAIVPFRRSLRLRHNQNSQNAFSMDQNHESSSRRSQKNTVVKLSMRMPKFCDGRLMNAERNNKELNGSERRETQCGLNNWTEEQDMALRKAYFTARPSPNFWKKVSKMRLPYGRHQIKGTSKMKFSPLGHFTLSDPKHPNVLEPSFRRRTAKQKSLAAQKTVRHLLKKQCLTDQTQEADHFSIFETSPTVLPVEFSFEDSPGTPNSSGKKLLAREGTTRPRKKAAGSKALDSVKTQQAGGVKAARNALITEATDFISHFKKMQANPLAHVVEDDEDDEIDAQFLEFIAAKAISPTEVYIYSKFSSICRSMNVLFISQNWCRYLHRHKSSAVGVPQMDTLLSVVASDIISRLISSLITKYSNQSTADHKLERLQWLLLRARTIVEEAHGRQISNQGMLLQLRQLMQSMYQGYYILNAFQEQHITGKRRRSSSSLKLKKLQAAMEDLESAIDDSKKEFVVFLLGCPCLPQRPYDTHLFREKCMFGRHEEKELIREFLLQPCDSPLRVLPIIRPREVGKNTLIEHVCNEESVHEHFSRVVRFKSDDLNNEENQESFFKTSELVASSTMSLVVVELVNDDISDETWRGFCSSIANGCSKMIVISRSETISRLGTTQALKLKRLKRHEFWYFFRTIAFGTADPEEHPELLRIARRIATTDQSDGPLHLCNDGYKTVAAGCLVNDELPRIIADDMLIRTNAFSEGSFDILRWKSPIRPYYCYIANCVVKKAPQIVQPKDKSLKRRRGI

SEQ ID NO: 61073 - protein, 547 aa, Listeria monocytogenes str. 4b F2365
MTVKPGFDYMNNPLLNKGTAFSKEERASYQLDGLLPPIIETIEQQAVRIETQIENLETPLHKHQLLTNLYNENRTLYYYVVTKNVTDYLPIIYTPTIGDAVIQYHKEYTAPDEALFIDAFAPEKLSASIKNYAKNNPNIDMIVITDGEGVLGIGDWGVNGVKIAVGKLAVYTVAAGLAPDRVLPVVIDAGTNNETLLNDPLYLGNKRPRLSESEYDAFIASFVNVMKEVFPKAILHWEDFGRANASRILHNYRDKICTFNDDIQGTGAMVVAAVLATIQVSKIPLSEQKIIIFGAGTAGIGIADQLSAQWMRETGLPFESAKKHFYLVDRNGLVLDNMTDLTTGQKKYAHPSTEWSNVPTDTLENLMEAVHPTMLIGCSGVTGAFKESIVKKMTQYTERPAILPLSNPTKLAEATASDLIQWTDGKALIVTGSPSKPVEYQHTTYEIGQANNALLYPGLGLGALVTRAKYITDGMLAAASMAVAEQISPNKAGAALLPHVRTLRETSRAVAIAVANQAIKENIHQVELTNVTEAIEREMWQPIYKGV

SEQ ID NO: 61074 - protein, 359 aa, Coccidioides immitis RS
MAASRTLRIGLIPGDGIGREVIPAGRRILEALPASLGLKFSFVDLDAGFETFKRTKTALPDKTVDTLKKECDGALFGAVSSPTTKVAGYSSPIVALRKRLDLYANVRPVKTTPGANVPAPIDLVIVRENTEDLYVKDEKSYDTPEGKVAEAIKRISERASSRIATIAGEIALRRQKIRETGQAAPRSGPMVTITHKSNVLSQTDGLFRETARKALAAEKFSSVEIEEQIVDSMVYKLFRQPSYYDVIVAPNLYGDILSDGAAALVGSLGLVPSANVGDGFAIGEPCHGSAPDIEGKGIANPIATLRSAGLMLEFLGEEEAAAKIYAAVDANLDEGKFLSPDLGGKATTEEVLQDVLRRL

SEQ ID NO: 61075 - protein, 554 aa, Flavobacteria bacterium BBFL7
MCGIVGMFQLKKDSQEQREKVLELSKKLRHRGPDWSGIYCGDKAILAHERLTIVDPQSGGQPLYSPDGKIVLAVNGEIYNHQKIRNHYKDTYEFKTKSDCEVILALYQDKGVDFMDELTGMYGFALYDSDKDVFLCARDHQGIIPLYYGTDDLGQFYVASELKALEGTCNEIAPFPPGHYYYSETGEFVKWYNREWKDYDAVKDNTSSVADLKQAMEDSVHRHLMSDVPYGVLLSGGLDSSIVSAVAKKYAAKRIESGDNKEAWWPQLHSFAIGLEGSPDLAAAQEVADHIGTVHHSVNFTIQEGLDAIKDVVYYLETYDVTTIRASTPMYLLARVIKSMGIKMVLSGEGSDEIFGGYLYFHKAPNAEEFHKETVRKLDTLHLYDNLRANKSLAAWGIEGRVPFLDKEFMDVAMRLNPEDKMCGGGKMEKHILREAFEDYLPHSVAWRQKEQFSDGVGYSWIDTLKEVVNDVVTDDMMEAAPFKFKINPPKNKEEYYYRSIFSEHFPSDTAASCVPSLKSVACSTPVALEWDEAFKNMNDPSGRAVSGVHDEGY

SEQ ID NO: 61076 - protein, 432 aa, Mycobacterium avium 104
MTETTTQPVADAVADRPSVSLRTRGRWLRWGLLSVWGPGLVVMLADTDAGSLITASQSGAQWGYRMVLPQLILMPVLYVVQEMTVRLGIVTGRGHGSLIRERFGRGWAWLSAFTLFASAIGALLTEFAGVAGVGELFGVSRWVSIPVATIALLALALTGSYRRVERIGLAVGAAELAFLVAMVMARPDPGALAHGLTSMPLGDSSYLLLIAANVGAVIMPWMIFYQQGAVVDKHLSESTIRQARYDTAFGAVLTQLIMIAVVITMASTIGRHGDGAPLETVGQIAQSLTPYLGHVGGTVLFGLGMLGAALVAAIVASLAGAWGLAEVFGWKHTLNQRPNRATAKFYLTYSLAHIVGAVLVLASVDLVNLAVDVEIMNALLLPIVLGLLLALEARALPEQWRMRGLHKHVTRALCLVTIGFGLYMVPQALGWA

SEQ ID NO: 61077 - protein, 113 aa, Oryza sativa (japonica cultivar-group)
MGEIRALRNMDDDEVFAYAKRIAAPYDLVMQTKQLGRLPVVQFAAGGVTTPADAALMMQLGCDGVFVGSGIFKSGDPARRARAIVQAVTHCRLSRPSTPPPRRPRWRKKERKR

SEQ ID NO: 61078 - protein, 305 aa, Miscanthus sinensis var. sinensis
IESVGEGVTDVAPGDHVLPVFTGECKECAHCRSAESNMCDLLRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASRIIGVDLNPSRFEEARKFGCTEFLNPKDHKKPVQEVLAEMTNGGVDRSVECTGNINAMIQAFECVHDGWGVAVLVGVPHKDAEFKTHPMNFLNERTLKGTFFGNFKPRADLPNVVELYMKKELEVEKFITHSIPFAEINKAFDLMAKGEGIRCIIRMEN

SEQ ID NO: 61079 - protein, 305 aa, Miscanthus sinensis var. sinensis
IESVGEGVTDVAPGDHVLPVFTGECKECPHCRSAESNMCDLLRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASRILGVDLNPSRFEEARKFGCTEFLNPKDHKKPVQEVLAEMTNGGVDRSVECTGNINAMIQAFECVHDGWGVAVLVGVPHKDAEFKTHPMNFLNERTLKGTFFDNFKPRTDLPNVVELYMKKELEVEKFITHSIPFAEINKAFDLMAKGEGIRCIIRMEN

SEQ ID NO: 61080 - protein, 335 aa, Arabidopsis thaliana
MVKKGGTKRKIAIETIQKRDSLRVTCTKRREGLYSKASQLCLLSDAQIAILATPPSSESNVSFYSFGHSSVDAVVSAFLSGQRPVPKDNKETREDVGICLTRNNLGLGFWWNDESLARSENPQEISEAIDSMRTLLRNLKELRADEALACNQAFVNDREDLKNNDKCDFVSDHETHDQTLILQSASPICCIPENLNEITQEPNQTLNIQSSTSAICCVPDNSPENFNEITEEQDQIRSICETFCVMDNNAALPEMNLDYDQDIGFDTPFESALNDWFSDNTTHQEISASILNAVVDDQVSVDLTPFSYFQRCLDGDNLRFSDCFKDFANTISALG

SEQ ID NO: 61081 - protein, 604 aa, Nicotiana tabacum
MDVRRRPVKPFYPSKDDVSAGESLKPHKQTQQVSSPKASDALPLPLYLTNGLFFTMFFSVMYFLLVRWREKIRNSTPLHMVTLSELVAMVSLIASVIYLLGFFGIGFVQSFVSRSNSDSWDVEDENTEQFIIEEDSRRGPCAAATTLGCAVPPPSARQIVPMVPQQPAKVALAVAEKPAPIITPAVSEDDEEIIQSVVQGKTPSYSLESKLADCKRAASVRREALQRITGKSLEGLPLEGFDYESILGQCCEMPVGYVQIPVGIAGPLLLDGREYSVPMATTEGCLVASTNRGCKAIFASGGAISVLLRDGMTRAPVVRFATAKRAAELKFFVEDPLNFETLSLVFNKSSRFARLQSIQCAIAGKNLYMRFSCSTGDAMGMNMVSKGVQNVLDYLQNEYPDMDVIGISGNFCSDKKPAAVNWIEGRGKSVVCEAIITEEVVKKVLKTEVASLVELNVLKNLTGSAMAGALGGFNAHASNIVSAVYLATGQDPAQNVESSHCITMIEAVNDGKDLHISVTMPSIEVGTVGGGTQLASQSACLNLLGVKGANREAAGSNARLLATIVAGSVLAGELSLMSAISAGQLVKSHMKYNRSSKDVTKISS

SEQ ID NO: 61082 - protein, 363 aa, Glycine max
MGKWDHRPWRRFFRRRRSPVRPPTFYDINAPLPEYWQDGIPLWEKKYCTIVGLVPWQKIVDSKMFVYCHSNVFDWNDSAAEEAFQNAKSHYWAKINSLPCDISLPDPDTYINQIDWSPYIDPDLIKEIDGAFFIVPDEEQENAMKNKRTKTSLNDENPWECTDTPLSTALENNEVQGWNQGNSGDVDNTDNPWECSITCGNGGLTDNAWEGGPVKSWGWNEEKGHNNQCKDWNSGNSQDKGWGKARDSSWCQQQSNNLANFGNSSWHCKSSQQNVTPMKTGWRNRGANVSGWKQQEKAGVSRRNYGGGWTAQNKGNQWNQGNQWREGSHRHTLGYNGSQFQRDGCQTGHYWGKDRSKKRDFFP

SEQ ID NO: 61083 - protein, 305 aa, Miscanthus sinensis var. sinensis
IESVGEGVTDVAPGDHVLPVFTGECKECPHCRSAESNMCDLLRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASRILGVDLNPSRFEEARKFGCTEFLNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSIPFAEINKAFDLMAKGEGIRCIIRMEN

SEQ ID NO: 61084 - protein, 525 aa, Pseudomonas putida GB-1
MALDIHAHRILILDFGSQYTQLIARRVREIGVYCELHPFDMDDEAIREFNPRGIILAGGPESVHEANSPRAPQAVFDLNVPVLGICYGMQTMAEQMGGKVEGSDLREFGYARVDVVGKSRLLDGIEDHVDDDGVLGLDVWMSHGDKVTQMPGNFNILASTPSCPIAGMYDDARGYYGVQFHPEVTHTKQGGRILSRFVQDICGCEALWTASNIVEDAIAQVRAQVGSANVLLGLSGGVDSSVVAALLHRAIGDQLTCVFVDNGLLRLHEGDQVMAMFKENMGVKVIRADAEKQFLDNLEGEADPEKKRKIIGRTFIDIFDAEASKLENIQFLAQGTIYPDVIESAGAKSGKAHVIKSHHNVGGLPEEMNLKLVEPLRELFKDEVRKIGLELGLPYDMVYRHPFPGPGLGVRILGEVKKEYADILRRADHIFIEELRKADWYHKTSQAFVVFQPVKSVGVVGDGRRYAWVVALRAVETVDFMTARWAHLPYELLETVSGRIINEIDGISRVTYDVSSKPPATIEWE

SEQ ID NO: 61085 - protein, 305 aa, Miscanthus sinensis var. sinensis
IESVGEGVTDVAPGDHVLPVFTGECKECPHCKSAESNMCDLLRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASRIIGVDLNPSRFEEARKFGCTEFLNPKDHKKPVQEVLAEMTNGGVDRSVECTGNISAMIQAFECVHDGWGVAVLVGVPHKDAEFKTHPMNFLNERTLKGTFFGNFKPRTDLPNVVELYMKKELEVEKFITHSIPFAEINKAFDLMAKGEGIRCIIRMEN

SEQ ID NO: 61086 - protein, 466 aa, Bacillus pumilus
METNKQSYTLPEGFWWGSSASATQTEGSVPGDGKGPNIWDHWFEQEPTRFFDGVGPDVTSQFYRKYKEDIRLMKEIGHNSFRLSISWSRLLPEGTGAVNEEAVSFYNDVINELIAHDIEPFVNLYHFDMPMALQEKGGWVNRQVVDDYVSYAALCFQLFGDRVKKWFTHNEPIVPVEGGYMYSFHYPNEVDFQKAVQVGFHEILSNAKAIAAYKKLQQGGKIGIILNLTPSYPRSQHPRDVEAAEMADAFFNRSFLDPAVKGHFPEKLVEVLKKEGFMPSMEEGDLELIRENTIDLLGINYYQPRRVKAKEHMPHPQAPFMPNHYFDSFEMPGRKMNVYRGWEIYEKGIYDILKKVQTDYDNIECFISENGMGVEGEERFKDEEGMIHDDYRIDFISEHLKWVHRAIQEGSNVKGYHLWTFMDNWSWSNAYKNRYGFVSVDLQKDGKRTIKKSGYWFQSVSKNNGF

SEQ ID NO: 61087 - protein, 168 aa, Oceanicola granulosus HTCC2516
MTMHPVLLVMGTAGSGKSTLGELLAERLEATFLEGDQFHPEENIARMEAGKPLNDEMRWPWLDRIAEAAADARQTRPVIIACSALKRSYRERLRAGLPGLVTIYPDAPKDLVAERMGSREGHFMPLSLLDSQFDTLEVPGDDEDHIAVSARRPPEEMADAVLEAWRAR

SEQ ID NO: 61088 - protein, 305 aa, Miscanthus sinensis var. sinensis
IESVGEGVTDVAPGDHVLPVFTGECKECPHCKSAESNMCDLLRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASRIIGVDLNPSRFEEARKFGCTEFVNPKDHKKPVQEVLAEMTNGGVDRSVECTGNINAMIQAFECVHDGWGVAVLVGVPHKDAEFKTHPMDFLNERALKGTFFGNFKPRTDLPNVVELYMKKELEVEKFITHSIPFAEINKAFDLMAKGEGIRCIIRMEN

SEQ ID NO: 61089 - protein, 762 aa, Oryza sativa (japonica cultivar-group)
MGTAHLSHLQYMGRLRGKVWVWRRSASGTRLGSERVLRRQVRRFDSVRSTTARAQNGNAGRSMTEERGCTMSDTEMPFKYSSGKAFPLGVSQVEGGLNFALFSQHASSVILCLKLPGRGTEDEKGADVVEFVLDQQKNKTGDIWHVIVEGLPASGVLYGYRVGGPQGWDQGHRFDSSTVLLDPYAKLVSGRKYFGVAEEKSSQHFGTYDFDSSPFDWGDDYRLPNLPEADLVIYEMNVRAFTADESSGLDSTSRGSYLGLIDKIPHLLELGVNAVELLPVFEYDELEFKRYPNPRDHMVNTWGYSTINFFAPMSRYASAGGGPVAASKELKQMVKELHKAGIEVILDVVYNHTNEADDAHPYMTSFRGIDNKVYYMLDLNKNAELLNFSGCGNTLNCNHPVVKELILDSLRHWVEEYHIDGFRFDLASVLCRGPDGCPLDAPPLIKEIAKDAVLSRCKIIAEPWDCGGLYLVGRFPNWDRWAEWNGKYRDDLRRFIKGDPGMKGVFATRVSGSADLYQVNERKPYHGVNFVIAHDGFTLCDLVSYNLKHNDANGEGGCDGCNDNFSWNCGVEGETNDLNVLSLRSRQMKNFHVALMISQGTPMMLMGDEYGHTRYGNNNSYGHDTCINNFQWEQLEQRRDGHFRFFSEMIKFRHSNPILRRDRFLNKNDVTWHEDCWENQESKFLAFTVHDHNSGGDIYLAFNAHDYFVDAVIPPPPHHKCWNRVVDTNLESPNDIVPEGVPFTGPKYRIAPYSSILLKAKP

SEQ ID NO: 61090 - protein, 394 aa, Sinorhizobium meliloti 1021
MSKNWRPATQLVHGGTLRSQYGETSEAIFLTQGFVYDSSEAAEARFKGETDGFIYARYGSPTNDMFEKRMCMLEGAEDARATASGMAAVSAAILCQVKAGDHIVAARALFGSCRWVVETLAPKYGVECTLVDGRDLKNWEDAVRPNTKVFFLESPTNPTLEVIDIAGVARLADQIGAKVVVDNVFATPLFQKPLELGAHVVVYSATKHIDGQGRCLGGVVLSDKQWVDENLHDYFRHTGPAMSPFNAWTLLKGIETLPLRVKQQTESARRVADFLAEQPQVARVIYPGRKDHPQADVIAKQMSGGSTLVAFELKGGKEAAFALQNALEIIRISNNLGDSKSLITHPATTTHKNLTDEARAELGISAGTVRFSAGIEDSEDLIEDFARALKGVNA

SEQ ID NO: 61091 - protein, 336 aa, Zea mays
MSVSASSPAAAAGDEKQEAAPVRRCKGVNDLDKVVLREVRGSSAEVYLYGGHVTSWKDEHGDELLFVSNKAIFKPPKAIRGGIPICFPQFSNFGNLEPHGFARNRTWSVDDDPPPFPVPTSNSAYIDLILKPTEDDLKIWPHSFEYRLRVALSPGGDLMLTSRIRNTNADGKPFSFTFAYHTYFKISDISEVRVEGLETLDYLDNLQDRARSTEQGDAIVFESELDRIYLGTPSKIAIIDHEKKRTFVVRKGGLPDAVVWNPWDKKAKAMSDFGDDEYKRMVCVEAAAIEKTVTLKPGEEWTGKLELSAVPSSYYSGQLDPDRVIQDSTVPEDSIS

SEQ ID NO: 61092 - protein, 104 aa, Arabidopsis thaliana
  misc_feature (6)..(6): Xaa can be any naturally occurring amino acid
  misc_feature (21)..(21): Xaa can be any naturally occurring amino acid
  misc_feature (48)..(49): Xaa can be any naturally occurring amino acid
  misc_feature (51)..(51): Xaa can be any naturally occurring amino acid
  misc_feature (54)..(56): Xaa can be any naturally occurring amino acid
  misc_feature (58)..(59): Xaa can be any naturally occurring amino acid
  misc_feature (61)..(61): Xaa can be any naturally occurring amino acid
  misc_feature (63)..(67): Xaa can be any naturally occurring amino acid
MASSMXSSAAVVTSPAQATMXAPFTGLKPSAAFPVTRKTKKDITSIAXXGXKEXXXCXXCXQXXXXXASGGGGQKNMKEKGKKIKIKKKKKKTKKKSSNSPTGR

SEQ ID NO: 61093 - protein, 369 aa, Trichodesmium erythraeum IMS101
MEIKAAVAFEAGKPLTIETINLEGPKAGEVMVEIKATGVCHTDAYTLSGADPEGLFPSILGHEGAGVVVEVGHGVTHLKPGDHVIPLYVPECRQCEYCLSMKTNLCQAIRTTQGRGVMPNGTSRFSLNGEIIHHYMGTSTFANYTVLPEISLAKIRKDAPFDKVCYIGCGVTTGIGAVINTAKVEVGAKVIVFGLGGIGLNVIQGAKMVGADMIVGVDINPAKQELAKKFGMTHFVNPKEVEGDLVPYLVDLTKGGADYTFECIGNINVMRQALECCHKGWGMSVIIGVAGAGEEISTRPFQLVTGRVWKGSAFGGAKGRTDVPKIVDWYMEGKINIDDLITNVMPLEKINEAFDLMHEGKSIRSVVTF

SEQ ID NO: 61094 - protein, 203 aa, Listeria monocytogenes str. 1/2a F6854
MYKAIIFDVDGTILDTERAVLHSLQAVLAEEGLSYELDELRFVLGITGAAAVEQLNILDQEKVLGKWIEREATFIEEVEVFEGIHKVLHAIPESGVVTSKNALEMEKGFYPFNIQDHFQAIVCASDTENHKPHPDPLLKGLEILGREPHEVLYVGDSSYDMKCAHAAGAHFGLALWGAKTTDGFEQAELVFEKPEDILAYVSK

SEQ ID NO: 61095 - protein, 338 aa, Caulobacter crescentus CB15
MVLDAAAATLPRKSGSVDRLVRLAEADMAGVNRLITDRMQSDVAIIPALAEHLIAAGGKRLRPLMTVAAARLAGADNDHFQKLAAAVEFIHTATLLHDDVVDGSQLRRGKVAAHLIWGGAQSVLVGDFLFARAFELMVETNSMKALEILARASRVIAEGEVLQLMRSHDLNLSQAVYLEIIQAKTAELFAAASEAGAVSAGVDVAKSEALRDYGLNLGLAFQLADDALDYGGATETLGKNAGDDFREGKATLPLLLAIARSGPREAEFWERAIGRREQTEADFRRARELIIGSGALDATLDLAADYADKAKAALAMFPANDWREALEELADFAVSRRA

SEQ ID NO: 61096 - protein, 474 aa, Streptomyces avermitilis MA-4680
MSTTQTRTGMGQVVVIGGGIAGLAAAHRLLDRGARVTVLEASDRLGGKLLPGEIEGVRVDLGAESMLARRPEAVGLAREVGLADRLRPPATASASIWTRGALRPMPKGHVMGVPGTASALAGVLSDEGLRRIERDADLPRTEVGDDVAVGEYVAARLGREVVDRLVEPLLGGVYAGDAYRLSMRSAVPQLFTAIHAHASLTEVVRELQEKAAAAQQTGPVFMGIEGGVGQLPLAVAESVRARGGEIVTGAPGDRAAQSRGRAGRVGGWSPAVVCCTPTPWSSPCPPRPPPSCCAPRHPPPRPSWPASSTRPWRWSPSPTAAVGPASPKAAASSCLPSTGAPSRHRRSPPRSGAGSRTRTPTCWCCARRSGGTARRRSSAGTTPASWTSRATTCARRPAWPPRRSPAASPAGPTACRSTPSATTRAWPASATTSPSCPASPSAARRTTASASRPASPARTPPWSSWAATARGWTS

SEQ ID NO: 61097 - protein, 408 aa, Mycobacterium avium 104
MAQRTQGSLKGNWYLLGPAFVAAIAYVDPGNVAANVSAGSQYGYLLLWVIVAANVLAGLVQYLSAKLGLVTGRSLPATIGKRMSRPARLVYWVQAELVAIATDAAEVVGGAIALHILFGLPLLAGGLITGVVALLLLGIQDRRGQILFERVITGLLLVIAIGFAASFFVKTAPPEAVLSGLLPRFRGTESVLLAAAILGATVMPHAVYMHSGLVLDRHGHPDEGPHRRLLLRVTRWDVVLAMAVAGTVNAAMLLIAATNLQHRDVSASIEGAYAAIHNTLGATIAVMFAVGLLASGLASSSVGAYAGAMIMQGLLHRSIPMVVRRLITLCPALLILAVGYDTTRALVLSQVVLSFGIPFAVLPLIKLTSDRELMGSDANHRITTILGWGVGILISLLNMVLIWLTVTG

SEQ ID NO: 61098 - protein, 711 aa, Oryza sativa
MSLLVVLFFFFLSPPLAAAAAYTEYSCNGTRGNFTEGSAFGLNLELLAAELPANASSSRSLFASAAVGAAAAPEDRVFGLALCRGDMRDAAACAGCVSGAFQRLRALCGRDRDATYYHDLCVVRYSGDDFLSRPDDNSPVINALDANASTYYGWDGRNATTRSFFLSLVGTLFGEMAMYGSYNSSARRYASAVMYVNPQLPTVYGLAQCTPDLSPAQCWHCFQGLQEQNRQWYDGRQGGRILGVRCNFRYESYQFYAGTPDVRIGLQDVAPSPTANNGTNHRKTLVIVLSVSITVFCFMLVGCLLLIKKLRKGDGRKSNRQLEAHSRNSSKTEEALKLWRTEESSTDFTLYDFGDLAAATDNFSEDHRLGTGGFGPVYRATVNVDENADDLGELSDGAEIAVKRLAAQSGQGLKEFKNEIQLIAKLQHTNLVRLVGCCVQEEEKMLVYEYMPNRSLDFFIFDQEQGPLLDWKKRLHIIEGVVQGLLYLHKHSRVRIIHRDLKASNILLDKDLNPKISDFGMARIFGSNMTEANTNRVVGTYGYMAPEYASEGIFSVKSDVFSFGVLLLEIVSGKRNSGHQHYGEFVNLLGYAWQLWREERGCELIDPTLGECSGSEAAAIIRCVKVALLCVQDNATDRPTMTDVAAMLGSDGVPLPDPLPPPHYQLRVSGDDYDDGGRGSPAGGGFRPSRWRFTDSCSTNDVTITTIEEGR

SEQ ID NO: 61099 - protein, 450 aa, Methanosarcina barkeri str. Fusaro
MENKYDIIIIGTGTAGRTFAGKVAHSGLKIAIVDSREYGGTCPIRGCDPKEVLTNITKVIDSSNRLMGKGVRIDAPLKLDWTSLIKFKKTFTEGYSSKTEKHLVGMGIDTYHGRAHFENQNTVVVGMDKLKGEHIFLATGAKPRTLNIPGEEYIITSEKLMETKKLPEKIIFIGGGYISMEFAHIARRTGAEVTILQRSEKVLRAFDSDMVDLLMKASKAAGIKILTNKPVISVEKDNNGLILKVQSQSETEPEIQIFRADMVVQGAGRVADIEDLRLENARIKTEKGAIVVDKHMRTSNSRIYAGGDCALEGMQLTPVAALQGEVAAINVLEGDSAEADYTGIPSAVFTIPVLASVGISVAKDDDKYKVIFQDRSNWYTTRKKGMEFAASKVIIDEANDRIMGAHILGPNAEEAINIFASVMRLGLKASDIKKLIFTYPTTCSDIPYML

SEQ ID NO: 61100 - protein, 369 aa, Flavobacteria bacterium BBFL7
MKKVLFIDRDGTIVKEPPVDYQLDSYEKLEFLPMAITQLHRIARELDYELVMVTNQDGLGTDSFPEDTFWPVHNLMMNVLENEGIKFSEVLIDRSFPEQNAPTRKPQTGLLTHYIKGNYDLENSFVIGDRNSDMQLAKNIGCKGIQLPSITDDSTFEDELVALKTDSWKEIFEFLKGQPRKVTVSRKTNETDIKIVLNLDGSGNGKIDTGLKFYDHMLEQLQRHGSLDLDIKVNGDLEIDEHHTIEDTAIALGDAFAKALSSKKGINRYGFLLPMDDSLAQVGIDFGGRPWIVWEAEFKREYVGDMPTELFFHFFKSFSDAAKCNLNMKVEGDNEHHKIEALFKAFAKAIKMAVKQTGDGKLPSTKGTL

SEQ ID NO: 61101 - protein, 291 aa, Oryza sativa
MYPYRFSNVMIGYLNLATLLASIPVIGAGLWMAKGSTATCSSMLQTPLLVIGFVVLLVSLAGFVGACFHVAWALWLYLLAMMLLIAFLLGLTAFGFAVTAGGGGTQVPGRPYREYHTSDYSSWLQKHIQDAKYWRPALACVVGSKACPKIANWSPMDYLQHDLTPIQMINCISGCCKPPTACAYSGGVAVGAQDEDCFRWNNAAGILCYGCESCRAGVMEKVREDWHKISVLNVMVLVVLICICACGCCAFRNARRSVSEYPYGVNRMHKIHPRWDYYWWRWWRDRREQLY

SEQ ID NO: 61102 - protein, 398 aa, Oryza sativa (japonica cultivar-group)
MEGSPSKRRGVTAPAHTDDGDWFSDVPDDVILNIMSFLTTRQAVQTCVLSRRWLNLWRSVPCINADVGEFQRSDTEWEEYDQERESAFKMFMDRVLELRNPAAPIRTFRFRCCRLDGFEGTSDEADMNRWITHAMQKQPWVLDILVLYDALKLDHSAFTCRYLTRIKFINVLMMPGFFQQLEMGCPVLENLFLDESIVADVEISSRTLKVLTIKSTQFSYKFRTTISTPSVTYLKLWRPVNGIYVFNDMPLLVTSILVLYDVQDSSDFCQNLRSLSAAKRLEFDYFGRKLTMENNLQLYPKFNNLVSLTLGQWCLDANFYGLVVFLQNAPKLEKLTLELEKNTPERIIGKLEDRSFTCEHLTRVEVVCSEGDPLVKDVVNFFVNSGLTSAQVQIIRWC

SEQ ID NO: 61103 - protein, 216 aa, Flavobacteria bacterium BBFL7
MKISAYAEIIDMKLDWNKGENGLLPVIVQDATSKEVLMLGYMNEEAFEKTKEENRVTFYSRSKQRLWTKGESSNNFLDVVAIKIDCDQDTILIKANAHGPTCHTGTVSCFDNGDESRFRESENKFTINDLEKTIHQRIDDQVEGSYTYSLIQKGINKVAQKVGEEAVETVIDAINGKEEDFIYEAGDLMYHYLVLLKAKGYSLKDIEKELAKRHQK

SEQ ID NO: 61104 - protein, 119 aa, Zea mays
  misc_feature (57)..(57): Xaa can be any naturally occurring amino acid
  misc_feature (73)..(73): Xaa can be any naturally occurring amino acid
  misc_feature (89)..(89): Xaa can be any naturally occurring amino acid
  misc_feature (104)..(104): Xaa can be any naturally occurring amino acid
MYSSLPVVMAGMRVVKLPLAAELMCAEVVMATAHQASCVRATYSLYNPQQNTWDLNXVSTYCATCDASMLLYXPMKYGWTALCRPDCPXGQSMCGQRLLLTNTXTGAYITERIMDQRMN

SEQ ID NO: 61105 - protein, 450 aa, Oceanicola granulosus HTCC2516
MIPPKPASRPERVSLWRYLRLFRRDILSAQPEKLYRAWMAEFRTPFFRSYLVNDPSLVKRVLQERPDDFPKSDRIGAGLRPLLGQSVFLTNGAQWKRQRRIIDPAFEGGRLRDTYPAMWAAGQAAVARLGPLADGRPVEIEAETSHAAADVIFRTLFSIPIEHALAREVFAEFRTYQRSQPILNLAAFIPARWLPRFFRRETRASAHRIRALIARLTTERGAEIRAGRAPDDLATKIMTTRDPETGETFSDAEMVDQVAIFFLAGHETSASALAWALYLLALYPDWQDKVAAEAAGASDDFASVSRLRITRDVFREALRLYPPVPMMVREARCPETFRDRAVSPGAQVVLSPWHLHRQSRLWERPDEFDPARWASDNGRACAREAYIPFSAGPRVCTGAGFAMIEGVLLLALILRAYRVTPVEDRTPVPVAHLTVRSADGIWLRLAPRQP

SEQ ID NO: 61106 - protein, 760 aa, Cryptococcus neoformans var. neoformans JEC21
MTSPSAQPMIPRSQPPRPSHTQSSPAINSTGIKPNGPPSVIRRAPSVPVNPSTAAASGSLSSLLKSENTAQAVSRSSPPTEPNDLPRPIEPTPMLPITGLPNSSSSSSNARHGSSSSISRGPSVTGTLTPATTALGAPIEPTPPQTGASKMAAAAKRGLDGSAGNNVKVYEEGHPLNEETLKQRGYQTLNILNHPFHLPDRWKLLRPLGQGAYGLVIQVQDAETEIPIAVKCVTRVFDKVILARRALREITLLRHFGEHDNLTGLVDMDNVWDGYNEIYLYMEPMEADLHQIIRSGQPLGNAHIQFFIYQLLRGMKYIHSANVIHRDLKPGNLLVNSGCELKICDFGLARGFNPVKGEEPQGEEGKLTEYVATRWYRAPEIMLSNRRYTTAIDVWSIGCILAELLGLKPVFKGKDYIEQMTLILETLGTPDEETMARVASEKALTFLKTLPTYEKKDLGSIFPDADPLAVDLTDKLLEFDPTRRIDVPSALTHAYVERYHDPEDEPSCDKIFDKWEEVESLSTIEELKEAITREIQGFREEVRMAAEEDDEDEEWAEGEYLDDENVFHDSPGPALASTLEKFTYPDHIAPTGSAPRTREHSPTTTFITSAEDYFTAQHGFGGPNGRASRRSSSHSTSGRRPASFLFSPFGAGMTQIVPTPNAYPRSHAQASPELTTAEKTPRDRRSSGLWRTRSRAQSQSGNLVLERLSSLEINDHKDGEKNRIDALHAVVGLGGDGEVPPMTVSPSDAPPSEVPKSFGY

SEQ ID NO: 61107 - protein, 92 aa, Ambrosia artemisiifolia
MSILGGITEVKDNDNSVDFDELAKFAIAEHNKKENAALEFGKVIEKKQQAVQGTMYYIKVEANDGGEKKTYEAKVWVKLWENFKELQELKLV

SEQ ID NO: 61108 - protein, 284 aa, Pseudomonas putida GB-1
MPEHPLHRFFSSQRPRPTFEWERYQQRDVLIIDHPRCQAVFSRQGAQLLHFQPAGERPWLWCAEQWPQVGAIRGGVPVCWPWYGRHPSEDLWPAHGWARLLDWKLVDSREDEEGVSLKWRLDLCDWQVDLHARLDSRMELSLSTEHQDSEPCQLSHALLAYWRISDVSEIALSGLEDIEGYDRLNRQACREEGALKLKGGCQKVYPSTPRVQLQDPAWQRELCIDTGDSDDTVVWHPGNRPLMGVSGRESQRFVCVEAASGSGEGLSLAPGQRAHLRLQAHRLS

SEQ ID NO: 61109 - protein, 181 aa, Oryza sativa
  misc_feature (66)..(66): Xaa can be any naturally occurring amino acid
MSMGHYSEQRPGFEVGKDWNGADQVMIRSPRGASVLVSLHGGQVVSWRNDRGEELLFTSSKAIFKXPPKAMRGGIPICFPQFGNCGTLEQHGFARNRLWAIDDEAPPLNHNDNNGKVSVDLLLKPSEDDLKCWPHCFEFRLRVSLSTDGDLSLVSRVRNVNGKPFSFSFAYHTYLSVSDIR

SEQ ID NO: 61110 - protein, 476 aa, Azoarcus sp. EbN1
MADKQFDVLVIGGGPGGYVAAIRAAQLGFKTACAESNPYADPKGEPRLGGTCLNVGCIPSKALLHTSHLFEEAEHAFPTQGIRLEGKVSIDVPVMIGRKNKVVDQLTSGIKGLFKKNKVTFLAGHGSFEGNGPAGYVVRVGAETVEARHVIIATGSKPRHLPGIPVDNRIVCDNVGALDFDSVPKKLGVIGAGVIGLEMGSVWRRLGAEVTVLEALPDFMPFADMDVAKEALKVFTKQGLDIRTGVTIGETKVGADGVSLAYTGKDGKEARLECERLIVSVGRVPNTEGLNASTVGLDVSDRGQIVVDGHCRTNLPNVYAVGDVVRGPMLAHKAMEEAVMVAEIIAGQAGHANLDTVPGVIYTSPEIAWVGKSEQQLKAEGVAYRAGKIPFMANGRALGSGDPTGFVKMLADADTDRILGVHIIGANASELISEAVVAMEFGGAAEDLARICHAHPTLSEVVHEAALAVDKRPLHF

SEQ ID NO: 61111 - protein, 394 aa, Azoarcus sp. EbN1
MLIEVKVPQLSESVSEATLVSWHKKEGDAVSRDENLIDIETDKVVLETPAPADGVLVKIVKADGENVTSGDLIAQIDTEAKAPAGAKPAEAVQAVAAPAPAVAAATTGGAPSPAARKILEEKGVAAGDVSGTGRGGRVTKEDAVAAQPRAAAPVAAAVRGGDRAEERVPMTRLRARIAERLIQSKNENAILTTFNEVNMAPVMALRKQYGEKFEKAHGVRLGFMGFFVKAAVAALKKYPIINASVDGNDIVYHGYIDIGIAVGSPRGLVVPIIRDADQMSIADIEKKIAEYGQKAKDGKLSLEELTGGTFSISNGGVFGSMLSTPIINPPQSAILGIHATKDRPVVENGQIVIRPINYLALSYDHRIIDGREAVLGLVAMKEALEDPARLILDV

SEQ ID NO: 61112 - protein, 444 aa, Listeria monocytogenes str. 1/2a F6854
MNPDPESQQIILQLILIVVLTMLNAFFASAEMALVSLNKNRVKSQAETGDKKAVMLAKLVDDPSKFLATIQVGITLAGFFSSASAATSIATRLESVFGGSSFAKELSIIVVTIVLSYITLVFGELYPKRLALQKSEKIARVSVRPIMAVGVVLRPFVKFLSFSTDILVKLTRMEKNTDNEKMTREEMQLLIETGRRDGVIEVEELQMLRGVFEMDNKYAREVMVPRTDAFMIDAETESEELCDALLSENFSRVPVYTGDQDSVLGILHMKDFFAEARKSGFENIDVKGLVKDAYFAQETMFIDDLLKNMQRTRNQMAILMDEYGGVAGIVTVEDLLEEIVGEIDDENDVFSDEVKKVDETTFIVEGRMPLDDFNKMFHVELPSRGVDTVAGFVLTLTGTIPEEDDKVVVEYGTLRFTVEEMNDARLVSVRVEKDIQTSELEQMA

SEQ ID NO: 61113 - protein, 229 aa, Listeria monocytogenes str. 1/2a F6854
MNKLNEALKKAERIVFLTGAGVSVPSGIPDYRSKNGLYAGMSSPEYMLSHTCLVREPEKFYQFVTENMYYPDAEPNAIHTKMAEIEAEKDVTIITQNIDGLHEKAGSKKVVNFHGSLYHCYCQNCGMTVTAKDYLKSDIHTDCGGVIRPDVVLYEEAISESAIDQSLTAIRKADLIVIVGTSFRVSPFCNLTDYRNKKARIFAVNKERISLPYPFEMMESDAVKVFAEI

SEQ ID NO: 61114 - protein, 147 aa, Listeria monocytogenes str. 4b F2365
MEQTYVMVKPDGVERGLIGEIVTRIEKKGLKIVAGKLMQIDRELAEKHYAEHIGKSFFEDLIGFITSGPVFAMVLEGDDAIATARRMMGKTNPLEADPGTIRADYAIHTNRNVIHGSDSPESAKREIQLFFAPQEILSYQKAIDTWI

SEQ ID NO: 61115 - protein, 321 aa, Listeria monocytogenes str. 4b F2365
MKLNFLYANMQKDIDSVEKELKKALSGAAAETTSDAALHLLEAGGKRIRPMFVCLSARLAPNADFDAVKNASVAIELIHMASIVHDDVVDNADLRRGRETIKSKWGNHIAMYTGDFLFAKSLEYMTEIKDVAAHKMLSHVTVELSTGEIEQLKDKYNFDQSVRNYLRRIKRKTALLIAASCGLGGVVSGQSEADYQKLYRFGYYVGMAFQITDDVLDFVGTEKELGKPAGEDLRQGNVTLPVFFAMEDPFLKKRISQVTEETPAEEIAVLVEEVKKAGAKQAEDVATVYLKKAVEILDSLPQVPELKPLKQIVRVLDKRNY

SEQ ID NO: 61116 - protein, 220 aa, Brassica napus
MGTAWFVWQDSSYQLLLLQDRENRIIKPAAWWDGDEETKDILGGRDEKTGGTWLGCSKQGRVAFLVNVTNQTSFTHTGAELLTVKFLKGKMTTSEFANELASNKELSSGLTFNLVVADIASKSMVYISKKSPTKEVDEMIDPIGPGRYFITSAGIYDIFSSQDKHPKDKFSEVLDENKESPRREFYEKLMNDDQIIVPEGEGETDTSRTGPRGCALEQHR

SEQ ID NO: 61117 - protein, 129 aa, Ehrlichia ruminantium str. Welgevonden
MEIYMSNLLKEFNEQQIKLLSNREIPKFKSGDTLRVTMKIFDSAGERIQTFEGVCIKRRNNGLHSSFTLRKISYNESIQLQVFLYSPTIESIEVVKFGKVRRAKLYYMLSLFGKSARIKERIDRSKKSS

SEQ ID NO: 61118 - protein, 388 aa, Oryza sativa (japonica cultivar-group)
MEYLRSCWGPASSPAGRPRKGSDAAGRQDGLLWYKDAGQLVAGEFSMAVVQANNLLEDHSQVESGPLSTTDPNLQGTLVGVYDGHGGPETARYINDHLFNHLRGFASEHKCMSADVIRKAFRATEEGFFSVVSSQWSMRPQLAAVGSCCLVGVICAGNLYIANLGDSRAVLGRLVKGTGEVLAMQLSAEHNASFEEVRRELQAAHPDDPHIVVLKHNVWRVKGIIQITRSIGDVYLKKPEFNREPLHSKFRLQETFRRPLLSSEPAIVVHQLQTTDQFIIFASDGLWEHISNQEAVDLVQHNPRNGIARRLVKAAMQQAAKKREMRYSDLKKIDRGVRRHFHDDITVVVVFFDSNAITTANWSRPSVSLRGGGVTLPANSLAPFSVPT

SEQ ID NO: 61119 - protein, 455 aa, Escherichia coli O157:H7 EDL933
MSFDSLGLSPDILRAVAEQGYREPTPIQQQAIPAVLEGRDLMASAQTGTGKTAGFTLPLLQHLITRQPHAKGRRPVRALILTPTRELAAQIGENVRDYSKYLNIRSLVVFGGVSINPQMMKLRGGVDVLVATPGRLLDLEHQNAVKLDQVEILVLDEADRMLDMGFIHDIRRVLTKLPAKRQNLLFSATFSDDIKALAEKLLHNPLEIEVARRNTASDQVTQHVHFVDKKRKRELLSHMIGKGNWQQVLVFTRTKHGANHLAEQLNKDGIRSAAIHGNKSQGARTRALADFKSGDIRVLVATDIAARGLDIEELPHVVNYELPNVPEDYVHRIGRTGRAAATGEALSLVCVDEHKLLRDIEKLLKKEIPRIAIPGYEPDPSIKAEPIQNGRQQRGGGGRGQGGGGRGQQQPRRGEGGAKSASAKPAEKPSRRLGDAKPAGEQQRRRRPRKPAAAQ

SEQ ID NO: 61120 - protein, 197 aa, Oryza sativa
MAAKRGSESDGDELGGGGAAEGTSPNDGGASPPPLAAAPAVCFIRSAGDFAGGAFIGSIVGYGQGLFTKKGFKGSFSTAGSSAKTFAVLSGVQSLVVCLLRRLRGKDDIVNAGIAGCCTGLALSFPGTPQALLQSCATFAAFSCIMEGLNKQQAAMAQTLGGSALTVSHQNGGVLPPFTLPPLLDASDALSSCWPVL

SEQ ID NO: 61121 - protein, 507 aa, Streptomyces avermitilis MA-4680
MSSTLFRTKKVEQSIQDTEEPEHALKKSLSALDLTVFGVGVIIGTGIFVLTGKVAKENAGPAVSLAFVAAGIACGLAALCYAEFASTVPVAGSAYTFSYASLGELPAWIIGWDLVLEFALGTAVVAVGWSGYVRSLLDNAGWHLPDYLSGREGATGFGFDILAAALVLVLTVILVIGVKLSARVTTVVVAIKVTVVMIVIIAGAFFISGDNYKPFVPKAEHVAAGSGVKSPLVQLMFGWAPTNFGVLGIFTAASVVFFAFIGFDVVATAAEETKNPQRDMPRGILGSLLICTTLYVAVSIVVTGMQKYTRLSIDAPLADAFKATGHPWYAGVISFGAAVGLTTVCMILLLGQTRVFFAMSRDGLLPRFFSRVHPRFRTPHRPTILLGVIIAIVAGFTSLSELAELVNIGTLFAFVVVAIGVIILRHTRPDLHRAFRTPLVPLVPILSVLASLWLMLNLPAETWIRFAVWMVIGFVVYFLYGRSHSRLGREQAAAAGRTPTPSGGDIE

SEQ ID NO: 61122 - protein, 168 aa, Zea mays
MGDGGADDASSPPPHDGGFSYLAVFHNYPLVAALLGFAVAQSIKFFLTWYKENRWDPKQLIGSGGMPSSHSATVTALAVAIGLQDGFNCSLFATATIFASVVMYDASGIRLHAGKQAAVLNQIVCELPSEHPLSETRPLRELLGHTPTQVVAGALLGCTIATAGQLFV

SEQ ID NO: 61123 - protein, 335 aa, Xanthomonas axonopodis pv. citri str. 306
MTQTITVIRGDGIGPEIMDATLFVLDALQAGLTYEYADAGLVALEKHGDLLPESTLASITKNKVALKSPLTTPVGEGFSSINVAMRRKFDLYANVRPAKSFPNTKSRFADGVDLITVRENTEGAYLSEGQTVSEDGETAFSGTRITRKGSERIVRYAFELAKSTGRKKVTAVHKANIIKSTSGLFLKVARDVAAQYPEIEFQEMIVDNTCMQLVMRPEQFDIIVTTNLFGDIISDLCAGLVGGLGLAPGANIGLDAAIFEAVHGSAPDIAGQGKANPCALLLGAAQMLDHIGQPQNAERLREAIVATLEAKDSLTPDLGGTGNTMGFAKAIASRL

SEQ ID NO: 61124 - protein, 149 aa, Streptococcus mitis
QPNWINRDRFILSAGHGSMLLYALLHLSGFEDVSMDEIKSFRQWGSKTPGHPEFGHTAGIDATTGPLGQGISTATGFAQAERFLAAKYNREGYNIFDHYTYVICGDGDLMEGVSSEAASYAGLQKLDKLVVLYDSNDINLDGETKDSFT

SEQ ID NO: 61125 - protein, 498 aa, Triticum aestivum
MAMATAMAATYGAPITAPAPAAFSPRRAAGGRRVRAVTARPRPLFSPRAVSDSRNSQTCLDPDASTSVLGIILGGGAGTRLYPLTKKRAKPAVPLGANYRLIDIPVSNCLNSNVSKIYVLTQFNSASLNRHLSRAYGNNIGGYKNDGFVEVLAAQQSPESPDWFQGTADAVRQYLWLFEEHNVMEFLILAGDHLYRMDYQKFIQAHRETDADITVAALPMDEERATASGLMKIDDEGRIVEFSEKPKGEKLKAMMVDTTILGLDSERAKELPYIASMGIYVFSKDAMLRLLRDNFPSANDFGSEVIPGATEIGMRVQAYLYDGYWEDIGTIEAFYNANLGITKKPVPDFSFYDRSAPIYTQSRYLPPSKVLNADVTDSVIGEGCVINHCTINHSVVGLRSCISEGAVIEDSLLMGADYYETENDKKVLSESGGIPIGIGKNAHIRKAIIDKNARIGENVKIINVDDIQEASRESDGYFIKSGIVTVIKDALIPSGTVI

SEQ ID NO: 61126 - protein, 478 aa, Oryza sativa (japonica cultivar-group)
MELGVPLPRRPVPGSYGVPFVSAVRDRLDFYYLQGQDKYFESRAERYGSTVVRINVPPGPFMARDPRVVALLDAKSFPVLFDVAKVEKRDVFTGTFMPSTSLTGGYRVCAYLDPSEPNHAKIKQLLLSLLVSRKDAFVPVFRSNFGALLDTVESQLASGGGKSDFTALNDATSFEFIGEAYFGVRPSASSSLGTGGPTKAALWLLWQLAPLTTLGLPMIIEDPLLHTLPLPPFLISSDYKALYAYFAAAASQALDAAEGLGLSREEACHNLLFATVFNSYGGFKLLLPQILSRVAQAGEKLHERLAAEIRSAVADAGGNVTLAALEKMELTRSVVWEALRLDPPVRFQYGRAKADLEIESHDASFAIKKGEMLFGYQPCATRDPRVFGATAREFVGDRFVGEEGRKLLQYVYWSNGRETENPSVDNKQCPGKNLVVLVGRLLLVELFLRYDTFTAEAGKKVVITGVTKASTSAVNRTA

SEQ ID NO: 61127 - protein, 294 aa, Bacillus subtilis subsp. subtilis str. 168
MAQTGTERVKRGMAEMQKGGVIMDVINAEQAKIAEEAGAVAVMALERVPADIRAAGGVARMADPTIVEEVMNAVSIPVMAKARIGHIVEARVLEAMGVDYIDESEVLTPADEEFHLNKNEYTVPFVCGCRDLGEATRRIAEGASMLRTKGEPGTGNIVEAVRHMRKVNAQVRKVVAMSEDELMTEAKNLGAPYELLLQIKKDGKLPVVNFAAGGVATPADAALMMQLGADGVFVGSGIFKSDNPAKFAKAIVEATTHFTDYKLIAELSKELGTAMKGIEISNLLPEQRMQERGW

SEQ ID NO: 61128 - protein, 251 aa, Betula pendula
MGRGRVELKRIENKINRQVTFAKRRNGLLKKAHELSVLCDAEVALIIFSNRGKLCEFCSSPSMLKTLERYQKCNFGAPEPNVSAREALELSSQQEYLKLKARYEALQRTQRNLMGEDLGPLSSKELELLERQLNMSLKQIRSIRTQCMLDQLTDLQRKEHMLNEANRTLKQRLVDGYHIDTVLQLDQSANDVGYGRQPAQTQDDCFFHPLCEPTLQIGYQHDHPMTVVTAGSGSVVTAGPSVNNYMSGWMP

SEQ ID NO: 61129 - protein, 518 aa, Lotus japonicus
MGYDQTRKLSDEYEISEILGRGGFSVVRKGTKKSGNEKTQVAIKTLRRLGSSPSGTGGGQKSTATVMGFPSLRQVSVSDALLTNEILVMRRIVENVSPHPNVIDLYDVCEDSNGVHLVLELCSGGELFDRIVAQDKYAETEAAAVVRQIAAGLEAVHKADIVHRDLKPENCLFLDSRKDSPLKIMDFGLSSVEEFTDPVVGLFGSIDYVSPEALSQGKITAKSDMWSLGVILYILLSGYPPFIAQNNRQKQQMIINGNFSFYEKTWKGITQSAKQLISSLLTVDPSKRPSAQELLSHPWVRGDKAKDEQMDPEIVSRLQSFNARRKLRAAAIASVWSSTIFLRTKKLRSLVGTYDLKEEEIESLRIHFKKICGNGDNATLSEFVEVLKAMKMPSLIPLAPRIFDLFDNNRDGTIDMREILCGFSSLKNSKGDDALRLCFQMYDTDRSGCITKEEVASMLCALPEECLPADITEPGKLDEIFDLMDANSDGKVTFEEFKAAMQRDSSLQDMLLSSLRPS

SEQ ID NO: 61130 - protein, 362 aa, Cryptococcus neoformans var. neoformans JEC21
MAPQTVPCQYKTGKTLGSGTYAVVKECVHITTGEYYACKVLNKKFLMGREHMVRNEIAVLKRVSAGHKNIVQLHDFFETTHNLYLVFDLCTGGELFDRICAKGSYFEKDAANIVRTVTSAVKYLHDQGIVHRDLKPENILFKSKAEDADLMLADFGLSKVLDDDKFAILTTTCGTPGYMAPEIFKKAGHGKPVDIWAIGVITYFLLCGYTPFDRDSQYEEMQAICKGDYRFEPVEYWGGVSETARQFVRDCLTVDPTNRPTVDELLNHPWLRDVEASKDEPAEAKGVDLLPNVKAAFDAKKTFRKAVLGMMAVHRLQDHSATIHGQTEAEQEKLKKEVEAFKEEAAQEDVKDVIQPGAPASI

SEQ ID NO: 61131 - protein, 112 aa, Arabidopsis thaliana
MLQLCTSPVFLLFSVFEFLFSNCSLAGLSAYTTDQSLRQLFAPFGQITESRLIKDQQTQRPKGFGFITFESEDDAQKALKALNGKIVNGRLIFVETAKEVEAPTTSLKSNKD

SEQ ID NO: 61132 - protein, 484 aa, Listeria monocytogenes str. 1/2a F6854
MEHNKLKPFPKDFLWGSASAAYQVEGAWDEDGKGPSVWDEFVRIPGTTFKETNGDVAVDNYHRYKEDVALMAEQGLKAYRFSVAWSRVIPHGNGEVNEAGLKFYDNLIDELLSYGIEPVVTLYHWDIPQGLQDEYGGWESRKVVEDFTNYAALLFERFNGRVKYWVTLNEQNVFISHGYKLAYHPPGVSNDKRMFAANHNANLANASAIAKFRELGTSGKIGPSFAYGPSYSIDANPANVLASENSEEFNAHFWMDVYTWGEYPTATWNWLEEHGLAPEILPGDTELLKKGKPDFMGVNYYRSMTHAFNGKDGVGSGKMNTTGEKGTSEETGVPGLYKNTNNPYLEKTNWDWDIDPTGLRIGLRRITNRYKLPIMITENGLGEYDSLTEDHKIHDEYRIEYIRAHALAIQEAITDGVEMLGYCTWSFTDLLSWLNGYQKRYGFVYVDRDENDEKELKRYKKDSFYWYKKTIEANGANLVEEQGK

SEQ ID NO: 61133 - protein, 436 aa, Listeria monocytogenes str. 4b F2365
MTFERLGTMNVNAEGHLEIGGVDTLKLTEKYGTPLYVYDVALIRDRARGFKKTFEELGVKAQVAYASKAFSAVAIYQLMAEEGLSLDVVSGGELYTAIKANFPPERIHFHGNNKSAEEIHMALDYGIGCFVIDNYYEISLLEDILIERNEKASVLIRVTPGIEAHTHDYILTGQDDSKFGFGLTNGQAEKAIKQVLHASASFDLIGLHCHIGSQIFETTGFKLAARRIMDKLVEWHQTLGFDSKVLNLGGGFGVRYTAEDEPLEPSEYVRQIMDEVRDVANNNDIDIPEIWIEPGRSLVGEAGTTLYKVGSRKEVPGIRNYIAVDGGMSDNIRPALYDAHYDAVLAANPEKVAEETVAIAGKCCESGDMLIWDLPLPKSNAGEVLAVFCTGAYGYAMASNYNRIPRPPVVFVENGVDKLIVARETYENLVQNDLSL

SEQ ID NO: 61134 - protein, 428 aa, Methanosarcina barkeri str. Fusaro
MTIVEDAQKGIITEEMKIVAKDEGLDPEFIRRGVAAGRIVIPTSPYRQVKICGIGEGLRTKVNASIGVSSDIVDADMEVKKAQAAEAAGADTLMELGTGGDFLAIRKKVIDSISLSVGSVPLYQAFIEAARKYGSIVDMTEDELFKATEDQAKLGTNFMAIHTGINNITMDRLKAHGRYGGLCSRGGAFMTSWMLHNEKENPLYANFDYLVEILKEHEVVLSTGNGMRAGAVHDATDRAQIQELIINSELADRAHKQGVQVIVEGPGHVPLDQIGTNVKLMKEMSGHKPFYMLGPLVTDIAPGYDHIVTAIGASVSASYGCDFLCYVTPAEHLALPNLEDVITGVKTSKIAAHVGDMVKYPDRAREQDLAMGRARRDLDWQKMYSLAIDPEHAKEVRNSRAPEDSDACTMCGNFCALKIVNQNYNLAK

SEQ ID NO: 61135 - protein, 294 aa, Acidobacteria bacterium Ellin345
MDRSYRTKKDLSFNWITVIAMGIFHLGAVAALFFFSWKGLFLALALWWVAGSWGIGMGYHRLLTHRGYKAPKWLEYFLTTCATLALEGGPIFWVATHRVHHQLTDKEGDPHSPRDGKWWSHMGWIILGKTLHQNTKELSPYVPDLRKDGFHNWISKWHWVPITVLGLIILAVGGWKMVLWGIFLRTTIGLHCTWLVNSATHIWGSQRFVTDDDSTNNFVIAILTFGEGWHNNHHAHPQSARHGLAWYELDFNWMQIWALSKLGILRDVKMPRLDKRPAIVAVPAAAAEAVAAGD

SEQ ID NO: 61136 - protein, 342 aa, Rhodopirellula baltica SH 1
MAIKVAINGFGRIGRLTFRNLMERSDEFEVVAINDLTDNRTLAMLLKYDSIHGRFDGTVEYDNTSLTVNGKKIVALAERDPRNLPWKDHNVDIAIESTGFFTARSTADKPGYDSHLAAGAKKVVLSAPAKDGADLTCVLGVNDDKLSADLNCVSNASCTTNCLAPVAKVLNDSFGIESGLMTTVHAYTNDQNVQDQPHADLYRARGAAQNIIPTSTGAAKAVGLVIPELQGKLTGIAMRVPVPTGSVVDLTVNLSKEVTKEDINLAIQTAAEGPMKGILFYAVDPIVSSDIVHDPHSSIFAADFTQVLGDKGKMAKVVSWYDNEWGYSSRTADLCSKLGKML

SEQ ID NO: 61137 - protein, 548 aa, Oryza sativa (japonica cultivar-group)
MLTVAASALRNNKKSTAAACFSLAMPFLLSSPTPPPPPHSSSLPRSPSPRPRLPLPPPRRAALVTAAQDPRWRRAMASLAVSASASASGEEVTHLAQREAAEIDEQLMGPLGFSVDQLMELAGLSVAAAVAEVYKLGEHTRVLVICGPGNNGGDGLVAARHLHHFGYKPSVCYPKRTPKPLYSGLCTQLESLTIPFVPVEDLPANLSEEFDIIIDAMFGFSFHGTPRPPFDDLINRLVSLSAIDNSAKRPAIVSVDIPSGWHVEEGDINGGGFKPDMLVSLTAPKLCAKKFTGPHHFLGGRFVPPPIVSKYKLHLPPYPGTSMCVRIGKAPSVDISSLRENYISPELLENQVMPDPFDQFVRWFDEAVTAGLREPNAMALTTADKEGKPSSRMVLLKGVDKQGFVWYTNYGSQKAHDLSENPNAALLFYWNEMNRQVRVEGSVQKVPEEESEKYFHSRPRGSQLGAIVSKQSTIIPGREVLQQAYKELEQKYSDGSVIPKPDYWGGYRLTPKLFEFWQGQQSRLHDRLQYSLREVDRSTVWHIERLSP

SEQ ID NO: 61138 - protein, 376 aa, Arabidopsis thaliana
MECIIKLPQRFNKNKSKKNPLRIFDSTVLNHQPDHIPQEFVWPDHEKPSKNVPILQVPVIDLAGFLSNDPLLVSEAERLVSEAAKKHGFFLVTNHGVDERLLSTAHKLMDTFFKSPNYEKLKAQRKVGETTGYASSFVGRFKENLPWKETLSFSFSPTEKSENYSQTVKNYISKTMGDGYKDFGSVYQEYAETMSNLSLKIMELLGMSLGIKREHFREFFEDNESIFRLNYYPKCKQPDLVLGTGPHCDPTSLTILQQDQVSGLQVFVDNQWQSIPPIPQALVVNIGDTLMALTNGIYKSCLHRAVVNGETTRKTLAFFLCPKVDKVVKPPSELEGERAYPDFTWSMFLEFTMKHYRADMNTLEEFTNWLKNKGSF

SEQ ID NO: 61139 - protein, 77 aa, Glycine max
  misc_feature (10)..(10): Xaa can be any naturally occurring amino acid
  misc_feature (14)..(14): Xaa can be any naturally occurring amino acid
  misc_feature (16)..(16): Xaa can be any naturally occurring amino acid
  misc_feature (31)..(33): Xaa can be any naturally occurring amino acid
  misc_feature (44)..(44): Xaa can be any naturally occurring amino acid
  misc_feature (48)..(48): Xaa can be any naturally occurring amino acid
  misc_feature (55)..(56): Xaa can be any naturally occurring amino acid
  misc_feature (58)..(58): Xaa can be any naturally occurring amino acid
  misc_feature (62)..(62): Xaa can be any naturally occurring amino acid
  misc_feature (64)..(64): Xaa can be any naturally occurring amino acid
  misc_feature (71)..(73): Xaa can be any naturally occurring amino acid
MGELYALDFXGVIXDXCGESSLSALKAAKVXXXGLFDGVDSTTXNWIXDQMHTVXXVXETGXEXLLLVILXXXHNPP

SEQ ID NO: 61140 - protein, 511 aa, Agrobacterium tumefaciens str. C58
MDMDAMTKLDVKQEAAALLDKMGVARDLYTGGDMASFSPVTGEQIASLRTVSVEGVAAVVDKADAAFRTWRNVPAPRRGELIRLLGEELRAFKTDLGRLVSLEAGKIPSEGLGEVQEMIDICDFAVGLSRQLYGLTIATERPGHRMMETWHPLGVVGVISAFNFPVAVWSWNAALALVCGNSVVWKPSEKTPLTALAVQGIFERAAARFGDAPEGLSQLLIGDRAVGEAMVDYPKVPLVSATGSTRMGRDVGPRLAKRFARAILELGGNNAGIVCPSADLDMALRAIAFGAMGTAGQRCTTLRRLFVHDSVYEELVPRLKKAYASVSVGNPLESSALVGPLVDKAAFDGMQKAIEAAKAAGGVVHGGDRVDTGAADAYYVKPALVEMPKQVGPVLEETFAPILYVMKYSDLDQAIDAHNAVAAGLSSSIFTRDIQESERFLSSEGSDCGIANVNIGTSGAEIGGAFGGEKETGGGRESGSDSWKAYMRRATNTINYSKALPLAQGVSFDIE

SEQ ID NO: 61141 - protein, 230 aa, Triticum aestivum
MGAEDVQALVIDNGSGMVKAGFAGDDAPRAVFPSIVGRPRHTGVMVGMGQKDSYVGDEAQSKRGILTLKYPIEHGIVTNWDDMEKIWHHTFYNELRVAPEEHPVLLTEAPLNPKANREKMTQIMFETFNTPAMYVAIQAVLSLYASGRTTGIVLDSGDGVSHTVPIYEGYALPHAILRLDLAGRDLTDYLMKILTERGYSFTTTAEREIVRDIKEKLAYVALDFEAEMQT

SEQ ID NO: 61142 - protein, 73 aa, Brassica napus
MKRKIAIGFEGSANKIGVGIVTSDGTILANPRHTYITPPGHGFLPRETAHHHLDHVLPLVKSALETSQLTPED

SEQ ID NO: 61143 - protein, 507 aa, Mycobacterium sp. JLS
MTGLPHYRMYVDGEWRDAAESIEVRSPATGAPVATVAYGDLTAVDDAVAAARAAHEAGVWRSMPPQQRADLLDAIADKLAARSDELTALQVRENGATVRGAGAFLIGYAIANLRYFASLARSYAFQTSGPLIEAPTLASGLILREPVGVCAGIIPWNFPLLLAVWKLGPALAAGNTVVLKPDDQTPLTLLELARAADEVGLPAGVLNVVTGPGPVAGARLAEHPDVRKIAFTGSTEVGKGVMRAAADNVKKVTLELGGKGANIVLEDADLDLAVDGSLFAFLMMSGQACESGTRLLVHESVHDEFVRRLVARAETLVMGDPMSPATDLGPLVSAKQKARVEKYIALGQEEGCRMAFQGTVPSDPALAEGHWVPPVILTGATNQMRIAREEIFGPVLVVIPFRDDDDAVAIANDSEYGLSAGVWSADNGRALGIARRLESGTVWVNDWHMVNAMYPFGGVKQSGLGRELGPGALDEYTEPKFVHIDLTNDRRKRAFAVVVSAAAAESD

SEQ ID NO: 61144 - protein, 295 aa, Oryza sativa (indica cultivar-group)
MAGAKDVILDEPLLTSGSAESSQQRSTDAGMYTGLSAPCFTGPSGLQVRVTQKSEASVLNMSYVDELCDKDYTKSRVEDIWKKMNSGMPAKMPKPVMNKLSTPAKEKKSTTGNNWMSVLGLSPSKASTNDQGSNNGQKQAQQETSEDAKKLAASALAAVRDAASAAAGRGKVEITEVRDFAGKDIEIKKLVDADSREAIEKAKAAGAAPSPLDHILEQIKKKQKLSVLDKTKKDWGEFKEENKGMEEELDQYKKSSNKYLDKVSFLQRADYREFERERDARLSMMSKRKSDTRED

SEQ ID NO: 61145 - protein, 480 aa, Oceanicola granulosus HTCC2516
MSQPHRPHGEPSFRQSVDIMFNRAVALMDLPPGLEEKIRVCNATYTVRFGVRLRGGIHTFTGYRSVHSEHMEPVKGGIRYAMSVNQDEVEALAALMTYKCALVETPFGGSKGGLRIDPREWEEDELERITRRFAYELAKRDLIHPAQNVPAPDMGTGEREMAWIADQYRRMNTTDINANACVTGKPLNSGGIAGRVEATGRGVQFALREFFRHPDDINAAGLSGTLEGKRVIVQGLGNVGYHAAKFLQEEDGCRIVGIIERDGALTAPDGLDVDDVHAWIGEHGGVTGYPRATYTPEGDAVLEATCDILIPAALEGVIHKDNAARIQAPLIIEAANGPITAGGDEILREKGCVIIPDMFANAGGVTVSYFEWVKNLSHIRFGRMQRRQEEARHELIVRELERLSADRDLGWELSPNFKDRYLKGAGELELVRSGLDDTMRTAYQAMSETWHGRNDVHDLRTAAYLVSIERVAASYRAKGL

SEQ ID NO: 61146 - protein, 467 aa, Oryza sativa (indica cultivar-group)
MALASPGEEAGGGGAAAAAAGGGGGVGAEGVVRGGGGGGERRGGGGRRAGRALLHSSHMYHEAKSSFAHHGVKFSNLEVDLPAMMAQKDKAVAGLTKGIEGLFKKNKVTYVKGFGKLASPSEVSVDLSDGGSTVVKGKNIIIATGSDVKSLPGVTIDEKKIVSSTGALCLSEIPKKLVVIGAGYIGLEMGSVWNRLGSEVTVVEFAPDIVPSMDGEVRKQFQRMLEKQKMKFMLKTKVVGDDTSGDGVKLTLEPAAGGEQSVIEADIVLVSAGRVPYTAGIGLESVGVETDKAGRILVDKRFMTNVNGVYAIGDAIPGPMLAHKAEEDGVACVEFIAGKEGHVDYDTVPGVVYTHPEVASVGKTEEQVKALGIPYRVGKFPLLANSRAKAIDDAEGLVKVVAEKETDKILGVHIMAPGAGEIIHEAVLALQYGASSEDIARTCHAHPTVSEALKEACLQTFTKAIHI

SEQ ID NO: 61147 - protein, 616 aa, Oryza sativa (indica cultivar-group)
MRKCTGVLLILTLAVLLLLLSPLVDGLVRCNQQAGVSGLQGRNNTMANVTANEHENEKRPKGRANFGGSFSIIEGEPFTATLWAGAEGFHMTVNGRHETSFAYRERLEPWSVAEVKVSGDLELLSVLANGLPVSEEVDMASVELMKAPPLSKKRIFLLIGVFSTGNNFKRRMALRRTWMQYEAVRSGEVAVRFFTGLHKNEQVNMEILKEAQIYGDIQFMPFVDYYTLITLKTIAICMFGTKVVPAKYIMKTDDDAFVRIDEVISSLKKSDPHGLLYGLISFQSSPHRNKDSKWFISPKEWPVEAYPPWAHGPGYIVSRDIAKFIVHGHQERTLQLFKLEDVAMGIWIQQYKNSGQKVNYVNDDRFYSEGCDSDYVLAHYQSPRLMMCLWEKLQKEYQPEERNFLRFNPSNPLKPNRMNRFEPAVLLPALLLSPLGVGGEVGPVRPTRTPGPLRLYCGEIQTIDFSGSAAPVVNCICVPLKHSFDRASYIVRAPWGDILQVWRSFELDDGEEPRTYELAVFKLDLATEDLVQIKDLRGHALFVSFFVSVNEFPVLTPNCVYLAHDSTKCRRFKHIAKEVRVYNLQDDTFADQYTQSSWKNCPPPALWFQPTWSLNK

SEQ ID NO: 61148 - protein, 1076 aa, Trichodesmium erythraeum IMS101
MPRRQDIRKILLVGSGPIVIGQACEFDYSGTQACKALREEGFEVVLVNSNPATIMTDPEIAECTYIEPLTPELIEKVIAKERPDALLPTMGGQTALNIAVSLAKNGTLAKYGVDLIGAKLPAIEMAEDRQLFKEAMGRIGIQVCPSGIASNWEEAKAIAQKIGTYPLIIRPAFTLGGTGGGIAYNQEEYEVMAQGGIDASPVSQILVEKSLIGWKEYELEVMRDLADNVVIICSIENIDPMGIHTGDSVTVAPAQTLTDKEYQRLRDASIKIIREIGVETGGSNIQFAVHPLNGDVIVIEMNPRVSRSSALASKATGFPIAKMAAKLAVGYTLDEIPNDITKKTPASFEPTIDYVVTKIPRFAFEKFPGSQPVLTTQMKSVGEAMAIGRTFQESFQKALRSLETGRAGFGADRWEKIPSLEQVRSGLRTPNPERLFTVRHALLLGMSLEEIYELTGIDIWFLDKMRELINTEKLIKYTPLNELTKEQLWDIKRQGFSDRQIAYCSKTTEDEVRSYRLSLGIKPVYKTVDTCAAEFEALTPYYYSTYEEESEILPSEKRKVMILGGGPNRIGQGIEFDYCCCHASYALGADGFETIMVNSNPETVSTDYDTSDRLYFEPLTKEDVLNIIEAENPVGIIVQFGGQTPLKLAVPLQKYLEQVDAQTKIWGTSPDSIDTAEDRERFEKILRDLDIRQAANGLARSFEDALTVAHTIGYPVVVRPSYVLGGRAMEIVYSDQELERYMKFAVQVEPEHPILIDKFLNNAVEVDVDAIADSTGRVVIGGIMEHIEEAGIHSGDSACSIPYQTLTSAAVETIRQWTVALAKALNVIGLMNIQFAVQGETVYILEANPRASRTVPFVSKAIGIPLAKIASRVMSGKNLEELGFIDEQIPDHVSVKEAVLPFAKFPGIDTVLGPEMRSTGEAMGIDVDFGKAFAKAQLSAGQKLPLEGTVFVSMSDRYKEAVVPVVKDLVDLGLKVVATEGTRKILRLHDLEVGLMLKLHEGRPNVLDGIKNGEIQLIIIIPSGDEARADGIKIRRSALDYKITLITTIAGAKATAAAIRALKSGALEVKAIQDYY

SEQ ID NO: 61149 - protein, 477 aa, Oceanicola granulosus HTCC2516
MADTSIGTPEQLRDPDYTPPLHKAIPLGIQHVLAMFVSNVTPAIIVAGAAGFGFGSNSPDFPELLYLIQMAMLFAGIATLLQTITLGPVGAGLPIVQGTSFAFLPIMIPLVAGKGVDGLAALFGGVVIGGLFHALLGTFIGRIRFALPPLVTGLVVTMIGLALVRVGIQYAAGGVPAIGTEEYGSALNWSAAVLVIVVTLALKFFTRGMLAVSAVLIGLVAGYVYAILVGILPVASITGSWNSAAAFALPDPFRYGFEFSVAAIVGFCLMAVVSAVETVGDVSGVTKGGAGREATDREITGATYADGLGTAVAGVFGSFPNTSFSQNVGLIAMTGVMSRHVVTCGAIFLIVCGLIPKVGGVIRTVPIEVLGGGVIVMFGMVVAAGVSMLSDVDWNRRNMVIFAVSLSVGLGLQLEPQAVQYLPDWASVLMVSGLLPAAFLAIVLNLVLPEHLPEDTAAPEPGRHRQPTGLPLETPRH

SEQ ID NO: 61150 - protein, 281 aa, Glycine max
MASLSLSSPPSLSSAHHNASTRLILRTPNSLNLRTPPHSLPAIRAITLTQDDLKRLAADKAVESVKSGMVLGLGTGSTAAFVVAKLGALLASGQLSDIVGVPTSKRTEEQARSLGIPLSVLDDNPRLDLAIDGADEVDPDLNLVKGRGGALLREKMVEAASDKFVVVVDDTKLVDGLGGSGLAMPVEVVQFCWKYNLDRLQELFKEEGVEAKLRLEESGKPYVTDNSNYIVDLYFKTPIRDALAAGAEISALEGVVEHGLFLNMATSVIIAGKSGVEVKAK

SEQ ID NO: 61151 - protein, 1501 aa, Candida albicans
MAKTSQAEGQPYKGYYNNKSQGQPYHGYYSGFNKSASAQIHHLARSLTQGVQSHYDDTYTTATMHPNGINPISDKTDPTLDPESPSFSSKRWVQNMWKLYQSDSEYYKPGKLGVAYKNLRVYGDAIESDYQTTVSNGVLKYARNIFNKFRKDNDDYSFDILKPMEGLIKPGEVTVVLGRPGAGCSTFLKTIACRTEGFHVADGSVISYDGITQDEIRNHLRGEVVYCAETETHFPNLTVGETLEFAALMKTPQNRPMGVSREEYAKHVVDVVMATYGLSHTKNTKVGNDFIRGISGGERKRLSIAEVTLVQASIQCWDNSTRGLDAATALEFISSLKTSASILNDTPLIAIYQCSQNAYDLFDKVIVMYEGYQIFFGSSQRAAAYFKKMGFVCQDRQTTPDFLTSITSPAERIIKPGYERLVPRTPKEFYRYWRRSPERQALLEEIDEYLDNCENYDQKQKIFEANNAKKAKHTYNKSSYTVSLPMQVRYIMKRYWDRMRGDIIVPLSTVAGNIAMALILSSVFYNLQPNSSSFYYRTSVMYYALLFNAYSSVLEIYNMYEGRAIVQKHREYALYPPMADAIGSIISDFPLKVVCSVLFNLILYFMVNFKREPGAFFFYLLISFCSTLFMSHLFRTIGAFTNSLAEAMTPSSLLLFALSTFSGFAIPVTYMLGWCKWIRWVNPLAYAYEALISNEFHGRVFDCSNIVPSGFGYPKTGNSVVCASIGALPGEFKVDGDLYLKLAFDYSYSNVWRNFGVLMAFIIFLFGTTIFFVQTNKSSISKGETLVFRRKNIRKMRKMEEDEEAYMDGMAPLDFSGSTEISDYSYDYMDRKLLDTSNIFHWRNLTYTVKIKSEERVILNNIDGWVKPGEVTALMGASGAGKTTLLNALSERLTTGVITSGTRMVNGGELDSSFQRSIGYVQQQDLHLETSTVREALKFSARLRQPNSVSIAEKDSYVEKIIDLLEMRTYVDAIVGVPGEGLNVEQRKRLTIAVELVARPKLLVFLDEPTSGLDSQTAWSICKLIRKLANHGQAILCTIHQPSAILLEEFDRLLLLQKGETVYFGEFGANCHTLIEYFERNGASKCPQHANPAEWMLGVIGAAPGTQANQDYFETWRNSPEYRAVQNELHRLEEMPGLASGEKEPDTNQAYAASFWKQYIFVVHRLFQQYWRTPSYIYSKFAMAVLCSLFNGFTYYKSQNSMQGLKNQMLSIFSMFVVLTTLAQQYVPLFVTQRDLYEARERPSKTFSWLAFIAAQITAEIPYQVLAATISFFSWYYPVGLYRNAVYSGAVTHRGVLMWLIMTLMFIYSSTLAQFCISWNQLADYAANWISLLLTISMIFCGVIATKDSMPKFWVFLYRCTPLTYLTSAMMSIGLGDSFVKCAPTEILTFPPQTPGVQKCQDYMGAYISIAGGYLLNPEATDNCKFCIMDKTNQFLDFMNISIHNFGRDTGIFIVFIVFNMAATVFSYWLFRVPKGNREKGSFFDKLPFLNGGGDTNHENV

SEQ ID NO: 61152 - protein, 342 aa, Trichodesmium erythraeum IMS101
MPLKVAINGFGRIGRLVFRAGLNYPDLIEFVGINDLVPPQNLAYLLKYDSTHGRFQGEVTASDDGIKINGKLIPCVSVKNPAELPWKEKDAHYVVESTGLFTTFDSASNHLAAGAKRVIISAPTKDPDKVKTLLMGVNHDLFDPAVDTIVSNASCTTNCLAPIAKVIDDNFGLTEGLMTTVHAMTATQPTVDGPSKKDFRGGRSAAQNIIPAATGAAKAVTLVLPHLKGKLTGMAFRVPTPDVSVVDLTFKTEKSTNYKDICAAMKTAAENSMKGILSYTEDPVVSTDFTGNSHSSIFDAGAGIELNSNFFKVVSWYDNEWGYSNRVLDLMLSMAEKEGKPK

SEQ ID NO: 61153 - protein, 239 aa, Arabidopsis thaliana
MSTGLDMSLDDMIAKNRKSRGGAGPARGTGSGSGPGPTRRNNPNRKSTRSAPYQSAKAPESTWGHDMFSDRSEDHRSGRSSAGIETGTKLYISNLDYGVMNEDIKELFAEVGELKRYTVHFDRSGRSKGTAEVVYSRRGDALAAVKKYNDVQLDGKPMKIEIVGTNLQTAAAPSGRPANGNSNGGQGRGGQQRGGGRGGGGRGGGGRGRRPGKGPAEKISAEDLDADLDKYHSGDMETN

SEQ ID NO: 61154 - protein, 1490 aa, Candida albicans
MADADTSSNSSKTNEDRSQEGFGTYQGYTDRVASEVQELARIISHASIQQLKLKRQHSRQESQKSNEQESELSGKLGVIPVDENGNFVDQRLNPNSPEFNAAYWIQNAHKLVSSDIDYFKPVTIGVAYKNLRAYGSASDADYQSTLVNLIPKYLSLFFREYILRHTGPTFDILKPMDGLIKPGELTVVLGRPGAGCSTFLKTIASQTYGYHIDKDSVIRYNSLTPHEIKKHYRGEVVYCAETENHFPQLTVGDTLEFAAKMRTPQNRPLGVSRDAYARHLAAVVMAVYGLSHTRNTKVGNDFIRGVSGGERKRVSIAEITLNNAMVQCWDNSTRGLDSATALEFIRALKASADIVHTTPLVAIYQCSQDAYDLFDKVVLMYQGYQIYFGSAKKAKQYFIDMGYECPQRQTTADFLTSLTNPAERIVRQGFEGKVPQTPQEFYEYWKKSPEGQQIVADVDQYLTEHSSAAEKEAIKEAHQARQSDHLKPASPYTVSFFMQVRYIAHRNILRIKGNPSIHLFQIFGNIGMSFILSSIFYNLPTATSSFYHRTAALFFAVLFNAFSCLLEIFSLYEARSIVEKHKKYALYHPAADAFASIVTELPTKFIIAIGFNLVYYFMVNFRRTPGNFFFYLLINFSATLAMSHIFRTIGAATKTLQEAMTPAAILLLALTIFTGFVIPTPNMHGWCRWINYLDPLAYAFESLIANEFHNRDFECSQYVPSGGSYPTAGPNRICTPVGSVPGQDFVDGTRYMEMSFDYRNSHKWRNFGIVIGFIVFFFCTYILLCEINKGAMQKGEILLFQQRALKKRKKANNDIESGEIEKVTPEFDNEYENNQDKMLQSGGDTFFWRDLTYQVKIKSEDRVILDHVSGWVKPGQVTALMGASGAGKTTLLNALSDRLTTGVVTEGIRLVNGRPLDSSFQRSIGYVQQQDLHLETSTVREALEFAAYLRQPKSVSRKEKNEYVDYIIRLLEMEQYADAVVGVSGEGLNVEQRKRLSIGVELVAKPKLLVFLDEPTSGLDSQTAWSICKLIRKLADNGQAILCTIHQPSAILLAEFDRLLFLQRGGQTVYFGDLGKNFTTLINYFEKYGAPKCPPEANPAEWMLEVIGAAPGSKANQDYYDVWLKSSEFQEMNSELDLMSEELVKKPLDDDPDRLKPYAAPYWEQYLFVTKRVFEQNWRTPSYLYSKFLLVVTSSLFNGFSFYKADRSLQGLQNQMFSVFMFLVILHTLIQQYLPTFVSQRDLYEVRERPSKTFSWITFIAAQVTAEIPWNIICGTLGYFCWYYPVGLYQNATYTNTVHQRGAFMWFAIVLFFIYTSTLAQLCISFLEIDDNAANLSVLLFTMCLAFCGVLVTKEQLPGFWVFMYRCSPFTYLVSVMLSVGLVDAPVTCAAKEYLRFSPPQGYTCMQYMEPYMKVAGGYLLNENSTTECEFCTMKVTNVFLKMIGSDYSKRGRDIGIYIAFIGINIIGTFILYWFARVPKNFDIKLRRKR

SEQ ID NO: 61155 - protein, 349 aa, Rubrobacter xylanophilus DSM 9941
MAEVRRVGMLTGGGDAPGLNGVIRAVTVKCVEDYGYEVVGIKRGWRGLLAPQEDSVEKLTVDGVRYILDEGGTVLLSSRTNPYKKEGDAEKVVKNMQEFGIDALVAIGGDDTLGVASRLHKDFGVQVVGCPKTIDNDLSGTDICFGYDTAVSIATEALDRVRTTAKSHERILVVEIMGRHAGWITYGAGLAGAANVTLIPEVEPDIDAIADLFKKRAERGERWGVVAVSEGVTIGEEYITQSAERDEFGHVRLGGIGETLAKELKERTGIDTRHVVLGHLQRGGTPTAYDRILSTRYGLRAAEAVKNGEWGKMVALRGSDIVTVPLEEATGETRTVPEDLYGVLKTFFG

SEQ ID NO: 61156 - protein, 694 aa, Solanum tuberosum
HRRILPSTTVTKQQFSVRASAAVETLEKTDAAIVEKSVNTIRFLAIDAVEKANSGHPGLPMGCAPMGHILYDEVMKYNPKNPYWFNRDRFVLSAGHGCMLQYALLHLAGYDSVQEDDLKSFRQWGSRIPGHPENFETPGVEVTTGPLGQGIANAVGLAVAEKHLAARFNKPDAEIVDHYTYVILGDGCQMEGISNEVCSLAGHWGLGKLIAFYDDNHISIDGDTEIAFTEDVSARFESLGWHVIWVKNGNTGYDEIRAAIKEAKAVKDKPTMIKVTTTIGFGSPNKANSYSVHGSGLGAKEVEATRNNLGWPYEPFHVPEDVKSHWSRHTPEGAALETEWNAKFAEYEKKYAEEAADLKSIITGELPAGWEKALPTYTPESPADATRNLSQQNLNALAKVLPGFLGGSADLASSNMTLLKMFGDFQKNTPEERNLRFGVREHGMGAICNGIALHSLGLIPYCATFFVFTDYMRGAMRISALSEAGVIYVMTHDSIGLGEDGPTHQPIEHLASFRAMPNILMFRPADGNETAGAYKVAVLKRKTPSILALSRQKLPQLAGTSIEGAAKGGYIVSDNSSGNKPDVILIGTGSELEIAVKAAEELKKEGKTVRVVSFVCWELYDEQSAEYKESVLPSSVTARVSIEAGSTFGWQKFVGDKGKAIGIDGFGASAPADKIYKEFGITAEAVVAAAKQVS

SEQ ID NO: 61157 - protein, 388 aa, Alkalilimnicola ehrlichei MLHE-1
MAKGRTWRVAVCPGDGIGPEVMAPTVAALRAVAGREGLALELQHYDWPSHDWHRRHGEMMPGDWREQLAAHDAILLGALGDPGPTNDPDRYLLSDGVSLAPLLQLRKGFDLWACERPAVRLPGTPQYLADPRAEELDMLVIRENSEGEYVAQGGRLAPGTAREVATQVEVFTRLATERIIRHAFERALQRAHLRQTGERPPRPFPRTGGGEANAQVCLITKRNAQAYWGEMWTEIFAEVAPDYPEIATHHELVDAACMKFVTRPWVFDVVVASNLHGDILTDLAAVLCGGMGVAPSCNINPQDRRVPPLFEPTHGSAPDIAGQGLAGPEAMLLTAAMMLDWMGEEDPAAARAGERLRLAVAADLQTGSGEARGTEAVGAAILDRLDQQ

SEQ ID NO: 61158 - protein, 427 aa, Alkalilimnicola ehrlichei MLHE-1
MSAAQETTDRQGMLSPLLKQSSGVVAERGEGAYLFDRDGTRYLDFTSGIGVTATGHAHPKVVAAIKAQADKLLHGQYAIVRHPGIMELAERLGAYMPGPIDALFFSNAGTEACEAALRLARHATGRPNIIVFHGGFHGRTMGSLSMTTSSVGLRAGLQPMMGGVVVAPFPNTYRYGWDEEAATDFCLRELDYIFATYSTPAETAGVFIEPVQGESGYVPANTRFMQGLRERCDQHDMLMILDEVQAGYGRTGRFWAHSHFEVQPDVVVTAKGLASGMPLSGVGAPSELMERGWAGSQGGTYGGNAVACAAALATLDVIEEEGLVHNAAEQGAYLKQRLKEVQAEFPEVADVRGMGLMIGTEMVDAEGRPDGDRAARILKAMEKRKVLMIRCGAFGGQVVRWLPPLIVSRQQVDTAVDTFIEALRETA

SEQ ID NO: 61159 - protein, 334 aa, Thermobifida fusca YX
MSGAVPSGFLTLPSIDETLAREIQAELEQVEKVLRDAVAESDPLLREAASHLLEAGGKRFRAILVLLSARFGDATNPDLVSAAAVVELTHVATLYHDDVMDEAELRRGSPSANRRWGNTIAILTGDYVFARASEILADLGTEAVRLQAQTFGRLVRGQILETAGPRPGVDPMKHYLDVIADKTASLIASSARFGAMVGNADPEVVETLTRAGDALGMAFQLSDDILDVASETEESGKTPGTDLREGVLTLPMLYALQGTEPEHARLRSLLGRPLNDEEAAEALALLRAHPAMDEARADLAAWGERAQAELATLPECPAKTAFLAICDYVVNRKG

SEQ ID NO: 61160 - protein, 459 aa, Methylobacillus flagellatus KT
MKIVDGRFTCQPGTPAEQLAAAKKFLADNHVKYVLAQFVDIHGVAKVKSVPAAHLESILKDGAGFAGGAIWGMGILPNGPDYMAVGDLSTLSLLPWQPGYARIICDGHVDQKPYEYDSRVVLKKQVERLSAQGWTLYTGLEPEFSLLRRDEKGALHPCDETDTLQKPCYDYKGMTRQAVFLERLTEALIAAGLDVYQIDHEDANGQFEINYTYADCLKSADDYILFKMAASHIANELGMTCSFMPKPFGNRPGNGMHMHMSIGDGNKSLFHDDSDSTGHGLSPLAYHFLGGILHHAPALTALAAPTVNSYKRLVVSQSLTGSTWAPAYISYGNNNRSTMVRIPYGRLELRLPDGSCNPYLTTAAVIAAGLDGVKRELHPGPGHSTNLFDLSLAEMKEQGIGILPQNLNESLDQLEANQVLRDALGNALTEEFIKLKRAEWVDYQRHVSDWEINRYIEFF

SEQ ID NO: 61161 - protein, 194 aa, Glycine max
  misc_feature (148)..(148): Xaa can be any naturally occurring amino acid
  misc_feature (185)..(185): Xaa can be any naturally occurring amino acid
MASIFLSSPPSFSSAHHNASTHLILHTPNSLNLRTMSHSLPIRAITLTWDYLKRLAANKAVEFVKRGMVLDPGTGTGSTATFVIAKLGTLLASGQLIDIVGVPTSKRTEDKVLFLGIPLFVLGLTIDDADEVDPNLNLIKGCGGALFXKKMVEAASNKFVTDKDDTKLVDGLGGSGLAMPVEVVXFCWKYNLDQ

SEQ ID NO: 61162 - protein, 431 aa, Flavobacteria bacterium BBFL7
MTVIAKGKTKKLPLRGMMDNVMEQFNSAADHINLHLNIRKILSITNNEIIVHFPVKMDNGDVEIFTGYRVQHNNALGPYKGGLRYHPTVDIDAARALAMWMTWKTSLAGLPYGGGKGGIQLDPSKYSPSELERITRRFTFALADNIGPEHDIPAPDVNTNSQTMAWMADTYMSTRPPAERTANQHVVTGKPDGSGGLEGRDRATGYGVFLTIKFWAHKSAESLKDKRFIVQGFGNVGYWAAHFLEKEGAHLVAVQDAYGTLHNDDGIKVEDLYNYSIANKGSIVDFPEAKAIPKADFYTTDCDICIPAALGNQITSENAPYIKARLIAEGANGPTNVDGEKILLEKGVTIIPDILCNSGGVIGSYFEWLQNRNGELWQLDEVMIKLEKKMRESFNKVYTFSESEAMDMRTAAYCIAIKRIEKAYVQRGIFP

SEQ ID NO: 61163 - protein, 665 aa, Pseudomonas syringae pv. tomato str. DC3000
MPSRRERANAIRALSMDAVQKANSGHPGAPMGMADIAEVLWRDYLKHNPTNPSFADRDRFIMSNGHGSMLVYSLLHLTGYDLSIDDLKNFRQLHSRTPGHPEFGYTPGVETTTGPLGQGFANAVGFAAAEKTLAAQFNRPGHSIVDHHTYVFMGDGCMMEGISHEVASLAGTLQLGKLIAFYDDNGISIDGEVEGWFTDDTPKRFEAYGWQVIRNVDGHDADEIKTAIDTARKSDQPTLICCKTTIGFGSPNKQGKEESHGAPLGADEIALTRAALKWNHGPFEIPADIYAEWNAKEKGLAVEAEWDQRFAAYSAAFPELANEFIRRMSGELPADFAEKSAAYVAEVNAKGETIASRKASQNALSALGPLLPEILGGSADLAGSNLTIWKGCKSITGEDPNGNYLHYGVREFGMAAMMNGIALHGGFVPYGATFLIFMEYARNAVRMASLMKKRVIYVFTHDSIGLGEDGPTHQPIEQLTSLRTTPNLDTWRPADAVESAVAWKYSLERNDGPSALIFSRQNLTHQAREQQQIDAIARGGYVLRDCAAEPELILIATGSEVGLAVEAYEKLTAQGRNVRVVSMPCTSVFEAQDAGYKQAVLPLQVSARIAIEAAHADYWYKYVGLEGRVIGMTTFGESAPAPLLFEEFGFTLENVLSIAEELLED

SEQ ID NO: 61164 - protein, 117 aa, Oceanicola granulosus HTCC2516
MAGYLTTHVLDTARGRPAAGLRIELYRIEGDGRTKLAEATTNDDGRTDGPILPEADFATGSYELVFHAGSYLDVSGVPGESPRFLSEIPIRFGMSEETHYHVPLLLSPFGYATYRGS

SEQ ID NO: 61165 - protein, 183 aa, Thermobifida fusca YX
MLEWLNPVKGFGVTFHTMFKKVPTVEYPEVKAPTMPRFHGRHQLNRWPDGLEKCIGCELCAWACPADAIYVEAGDNTEEERYSPGERYGRVYQINYLRCILCGLCVEACPTRALTMTNEYELADDSRESLIYTKEQLLAPLQQGMEAPPHPMRLGETEKDYYRLGRDDNAAARADEQNSEAVQ

SEQ ID NO: 61166 - protein, 114 aa, Glycine max
MMEDPTTLLNSEYSRLFGEDTDLYNRIVLGALLPHSVWGPLPRFLQTWLRNYLGGVLLYLLSGLLWCFYIYYWKRNVHVPKGFTLFLPSFWCVPARVIIMFCFSIATVESCRRD

SEQ ID NO: 61167 - protein, 649 aa, Lactobacillus acidophilus NCFM
MCGIVAFYDPKINDKQAVIGKMMATIKHRGPSSDGYYTNDEVALGFRRLSIIDLRGGSQPIYNEDKTRAIIFNGEIYNFKPLREELIKAGHTFTTKADTEVLLHGYEEWGMDGLLKRVRGMFAFLIWDDNNKTLYGARDFFGIKPMYYSNQDGHLLVGSELKSFLEYPKFKRELNVEAVKPYLMNQYNDLEETFFKGVYRFPAGHWFEYKDGEMKTHQYWDAEYKENSLSFEETLKRINDDLKETVDLYRNADVKVGAFLSEGIDSSYLTSLLNPDDVFSVSFDDSTYDEASKAKALADINHWKFFSEKVDADEAMRDFPEMQYHMDEPDANPSIIPLWYLCKLARKHVTVALSGEGADELFAGYVNYGMHTHNDVIKVFTSELKKLPKNKQVKLAHKIKKMPNFPGKVHMYTNLAEPSEFYVGQSVIYDMDYPTIFTSKDANSILQPTYRNKLTVNGIYQKDFKKVKGIDNVKQMQYIDLHHFMLNDIEQKADKISMAHSLEVRVPYLDKKIAELANSIPTKYLVNRHDTKYALRKASEKVLPDEWAKRPKLGFPTPIKQWLKEPRFYKQVRSLFEEEFVNDIFDQKKIIKLLDDNYEGDGSHRRQIWAIYTFLVWYKLFFVDYENTVKKYQHVQPEVANLISQGKLL

SEQ ID NO: 61168 - protein, 556 aa, Frankia sp. CcI3
MSTTEPAAPVAPLDITATEEWAALTTHLREISEVSLRDLFAADPRRGETFAAEADGLYLDYSKNRLTARTVELLTALARRAGLADRIEAMFRGERINVTENRPVLHVALRAPAGTRIEVDGVDVVPDVHRVLDAMSQFADRVRSGDWLGATGERIRTVVNIGIGGSDLGPAMAYDALRDYADRSIEVRFVSNVDPTDIWEATADLDPASTLFIVSSKTFTTLETISNARAARSWLTGLLGEDAVSRHFVAVSTNAEKVAEFGIDTVNMFEFWDWVGGRYSVDCAIGLSLMIAIGPPNFREFLAGFAAMDTHFRTAPFERNLPVLLGLIGLWYRDFFGTATHAVLPYSHYLGRFPAYLQQLDMESNGKSVDLTGRPVSTPTGPIVWGTPGTNGQHAYYQLLHQGTTIVPADFIGFVRPNHPGVGTADGAGVDQHALLLANFLAQTEALAFGRTAAEVAAEGVTPDLVAHRTFPGNRPSNTLLAQKLTPFALGQLIALYEHKVFTQGVIWGINSFDQWGVELGKVLAGRIIPELGSEQEPELGHDSSTNALIKRLRAG

SEQ ID NO: 61169 - protein, 387 aa, Pseudomonas syringae pv. tomato str. DC3000
MTVLKMTDLDLQGKRVLIREDLNVPIKDGVVSSDARILASLPTIRLALEKGAAVMVCSHLGRPTEGEFSAENSLKPVAEYLSKALGRDVPLVADYLDGVDVKAGDIVLFENVRFNKGEKKNADELAQKYAALCDVFVMDAFGTAHRAEGSTHGVAKYAKVAAAGPLLAAELEALGKALGAPAQPMAAIVAGSKVSTKLDVLNSLSAICDQLIVGGGIANTFLAAAGHKVGKSLYEPDLLDTARAIAAKVSVPLPTDVVVAKEFAESATATVKLIADVADDDMILDIGPQTAAHFAELLKSSGTILWNGPVGVFEFDQFGEGTKTLAKAIAESKAFSIAGGGDTLAAIDKYGVADQISYISTGGGAFLEFVEGKVLPAVEMLEQRARA

SEQ ID NO: 61170 - protein, 326 aa, Bacillus clausii KSM-K16
MASKNDEDFKEKEIKALQDWFERHKQTKPYPQYPYYGKITRYEDIPLVAPEQRQLKHPGVERLMVPKPIIENPNVQGSGKLTGKTAIITGGDSGIGAAAAIAFAKEGADVVISYLDEHEDAQRTKKRIEELGQRCLLLPGDVSEKQMCETIVAKTIEAFGKIDILCNNVGIQFPQHSIVDITDEQFDHTFKVNFYSHFYLTRAALPYLKAGSSIIGTTSVVTYVGEPQLVDYTATKGAIVGWTRALAKQIGDKGIRVNAVAPGKIWTPLIPASFSADDNALPGDNVFNRVGQPFELAPTYVYLASDDSRFVTGQVLHVDGGQSTNS

SEQ ID NO: 61171 - protein, 237 aa, Brassica napus
MVKIAIGSLGDSFSVASLKAYLSEFIATLLFVFAGVGSAIAFGKLTSNAALDPAGLVAVAVAHAFALFVGVSIAANISGGHLNPAVTLGLAVGGNITVITSFFYWIAQCLGSIVACLLLVFVTIGESVPTHGVAAGLGAAEGIVMEIVVTFALVYTVYATAADPKKGSLGTIAPIAIGFIVGANILAAGPFSGGSMNPARSFGPAVVSGDFSQIWIHWVGPLVGGALAGLIYGDVFI

SEQ ID NO: 61172 - protein, 163 aa, Triticum aestivum
  misc_feature (111)..(111): Xaa can be any naturally occurring amino acid
  misc_feature (128)..(128): Xaa can be any naturally occurring amino acid
MARRHHLLLLLPLLALAFSFVAAAPEATSMSLDEVSAAVSVLLGFAPPAMLPAPSSAKLNELLLPKPFDRPRAVFLMQIDGSHDSVDSFVSDAGSIYKTKIDVAKNAATGXTDRDELIVIRSDESSGXDVLDNELTNLATWLEGSIEGDNNHPLKSGTVYCPQ

SEQ ID NO: 61173 - protein, 336 aa, Rhodopseudomonas palustris CGA009
MAVIVPFEGPSTASIDQLVELVAADMERVNATILSRTGSDVTMIPEVANHLISSGGKRLRPMLTLAMANLTGYTGDGHIKLAAAVEFMHTATLLHDDVVDESEMRRGKKSARMLWGNEASVLVGDFLLGQAFRMMVEVGSLRALDILSSASATIAEGEVMQLAAAKNTATTEDEYLAVIRGKTAELFAAACEVGPAIANRPKPEQSACRSFGMNIGIAFQLIDDVLDYGGKAAKLGKNVGDDFREGKITLPVVLAFRRGNDAEREFWIKSLERGEISDADLDQAIKLMTKHRALDDTIQRAHHYGAMAVDALALFPSSPMKTALEQVVAFCLARSH

SEQ ID NO: 61174 - protein, 647 aa, Oryza sativa (indica cultivar-group)
MGEVATTTLLLTSHEAKPAKAPSIHDAIEVYIGATGARQLLKAMLLAFAWAFDAQQVFMSVFTDAEPPWHCTGVVDAVAAVAGDSGSSCSSPATSASPCALPLGTWEWDRLAKTSVVSDWALNCSGGGPALVSLPASSFFTGNLVVVLPYSLISATTTPLLTSHEAEPSIDDVIEAYIGATGARQLLKAMLLAFAWAFDAQQVFMSVFTDAEPPWHCTGVVDAAAAAAADSGSSCSPPAASASPCALPPGTWEWDRPAETSVVSDWALNCGPALVSLPASSFFAGNLAGGFLLATLADTHLGRRKMLLLSLVTMSVAAELTAFSPNVWVYSALRFVSGFGRSMVGTSAMVLSTELVGKRWLRGIRLLLRRESPRWLLVRGRKQEAIEAVRQIASLNGGGGGITTSSFSMLDACAVELGDGGEGMFATLHSIWERRWALRRLAAITAASFGVGMVYYGMPLNVGSLSPSNLYLSVAYNAVAELPSSILAWLLMGRWFNRRGSVVALTTASGLCSLAACVPAVVLPDGARLAAEVASFFASCTAYDMMLMYTIELFPTSVRNSAVGLVRQAVALGGVVAPVLVAVGRETTSYWSSSFGLFGLAVGCLGLLVTCLPETRGRRLSDTMEEEEAAILSSSGASDMENNGELV

SEQ ID NO: 61175 - protein, 379 aa, Zea mays
MATAGKVIKCKAAVAWEAGKPLSIEEVEVAPPQAMEVRVKILFTSLCHTDVYFWEAKGQTPVFPRIFGHEAGGIIESVGEGVTDVAPGDHVLPVFTGECKECPHCKSAESNMCDLLRINTDRGVMIGDGKSRFSINGKPIYHFVGTSTFSEYTVMHVGCVAKINPQAPLDKVCVLSCGISTGLGASINVAKPPKGSTVAVFGLGAVGLAAAEGARIAGASRIIGVDLNPSRFEEARKFGCTEFVNPKDHNKPVQEVLAEMTNGGVDRSVECTGNINAMIQAFECVHDGWGVVVLVGVPHKDAEFKTHPMNFLNERTLKGTFFGNYKPRTDLPNVVELYMKKELEVEKFITHSVPFAEINKAFNLMAKGEGIRCIIRMEN

SEQ ID NO: 61176 - protein, 220 aa, Triticum aestivum
MDPFYTSFSDSFLSIPDHRSPVSDSSECSPKLASSCPKKLAGRKKFRETRHPIYRGVRQRNSGKWVCEVREPNKKSRIWLGTFPTVEMAARAHDVAALALRGRSACLNFADSAWRLRIPESTCPKEIQRAAAEAAMAFQNKTATTETTMVEAVKPAEETVGQTGGETMEENGVFYMAEEAVLGMPRFLENMGEEMLLPPPELGWNHNDLAGDADVSLWSF

SEQ ID NO: 61177 - protein, 645 aa, Photorhabdus luminescens subsp. laumondii TTO1
MSHNTVIPTTDISPKPDPARPRKAQRDAAQEFINSIQGVTFPNSRRIYLQGSRDDIQVPMREIQLSPTLIGGTKEEPQYEENEAIPVYDTSGAYGDPDAKLDVHVGLTQLRQPWIDERQDTEPVAALSSDFTQQRLTDAGLDHLRFNHRPHPLKARKDKRVTQLHYARQGIITPEMEFIALRENMGRERIRGDVLRQQHPGQSFGAQLPENITPEFVRQEVAAGRAIIPANINHPESEPMIIGRNFLVKVNANIGNSSVTSSIEEEVEKLIWSTRWGADTVMDLSTGRYIHETREWILRNSPVPIGTVPIYQALEKVNGGAENLTWEIFRDTLLEQAEQGVDYFTIHAGVLLRYVPMTAKRLTGIVSRGGSIMAKWCLSHHQENFLYQHFREICEICAAYDVSLSLGDGLRPGSIQDANDEAQFAELHTLGELTKIAWEYDVQVMIEGPGHIPMQMIRRNMTEELEHCHEAPFYTLGPLTTDIAPGYDHFTSGIGAAMIGWFGCAMLCYVTPKEHLGLPNKDDVKQGLITYKIAAHAADLAKGHPGAQIRDNAMSKARFEFRWEDQFNLALDPDTARAYHDETLPQASGKIAHFCSMCGPKFCSMKISQEVRDYAAGMEQMSEAFRAHGSELYHSVEDVSHEQSA

SEQ ID NO: 61178 - protein, 434 aa, Thermobifida fusca YX
MTTPTETYVDASGGDWDEVVAAAQRSQTDRLVINMGPQHPSTHGVLRLILTLDGETVTEARVGIGYLHTGIEKNMEYRTWTQGTTFVTRMDYLTPLFNETAYCLAVEKLLGITDQVPERANVIRVMMMELNRISSHFVAMATFGMELGATTVMTNGFREREMVLDIFEMVTGLRMNHAYIRPGGVAQDLPPGTVGKVRELLTEMPKRLKDMRKLLDANPIYLARTRDVAYLDVTGCLALGVTGPILRAAGLPWDLRKAKPYCGYENYEFDIPVSDGADVYARYRVRMAEIEQSLKIIEQCLDKLKPGPVMIEDPKIGWPAQLALGPDGMGNAPSHIAHIMGKGGSMEALIHHFKLVTEGFRVPPGQAYAAVESPKGELGCFAVSDGGPRPYRVHFRDPSFTNLQAVAAMCEGGTVADVIAAVASIDPVMGGVDR

SEQ ID NO: 61179 - protein, 252 aa, Thermobifida fusca YX
MTSNGQQGKPNLPEKDNLPRELGTQRINSPIARMGMFGAKTTGDTSGYGRLRVYRHVPAAAQRPYSDPSDPRTAYFDEVADALERSLKEIGTPYDTAISRVVVDRGEITFHVQREHLLDVATRLRDDPALRFELCLGVTGVHYPEDEGNELHAVYALRSITHNYEIRLEVSCPDSDPHIPSIVSVYPTNDWHEREAWDFFGIIFDGHPALTRIHMPDDWHGHPQRKDYPLGGIPVEYRGAKVPPPDQRRSYA

SEQ ID NO: 61180 - protein, 279 aa, Zea mays
PTPPPPRVPDASNQQNQSLHPMSAMAAAPPQAPHLDSVLSFSALASHAAAEPASSDSDSDSDSDLEFAFAPPPRAGAHALAPADDLFAHGRIVPVYPLAAHGHGHGHDEALASSPALTSSSAAAPPPSPDTYCAWAPRDAPAAFPKSASTGTEARRSWRLRDLVVAGGGRSRSDGKEKFAFLQPSSSSSDGSKHASAKAAAPPQKQAGKKNNNNKKKKGGATEMDMATAHRLFYGKPGAAALAGDRTRQPQQQSYLPYRPGIVGFFATAHALGRSHHPY

SEQ ID NO: 61181 - protein, 524 aa, Frankia sp. CcI3
MTQRQFRLPDLGEGLTEADIVRWLAQVGDTVTVNQPLVEVETAKAVVEVPSPFAGILVETHGAEGTTLAVGAPLLTIQTADTDTYVDTDTNADGTGGNGTGANSLPTSRDAGSIERTPVLVGYGPRTAESRRRRPRRPPTPAGPVHTAGPVHTAGPVHTAGPVHTAGPVHTAGPVHTAGPVHTAGPVHTAGPVHTAGPVHTAGPVLAKPPVRKLARDLGVDLASLAGTGPDGTISRADVEAAVRAAARTAPLAAPPTRDAPPIGVIPAGATFSAETRTWHVPVTGIRRSMAQAMVASVSAAPHVTEFLTVDATATMAARDRIAALPEFTGIKITPLLFVARALLIAVRRHPMINSSWVEDAGGGRPENGGRPENGGRPEIHVYDRVNLGIAVAGPRGLVVPTIPDAGRLDVVGLAHALAGLTTAARADRLSPADLRGGTITITNVGVLGVDIGTPILNPGEAAILALGSIRPMPWVHEGQLTVRTVVQLALSFDHRIVDGALGSAVLADVGAVITDPTVALAWS

SEQ ID NO: 61182 - protein, 232 aa, Bifidobacterium longum DJO10A
MDKAQQDALKKAAGIEAAKLVENGMIAGLGTGSTVKFLVDELGRRHQEEGLEFTGVTTSRRTQVQAESYGIKIVDIDDVDHIDVTIDGADEVDKNFNGIKGGGAALLWEKIVATNSNQIVWIVDESKVVDTIGKFPLPVEVIPFGAGQVIKKFEARGYKPVLRLDADGKEVRTDENNFVVDLHLERIDHPQELAEDLINTVGVVEHGLFLNMVDKVIVGDPNGPRVMTNANK

SEQ ID NO: 61183 - protein, 264 aa, Streptococcus mutans UA159
MSQHLFTAFILTALAGLSTGIGSLIAFVTKHTNKTFLSVSLGFSAGVMIYVSMIEIFPTAQTILTKAMDKKSGSWLTVLAFFGGILLIAIIDKLIPSEENPHEIKTIEEEDQKPTKLMRMGLMTAIAIGIHNFPEGLATFISGLQDASIAIPIVIAIAIHNIPEGIAVSVPIYQATGSKKKAFTYSFLSGLAEPLGAIIGWFLLMPIMNNIVYGAIFSAVAGIMVFISLDELLPAAEEYGKHHLAIYGVISGMLIMAVSLLLFI

SEQ ID NO: 61184 - protein, 292 aa, Candida albicans SC5314
MSAIYKALQSKSSKETSEKTKHINRQRLLVISSRGITYRHRHLIQDLLALLPHARKEPKFDSKKNLHQLNEVAELYNCNNIFFFECRKHQDLYLWISKPPNGPTLKFHIQNLHTLDELNFTGNCLKGSRPILSFDKSFLENDHYKLLKEMFLQTFGVPPNARKSKPFIDHVMTFSIVDGKIWIRNYQINETLDVKENDKIEDDEDYDVDQLNLVEIGPRLVLTLITVLEGSFSGPKIYENKQYVSPNFVRAQLKQQAADQAKSRSQAALERKIKKRNQVLKADPLSNDALFK

SEQ ID NO: 61185 - protein, 913 aa, Rhodopseudomonas palustris CGA009
MAKSAAKPAKKPAANAVAAPKAGKWVYTFGDGKAEGRANMRDLLGGKGANLAEMANLGLPVPPGFTIPTSVCTYFYANGKTYPKELQSQVERALDHVGKLTNKKFGDAKNPLLVSVRSGARASMPGMMDTVLNLGLNDQTVEALAEKSGDRRFAYDSYRRFITMYSDVVLGFEHHHFEEILDAYKDAKGFTLDTDLDADDWVDLVGQYKEAVARETGEDFPQDPHAQLWGAIGAVFSSWMNARAVTYRRLHDIPESWGTAVNVQAMVFGNMGETSATGVAFTRNPSTGESRLYGEFLINAQGEDVVAGIRTPQDITEHARIESGSDKLSMEMAMPEAFKELTRIYTLLEKHYRDMQDMEFTIEQGKLWMLQTRGGKRTAKAALRIAVELANEGLINRKDAVTRIEPGSLDQLLHPTIDPNAKRDVIATGLPASPGAASGEIVFSSDEAAKLHADGRKVVLVRIETSPEDIHGMHASEGILTTRGGMTSHAAVVARGMGKPCVSGCGAIRVDYGRGTMMIGNRTFKAGDIITIDGGTGQVLAGKMPMIEPELSGDFNTLMGWADEVRKLKVRVNADTPADARTAIKFGAEGIGLCRTEHMFFEETRIRTVREMILAEDEQSRRSALAKLLPMQRADFVELFEIMKGLPVTVRLLDPPLHEFLPHTQAEIEEVARAMNADPRRLADRARELAEFNPMLGFRGCRLAIAYPEIAEMQARAIFEAAVEAEKRTGEQVGLEVMVPLIATRAEFELVKARIDATAQAVNRDTGSNLKYQVGTMIELPRACLMAGDIAESAEFFSFGTNDLTQTTFGISRDDAASFLGTYIEKGIFTVDPFVSVDRDGVGELVRIGVERGRKTRAKLKVGICGEHGGDPALVAFCHEVGLDYVSCSPYRVPIARLAAAQAALGKGIASQA

SEQ ID NO: 61186 - protein, 151 aa, Zea mays
  misc_feature (86)..(86): Xaa can be any naturally occurring amino acid
  misc_feature (89)..(89): Xaa can be any naturally occurring amino acid
  misc_feature (121)..(121): Xaa can be any naturally occurring amino acid
  misc_feature (126)..(126): Xaa can be any naturally occurring amino acid
  misc_feature (134)..(134): Xaa can be any naturally occurring amino acid
RSWYERYVLLADPCDVYGVRNLSFAIADFSVTGHLRPSAELVIHPHPHQDLGHFPSLPQLESRLQSDGYYAGVRVMMLMCIVFYNXVSXNNITIKADDFTVSYDTNIPHQFGLSASSAIVXAALNXLLDFYNVXRHLIEVEMRPNLMLNAE

SEQ ID NO: 61187 - protein, 231 aa, Rubrobacter xylanophilus DSM 9941
MVRALLFDLDGTLAETDSVHYPAWAGILASHGYEADWGFYQERISGRLNPEIAAELLPQLSEEERRRIIEAKEEDFRRRVGELEPLPGLVRFVERAREGGRRVALVTNAPRENALAVLRALGLEGCFDPVVLAEDAGAGKPDPAPYRRALRLLGVAPGEAVAFEDSPSGLRAAVAAGVPVVGVASTHDPSRLEALGAFMVVEDFTDPRLGALLDGRGGGARSSGRGAGREG

SEQ ID NO: 61188 - protein, 398 aa, Methanosarcina mazei Go1
MNEQGLSEREIFSYLENAKSEDTDYYRVFSSMCTRPHKIAIEANRLFIEANLGDLGLFAGAHKLEQEVVRMLGNLLHASSIDVPSGGLCQSSVCGYLTTGGTESNIQAVRGMKNLVTAGKKEFKGTPNIVIPASAHFSFDKVADMMGIEVRRASLDSEFRVDMASVEKLINENTIGLVGIAGNTEFGQIDPIDKLSEVALENELFLHVDAAFGGFVIPFLEKPQPFDFKVPGVTSIAIDPHKMGLSTIPSGALLFRSPSFLDSLKVSTPYLTTKSQFTLTGTRSGASAAATCAVMKYLGYEGYRKNVQYCMELTSKIVEEARKLGFEPLIEPVMNVVALKVPNPDLVRERLLKKFGWNVSITRTPRALRLVLMPHNSPEDIELFLEDLKKVTAEIKSP

SEQ ID NO: 61189 - protein, 623 aa, Arabidopsis thaliana
MVMYKEDYVSNSRGIQLFTCSWKQEEQQEPKALIFLCHGYAMESSITMSSTAVRLANAGFSVYGMDYEGHGKSGGLNGYVKKFDDLVQDVSSHYSSICELEENKGKMRFLMGESMGGAVVLLLERKKPNFWDGAVLVAPMCKLAEDIKPHPMVISFLTKLTRFIPTWKIVPSNDIIDVAFKETHIRKQVRDNEYCYKGRPRLKTAHQLLMVSLDLEKNLDQVSMPFIVLHGEDDKVTDKNVSKLLYEVASSSDKTFKLYPNMWHGLLYGESPENLEIVFSDIISWLKERASVTNQKLETELKLAHVDGQVGYSEEFIENSRGMQLLTCKWFPVNQEPRALIFFCHGYAIDCSTTFKDIAPKFAKEGFAVHGIEYEGHGRSSGLSVYIDNFDLLIDDVSSHFSKISEMGDNTKKKRFLMGESMGGAVVLLLHRKKPEFWDGGILIAPMCKSQIAEEMKPSRMVISMINMVTNLIPSWKSIIHGPDILNSAIKLPEKRHEIRTNPNCYNGWPRMKTMSELFRISLDLENRLNEVTMPFIVLHGEDDKVTDKGGSKLLYEVALSNDKTLKLYPEMWHSLLFGEPPENSEIVFNDIVQWMQTRITTLQVKANNHEAKTSNLITSDSV

SEQ ID NO: 61190 - protein, 130 aa, Methanothermococcus thermolithotrophicus
MSLMDPLANALNHISNCEGVGKSVAYVKPASKLIGRVLNVMQDHGYIGNFEYIEDGRAGIYKVELIGQINKCGAVKPRYAVKKQEFEKFEKRYLPAKGFGLLIVSTPKGLMTHDEAKNQGLGGRLISYVF

SEQ ID NO: 61191 - protein, 1109 aa, Ipomoea nil
MKVAVNTFLLFLCSTSSIYAAFALNSDGAALLSLTRHWTSIPSDITQSWNASDSTPCSWLGVECDRRQFVDTLNLSSYGISGEFGPEISHLKHLKKVVLSGNGFFGSIPSQLGNCSLLEHIDLSSNSFTGNIPDTLGALQNLRNLSLFFNSLIGPFPESLLSIPHLETVYFTGNGLNGSIPSNIGNMSELTTLWLDDNQFSGPVPSSLGNITTLQELYLNDNNLVGTLPVTLNNLENLVYLDVRNNSLVGAIPLDFVSCKQIDTISLSNNQFTGGLPPGLGNCTSLREFGAFSCALSGPIPSCFGQLTKLDTLYLAGNHFSGRIPPELGKCKSMIDLQLQQNQLEGEIPGELGMLSQLQYLHLYTNNLSGEVPLSIWKIQSLQSLQLYQNNLSGELPVDMTELKQLVSLALYENHFTGVIPQDLGANSSLEVLDLTRNMFTGHIPPNLCSQKKLKRLLLGYNYLEGSVPSDLGGCSTLERLILEENNLRGGLPDFVEKQNLLFFDLSGNNFTGPIPPSLGNLKNVTAIYLSSNQLSGSIPPELGSLVKLEHLNLSHNILKGILPSELSNCHKLSELDASHNLLNGSIPSTLGSLTELTKLSLGENSFSGGIPTSLFQSNKLLNLQLGGNLLAGDIPPVGALQALRSLNLSSNKLNGQLPIDLGKLKMLEELDVSHNNLSGTLRVLSTIQSLTFINISHNLFSGPVPPSLTKFLNSSPTSFSGNSDLCINCPADGLACPESSILRPCNMQSNTGKGGLSTLGIAMIVLGALLFIICLFLFSAFLFLHCKKSVQEIAISAQEGDGSLLNKVLEATENLNDKYVIGKGAHGTIYKATLSPDKVYAVKKLVFTGIKNGSVSMVREIETIGKVRHRNLIKLEEFWLRKEYGLILYTYMENGSLHDILHETNPPKPLDWSTRHNIAVGTAHGLAYLHFDCDPAIVHRDIKPMNILLDSDLEPHISDFGIAKLLDQSATSIPSNTVQGTIGYMAPENAFTTVKSRESDVYSYGVVLLELITRKKALDPSFNGETDIVGWVRSVWTQTGEIQKIVDPSLLDELIDSSVMEQVTEALSLALRCAEKEVDKRPTMRDVVKQLTRWSIRSYSSSVRNKSK

SEQ ID NO: 61192 - protein, 130 aa, Methanococcus voltae
MSLMDPLANALNHISNCENVGKNTAYLKPASKLIGRVLKVMQDQGYIGNFEYIEDGKAGVYKVTLIGQINKCGAVKPRFAVKNQEFEKFEKRYLPAKGFGLLIVSTPKGLMTHDEAKDSGIGGRLISYIY

SEQ ID NO: 61193 - protein, 130 aa, Methanotorris igneus
MSLMDPLANALNHLTNCERVGKKVFYIKPASKLIGRVLKVMQDHGYIGEFEFIEDGRAGIFKVELIGKINKCGAIKPRYAVKKHEFEKFEKRYLPARDFGLLIVSTSQGIMTHYEAKEKGIGGRLISYVY

SEQ ID NO: 61194 - protein, 353 aa, Frankia sp. CcI3
MTSGAVVAGEQRSDEVGERVARAPVTMAKALNLGLRSAMAADPKVLIMGEDVGKLGGVFRVTDGLQQEFGEARVIDTPLAESAIVGTAIGLAMRGYRPVCEIQFDGFVYPAFDQIVSQLAKLHYRSAGRIRLPVTIRIPFGGGIGAVEHHSESPEAYFCHTAGLKVVACSNPVDAHHMIQQAIRSDDPVIFLEPKRRYWEKGVVDPRPLAELPAGELTQLHASRVVRTGTDATLVGYGPTVRTCLDAAEISAADDSRSLEVIDLRTLSPLDLEPVLDSVRRTGRLVVVHEAPSNVSVSAEVAARVTERAFYSLEAPVLRVTGFDTPYPPARLEDHYLPDVDRILDAVDRSFAY

SEQ ID NO: 61195 - protein, 118 aa, Brassica napus
MATLDSDVNMIPAGESSSSVVASSSSKKAKRFEVKKWSAVALWAWDIVVDNCAICRNHIMDLCIECQANQASATSEECTVAWGVCNHAFHFHCISRWLKTRQVCPLDNSEWEFQKYGH

SEQ ID NO: 61196 - protein, 200 aa, Flavobacteria bacterium BBFL7
MKITSSEFVISNQDVKRCPDSKLAEYAFIGRSNVGKSSLINMLTNKKSLAKTSGRPGKTQLINHFLINKSWHLVDLPGYGYARVSKSSKAKFQKFITNYFQQRRQLVCAFVLVDVRHEPQPIDTEFMEWLGENGIPFGIVFTKADKLKPNALERNVEVYKKQLLDGVWEEVPPYFITSSSNGTGQEELLNYIGEINASLD

SEQ ID NO: 61197 - protein, 573 aa, Cryptococcus neoformans var. neoformans JEC21
MSFAEYIPKADDPISVPRPQLESSFQSLPDTAGPTAELQTRTSPVKISFGQPSGGAVKKGWKSISPKKKARVSLFDEDEEEIQGAKGEKEDKKEVMPEKEQDIMGEALPHPDTLIHRLTLASTRYTTLLTSLSAPLRAAFDSFSTLPSSPPPPPIDLFLDEYLGRKARDDEVKRVEEVWDAKKEWEREEEMGRRYLEEVGKGGRVEGVNVAPAEPGGARVSPAAVVVAPKPEPELAPIPVSGTELQAPAPGAEPHPQTQKVPIPLPPAATLVYQKLAAVGEGTYGKVYKALSLITHQPVALKRIRMENEKDGFPVTAMREIKLLQMLQHENVLRLVEMVVERGGVYMVLEYMEFDLTGLLAHPEIKFSPANIKSLSHQMLSGLSYLHRQSILHRDMKGSNILVNSRGELKLADFGLARVYAKKRREDYTNRVITLWYRSPELLMGETIYGPEVDMWSAGCIILELYTTKPIFQGSDELNQLEVIYALLGTPTEAEWPSVKELPWYELVKPKEEIGSKFRTSFAKWLSPAALDLVEGLLFYDPSQRLLADSALQTDYFLMEEPKMEKPTQYVPF

SEQ ID NO: 61198 - protein, 230 aa, Lactobacillus acidophilus NCFM
MSKLVLIRHGQSEWNLSNQFTGWVDVNLSEKGVEEAKKAGRLIKEHGLEFDQAYTSLLTRAIKTLHYALEESDQLWIPETKTWRLNERHYGALQGLNKKATAEKYGDEQVHIWRRSYDVLPPAIDDDNEFSQAHDRRYANLDPHIVPKAENLHVTLDRVMPFWEDNIAPDLLDGKNVIIAAHGNSLRALTKYIENISDDDIMDLEMKTGEPVVYTFDENLDVVNKEKLDD

SEQ ID NO: 61199 - protein, 355 aa, Chlamydia trachomatis
  misc_feature (17)..(17): Xaa can be any naturally occurring amino acid
ACLQVDSRGSPQIGIKXSELGPKAMYFAMQGSCPSDKRIFFVSNIDPDNAAEVLLEIDLEQTLVVVVSKSGTTLEPAANEELFRQAYQNKGLSIAEHFVAVTSQGSPMDDKSAYLEVFHLWDSIGGRFSATSMVGGVVLGFAFGYEAFIEFLQGAAAIDAHALTPKMRENLPLLSAMLGVWNRNLLGYPTTAVIPYSTGLKYFTAHLQQCGMESNGKSISREGKEISFRTSPIIWGDVGTNCQHSFFSLHQGTDIVPVEFIGFLHNQRGLDCVLSGTSSSQKLFANLVAQSLALAQGRDNANPNKRFKGNSPSSILVAQQLSPRIAGSLLAFYSINLHFKGFAGESILLTKKGFH

SEQ ID NO: 61200 - protein, 275 aa, Brassica napus
MAAPRNLTGDGGGKLVVKDEESAAASSSKRTKSERFPLSRWEFVVFFTVFLVFTTGLLCIYLTMPAAEYGKLKLPRTISDLRLLKDNLGSYASEYPARFILGYCSTYIFMQTFMIPGTIFMSLLAGALFGVVRGFVLVVLNATAGACSCFFLSKLVGRPLVCWLWPEKLRFFQAEIGKRRDKLLNYMLFLRITPTLPNLFINLSSPIVDIPFHVFFLATLVGLMPASYITVRAGLALGDLKSVKDLYDFKTLSVLFLIGSISIFPALLKRKRVYE

SEQ ID NO: 61201 - protein, 445 aa, Zea mays
  misc_feature (113)..(113): Xaa can be any naturally occurring amino acid
MASCLCFRRRRRPIIASSVPFFLLLVSFLASASASSTTTTKLLGSGNNATRRVAFSSEELRGLRSITARLARLRDASVKTIQSPDGDVIDCVPAHLQPAFEHPKLRSQKPEVXEPEERPRSSAGRFSDAGQDEDDDPLPQVWRRSGESCPEGTIPVRRTTEDDVLRATASSATRFGMKARGAGLGFARRDSTGGGHEHAVGYVTGGQFYGAKASLNVWPAQVASPAEFSLSQIWVISGAFGNDLNTIEAGWQVSPQLYGDNSPRFFTYWTDDAYQETGCYNLHCSGFVQTSSRVAIGAAISPVSSYAGRQFDVTLLIWKDPRRGHWWLQLGSGALVGYWPSALFTHLGSRADMVQFGGEVVNARPAGAPHTPTQMGSGRFPAEGYARAAYFRNVQLVDWDNNLVPAAGLRLLADRPGCYDIAGGSGGAWGTYFYYGGPGRNARCP

SEQ ID NO: 61202 - protein, 214 aa, Glycine max
MQVAAELQRAHHHHQRQRQQQDTTPMCRQIQLTISDHTTAGDAVADDGEDLFIPPLNFAMVDNGIFRSGFPEPANFSFLQTLGLRSIIYLCPEPYPEANMEFLKSNGIKLFQFGIEGHKEPFVNIPEDTIREALEVVLDVRNHPVIIHCKRGKHRTGCLVGCYRKLQKWCLSSVFDEYQRFAAAKARVSDQRFVELFDISSMKHLPIPFSCLKR

SEQ ID NO: 61203 - protein, 203 aa, Zea mays
MEMSDAERLFFFEMACNNSEVAYEQNPNDADNLTRWGGALLELSQLRNGPDSLKLLQDAEAKLEEALQIDPNKSDALWCLGNAQTSHGFFTPDTAIANEFFAKATECFQKAADVEPANELYRKSLDLSAKAPELHSEIHRQMASQAATQASSASNPTQSRKKKKKKDSEFWYDVCGWVILGAGICAWVGLARASMPPPPAPAT

SEQ ID NO: 61204 - protein, 1111 aa, Arabidopsis thaliana
MSSNTSRSYSTRSRQNSRVSSQVLVDAKLHGNFEESERLFDYSASINLNMPSSSCEIPSSAVSTYLQKIQRGMLIQPFGCLIVVDEKNLKVIAFSENTQEMLGLIPHTVPSMEQREALTIGTDVKSLFLSPGCSALQKAVDFGEISILNPITLHCRSSSKPFYAILHRIEEGLVIDLEPVSPDEVPVTAAGALRSYKLAAKSISRLQALPSGNMLLLCDALVKEVSELTSYDRVMVYKFHEDGHGEVIAECCREDMEPYLGLHYSATDIPQASRFLFMRNKVRMICDCSAVPVKVVQDKSLSQPISLSGSTLRAPHGCHAQYMSNMGSVASLVMSVTINGSDSDEMNRDLQTGRHLWGLVVCHHASPRFVPFPLRYACEFLTQVFGVQINKEAESAVLLKEKRILQTQSVLCDMLFRNAPIGIVTQSPNIMDLVKCDGAALYYRDKLWSLGVTPTETQIRDLIDWVLKSHGGNTGFTTESLMESGYPDASVLGESICGMAAVYITEKDFLFWFRSSTAKQIKWGGARHDPNDRDGKRMHPRSSFKAFMEIVRWKSVPWDDMEMDAINSLQLIIKGSLQEEHSKTVVDVPLVDNRVQKVDELCVIVNEMVRLIDTAAVPIFAVDASGVINGWNSKAAEVTGLAVEQAIGKPVSDLVEDDSVETVKNMLALALEGSEERGAEIRIRAFGPKRKSSPVELVVNTCCSRDMTNNVLGVCFIGQDVTGQKKLTENYSRVQGDYARIMWSPSTLIPPIFMTNENGVCSEWNNAMQKLSGIKREEVVNKILLGEVFTTDDYGCCLKDHDTLTKLRIGFNAVISGQKNIKKLLFGFYHRDGSFIEALLSANKRTDIEGKVTGVLCFLQVPSPELQYALQVQQISEHAIACALNKLAYLRHEVKDPEKAISFLQDLLHSSGLSEDQKRLLRTSVLCREQLAKVISDSDIEGIEEGYVELDCSEFGLQESLEAVVKQVMELSIERKVQISCDYPQEVSSMRLYGDNLRLQQILSETLLSSIRFTPAWKGLCVSFKVIARIEAIGKRMKRVELEFRIIHPAPGLPEDLVREMFQPLRKGTSREGLGLHITQKLVKLMERGTLRYLRESEMSAFVILTEFPLI

SEQ ID NO: 61205 - protein, 296 aa, Arabidopsis thaliana; identical to SEQ ID NO: 969

SEQ ID NO: 61206 - protein, 281 aa, Saccharomyces cerevisiae
MSNHSEILERPETPYDITYRVGVAENKNSKFRRTMEDVHTYVKNFASRLDWGGFAVFDGHAGIQASKWCGKHLHTIIEQNILADETRDVRDVLNDSFLAIDEEINTKLVGNSGCTAAVCVLRWQLPDSVSDDSMDLAQHQRKLYTANVGDSRIVLFRNGNSIRLTYDHKASDTLEMQRVEQAGGLIMKSRVNGMLAVTRSLGDKFFDSLVVGSPFTTSVEITSEDKFLILACDGLWDVIDDQDACELIKDITEPNEAAKVLVRYALENGTTDNVTVMVVFL

SEQ ID NO: 61207 - protein, 430 aa, Pasteurella multocida subsp. multocida str. Pm70
MMPIQNFSQIDRTYRYWRIHLMIAMYVGYAGFYLSRKSLNYAMPALISDLAMDKNAIGLMATLFYLTYGLSKFFSGLFSDQANPRYIMAIGLMMTGITNILFGLSSSVFLFTCLWVINAWFQGWGWPACSKYLTTWYSRSERGLWWSIWNTAHNVGGALIPLIVGYLTLHYSWRHGFIVAGIIVILISVFLLWRLPSTPDAMGLPSIGQWRHDPLELAQEKEGQDLPWRQILRDYVFYNKYLWLLAMSYALVYLVRTAINDWGNLYLSERYHYDLVSANSALSLFEIGGFMGSLVAGWGSDKLFSSNRGPMALVFAIGIFFSITALWLMPKENMLLQSGLFFCVGFFVFGPQMLIGMAAAECAHKKTAGTATGFVGLFAYLGAALAGYPLALITQTFHWTGFFVVISCCAFAIALLLLPFLKVQPNQSSC

SEQ ID NO: 61208 - protein, 213 aa, Rubrobacter xylanophilus DSM 9941
MGVTERVRFDEKGLVPVVAQDAEDGAVLMVAYADREAVERTLATGEAHYYSRSRGELWRKGQTSGNTQRVVEVRVDCDGDTLLYLVEPRGPACHTGERTCFFATLAGEGVGVSAGRGEDGVGLGAMLERLAGTIAARRRERPEGSYTASLMERGTGYVAQKVGEEAVEVVVAALRGERLAEEAADLVYHLLVLLEERGVGTGEVARVLRDRHR

SEQ ID NO: 61209 - protein, 116 aa, Xanthomonas axonopodis pv. citri str. 306
MSDTIFGKIIRREIPATIVYEDDEVLGFEDIAPQAPVHVLFIPKQHAFPTLDDVPPEQALLVGKLAIAAATYARAQGLAQDGYRIVMNCREHAGQTVFHIHLHLLAGAPLGRFGTP

SEQ ID NO: 61210 - protein, 117 aa, Colwellia psychrerythraea 34H
MSKILEMLEQEQMKTDLPAFAPGDTVVVQVKVTEADKSRLQAFEGVVIAVKSRGLHSAFTVRKISNGVGVERVFQTHSPIVDSIEVKRRGDVRQAKLYYLRELSGRKARIKEKLAKK

SEQ ID NO: 61211 - protein, 459 aa, Pasteurella multocida subsp. multocida str. Pm70
MLSFLQEVRKPTLELPVEERRKLWFKPFMQSYLVVFIGYMAMYLIRKNFNIAQNDLIETYGLSKTQLGMIGLGFSITYGVGKTLVSYYADGKNTKQFVPFMLILSAICMLGFSASMGGGSVSLFLMIAFYALSGFFQSTGGPSSYSTITKWTPRNKRGTYLGFWNLSHNVGGAAAAAVALFGANVFFNGHVIGMFVFPSIIALIIGFWGLRYGSDSPEAYGLGKAEELFGEPLSEEDLATEQNQLTKWQTFVQYILKNKVIWLLCFANIFLYIVRIGIDQWSPVYAYQELGFSKDAAISGFALFEVGALVGTFLWGYLSDLANGRRGLTACVALILIVFTLEFYQFATNEVMYLCALFVLGFLVFGPQLLIGVAAVGFVPKKAISVADGVKGTFAYLIGDSFAKLGLGMIADGTAIFGLTGWAGTFAALNISAIVCMVLLAFVAIAEEKKIRKIKAQAR

SEQ ID NO: 61212 - protein, 161 aa, Zea mays
  misc_feature (76)..(76): Xaa can be any naturally occurring amino acid
  misc_feature (115)..(115): Xaa can be any naturally occurring amino acid
  misc_feature (134)..(134): Xaa can be any naturally occurring amino acid
MTMMLNPDVDLIDRGGSVVVREVWAYNLVSEFHLISAVVEDFPYISMDTEFPGVIFKAEPAILRRGNPGYLYQLLXSNVDVLSLIQVGITLSPTRRNPPDLGGGVDGSRFIWEFXFRDFDVDRDAHAGESIELXRRHGIDFERPAARGEIGEVPKLMMSSG

SEQ ID NO: 61213 - protein, 451 aa, Colwellia psychrerythraea 34H
MKSEFQQKNTAHHFQPFSDNKELAEKGIKLISKAEGVYIYEDNGKKYLDGMAGLWCVNIGYGRKELVEAASQQMTELPYYNLFFKTTTAPATNLAAKIASLAPAHMNKVFFTGSGSDANDTNFRMVRRYWDLKGKPTKKTFISRKNAYHGSTVAAASLGGMGYMHEQGDLPIDGIVHVDQPYWFAEGGDLSQDEFGLKAAQSLEAKILEVGEENVAAFIAEPFQGAGGVITPPDSYWPEIKRILAKYDILFILDEVISGFGRTGEWFASEYFDLKPDMITIAKGMSSGYLPIGGVIISDKVADVVIGEGADFNHGYTYSGHPVAAAVALKNIEILESEGIVDQVKSEISPYLQQRWQELADHPIVGEARGLGMVAAIELVKDKATKERLAPNAAGGGVCRDYSMDNGLIMRSCGDIMVISPPLVITKAEIDELIEKAKKTLDDTARFYNLI

SEQ ID NO: 61214 - protein, 2237 aa, Coprinopsis cinerea okayama7#130
MSSSSTQKEATEPVQQRPELSRSPSLFAHVPASPVTGPVQDDANAVDGVLELADGTAYRGISFGAEGKSVAGECVFQTGMVGYTESLTDPSYEGQILVLTYPLLGNYGVPARPASWDDLPEHFESSRIHVAALIVGNYTEDYSHFLASSSLGAWLKENGVPALFGVDTRALTKRIREKGSMLGRVLARADGPRVSRPQASLISSVPSTPYPWREEYIDIPFSNPYEKNLVAQVSIAAPRVYAPTSTPRLHPSGRPLRVLAIDVGMKFNQIRCFINRGVELKVVPWDYDFLAESEPYDGLFVSNGPGDPTKVPITVERIRKAMEGDMPIFGICLGHQLISLAAGAKTSKMKYGNRGENIPCTDVLSGRCYITSQNHGYQVDASTLPIGWKELFRNANDESNEGIYCETKPFFSVQFHPESNPGPRDTEFLFDVFIQNVADSAATGYVGPLQLPGGKKEDNEKRVPRVNVSKVIILGSGGLSIGQAGEFDYSGSQAIKALKEEGIYTIMVNPNIATIATSKGLADKVYFLPVTPDFVRKIIKYEKPDGIYVTFGGQTALNVGIKLKDEFEELGVKVLGTPIETIITTEDRQLFADAMAEIGEKCAESCTATNYDEALAAAKNIGFPVIVRAAYALGGLGSGFAQDENQLKTLCDKAFATSPQVLVEKSMKGWKEIEYEVVRDCRDNCITVCNMERVAHDLKQNFDPLGIHTGDSIVVAPSQTLSDADYNMLRTTAINVIRHLGVVGECNIQYALNPTSQEYCIIEASRMSFICMIVVLINNQLATGYPLAFIAAKLGLGIPLNEIKNSVTKVTSACFEPSLDYVVVKIPRWDLKKFSRVSRLLSSSMKSVGEVMAIGRTFEETFQKAIRSIDDQFLGFAKNALVEDIDEELVNPTDKRVFAISTAFHRGYSVDKVWQMTNIDKWFLNKLHDIFKIEQKLSACNISSLSVDLLRRSKQYGFSDRQIAACISSTELAVRRVRQENGIAPFVKQIDTVAAEFPAFTNYLYTTYNAVEHDIKFEDRGIMVLGSGVYRIGSSVEFDWCAVRAIRTLRDQGIPTVMVNYNPETVSTDYDEADRLYFENISLETILDIYEIEHSRGVILSMGGQTPNNIALPLHRQNVKIYGTSPEMIDTAENRYKFSRLLDEIGVDQPQWKELSSFEAAVAFCDSVGYPVLVRPSYVLSGAAMNVVSTKDDLANYLTQAAEVSREHPVVISKYIEQAKEIEMDAIAKDGKMVMHYISEHVENAGVHSGDATLIHPPQDLDPQTVRQIEEATAKIGNALNVTGPYNIQFIAKNNEIKVIECNLRAARSFPFVSKVTGIDAIEMATKVMLGLPVEAYPDPGLPSDYVGVKVPQFSFSRLSGADPVLGVEMASTGEVACFGRDKYEAYLKALISTGIHPPKKNILFSVGSYREKLEILPSVQKLSAAGYNIFATSGTADFLTEHNVPCKYLETLGSDGGEQKSEYSLTQHLANNLIDMYINLPSKNHYRRPATYASKGYRTRRMAVDFAIPLITNVKNAKMLAEALIRNLPLDVSNVDAKSSHHTHTFPGLVNVAAFVPQLITPGSKELAAATEASIRSGFTTALISPVGADGSITTRQTLEQVRGEIAGSAHCNIAFSITATPDNVEAIDEEVQAEVKSLFVPASTPVSAVAAHFTSWIVEKPVVTDAKGAELASILLLASLNNCSVHVTNVQSTDDLLLISLSKAKGLKVTCDVSIFSLFFTKDEFDGASILPSAADQKALWDKLDIIDAFSVGPTPYQLAKASSEAGSVFSGTEEALPLLLTAVVEGRLTLNDIRKRLHDNPVSIFGIPDQTQTTVDVVLGRKAPFRKHSEAWSPLELRPVSAFVHRVVVQGQTLFLDGSLVASHQGRDISAFTLPPVIPAKEQEIIAPPVATSTASVTSPVPSTSLQLQQQQHLPPVSTHSLTHLQPHPSFHRRHILSVKQFTQRDLYDLFALAHEMQLQVERNGTLDILKGKVLCTAFYEPSTRTSSSFDAAMKRCGGQVVQITAETSSIQKGETLADTVRTLACYGDAIVLRHPDVGSAQMAAKFSPVPIINAGDGIGEHPTQALLDVYTIRSELGTVNGRTITLLGDLKNGRTVHSLVTLLCHYSVRLNFVSPPSLAMPSSVVSAARKAGIPVTICETLDEVLSDTDVLYVTRVQKERFESETEWLQVKDAYRVDHAVLSRAKEDMIVMHPLPRVNEIDPEVDFDSRRAVYFRQMRYGLFIRMALLASVLA

SEQ ID NO: 61215 - protein, 232 aa, Candidatus Blochmannia floridanus
MHIIKTVLIRHGESQWNKDNRFTGWIDVDLSNQGYSEAKRAGQLLKKYKFIFDYGYTSVLKRTIHTLWVILDQLNQTWLPIQKVWQLNERHYGALQGLNKNEAIKTYGYDTIQKWRRSFKDIPPKNNKNDLFLGTNDIRYKNIETNTLPNGESLELTANRVIPYWQKYIEPKIYNNNCIIIVAHGNSIRAILKFLNQLDDSEIFNIEIPTGIPLIYEFDNNIKPIRYYYLSE

SEQ ID NO: 61216 - protein, 216 aa, Triticum aestivum
  misc_feature (113)..(113): Xaa can be any naturally occurring amino acid
SEENEAAIFVDAPLRGKYCVCFDPLDGSSNIDCGVSIGTIFGIYMIKDKDNATLEDVLQPGTDMIAAGYCMYGSSCTLVLSTGNGVNGFTLDPSLGEFILTHPNIKIPNKGKXYSVNEGNARNWDAPTAKYAERCKFPQDGSSPKSLRYIGSMVADVHRTLLYGGIFLYPADKKSPSGKALEIVPSEIHQRSPIFLGSYDDVEEIKSLYASESSTA

SEQ ID NO: 61217 - protein, 167 aa, Coprinopsis cinerea okayama7#130
MGLSLDLGTPVNTALMLYILYSVQRIIFPPISKPTSIPTEFKAGYSWMPKSHPPTVLFKTFTPKTLEPFNGKDGGRILLAINGIVFDVTAGRNFYGPNGMYGNFAGRDASRGMAKQSFDLEMLTPVDQPLDKLEDLKPDEIENMKGWIEHFSNKYIICGKLVENDAI

SEQ ID NO: 61218 - protein, 230 aa, Glycine max
FGSSPNLVTLIGYHACETEMFLIYNFLSGGNLEKFIQERSTRDVEWKILHKIALDIARALAYLHDTCVPRVLHRDVKPSNILLDDDFNAYLSDFGLARLLGTSETHATTGVAGTFGYVAPEYAMTCRVSDKADVYSYGVVLLELLSDKKALDPSFSSYRNGFNIVAWACMLLKQGRAKEFFTAGLWEAGPGDDLVEVLHLAVVCTVDILSTRPTMKQVVRRLKQLQPLTC

SEQ ID NO: 61219 - protein, 520 aa, Zea mays
  misc_feature (195)..(195): Xaa can be any naturally occurring amino acid
METANVVILSFFFIFAIHRLFNRLHSRSTKMKPLPPGPLAIPVLGHLYLLLEKNIHHMFTRLAARYGPVLYLRLGSRNAVIVSSVDCARECFTEHDVTFANRPTFPTLHLMTYGGTTVGTCAYGPYWRHIRRVITVHLLSALRVRSMVPAIEAEVRAMARSMYRAAVTAPGGAGAAKVELGGMLFELGLSALMEXTVAKTKTSRSSMGGAADTGLSPEGREFKESMDVMMPLLGTANMWDFLPVLQRFDVFGVKNKMAAAVSGRDAFFRRLIDEERRRLDDGVESENKSMMAVLLTLQKSEPENYSDDMIMSLCFSMFSAGTETTATTAEWAMSLLLNNPDVLKKAQGEIDAHVGNSRLLGADDMPHLPYLQCVLTETLRLYPVFPMLIAHESTADCKVGGHHVPSGTMLLTNAYAIHRDPAAWTEPDAFRPERFEDGSAEGKLLIPFGMGRRKCPGETMALRTLGLVLGTLIQCFDWATVGGVPKVDMTEASGLTLPRAVPLEAMCKPRQAMLDVLQKL

SEQ ID NO: 61220 - protein, 91 aa, Phaseolus vulgaris
  misc_feature (44)..(44): Xaa can be any naturally occurring amino acid
MGAFAEKQEALVNSSFEAFKANIHQYNVVFYTSILEKAAAAKDXFSFLANGVDPSNPKLTGHAEKLFGLLRVSASQLKANGTVVANAALGP

SEQ ID NO: 61221 - protein, 273 aa, Anabaena sp.
MRYRALIVAILAVCLGLLTACSERSASSTRDILTYEQIRGTGLANKCPQLTETSRGSIPLDSSKSYVLKELCLEPTNFFVKEEPANKRQTAEFVAGKLLTRYTSTIDQVSGDLKFNDDSSLTFVEKDGLDFQAITVQLPGGERVPFLFTIKNLVAQTQPGLSSLNTSTDFEGTFKVPSYRGSAFLDPKGRGVVSGYDNAVALPAQADDEDLTRTNVKRAEILNGKISLQIAKVDSSSGEIAGTFESEQPSDTDLGADEPKEVKIRGIFYARVE

SEQ ID NO: 61222 - protein, 202 aa, Hyacinthus orientalis
VSDRGLFGFGGKKEEEKSQEEVLVTGVEKLHVEEKKEEEKELRRSHSSSSSSSSDEEVVGPDGEKMKKKKWLKEEIKEKLAGGLQETATVVTQDVVVVAEAEDTAVVVDKVDETVAVEAAPGGEKKGFLEKIKEKLPGGHKKEAADSGGEAVKEAAPPHPHHEAAGEGHDVKEKKGFLGKMMDKLPGHHKEEADKSSPTAGH

SEQ ID NO: 61223 - protein, 155 aa, Parasponia andersonii
VNKVFTEEQEALVVKAWAVMKKNSAELGLQFLKIFEIAPSAKNLFSYLKDSPVPLEQNPKLKPHATTFVMTTESAVQLRKAGKVTVKESDLKRIGAIHFKTGVVNEHFEVTRFALLETIKEAVPEMWSPEMKNAWGVAYDQLVAAIKFEMKPSST

SEQ ID NO: 61224 - protein, 455 aa, Cryptococcus neoformans var. neoformans JEC21
MPPNASKTVFVANIPYDVSEEQLANVFSEAGPVANVEIKFDANTGRSKGYAFVQFYDEATALSAVRNLQDAPVNGRNLRVELSTDEPGPRRRGPGPGAVGVGAAPGAGGPGVGGPSASLGGPRPMVPAPGPGGAPPFTSTGAGAPGYPPRAPFDPRYPQAHSQSHENTPPPAGVGARRQGGDDIDLRMAPQGIDLLPGQKAVDTISKTLAGIAPGQMGDVMTSMKSLIQTNPDQARQLLSQQPQLAYALFQAMLLLNLVDPSVLSSIQPLAASASAAASGGAASVAPGPGGAGARAPNYPPYPPPTQTQGPPGGQQAFRPPPQALYGGAPPLPNQNQNQNQNQNPPYPPYPSGPGVPGGVSGAGAGIPPPTSTPVPPTPHPAHAVPVGPPGGPAPPAPGLASLPPAAQAALSTLPPDQQQMLLQVLQLSPAQIAALDPTQKASVMQLRQQFLGTA

SEQ ID NO: 61225 - protein, 148 aa, Hyacinthus orientalis
AGGSCCCLLKSLISLFLAGISGAPQDNNIMLWNAVIFGPDDTPWDGGTFKLTLQFTEDYPNKPPTVRFVSRMFHPNIYADGSICLDILQNQWSPIYDVAAILTSIQSLLCDPNPNSPANSEAARMFSENKREYNRRVREIVEQSWTAD

SEQ ID NO: 61226 - protein, 377 aa, Oryza sativa (japonica cultivar-group)
MPKKGTKSRKGTDDEPKQEEKNKLPEHLEVQRTRVVCKGDAPTEGFQYAGAFAAMGIDNSVSADKFCKNFKVVVNRLTEDDMEFDMIGIDASMANAFRRILIAEVPTMAIEKVLMADNTSVIADEVLSHRLGLIPLDADPRLFEYISENDVPTERNTIVYKLHVSCKKGSPRLTVKSGDLEWLPEGSQLPLASPAQSGDKQKTYTSFSQSQKDILEKPLGVKFKDITIARLGPGQAIELEVHAVKGIGKVHAKWSPVATAWYRMLPEVVLREEIKDADAEMLVAKCPVNVFDIEDLGNGEKRAVVARPRACTLCRQCVMGPTGEVMGPTVEQVELRRVRDHFIFTIESTGALPPEMLFTEAVRILEEKCERVISELS

SEQ ID NO: 61227 - protein, 803 aa, Magnaporthe grisea
MAHCQDRGSNSRRGSLAHGTFEDEELSLSLTAIDPRNTAATTTRTTPTQHRRDDSNGRPRPKHSHSHSRRHSQHAQHQNQHQNQDQNQQSPPSAMPPTVHRGGGGGGPNAMPADGSTSSKIRVDQRISAYEISKTLGEGSFGKVKLAVHKGTKQMVALKIISRKRLASTDMAGRVEREIEYLQLLRHPHIIKLYTVIKTDNEIIMVLEYAGGELFDHIVTNGRLSEDEARRFFQQMLCAVEYCHRHKIVHRDLKPENLLLDDNLNVKIADFGLSNIMTDGNFLKTSCGSPNYAAPEVISGKLYAGSEVDVWSCGVILYVLLVGRLPFDDDHIPTLFSKIARGTYVVPHWMSPGAAALIKKMLVVNPVNRATITEIRQDPWFTTELPEYLQPPIEPFFNTGIDPEKAIRPSDIAPNAPPKVQEKLHAEVTDKISKTMGYGKQDVLDALEAEEPSAIKDAYMIVRENKMMQSNPALGGDNPFFATTPLGDENGSTGIMETMDSAMSASGHDPNASPMTSMSVRSATSSTLSAALAYQRPYTSKIGILPSSLPAYHNAYMESEKSGTAQDVPDMMALNEPPAPARTPAEQEETARRLRPHARSSQSAADSKPQSLTPSNAPKKTKPTRWQFGIRSRNAPFEALLCIYKALKKLDCSWKIDRDYHKVHGDENEKHRSRGDAGTPYILPADPWHIEARWETGPLRTHSVMTDPKNSAAFPGGKVRVQKKHSNNSSEDDDEEANATYEVIAMRLSIQIYEMESGVYLVDFKCAGYELPDGRLMEEKDVTSPFPFLDLAARLIIQLADAD

SEQ ID NO: 61228 - protein, 567 aa, Oryza sativa (japonica cultivar-group)
MAAAAVAANGGGDGAQASNAPAPTRLASVYSEVQTSRLKHALPLPSVLRSPFALADGPASSAAGNPGEIAKLFPNLFGQPSVSLVPSPEPASTRPLKVGVVLSGGQAPGGHNVICGIFDYLQEYAKGSVMYGFKGGPAGVMKCKYVELTADYVYPYRNQGGFDMICSGRDKIETPEQFKQAEDTVNKLDLDGLVVIGGDDSNTNACLLAEYFRGKNMKTRVIGCPKTIDGDLKCKEVPTSFGFDTACKIYSEMIGNVMTDARSTGKYYHFVRLMGRAASHITLECALQTHPNVALIGEEVAAKKETLKSVTDYITDIVCKRAELGYNYGVILIPEGLIDFIPEVQKLIAELNEILAHDVVDEAGAWKSKLQPESRQLFDFLPKTIQEQLLLERDPHGNVQVAKIETEKMLIAMVETELEKRKAEGKYPAHFRGQSHFFGYEGRCGLPTIFDSNYCYALGYGSGALLQCGKTGLITSVGNLAAPVEEWTVGGTALTSLMDVERRHGKYKPVIKKAMVELDGAPFKKFASLRDEWSLKNHYISPGPIQFSGPGSNDANHTLMLELGAEA

SEQ ID NO: 61229 - protein, 258 aa, Oryza sativa (japonica cultivar-group)
MAAIRRFRPALLLAAILLLAAGAVEGKKGGKVDVALYYESLCPYSAMFVVGSLAKVFRDGLLDAVDLSLVPYGNARVKDGKISCQVEHGSEECFLNTVEACAIDAWPDLRVHFRFIYCVEDLVVNHKQREWESCFGKLNLDPKPVTDCYKGERGHQLSLKYGRQTDALQPPHKYVPWVVVDGQPLYEDYENFEAYICKAYKGHPPKVCEGLARPPTPTVLEVAEAVNRVSYYDSGDIRLKPDEDGHAKIKKVVPDDDD

SEQ ID NO: 61230 - protein, 586 aa, Oryza sativa (japonica cultivar-group)
MSPSIRMAPAPSSSLATAGHGKTKSGRSSSSAVRPALLAIAVSVMVVLLMAVLFGARWTPSGGHGGGADTSWVSAGARVVLNAVSSQQGADPVVKVAQPHDRLLGGLLSPDFNDTSCLSRYRASLYRRRSLHVLSSHLVSALRRYESLHRLCGPGTSAYERAVARLRSPSSSNTTSDAPSECRYLVWTPHAGLGNRMLSITSAFLYALLTGRVLLFHRSGDDMKDLFCEPFPGATWVLPEKDFPIRGMERFGIRTRESLGNALGRGEGGRDPPPPWMYVHLRHDYTRPGASDRLFFCDDGQDALRRVGWVVLLSDNYFVPGLFLIPRYERELSRMFPRRDAVFHHLGRYLFHPSNTVWGMVMRYHGSYLAKAEERVGVQVRTFSWAPISTDELYGQIVSCAQGENILPRVRESSSGSDNATAIPGSGRQQQQRPARRKAVLVVSLHGEYYERIRDMYYEHGAAGGDAVSVFQPTHLGGQRSEERMHNQKALAEMMLLSFSDVALTSAASTFGYVSHGLAGLRPWVLMVPVRKKAPNPPCRLAATVEPCFHTPPHYDCQARTKGDNGKTVRHVRHCEDLKDGVQLVD

SEQ ID NO: 61231 - protein, 328 aa, Magnetococcus sp. MC-1
MSQPKPMNTIAVMTSGGDAPGMNSAIRAVVRTAIGAEMEVLGIRRGYSGLLEGDLIPMDAASVGNILQKGGTVLGTSRCAEFLKPEIRQEAANILRRKHVDGLVVIGGNGSFNGAYQLHQEHDIPVVGVPGTIDNDIQGTHYTIGFDTAVETGVYAVDKIRDTANAHDRIFLVEVMGRHSPAIAIHTGVCTGAEHVIHTPENTDYDTLVSGIRRGRKRGKNSFIIIVAEGQVPGSAYQVQKHLADNYQIASHVAILGHLQRGGSPTAHDRFIAASMGFHAVQALKTGEVATVTACRDGRIQLVPLQECLEKNDAIDAFSLNLTQQLAI

SEQ ID NO: 61232 - protein, 116 aa, Vibrio parahaemolyticus RIMD 2210633
MAEETIFSKIIRKEIPADILYQDDLVTAFRDINPRAPSHILIIPNKLIPTTNDVEAEDEAMMGRLFTVAKKLAKEEGIAEDGYRLILNCNPHGGQEVYHIHMHLLGGRPLGPMVLS

SEQ ID NO: 61233 - protein, 489 aa, Synechocystis sp. PCC 6803
MKSPQAQQILDQARRLLYEKAMVKINGQYVGTVAAIPQSDHHDLNYTEVFIRDNVPVMIFLLLQNETEIVQNFLEICLTLQSKGFPTYGIFPTSFVETENHELKADYGQRAIGRVCSVDASLWWPILAYYYVQRTGNEAWARQTHVQLGLQKFLNLILHPVFRDAPTLFVPDGAFMIDRPMDVWGAPLEIQTLLYGALKSAAGLLLIDLKAKGYCSNKDHPFDSFTMEQSHQFNLSVDWLKKLRTYLLKHYWINCNIVQALRRRPTEQYGEEASNEHNVHTETIPNWLQDWLGDRGGYLIGNIRTGRPDFRFFSLGNCLGAIFDVTSLAQQRSFFRLVLNNQRELCAQMPLRICHPPLKDDDWRSKTGFDRKNLPWCYHNAGHWPCLFWFLVVAVLRHSCHSNYGTVEYAEMGNLIRNNYEVLLRRLPKHKWAEYFDGPTGFWVGQQSRSYQTWTIVGLLLVHHFTEVNPDDALMFDLPSLKSLHQALH

SEQ ID NO: 61234 - protein, 509 aa, Mycoplasma mycoides subsp. mycoides SC str. PG1
MSKKFYITTPIYYPSGNLHLGHAYTTTLADILNRYKKEQGYETFFLTGSDEHGQKIENKAKEANLTPLEYLNPKVQAFKDLWTKLNIDYDKFIRTTDDYHEKTVQKIFTILLEKGYIYKGQYEGIYCVSCEEFLTNEQIDENGLCKISNTKPQLVNENTYFLKVSQFQEFVQNILKSEFLIPEYRRNEMLKNFVEPGLKDLSITRVNFKWGIPITQDQKHIIYVWLDALSNYITALGYLQEDDSLFKKFWQNDDCEILQLAGKEIIRFHSIYWPVMLETLNLKQPTHLLGHGWILNKNTKMSKSLGNIIDPVKIIELYSADALRFYIANDLPTEKDGNFSLELFIESFNAHLANNVGNLISRTHNMISKYFNGYIDLNNIKYDQELIDLGIKTIDNYIFNMDQYKISEAIKVVLELSNACNKYIEIKTPWNLEKENRIEELKTVLATLQRNIAIISYLLKPVLVNSYTDMIEQSGLENVQINFSDLKTFSNIKFNKLNNKKVIFNRIKE

SEQ ID NO: 61235 - protein, 76 aa, Zea mays
  misc_feature (37)..(37): Xaa can be any naturally occurring amino acid
  misc_feature (52)..(52): Xaa can be any naturally occurring amino acid
MACSNCECHRRFDLIVVGAGMMGSCAVYSTSSRGSRXLVLVRFYLLHHRGFXHGESRTMRATYPEAHYPHMVRLSW

SEQ ID NO: 61236 - protein, 530 aa, Coprinopsis cinerea okayama7#130
MAEEIAKPTNRYAILLAIFIAFGGFLFGYDIGVISGCLIMPDFIRRFGEQADDGTYFLSSSRTSIITSLLSAGTFVGAIAQAFTSDRFGRRASILSWSGIFTIGVIIQTATEYSVAQITIGRFVAGLGVGALSGIVPLYTGETAPKALRGTLLVLYQLQIIFGLFLSYVFDLATHHIPNSASWRIPIGLQLAWGLVMLSGIFFLPESPRHLLGTNRREEARKVVALLNGLSDTPEKPSPLVDELLGELEYAIHAENEGGEATWMECFSKRNTLWKRTMNGMMLQFVQQLNGQNFYYYYGDTFFQSAGTRLSPYVIQVILGAVSVVGTVPALRFIETWGRRRLLLTGALLQAGCSIIAGLVGHFTLAPEGTPIEELTKRNIQGGDTLIAFAVLHVFAFAMFWGPTPWVYLGESFPLRVRPKGIALGSATNWFWNFLLSFFAPRIAEKIGPLILLIFCGMLIFGYVYVYLFIPETKGLTLEEVDELYRSNVKPWNSVNWKPHLSEEAHGKVLEKLGKRETEDEQKEKVDGRE

SEQ ID NO: 61237 - protein, 268 aa, Oryza sativa (japonica cultivar-group)
MKSLCPKPGKGGKIHPSPLGGGDGDPVRAALRLLPAAILALATALRPEDQQVLAYLVTRCLQGAGAAHHPEREHPPARGGGGGRRRRGAHPPAIGCGCFDCYTSFWSRWDCSPSRELIHDAIEAFEDHLAAAESSAPPSSSSSKRRDKGKRRPPPPPSPMSPKVTPAQQQPPQPAEKVHDASPPPSSLFPPLPPPPPPAPEATTTFESDDDNDEKVPEDPSAAAAENASEGEEEEEEEEERKRGWADVMGMLNLRLWGIWSPAVESAT

SEQ ID NO: 61238 - protein, 225 aa, Pisum sativum
MANSGGYGDANQRIDYVFKVVLIGDSAVGKSQILARFSRNEFSLDSKSTIGVEFQTRTLVIDHKTVKAQIWDTAGQERYRAVTSAYYRGAVGAMLVYDITKRQTFDHIPRWLEELRNHADKNIVIILVGNKSDLENQRDVPTEDAKEFAEKEGLFFLETSALQATNVEASFMTVLTEIYNILNKKNLAADESQGNGNSASLLGQKIVIPGPGQEVPAKSSMCCQS

SEQ ID NO: 61239 - protein, 495 aa, Oryza sativa (indica cultivar-group)
MGPPQQARGGGIDIEACARPIAVDHRIKLPYYFRIAGNLLRQAKIYRDENNLVDLYVILLRYSRWKLIEVLSELESLKPVVQRQITEHNRARGGAIESNSINGTIAVNNITKQHMTNPYTYQPFVGSNNGSFQRPVPGGNHQMAPLMSAQPDRPTRKQLANLPFPKEETLARHSILGPNGLHGQWTGPVTAIKVQYPSNLDLIKSDVSSLFPSVLNQDGQNGPSTISTDSTQIENDDMKSVLSLDDGRWSKLAEECASVPSVSLEEELSQLSIKQPSPPPVLAELERRPIAPSEVADPTPGLAVSETGRYQNLHVPVKLMECFLRVAEANTKRSLETCGVLAGTLKKRTFYVTALIIPKQKSTSDSCEATNEDELFDVQDKGSLFTLGWIHTHPTQSCFLSSIDLHNHYSYQNIIAYPDMVMLPEAIAIVMAPTDTRRKHGIFHLSDPGGMGVIHDCPERGFHPHKAPLDGSPIYEHCSHVYMNPDVKFDVIDLR

SEQ ID NO: 61240 - protein, 679 aa, Arabidopsis thaliana
MATAFAPTKLTATVPLHGSHENRLLLPIRLAPPSSFLGSTRSLSLRRLNHSNATRRSPVVSVQEVVKEKQSTNNTSLLITKEEGLELYEDMILGRSFEDMCAQMYYRGKMFGFVHLYNGQEAVSTGFIKLLTKSDSVVSTYRDHVHALSKGVSARAVMSELFGKVTGCCRGQGGSMHMFSKEHNMLGGFAFIGEGIPVATGAAFSSKYRREVLKQDCDDVTVAFFGDGTCNNGQFFECLNMAALYKLPIIFVVENNLWAIGMSHLRATSDPEIWKKGPAFGMPGVHVDGMDVLKVREVAKEAVTRARRGEGPTLVECETYRFRGHSLADPDELRDAAEKAKYAARDPIAALKKYLIENKLAKEAELKSIEKKIDELVEEAVEFADASPQPGRSQLLENVFADPKGFGIGPDGRYRSQPLQIKVSSSELSVLDEEKEEEVVKGEAEPNKDSVVSKAEPVKKPRPCELYVCNIPRSYDIAQLLDMFQPFGTVISVEVVSRNPQTGESRGSGYVTMGSINSAKIAIASLDGTVRARETKKQEVGGREMRVRYSVDMNPGTRRNPEVLNSTPKKILMYESQHKVYVGNLPWFTQPDGLRNHFSKFGTIVSTRVLHDRKTGRNRVFAFLSFTSGEERDAALSFNGTVNNMKVAESSSEKVSRRVSRKPTVLLLLQRHLLDTNNV

SEQ ID NO: 61241 - protein, 537 aa, Cucumis melo
MSSIVIPSLQPHLRFPSSQETPQRSRSRVGFVSIRPIYATDGVSSSSSSSLQVPQRIVSPPEPTKLPLRKVPGDYGPPMFGALKDRHDYFYNQGREEYLKSRMLRYESTVYRTNMPPGPFITSDSRVVVLLDGKSFPVLFDHSKVEKKDLFTGTYMPVTELTGGYRVLSYIDPSEPDHAKLKQLIFFLLKHRRDKIMPEFHSTFSELFETLEKDLAAAGRAEYNASGEQAAFNFLARSLFGADPVDSKLGRDAPKLIAKWVLFQLGPVLSLGLPKVVEELLLRTVRLPPALIKADYRRLYDFFYKSSEAVFEEADRLGISREEACHNLLFTTCFNSFGGMKIFFPNMIKWIGRAGVNLHTRLAREIRTAVKANGGKITMGAMEQMPLMKSVVYEALRIEPPVPVQYGRAKKDLVVESHDAAFEIKEGEVICGYQPFATRDPKIFDRADELVPDRFTGEGEELLKHVIWSNGPETQSPSVQNKQCAGKDFIVFISRLLVVELFLRYDSFDIEASNTPLGAAVTVSAAVTVTSLKKASF

SEQ ID NO: 61242 - protein, 429 aa, Vibrio parahaemolyticus RIMD 2210633
MTRIIVVGGGAGGLELATKLGRTLGRKNRAQITLVDRKASHLWKPLLHEVATGSLDEGVDALSYRAHAKNHSFDFQMGSLQDIDRERKVIILSELKDEHGELLMPSRELEYDLLVMAIGSTSNDFNTPGVRENCIFLDSPEQAHRFRTEMNNEFLKLHAKNGNGTVDIAIVGAGATGVELSAELHNAVKELRTYGFGDLDSSKLNVNLIEAGERILPALPPRISSAAHQELVKLGVNVRTATMVTKAEKDGLTTKDGEKIPAQIMVWAAGIKAPDFIKDIAGLETNRINQLVVKGTLQTTRDDDIFVIGDLAQCTQPDGSFVPPRAQAAHQMASQAFSNIVAKLNGRELKNYVYKDHGSLVSLSRFSTVGSLMGNLTKGSMMVEGRIARVVYISLYRMHLMALHGVFKTGLMMLVGRINRVLRPNLKLH

SEQ ID NO: 61243 - protein, 496 aa, Oryza sativa (indica cultivar-group)
MAVQICNGKLQQKIDASSGLVVLTIQARTPSLMPPGCAKVAGAACEPVSGPKKAMLFAGLYVTALGIGGIKGSLPSHGAEQFDEHAPRGRKGRSTFFNYFVFCLSVGALIAVTFAVWVEDNKGWQWGFGISTIAILLSIPVFVAGSRLYRNKVPTGSPLTTIAKVVLAAALARRGGAQSASNGAVIDRAPSPTGSTDMKEYCKPGDICGATDSVAEAAAEPSQELVFLNRAVQRQPRCGALSCTVQEVEDVKVVLMVLPIFFSTIMLNSCLAQLSTFSVEQAATMDTRVGGLKVPPASLPVFPVTFIILLAPVYDHIIIPFARRATGTEMGITHLQRIGTGLVLSIVAMAVAAVVEVKRKNVASNAGMLDAAAPLPITFFWIAFQYLFLGSADLFTLAGLLEFFFSEAPARMRSLATSLSWASLALGYYLSSVLVTVVNSATGRGGRRAWLQGGNLNHYHLERFYWVMCVLSTLNYLFFLFWAIRYKYRNAGVIKG

SEQ ID NO: 61244 - protein, 367 aa, Zea mays
  misc_feature (280)..(280): Xaa can be any naturally occurring amino acid
MADAARGLGSSSLPVANVQALAESCNDNGADAPVPGRYLIKDPSAEEVVAAGDSACTIPVIDFRKLLDPGSYEEECARLGAACHHWGFFQLINHGVPAEVTGNLMKDVAGFFRQPLEAKKECAQQAGSIEGYGQAFVVSEDQKLDWADMLFLIVRPREARDMRFWPTRPESFRDSVDAYSLEASKLAYRLLEFMARGVGADPASLQGMFQGQVQGMRVNYYPPCRQAADQVLGLSPHSDPNGLTLLLQMSHDVHGLQVSKDGRWFPVQALPGAFVVNDSXVGDALEIVSNGAFRSVEHRAVIHPTKERISAALFHFPDQDRMLGPLPELVKEGDTVRYATTTYQEFMKRFFAAKLDGKKLIERFKLQ

SEQ ID NO: 61245 - protein, 79 aa, Arabidopsis thaliana
  misc_feature (46)..(47): Xaa can be any naturally occurring amino acid
  misc_feature (51)..(51): Xaa can be any naturally occurring amino acid
  misc_feature (58)..(60): Xaa can be any naturally occurring amino acid
  misc_feature (73)..(73): Xaa can be any naturally occurring amino acid
MASFMFLSTAVVTYPAQAGGVTPYTGLKSYSTFPDTRIANIYITKXXSNGXRVSCINXXXPILKNNYDTLSDXLDLTDL

SEQ ID NO: 61246 - protein, 843 aa, Synechocystis sp. PCC 6803
MRAVLMAGGAGTRLRPLTCDLPKPMVPIVNQPIAAHIIHLLRRHNITEVVATLHYLPDAMRDYFLDGSEFGVQMTYAVEDEHPLGTAGCVKNIEELLDDTFLVISGDSITDFNLTQAIAFHKQKQAKATLILTKVPNPLEFGVVITDENQRVQRFLEKPSTSEVFSDTVNTGTYILEPEVLAYLPPKEEMDFSKDLFPLLLENDEPMYGFVADGYWCDVGNLDAYREAQYDALEKKVTLELGNLPRHSDIWIGENTTIDPTAILTPPLAIGDNCNIGSGTKLEAGTIIGDNVTIGAGAELKRAIVWNGVLIGDEAYLAACVVGRGCRIERRVQVLEGAVIGPLSIIGEEAQINSNVKVWPSKRVEPGAILNINLIWGSTGHRNLFGQRGVSGIVNIDMTPEFAVKLGAAYGSSLRPGAEIVVSRDQRNVSRMVTRSLIAGLMSVGVNIQNLEATAIPIARTMTPKLKVAGGIHVRIHPDRPDYLLIEFLDSQGINISKKTEKKIEGAYFKEDLRRVSIPQIGDMSYPAQVLETYCHTFEKLLDMDIINNDGAKIVIDYAYGVSGAILPLLLTKFGCDAVVLNASLRQTAVSNEEKEVLLSQLGQVVSALQANLGVQVSANGEQLTLVDEGGLPIRGELLTALMVHMVLTASPRGTIVVPVQASSAVEHLARRHGGKVLRTKANPTALMAAAQSSHNVVLGGSGETGFIFPRLHPGFDAMFCIAKVMEMLTVQKRTLGEIRSELPTVYHNSCSVRCSWKIKGALMRHLVEIHRDQHIELVDGVKMTFPHGDNWVLILPDAGEPLVHIYANSEDRHWVDEKLRYYQAQVLNFISDAQEESYQHFS

SEQ ID NO: 61247 - protein, 191 aa, Pneumocystis carinii
MQTIKCVVVGDGAVGKTCLLISYTTNKFPSEYVPTVFDNYAVTVMIGEEPYTLGLFDTAGQEDYDRLRPLSYPQTDVFLICFSVTSPASFENVREKWHPEVRHHCPGTPCLIVGTQIDLRDDPMIVEKLSRQRQTPITKELGEKLSKELGAVKYVECSALTQKGLKNVFDEAIVCALEPPVTKKKTKCLIL

SEQ ID NO: 61248 - protein, 290 aa, Synechocystis sp. PCC 6803
MPSITGKTKLLGVIGYPVGHSLSPVMHNAALQAMASDYAYVAFPIAPEDLTIAIAGLGASGVQGLSVTIPHKQVVMPLLTQITETARQVGAVNTLWRDGHGWQGTNTDVEGFLAPLLELKQDWSGRTAVILGYGGAARAVVVGLTQLGCPEIIVVGRSQEKLAQFANSWTDPKIKQALQVLPWEALSTVIPKASLLINSTPVGMAPHPKQSPLDQSLVEKLPPTAIAYDLIYTPRPTRFLQHAQERGLVTIDGAEMLVQQGAAALKIWLQQEVPVDVMRQALLHHLEKSA

SEQ ID NO: 61249 - protein, 499 aa, Aspergillus nidulans FGSC A4
MAQQYKLPFELDNPDLLHFDSYVGNAWVTAKSGARFEVVDPGTDLPWASCPTNSAEDVDSAVQIAHDAFEKFKKVNPRQRAQWLLKWDSLIREARSDLAKILTHETGKPIAESYGEIDYATGFTWWFAGEAERIQGSIAVPAAPNRRVFTVKQPIGVAAALVPWNFPIAMVLRKAGAALAAGCTMIVKPSPETPLTALVLAHLAEKAGFPAGVFNVLTTDLENTPPLSEALCKHPLVKKVTFTGSTRVGKLIASHCAHGLKKVTLELGGNCPFLVFDDADLDQALDQLMALKWRHAGQACITANRIYVQAGIYDKFAQLLKERTAKLVIGHGAKEGTTLGPLTTPRSIDKAISQVEDARRLGADVILGGSRVQGTQGYFFEPTILKNMTKDMLVSREESFAPIAALYRFETEEEAVKLANDTSMGLASYAFSKNIDRMWRLLENLEAGMIGMNTGNSSAAESPFGGIKESGYGKESGKEVAVNEYLITKTGTLTIDGQY

SEQ ID NO: 61250 - protein, 1012 aa, Desulfovibrio gigas
MLIKRRAFLKLTAAGATLSAFGGLGVDLAPAKAQAATMALKTVDAKQTTSVCCYCSVGCGLIVHTDKKTNRAINVEGDPDHPINEGSLCAKGASTWQLAENERRPANPLYRAPGSDQWEEKSWDWMLDTIAERVAKTREATFVTKNAKGQVVNRCDGIASVGSAAMDNEECWIYQAWLRSLGLFYIEHQARICHSATVAALAESYGRGAMTNHWIDLKNSDVILMMGSNPAENHPISFKWVMRAKDKGATLIHVDPRYTRTSTKCDLYAPLRSGSDIAFLNGMTKYILEKELYFKDYVVNYTNASFIVGEGFAFEEGLFAGYNKETRKYDKSKWGFERDENGNPKRDETLKHPRCVFQIMKKHYERYDLDKISAICGTPKELILKVYDAYCATGKPDKAGTIMYAMGWTQHTVGVQNIRAMSINQLLLGNIGVAGGGVNALRGEANVQGSTDHGLLMHIYPGYLGTARASIPTYEEYTKKFTPVSKDPQSANWWSNFPKYSASYIKSMWPDADLNEAYGYLPKGEDGKDYSWLTLFDDMFQGKIKGFFAWGQNPACSGANSNKTREALTKLDWMVNVNIFDNETGSFWRGPDMDPKKIKTEVFFLPCAVAIEKEGSISNSGRWMQWRYVGPEPRKNAIPDGDLIVELAKRVQKLLAKTPGKLAAPVTKLKTDYWVNDHGHFDPHKIAKLINGFALKDFKVGDVEYKAGQQIATFGHLQADGSTTSGCWIYTGSYTEKGNMAARRDKTQTDMQAKIGLYPGWTWAWPVNRRIIYNRASVDLNGKPYAPEKAVVEWNAAEKKWVGDVPDGPWPPQADKEKGKRAFIMKPEGYAYLYGPGREDGPLPEYYEPMECPVIEHPFSKTLHNPTALHFATEEKAVCDPRYPFICSTYRVTEHWQTGLMTRNTPWLLEAEPQMFCEMSEELATLRGIKNGDKVILESVRGKLWAKAIITKRIKPFAIQGQQVHMVGIPWHYGWSFPKNGGDAANILTPSVGDPNTGIPETKAFMVNVTKA

SEQ ID NO: 61251 - protein, 224 aa, Solanum habrochaites
FLMQKELDYLVGAVSNPQKPFAAIVGGSKVSSKIGVIESLLEKVDVLLLGGGMIFTFYKAQGYAVGSSLVEEDKLELATSLMEKAKTKGVSLLLPTDVVIADKFAADANSKIVPASEIPDGWMGLDIGPDAIKSFGSALDTTKTIIWNGPMGVFEFDKFAAGTEAIAKKLAELSGKGVTTIIGGGDSVAAVEKVGLAEKMSHISTGGGASLELLEGKQLPGVLA

SEQ ID NO: 61252 - protein, 111 aa, Candidatus Blochmannia floridanus
MSNNTVEKIKKQIQANPILLYMKGTPDSAKCGFSAKSAQILHLYVKSFYYIDVLIDTDIRSVLPTFSNWPTFPQLWLEGKLIGGCDIIMDMHQNGTLKQAIDPIKLKYNLN

SEQ ID NO: 61253 - protein, 658 aa, Lactobacillus acidophilus NCFM
MADKDTFYITTPIYYPSGRLTIGNAYTTIAADTMARYKRSQGFDTFFLTGTDEHGLKIEQKAEAQGIKPKEFVDKMADSYKKLWKSLNISYDKFIRTTDEEHVKAVQKIFEKLLKKGDIYLGEYTGWYSVEDEEYFTESQLAEVYKDDNGNVIGGKAPSGHEVRLVKEPSYFFKMSKYADRLVEYYKEHPDFILPHSREKEMLNNFIKPGLEDLSVTRTTVNWGIPVPSDPKHVVYVWIDALSNYITALGYGSDNDALFKKYWPADVHLVGKEIVRFHTIYWPIMLMALDLPLPKHIIGHGWVLMKNGKMSKSKGNAVYPESLTSRYGVDPLRYYLMRALPFGADGIFTPEDFVERINYDLANDLGNLLNRTVSMINQYQNGQVAPVPVAQDKFGKELQDTAASVIADYREYMDSLHFSQALDSIWKLVARANKYIDETTPWVLNKEGKIEELSHVMSNLAESLRLIAVMIEPVMTETAPKMFEQLGLNWNDEDERKLAFNDFGWNTKVVEKPTPIFPRLKAEEEIKYIKDEMAKAKPKKTTRSEQKKTDEITIDDFDKVKIQVGQILSVEPVKGSSKLLMFKLDFGDGKERQILSGIRKFYPDASELLDKKVLAVTNLKPRKMLGHLSEGMLLSSEKDGEIKLALVEDEHANGAELG

SEQ ID NO: 61254 - protein, 471 aa, Mycoplasma penetrans HF-2
MEYNKKIVTDLTDLKGKKVILRCDFNVPINKTSGEITDYTRIDAALQTINYLLDKGVKLIVLSHLSRVKTLEDISSGKKSLKVVHKALKNRLLGKTVLFEENNRNKDLPKIIDGMEEGSLLLLENTRYADVNEKGEVVKLESKNDPSLGKFWASLADIFVNDAFGTSHRAHASNVGIAKNIKESAIGFLVNKELAKLSKAVVNPRKPVVAIFGGAKVSDKVPSIKNIGKFADKILIGGGMAFIFLKAKGFEIGKSLYEDDQLELTKELLSEFGNKIVLPVDAVVADSIKAAKGKRYDMEQFPADLAGFDVGKKTIKLFKKELKLAETVIWNGPLGVFENDAFNKGTLKVCKYIAKITAKKGCYSVIGGGDSAAAAAKCGVTHSFSHISTGGGASLEFFSGVELPGVACIKNKGEEGKVEAVKEKTTTTTESASKEKSSTAKTASKPATSKTTAAKKPAEKKPAAKKPAAKK

SEQ ID NO: 61255 - protein, 333 aa, Mycoplasma penetrans HF-2
MIKVAINGFGRIGRLALRRIFDVCKNVEIVAINDLTDAKTLCHLLKYDTAHRTFKGKLSYDENNNLIIDGKKIPILAEKDPANLPWAKLGVDIVVESTGRFVDEEGASKHLKAGAKKVIISAPAKGNIPTVVYNVNHQTLKATDKIVSAASCTTNALAPVANVLSKEFGIKWGFMNTIHSYTADQRLQDAPHSDLRRARAAAMSIVPTSTGAAKAIGLVLPELNKKMHGMALRVPTITGSLVDITVELEKDTTVEEIHKAMKKAANETLEYCEDPIVSTDIIGNTHGSIFDPGLSMELETNGKKTFKLFTWYDNEYSYVAQFVRVLEYFGNLK

SEQ ID NO: 61256 - protein, 343 aa, Agrobacterium tumefaciens str. C58
MKAIVAHGAKDVRIEDRPEEKPGPGEVRLRLARGGICGSDLHYYNHGGFGAVRLREPMVLGHEVSAVIEELGEGVEGLKIGGLVAVSPSRPCRTCRFCQEGLHNQCLNMRFYGSAMPFPHIQGAFREILVADALQCVPADGLSAGEAAMAEPLAVTLHATRRAGDLLGKRVLVTGCGPIGILSILAARRAGAAEIVATDLSDFTLGKAREAGADRVINSKDEPDALAAYGANKGTFDILYECSGAAVALAGGITALRPRGIIVQLGLGGDMSLPMMAITAKELDLRGSFRFHEEFATGVELMRKGLIDVKPFITQTVDLADAISAFEFASDRSRAMKVQIAFS

SEQ ID NO: 61257 - protein, 357 aa, Aspergillus nidulans FGSC A4
MAKTYRIATIPADGIGPEVIDAGVIVLKALADKLQSFSLDFTHLDWSSETFKATGKYIPDGGLEVLKKNDAILFGAVGAPDVPDHISLWGLRLAICQPFQQYANVRPTRVLRGTQSPLRKCNTGDLDWVIVRENSEGEYAGQGGRSHRGHPWEVATEVAIFSRQGVERIMRFAFETAAKRPRKLLTVVTKSNAQRNGMVLWDEVANIVAKDFPEVTMDKMLVDAMTTRMVLKPESLDTIVASNLHADILSDLAAALAGSIGIAPTSNLDPTRQNPSMFEPIHGSAFDITGKGIANPVATFWTAAEMLEWLGEKDAADKLMQCVESVCESGILTADLGGTATTKEVTSAVVEEINRLN

SEQ ID NO: 61258 - protein, 298 aa, Agrobacterium tumefaciens str. C58
MTRLASSPPARYVPKTGAPALTSALKRMNVIGNIYLQECNVERLEETVGLNLFDLSGRRALITGSSQGIGFALAQGLSEAGAEVVLNGRDEAKLKAAAAGIKGARTLAFDATDHGAVREAIDRFEAEVGAIDILVNNAGMQHRTPLEDFPADAFERLLQTNIASVFHVGQATARHMISRGRGKIINIASVQTALARPGIAPYTATKGAVGNLTKGMATDWAKYGLQCNAIAPGYFDTPLNAALVADETFSAWLEKRTPAGRWGKVEELVGACIFLSSDASSFVNGHILYVDGGITASL

SEQ ID NO: 61259 - protein, 180 aa, Triticum aestivum
MEDERSTQSYQGGEAAEQVEVTDRGLLGNLLGKKKAEEDKEKKEEELVTGMEKKETLFSKLHRSSSSSSSSSDEEEEEVIDDNGEVIKRKKKKGLKEKLQEKLPGHKDTEGEHVTGLPAPAAPASVQTHHDTDVVVEKIDGDVKTEATPAVPEEEKKGFLEKIKEKLPGGHKKPEDAAAV

SEQ ID NO: 61260 - protein, 142 aa, Oryza sativa
GSRGRDKGDIVDEAITFFRANVFFKNFNVKSPAGKLPIYLTFYINIALKRLEGCRTLAVGTKAIINLGLEKVPVPGEPGFPFPGLFTLPQSQEEAELLRNYLKQIREETSGRLLNCAYRANGTPNKWWLAFAKRKFMNIVIL

SEQ ID NO: 61261 - protein, 606 aa, Arabidopsis thaliana
MAETLEPSLVGEIDTSAPFESVREAATHFGGFGFWKPSSLNISEASQNEVGMVLKASELEKELIEKEGETLKVLKSLESTKAIVEELKSKIQNKEDKENCDMNVFKELNQAKMNLCKTTKDLAAIRVSVGLLNKRLEEERAALEKTRERLNSENAAEMSMEIQRLSYEAKEFSRTGENVRYAVNKAVAEIEQTRNKIEAAEMRLIAARKMKEAARAAEAVAIAEIKAVTRRGRRRRRGGNGEETMQEEILETIDETAREIRSSRRTLEEGLAKMEAEEGNWWWTEQRRISSCSAKFKNPPYMMDVKGLNMMMNGDGTSSSVAVLKPTMSIGQILSRKLLLADESAMMMNGRVSLGQILGKTNFGDREKEKRFNGKRKRFGFANLSVMLNKERIMGLKAGTFVLLLLGLILVSDARSFVDSTISEKVSNKEDVCTLCEEYVTDALSYLEKNVTQAEIIEDLHDRCSQLRGYSQQCISLVDYYVPLFFLQLESFQPHYFCKRMNLCGKVVALVEEARQDSCGVCHRTVSEILIKLQDPDTQLDIVELLIKGCKSLKNYEKKCKTLVFEYGPLILVNAEEFLVKNDVCTLLRACPPEKSVLRQPELADS

SEQ ID NO: 61262 - protein, 318 aa, Hyphomonas neptunium ATCC 15444
MTFDDAFRSFRDKLHLPEMHPPDLRLPIERLRQQFFRMDYSGEPDAPELADVRILTIPGPTGPLKARLYVPLGAGVPPGPGILFFHGGGFVLGDLESHDMICRRMAEGSRCRVLAIDYRLAPETCFPCAHDDALAAWHWISAHGEDVGIDPRRVAVAGDSAGGNLAAFVCQQMNRIKGPRPAFQLLLYPLLQFADIRSKKMSPQESGFFISVGLFEFFRGHYLPDPGTYMDPRISPLFAPAEELKGLPPAHIIVCGWDPLHDEGLAYAAKLRAMGIAVSEKEYPSMVHGFLNLTHISATARLAAREAGKITGEALGAI

SEQ ID NO: 61263 - protein, 384 aa, Xanthomonas axonopodis pv. citri str. 306
MNDTATPGFKPKKSVALSGTAAGNTALCTVGRSGNDLHYRGYDILDLATTSEFEEIAYLLVHGKLPNRGELRGYKAKLRSLRGVPAAVKTALEQLPPSAHPMDVMRTGVSVLGCLQPEKDDHNHPGARDIADKLMASLGSMLLYWYHYSHNGKRIEVETEDDSIGGHFLHLLHGFAPKDSWVRAMHTSLILYAEHEFNASTFASRVIAGTGSDMYSAIAGGIGALRGPKHGGANEVAFEVQKRYDTPDEAEADIKARVERKEVVIGFGHPVYTVSDPRNKVIKVVARELSDEQGSRKMYDIAERLESVMWDIKKMFPNLDWFSAVSYHMMGVPTAMFTPLFVLARTAGWSAHIIEQRVDGKIIRPSANYTGPEDQVFVPLDQRS

SEQ ID NO: 61264 - protein, 957 aa, Bradyrhizobium japonicum USDA 110
MSLIEEIDFGTPRAKSETMVTLTIDGKEISVPEGTSIMRAAMEAGHQIPKLCATDMVDAFGSCRLCLVEIEGRAGTPASCTTPVMPGLVVHTQTDRLKKLRKGVMELYISDHPLDCLTCGANGDCELQDMAGAVGLRDVRYGYEGENHVFAKSNGEVNAAWMPKDESNPYFAYDPSKCIVCSRCVRACEEVQGTFALTISGRGFDSRVSPGMSESFLGSECVSCGACVQACPTATLTEKSVIEIGQPEHSVVTTCAYCGVGCAFKAEMRGEEVVRMVPYKDGKANRGHSCVKGRFAWGYTNHKERILKPMIRERIEDPWREVSWDEAFSFAAARMRGIQKKYGRDAIGGITSSRCTNEETYLVQKLIRAGFGNNNVDTCARVCHSPTGYGLSQTFGTSAGTQDFDSVENTDVAVVIGANPASAHPVFASRLKKRLRQGAKLIVIDPRRTEMVESPHVKALHLPLMPGTNVAVVTALAHVIVTEGLVNEAFVRERCDWTEFEEWAAFVAQPNNSPEATAILTGVDPKALREAARIYATGGNGAIYYGLGVTEHSQGSTTVIAIANLAMATGNIGRPGVGVNPLRGQNNVQGSCDMGSFPHELPGYRHISGNAVRDQFEALWNVKLNPEPGLRIPNMFDAAIEGTFMGIYVQGEDILQSDPNTSHVVAALAAMECVIVHDLFLNETANYAHVFLPGSSFLEKDGTFTNAERRIQRVRKVMTPKNGMADWEVTIGLAKAMGFEMNYSHPSEIMDEIAALTPTFTGVSYAKLDELGSVQWPCNEKAPEGTPVMHIDGFVRGKGKFIVTEYVATDERTGPRFPLLLTTGRILSQYNVGAQTRRTENVVWHAEDRLEIHPHDAEQRGVRDGDWVRLKSRAGETTLRAEITDRVAPGVVYTTFHHPDTQANVITTDYSDWATNCPEYKVTAVQISPSNGPSDWQKSYDAQARHSRRIAPAEAAE

SEQ ID NO: 61265 - protein, 258 aa, Prochlorococcus marinus str. AS9601
MSSQKIFLFDFDGVIVDGMQEYWHSSLLACERYLNSPCISVDQKLYQGVPNSFKEIRPWVKYGWEMILIVHEIINTKNPLTSDNKDDFINNYHQNCQRILNENSWIAEDIQKMLDKSRKYQIDKDFKSWVNLHKPFFEIINFMKELSKRGIKTGVITTKGKIFAEKILIQLNIFPEFIFGYESGTKIKIAEKLTQTYEILGFIEDRKKTLIDIKQNSETSHIPCFLADWGYLKESDKNKLSNEIKLLKLGNLGELVAI

SEQ ID NO: 61266 - protein, 289 aa, Saccharomyces cerevisiae
GAMPPIFLPPPNYLFVRDVWKSNLYSEFAVIRQLVSQYNHVSISTEFVGTLARPIGTFRSKVDYHYQTMRANVDFLNPIQLGLSLSDANGNKPDNGPSTWQFNFEFDPKKEIMSTESLELLRKSGINFEKHENLGIDVFEFSQLLMDSGLMMDDSVTWITYHAAYDLGFLINILMNDSMPNNKEDFEWWVHQYMPNFYDLNLVYKIIQEFKNPQLQQSSQQQQQQQYSLTTLADELGLPRFSIFTTTGGQSLLMLLSFCQLSKLSMHKFPNGTDFAKYQGVIYGIDGDQ

SEQ ID NO: 61267 - protein, 546 aa, Colwellia psychrerythraea 34H
MSSRQTLASWKKLQLLAQDKKSQHMNTLFAQDSERFNKFSIELPNMLLDYSKNLIDTETLDALLALAEETQVCDWRAKMFAGEKINKTEDRAVLHTALRRQSDEAFIIEGENVTEHVKNQLAEMEVFVNKVRQGHWLGYSGKRITDIVNIGVGGSNLGPQMVTEALKHYSDGSVNVHYVSNVDGAQIAEVLRPLEPEKVLFIVSSKTFTTTETMTNARTAINWLTSASFDENSVAKHFVAVTANKENAMSFGIEEQNIFDMWDWVGGRFSLWSAIGLAIALDLGFDKFEELLAGAHDMDQHFINAPLKDNFPAILALISVWNTTFLGSQSQAILPYDQTLHMLTAYLQQAEMESNGKSVSWDGDEIDYATVPSIWGELGINGQHAFYQYLHQSNNVVPADFIGSVKSVTPVKGHHETLMANFFAQTQALMVGVNEEQVRADLKAKGRNAEYIDNVAPHKVHKGNRPTNTILLKCINPRNLGSLIAAYEHKIFVQGIILQICSFDQWGVELGKGLAAEIQTELQTDNISAQHDCSTSSLLKFYQSAK

SEQ ID NO: 61268 - protein, 914 aa, Arabidopsis thaliana
MTNLFLGFLVISFCLLGNLIHAADGSIHDYNNSGGFTKIANARYFVGGSEGIYGSEFLDVHHASSDTPLLKGNSFIRFDDITFVRTKESASKQNSTLAAAGLVEAILFEVKQRDRVGGSFFKSEDMCCTPKLADAGSCNLGEVMISADPNDPEWPKRIPTFFKRGEEEVKMSPEAVIIKKTGLYTVYFMTCDPELDGATIRGRTVWKNRGGYLQGEKAPLKKFYASMLLAYVVLGLVWFPQVAQYWKDGIQLHSHINFVIAFTMGELAFLYLDFVYLDSAGTSPMEVTVWAITLSSMRKALSRLLLLVISSGFGIVRPTLGGITLKMLLIGVLCFVISESLGLAMQFGNISENGMNYLMLSWAILETCFIQWIFRSLSKTLKKLKLNKRNITKLQLYKMFATVLVIMVVLSFAWIYVEVYLYSSLSQFWKVKWIVPTLWYILSYAMLVLICLFWPPSEKPMRYLYVADMEEETEEEDDLSTAETGMNATKAEYERSERKTLLEAFILLLGNIPGEKFFGNCFLYTRLDQEETLSQIIPETMASSTTKILCDAGESDLCRDDSAAFLLKFVAIASILLAGAAGVAIPLIGRNRRFLQTEGNLFVAAKAFAAGVILATGFVHMLAGGTEALSNPCLPDFPWSKFPFPGFFAMVAALATLLVDFMGTQYYERKQERNQAATEAAAGSEEIAVVPVVGERVTDNKVFGEEDGGGIHIVGIRAHAAHHRHSHSNSHGTCDGHAHGHSHGHMHGNSDVENGARHVVVSQILELGIVSHSIIIGLSLGVSQSPCTIRPLIAALSFHQFFEGFALGGCISQAQFRNKSATIMACFFALTTPLGIGIGTAVASSFNSHSPGALVTEGILDSLSAGILVYMALVDLIAADFLSKRMSCNLRLQVVSYVMLFLGAGLMSALAIWA

SEQ ID NO: 61269 - protein, 375 aa, Prunus dulcis
MTFTLRKKEILIDILVRLPAKSLLRFLCTCKSWSDLIGSSSFVSMHLHRNVRKHAHVYLLCLHHPNVRRQVDPDDPYVKQEFQWSLFSNETFEEYFKLSHPLGSPEYFVIYGSSNGLVCISDEILNFDSPIHIWNPSVRKFRTIPMSTNINIKFSYVALQFGFHPRINDYKAVRMMRTNKNALAVEVYSLRTDSWKMIEAIPPWLKCTWQHLKGTFFGGVSYHIIQKGPIFSIVSFDSGSEEFEEFIAPDAICRPFALCIDVYKEQICLLFRFYSCADEDMAKNDLWVLEEKRWKQLCPFIYPLDSYGTIGISIDNELLLERRDFIRGIGDLCLCNYESKQVFETGIELAVTKYGEIEFLFAITYIESLVLLDRY

SEQ ID NO: 61270 - protein, 510 aa, Allium cepa
MPIPVLLLLTIFLALLLYLFFFVAKKHEGKRVPGPKGWPILGNLPQLGAKPHQSLCELSRTYGPLFGLRFGYVDVVVAASADVAEQFLRVHDVNFSNRPPNSGAEHIAYNYQDLVFAPYGPRWRMLRKLCALHLFSPKALEDLSPVRSLEVATLANTLYLRAQSDQPTVNLAQMLTTCTTNALSKAMMGRRVFVNETTDTETSKFKDMVLEIMSLAGVFNVGDFVPWLRPFDLQRVVRKMKDVHARFDSFLDKVIAEHRMVDNAHDLLSLLIRSKDDVDNDGVKLTNTDIKALLLNLFTAGTDTSSSTVEWALSEMIRHPDALKRAQRELDEVVGRDRLVSETDIRSLPYIQAIVKETFRLHPSTPLSLPRISSEACTVNGYLIPKNTTLLVNVWAISRDPGVWKEPLEFRPERFLGGGGYETVDLKGNDFELIPFGAGRRVCAGLSLGLRMVQFLTATLVHGFDWKLVDGQSAEKLDMEEAYGLPLQRAVPLMVRPVPRLDEKAYHVVV

SEQ ID NO: 61271 - protein, 490 aa, Pseudomonas syringae pv. tomato str. DC3000
MARFELQKLYIDGGYVDASNTETFDSINPANGEVLAKIQRASKEDVERAVVAAEKGQKIWAAMTAVERSRILRRAVDILRERNDELAALETLDTGKAISETRYVDIVTGADVLEYYAGLVPAIEGEQIPLRDSSFVYTRREPLGVVAGIGAWNYPIQIALWKSAPALAAGNAMIFKPSEVTSLTTLKLAEIYTEAGVPNGVFNVLTGSGREVGTWITEHPRIEKVSFTGGTDTGKKVMASASSSSLKEVTMELGGKSPLIVFDDADLDRAADIAMMANFYSSGQVCTNGTRVFVPNALKGEFEAKILERVKRIRPGNPEDENINFGPLVSFEHMESVLGYIAKGKEQGARLLCGGDRLTGGVFDKGAFVAATVFTDCTDEMTIVREEIFGPVMSILGYDTEDEVVRRANDTDFGLAAGIVTRDLNRAHRVIHLLEAGICWINAWGESAAQMPVGGYKQSGVGRENGISSLAQYTRIKSVQIELGDYASVF

SEQ ID NO: 61272 - protein, 376 aa, Prunus salicina
MTFTLRKKENVIDILVRLPAKSLVRFLCTSKSWSDLIGGSSFVSAHLNRNATKHAHVCLLCLHHPNFERLVNRDDPYFKKEFQWSLYSNETFEEFSKLSHPVGSTEHYVIYGSSNGLVCISDEILNFDSPIYIWNPSFRKFRTTPMSTNINIKFSYVALQFGFHPRVNDYKAVRMMRTNKNALAVEVYSLRTDSWKMIEAIPPWLKCTWQHYKGTFFDGVAYHVIQKGPIFSILSFNSGNEEFEEFIAPDAICGTFGLCIDIYKEQICLLFRCYGCEEEGMNKVDLWVLQEKRWKQLCPFIFPLDEWSGAIGISIDDELLMAITDFDKGVADLYLCNYECQDVLETGIKLAVMKYDEIEFLFAITYIQSLVFLNNY

SEQ ID NO: 61273 - protein, 370 aa, Oryza sativa (japonica cultivar-group)
MALPCLSASAAVACIPPASRQSGRPPPPLGCMPAVACCQLGRRLSAIPLQSSTSKEENWDPSQNFPPTGQQPQHSPMVGEQPSAEVGGSSRPNNKRSKNFNTAEDQMLVSAWLNTTLDAITGVEQHRDSYWARIHQYFHENKNFPSDQNQNSLNNCWGTIQEQVNKFCGYYEQILNGPQSGMVVQDYITQAFTLYKSAEKKTFSLMHCWEILHHHPKWNDRLFQKRQKAHVDPLVRPSASTNSSEFHYSPDINTSDPLVRPPGKKVEKAKCPRGNTSSCSSESSPVVIALNNMWSEKKEMSAQSREERNDRLVEVISLEKERLKVEKRKLDIETHEREERIMNMDLSAMDGPRKTYYLRLQQEIIKAHMD

SEQ ID NO: 61274 - protein, 420 aa, Agrobacterium tumefaciens str. C58
MSEKRVQPLARDAMAYVLAGGRGSRLKELTDRRAKPAVYFGGKARIIDFALSNALNSGIRRIGVATQYKAHSLIRHLQRGWDFFRPERNESFDILPASQRVSETQWYEGTADAVYQNIDIIEPYAPEYMVILAGDHIYKMDYEYMLQQHVDSGADVTIGCLEVPRMEATGFGVMHVNEKDEIIDFIEKPADPPGIPGNEGFALASMGIYVFHTKFLMEALRRDAADPTSSRDFGKDIIPYIVEHGKAVAHRFADSCVRSDFEHEPYWRDVGTIDAYWQANIDLTDVVPDLDIYDKSWPIWTYAEITPPAKFVHDDEDRRGSAVSSVVSGDCIISGAALNRSLLFTGVRANSYSRLENAVVLPSVKIGRHAQLSNVVIDHGVVIPEGLIVGEDPELDAKRFRRTESGICLITQSMIDKLDL

SEQ ID NO: 61275 - protein, 567 aa, Agrobacterium tumefaciens str. C58
MFPGKKAPVSTPRFIASLFRKAIEPMIKTIKTTPYQDQKPGTSGLRKKVPVFAQENYAENFIQSIFDALEGFEGQTLVIGGDGRYYNREVIQKAIKMAAAAGFGKVLVGQGGILSTPAASNVIRKYKAFGGIVLSASHNPGGPTEDFGIKYNIGNGGPAPEKITDAIYARSKVIDSYKISDAADIDLDKIGSFKVDELTVDVIDPVADYAALMEELFDFGAIRSLIAGGFKVVVDSMSAVTGPYAVEILEKRLGAPKGSVRNATPLPDFGGHHPDPNLVHAKELYDDVMSPEGPDFGAASDGDGDRNMVVGKGMFVTPSDSLAIIAANAKLAPGYAAGISGIARSMPTSAAADRVAEKLGLGMYETPTGWKFFGNLMDAGKVTICGEESFGTGSNHVREKDGLWAVLYWLNIVAARKESVKDIVTKHWAEYGRNYYSRHDYEEVDSDAANTLVAILREKLATLPGTSYGNLKVAAADDFAYHDPVDQSVSKNQGIRILFEGGSRIVLRLSGTGTAGATLRLYVERYEPDAARHGIETQSALADLISVADTIAGIKAHTGRSEPTVIT

SEQ ID NO: 61276 - protein, 651 aa, Agrobacterium tumefaciens str. C58
MQIPPVFPKGATRTENGVEFTVYSRHASQIDLCLFDDAGEKETARLPMMRGEDDVHRLTHENAGPGTRYGFRAHGIYAPEHGLWFDPAKLLLDPYATEIDRPFRHDPSLYAFGAETGAIMPKAILSAHDPVKRQPPRFAEGGLIYELAVKSFTQLHPYVPEDIRGTVAALAHPAILAHLKKIGVDAVELMPITAWIDERHLPPLGLSNAWGYNPVGFIALDPRLCPGGVRELRDTVAALHAEGIGVILDLVFNHTGESDIEGSILSLRGLDNLTAFRHPQGKPGVLVNDTGTGNTVACDHPYIRQLIVDSLRHFVLNAGVDGFRFDLAPVLGRTAAGFDMASETLAAMHSDPVLYDRLLIAEPWDIGPGGYQLGNFPESFLEWNDRARDDMRRFWRGDAGTTGALANALSGSSPIFSRHGRLKSRSVNFLAAHDGFTLFDLVSHERKHNEKNGENNRDGHNDNHSWNNGFEGLTDDPAIVAARLADVKALLSTLFVSRGTLMLTAGDEGGRSQQGNNNAYCQDNEISWVDWSSLVPELIDHTAFLAALRKRFGVFSESGFFSGRGDVTWLAPGGEPMTVADWERPDGQAFAMVLSTPDRETGKATELAVLINRGRDIVPFTLPGDGWRSIGTDFGNPAFLPARSVVFYLRG

SEQ ID NO: 61277 - protein, 227 aa, Wolinella succinogenes DSM 1740
MMIYVSFMEILPKSMEAFALIYPGNLGQILALLCFFAGVTLSALIDKLIPKDVNPHELKSQKELSPLKRDYAITSSLKRTGIFTAIAISIHNFPEGFATFISALDNLSFGLMIALAVAIHNIPEGMAVSLPIYHATGDRKRAFFYSTLSGLAEPLGAVVGFFLLYPFLGDFTLALTFGIVAGIMIYISFDELIPASRVYGHAHDTLYGLVTGMAVMAFSLVALGNLG

SEQ ID NO: 61278 - protein, 330 aa, Arabidopsis thaliana
MSGALNMTLDEIVKRGKTARSGGRGISRGRGRGRGGGGRGAGPARRVSNPQKMCGVVVNIVTYPPNPYTVLTVSCMKLLMNVLLHLEFLQHAMSVGFSFIIIALPVRRVRSLPWQSGLFEDGLRAAGASGVEVGTRLHVTNLDQGVTNEDIRELFSEIGEVERYAIHYDKNGRPSGTAEVVYPRRSDAFQALKKYNNVLLDGRPMRLEILGGNNSSEAPLSGRVNVNVTGLNGRLKRTVVIQQGGGGRGRVRGGRGGRGPAPTVSRRLPIHNQQGGGMRGGRGGFRARGRGNGGRGRGGGRGNGKKPVEKSAADLDKDLESYHADAMNTS

SEQ ID NO: 61279 - protein, 519 aa, Vitis vinifera
MPAVGGFDKGTGKAYPGNLTPYVTVTCVVAAMGGLIFGYDIGISGGVTSMAPFLQKFFPSVYRKEALDKSTNQYCKFDSETLTLFTSSLYLAALLSSLVAATVTRKFGRKLSMLFGGLLFCAGAIINGAAKAVWMLIVGRILLGFGIGFANQSVPLYLSEMAPYKYRGALNIGFQLSITIGILVANILNYFFAKIKGGWGWRLSLGGAVVPALIITVGSLVLPDTPNSMIERGQHEGAKTKLRRIRGVDDVEEEFNDLVVASEASKLVEHPWRNLLQRKYRPHLTMAILIPFFQQLTGINVIMFYAPVLFKTIGFADDASLMSAVITGRVNVLATIVSIYGVDKWVRRFLFLEGGTQMLICQVIVATCILVKFGVDGEPWCLPKWYAIVVVLFICVYVSGFAWSWGPLGWLVPSEIFPLEIRSAAQSVNVSVNMFFTFIIAQIFLNMLCHMKFGLFLSFAFFVVVMSFFIYFFLPETKGIPIEEMAEVWKSHWFWSRYVNDGSYSGVELVKENYPVKNV

SEQ ID NO: 61280 - protein, 206 aa, Arabidopsis thaliana
  misc_feature (153)..(153): Xaa can be any naturally occurring amino acid
MTQSSSKPPLANCKISVPAWEKDFCAVIGSVPWWKVVEAKRFMHIYDRVVQWDDSAGEDAFKNAKSRFWAEINGLTCDLSLPDPDVYIDDVDWDAEVDNELILDLERGPDPLTEEQEHVVILDALVLSGQYGGLGWGTGWGDAEGINEENVGXGDQGRENRGWRKRGEGRHGGERVEDCRWRNGRGRSRGGFQQHSANAWGWTESF

SEQ ID NO: 61281 - protein, 440 aa, Zymomonas mobilis subsp. mobilis ZM4
MSIEVKMPALSPTMTEGTLAKWLVKEGDAVKAGDILAEIETDKAIMEFETVDAGIIAKILVPEGSENIAVGQVIAVMAEAGEDVSQVAASASSQISEPSEKADVAQKETADSETISIDASLDKAISNAGYGNKTENMTASYQEKAGRIKASPLAKRLAKKNHVDLKQVNGSGPHGRIIKADIEAFIAEANQASSNPSVSTPEASGKITHDTPHNSIKLSNMRRVIARRLTESKQNIPHIYLTVDVQMDALLKLRSELNESLAVQNIKISVNDMLIKAQALALKATPNVNVAFDGDQMLQFSQADISVAVSVEGGLITPILKQADTKSLSALSVEMKELIARAREGRLQPQEYQGGTSSISNMGMFGIKQFNAVINPPQASILAIGSGERRPWVIDDAITIATVATITGSFDHRVIDGADAAAFMSAFKHLVEKPLGILAQ

SEQ ID NO: 61282 - protein, 519 aa, Vitis vinifera
MPAVGGFDKGTGKAYPGNLTPYVTVTCVVAAMGGLIFGYDIGISGGVTSMAPFLQKFFPSVYRKEALDKSTNQYCKFDSETLTLFTSSLYLAALLSSLVAATVTRKFGRKLSMLFGGLLFCAGAIINGAAKAVWMLIVGRILLGFGIGFANQSVPLYLSEMAPYKYRGALNIGFQLSITIGILVANILNYFFAKIKGGWGWRLSLGGAVVPALIITVGSLVLPDTPNSMIERGQHEGAKTKLRRIRGVDDVEEEFNDLVVASEASKLVEHPWRNLLQRKYRPHLTMAILIPFFQQLTGINVIMFYAPVLFKTIGFADDASLMSAVITGGVNVLATIVSIYGVDKWGRRFLFLEGGTQMLICQVIVATCIGVKFGVDGEPGALPKWYAIVVVLFICVYVSGFAWSWGPLGWLVPSEIFPLEIRSAAQSVNVSVNMFFTFIIAQIFLNMLCHMKFGLFLFFAFFVVVMSFFIYFFLPETKGIPIEEMAEVWKSHWFWSRYVNDGSYSGVELVKENYPVKNV

SEQ ID NO: 61283 - protein, 466 aa, Zymomonas mobilis subsp. mobilis ZM4
MADHFDLIVLGGGPGGYVAAIRAAQLNLKVALVERVHLGGICLNWGCIPTKSLLRSAEVYHEMQNAEAYGLTSFKPDFDLDKIIARSREVATRLASGVKTLLRKNKVEVISGVGQLTGNQQMLVETTEGEEKILEAKDIIIATGARARQLPNVHSDGKHIWTYHHALKPPAMPKKLLVIGSGAIGIEFASFYADFGAEVSIVEHAPQILPMEDAEVSAYVAKAFKKRGIRILTQSALQNLTPDDEGVTAEIAGADGKVTKERFSHAIVAIGVVANVENIGLDKLGIKLDRGFIAVDGFGRTNVDHVWAIGDVAGAPCLAHKASHQGVIAAEAIAGCDHVHPLNTQNIPGCTYARPQVASVGLTEEKARQQGYNVKIGNFPFIANGKAIAQGATDGFVKTVFDADSGALLGAHMVGAEVTEMIQGYTVARTLETTEAEIMETIFPHPTLSEAMHESVLAAYGRALHF

SEQ ID NO: 61284 - protein, 197 aa, Cytophaga hutchinsonii ATCC 33406
MNIDFQKGGGLVPVIIQDAVTRNVLMLGYMNEEAYTKTKAEGKVTFFSRTKNRLWTKGETTGHFLHVVDIKIDCDNDTLLIKVKPDGPTCHTGTDTCWSEVNSGRTFFIEKLANVIKDRRNNPTDVSYTASLFKKGINKIAQKVGEEAVEIVIEAKDNNDDLFKGEAADLLYHYLILLEAKNIPLDDVIQVLESRQK

SEQ ID NO: 61285 - protein, 476 aa, Bartonella henselae str. Houston-1
MLNKRKFYINGLWDDPSTPHDLYVIDPSTEEACAVISLGSTRDADKAINAAKKAFQTWKTTSPHERLGFVEKILEIYEKRSSDMAKTISMEMGAPIDMALNAQTATGSSHIRNFIKAYKEFSFQEALIEGNEQAILHYDAIGVVGLITPWNWPMNQVTLKVIPALLAGCTMVLKPSEIAPLSAMLFAEILDEAALPSGVFNLINGDGANVGSYLSAHPDLGMISFTGSTRAGKDISKNASNTLKRVCLELGGKGANIIFADADIDALQRGVRHCFYNSGQSCNAPTRMLVEQAIYDKAIKTAKDIAEKTQVGPGHQTGNHIGPVVSKEQYDKIQDLIQSGIDEGATLVTGGTGLPMGMERGYYVRPTVFADVKPHMRIFREEIFGPVLSLLPFNTEDEAVTLANDTEYGLTNYIQSQDRSKCRRIAAQVRSGMVEVNGHELPGGSYFGGVKFSGRAREGGLWGIKEFLDTKAISYW

SEQ ID NO: 61286 - protein, 436 aa, Rhodopseudomonas palustris CGA009
MSDKPHRIVIVGGGAGGLELATALGNKYGKSDAVRVTLVDRSRTHIWKPLLHAIAAGSLRRSQHELNYLAQAHWHGFHYRLGEMNGLDRARKVIKLAPVIDDEGREINPESELAYDTLVIAIGSVTNDFGTPGARDHAVPLETPEQASRFNKRMVNACLRAQHQHAPIEPGQLHVAIIGAGATGTELAAELHHTAREIIAYGLDKIDPEHDLKIVLIEAAPRILPALPPRISDATLKLLLDLGVEVRTGARVAEVLDHAVRLADGEVIPSELVVWAAGVRAPDFLEGIDGLDTNRINQLVVRPTLQTTRDDNVFGMGDCAACAIPGYENGVPPRAQAAHQEAEFMLEQIEKRLKGEPLGEFRYRDLGSLVSLGKYSAVGNLMGSLVGKSFLIEGYFARFMYRSLYKMHEAALYGRGRTLLSVLSGSTRPTPTVKLH

SEQ ID NO: 61287 - protein, 105 aa, Zea mays
PPGGPFFPQCCIFSVPPEGDYFFVFLGGGLGKEVFFGGGFFAPGFKRGPPVGGILPEMPLAGGGTPAPGPGVALPPLTIGRFGGNPKGNLFPTQGCWGGGFFFMV

SEQ ID NO: 61288 - protein, 379 aa, Antarctic bacterium DS2-3R
MTEPTIHKGLAGVTADVTAISKVNSDTNSLLYRGYPVQELAAKCSFEQVAYLLWNSELPNDSELKAFVNFERSHRKLDENVKGAIDLLSTACHPMDVARTAVSVLGANHARAQDSSPEANLEKAMSLLATFPSVVAYDQRRRRGEELIEPREDLDYSANFLWMTFGEEAAPEVVEAFNVSMILYAEHSFNASTFTARVITSTLADLHSAVTGAIGALKGPLHGGANEAVMHTFEEIGIRKDESLDEAATRSKAWMVDALAQKKKVMGFGHRVYKNGDSRVPTMKSALDAMIKHYDRPEMLGLYNGLEAAMEEAKQIKPNLDYPAGPTYNLMGFDTEMFTPLFIAARITGWTAHIMEQVADNALIRPLSEYNGPEQRQVP

SEQ ID NO: 61289 - protein, 358 aa, Arabidopsis thaliana
MKMKTVLVIINCIFLAIGNCGGPLMMRLYFQNGGERIWFPSFLQTVGCPLIFFPLLLSFLRRRRCLEEQETTPFFLMKPPLFIAAIVVGLLVGFDNYLYSYGLAYIPVSTASLIISAQLGFTALFAFFMVKQKFTPFTINAIVLLTGGAVVLALNSDSDKLANETHKEYVVGFIMTLGAALLYGFILPLVELSYKKSGQRITYTLALEFQMVLCFAATCVCLVGMLAAGDFKVKHALFIFKNRVIAGEARDFKLGESLYYVVIVFTAIIWQAFFVGAIGLIFCASSLVSGIMVSALLPVTVILAVICFQEKFQAGKGVALALSLWGSVSYFYGQVKSEEKTKAQDTQLSQLPVTDYVA

SEQ ID NO: 61290 - protein, 475 aa, Bartonella henselae str. Houston-1
MVVKNGKQIKSKGSKLVSDFLKNLRGVDNWEQVSQWLAFRNVEDIECITPDQAGVPRGKMMLSKKFTSKTSLALPSAVFMATISGDYPEDGHGFEYPKTDGDLRLEPDLSTLSIVPWEEAPTAQVICDLVYQNGEVVDYTPRNVLRTVIDFYTQMGLKPVVSPEIEFYLVQKNPDPDYPLVPPVGRSGRSIGGGQGYSIAGVNEFDDLIDDIYHFSEAQGLEIDTLIHEEGAGQFEINLRHGDPIELADQVFMFKRTIREAALKHNMYATFMAKPIQGQPGSAMHIHQSVVDKKTGMNIFTQKDGKESVCFRHFIGGLQKHMAGVFVMLAPYVNSYRRLVPDLSAPVNLRWGYDNRTTAFRVPRSAPKGRRVENRLPSSDANPYLALAASLVCGLIGLQQKLEPDEPTTKNVNADNIELPRGLIEAVNLFEQDTAVRAILGEVFVSTYAAIKRQEFETFMEVISPWEREYLLLNV

SEQ ID NO: 61291 - protein, 151 aa, Schizosaccharomyces pombe
MSTTARRRLMRDFKRMQQDPPAGVSASPVSDNVMLWNAVIIGPADTPFEDGTFKLVLSFDEQYPNKPPLVKFVSTMFHPNVYANGELCLDILQNRWSPTYDVAAILTSIQRLLNDPNNASPANAEAAQLHRENKKEYVRRVRKTVEDSWES

SEQ ID NO: 61292 - protein, 337 aa, Synechocystis sp. PCC 6803
MTRVAINGFGRIGRNFLRCWLGRTDSQLEVVGINDTSDPRTNAHLLRYDSMLGKLDADISADENSITVNGKTIKCVSDRNPLNLPWAEWNVDLVIEATGVFVTHEGATKHVQAGAKKVLITAPGKGPNIGTYVVGVNAHEYKHEEYEVISNASCTTNCLAPFGKVINDNFGIIKGTMTTTHSYTGDQRILDASHRDLRRARAAAVNIVPTSTGAAKAVALVIPELQGKLNGIALRVPTPNVSVVDLVVQVEKNTIAEQVNGVLKEAANTSLKGVLEYTDLELVSSDFRGTDCSSTVDGSLTMVMGGDMVKVIAWYDNEWGYSQRVVDLAEIVAKNWK

SEQ ID NO: 61293 - protein, 560 aa, Thermus thermophilus HB27
MDQVREKPWLAHYDPGVPPEIQVPDIPLWRFLEESARRFPQNVALEFLGKTLSYQELWGLARRFAQGLKDLGVRPGDRVAIMLPNSPQFVIAFYGTLLAGGVGVNVNPLYTPRELRHQLADAGAETLVILDHLLPRYLEVEKEVPVKRVVVTGIKDFLPFPKNLLYPLKAKRDGLPLGFPKREGFHAFAELLKRPPAEPHVPDPEDLALLQYTGGTTGLSKGAMLTHKNLVANVLQIDAWDPTSKDLVGKGVMLGALPFFHVYGMTVAMNYGLFSGYKIVLLPRPEIKAIVEAIEKHQVTHFPGVPTLYVAFNNFPGIEKRNVKSIRICLSGAAPLPVEVAKRFEELTGARLIEGYGLSEASPVTHSNPVLGLIKKGSIGMPFPSVDAKVVDEEGKELPPGEVGELAVKGPNVMKGYWNRPEETQKTLKDGWLFTGDLAKMDEDGYFYIVDRKKDMIIAGGYNIYPREVEEVLYQHEAVQEAAVVGVPDPYRGETVAAFLVLKPEYQGKVSEKDIERFCRQNLAAYKVPRIIQFRESLPKSSVGKILRRELREEFAKKQG

SEQ ID NO: 61294 - protein, 376 aa, Prunus salicina
MAFTLRKKEILIDVLVRLPAKSVVRFLCTCKSWSDLIGSSSFVSIHLKRNVTKHAHVYLLCLHHPNFERQNDNDDPYDIEELQWSLFSNETFEQFSNLSHPLENTEHYRIYGSSNGLVCISDEILNFDSPIHIWNPSVRKFKTPPMSTNINMKFSHVALQFGFHPGVNDYKTVRMMRTNKGALAVEVYSLRTDSWKMIEAIPPWLKCTWQHYKGTFFNGVAYHIIKKGPIFSVISFDSGSEEFEEFIVPDAITSSWGLCIDVYNQQICLLLKFYSCEEEGMDKIDSWVLQEKRWKQLCPFIFPLDDYYSTIGISIDNKLLMQRTDYNMGIADLHLCDYESKQVLETRIKLALVKYGEIEFVFSITYIESLVLLNNY

SEQ ID NO: 61295 - protein, 285 aa, Triticum aestivum
  misc_feature (139)..(139): Xaa can be any naturally occurring amino acid
  misc_feature (153)..(153): Xaa can be any naturally occurring amino acid
  misc_feature (187)..(187): Xaa can be any naturally occurring amino acid
  misc_feature (199)..(199): Xaa can be any naturally occurring amino acid
  misc_feature (229)..(229): Xaa can be any naturally occurring amino acid
  misc_feature (250)..(250): Xaa can be any naturally occurring amino acid
  misc_feature (254)..(254): Xaa can be any naturally occurring amino acid
MEDERSTQSYQGGEAAEQVEVTDRGLLGNLLGKKKAEEDKEKQEELVTGMEKVSVEEPEVKKEEHEDGEKKETLFSKLHRSSSSSSSSSDEEEEEVIDDNGEVIKRKKKKGLKEKLKEKLPGHKDTEGEHVTGLPAPGXPPASVQTHHDTDVXVEKIDGDVKTEGVPGQCPREEKKGFLEKIKENLXPGGQKKPEDAAXVPVTHAAPSTVHAPAPAAEEVSSPDAKEKXGLLGKIMGQLPGYHQNREEDXAAAXAGEHNPALIRGGPGLGTGLDGIVGVVWFALR

SEQ ID NO: 61296 - protein, 365 aa, Prunus persica
MTFTLRKKEILIDILVRLPAKSLLRFLCTCKSWSDLIGSSSFVSMHLHRNVRKHAHVYLLCLHHPNVRRQVDPDDPYVKQEFQWSLFSNETFEEYFKLSHPLGSPEYFVIYGSSNGLVCISDEILNFDSPIHIWNPSVRKFRTIPMSTNTNIKFSYVALQFGFHPRINDYKAVRMMRTNKNALAVEVYSLRTDSWKMIEAIPPWLKCTWQHLKGTFFGGVSYHIIQKGPIFSIVSFDSGSEEFEEFIAPDAICRPFALCIDVYKEQICLLFRFYSCADEDMAKNDLWVLDEKRWKQLCPFIYPLDSYGTIGISIDNELLLERRDFILVRMRTWQKMTYGFWMKNGGNSCVLLFILLIAMVQSGLV

SEQ ID NO: 61297 - protein, 244 aa, Vibrio angustum S14
MLTDKVCLVTGGAQGIGRCIVETFANQGAKHVYVCDMNFGAMADLEQQFPNVTALELNVCDRANVSDAITKIAQHYGTIDVLVNNAGITRDNLIENMSENDWDLVIDVNLKGVFNMTQAVAPLMMASGSGSIITMSSVVGTDGNIGQTNYAATKAGVIAMTKSWSKEFARKGAKVRANCVAPGFIETPMTVDLPEKVIDYMVSKTPLKRMGLAQDIANGVLFLASDNSSFITGQTLKVDGGLVI

SEQ ID NO: 61298 - protein, 399 aa, Pseudomonas syringae pv. tomato str. DC3000
MSGNRGVVYLGAGKVEVQSIPFPKMEDPRGKRIEHGVILRVVSTNICGSDQHMVRGRTTAQTGLVLGHEITGEVLEAGRDVEHLKVGDLVSVPFNVACGRCRSCKEQNTGVCLTVNPARPGGAYGYVDMGDWVGGQAEYVLVPYADFNLLKLPDRDAAMEKIRDLTCLSDILPTGYHGAVTAGVGPGSTVYVAGAGPVGLAAAASARLLGAAVVIVGDVNPTRLIHAKAQGFEIADLSQDTPLHEQIAALLGEPEVDCAIDAVGFEARGHGHAGAQAEAPATVLNSLMGVVRVAGKIGIPGLYVTEDPGAVDAAAKMGSLSIRLGLGWAKSHSFHTGQTPVMKYNRQLMQAIMWDRIKIADVVGVEVISLDDAPRGYGEFDAGVPKKFVIDPHGLFGGV

SEQ ID NO: 61299 - protein, 336 aa, Streptococcus oralis
MVVKVGINGFGRIGRLAFRRIQNVEGVEVTRINDLTDPVMLAHLLKYDTTQGRFDGTVEVKEGGFEVNGKFVKVSAERDPEQIDWATDGVEIVLEATGFFAKKAAAEKHLHAGGAKKVVITAPGGNDVKTVVFNTNHDVLDGTETVISGASCTTNCLAPMAKALQDNFGVVEGLMTTIHAYTGDQMILDGPHRGGDLRRARAGAANIVPNSTGAAKAIGLVIPELNGKLDGSAQRVPTPTGSVTELVAVLEKNVTVDEVNAAMKAASNESYGYTEDPIVSSDIVGMSYGSLFDATQTKVLDVDGKQLVKVVSWYDNEMSYTAQLVRTLEYFAKIAK

SEQ ID NO: 61300 - protein, 98 aa, Arabidopsis thaliana
MGFIMEFAENLVLRLMENPEERDRKAREHIYEMHERCKKIKEMWALPIRPYGFWTFERHNAQLRWDPQISQVAGRRDPYDDLLEDNYTPPSSSSSSSD

SEQ ID NO: 61301 - protein, 442 aa, Zea mays
MASRNHNAAAPQLHHHNRAGVPALGKTKAVPARPDALNRRPPLGDIGNLVSVRPATGNPQEQVNRPITRSFGAQLVKKAQAKAAIKNAAILPARHAPRQERKAPVKQHPPPEDIIVLSSDSEQSRAQSESSASSVRSRRKAINTLSSVLSARSKAACGIAGKPRQVVDDIDKLDVNNELAVVEYIEDIYTFYKIAQHERRPCDYIDAQLEINSKMRAILADWIIEVHHKFELMPETLYLTMYIIDQYLSLQPVLRKELQLVGVSSMLIACKYEEIWAPEVNDFILISDSAYSREQILSMEKGILNRLEWNLTVPTVYMFLVRFLKAATLGGKVEKEMENMVFFFAELALMQYDLVTRLPSLVAASAVYAARLTLKRAPLWTDTLKHHTGFRESEAELIECTKMLVIAHSTAPESKLRVVYKKYSSEQFGGVALRPPAEEICK

SEQ ID NO: 61302 - protein, 379 aa, Oryza sativa
  misc_feature (210)..(210): Xaa can be any naturally occurring amino acid
  misc_feature (236)..(236): Xaa can be any naturally occurring amino acid
MEDQSLKPIRCKAAVCRAASEPLIVEEIVVDPPKAYEIRIKIICTSLCHTDVTLWHKVDPAFPRILGHEAYGVVESVGENVEGLAAGDTVVPTFMGQCDSCASCAAEWTNQCTAVPFTMGPGMRRDGTTRFWDGEGKPLSDTVAVTSFSQYTVVDVNQVVKVDPAVPPKIACLLGCCGGTGVGAAWRLAKVQPGSSVVVFGLGSVGLAVXKGAKMCGATKIIGVDLNPNKEEVGKXFGVTDFVNPSQLGDKSVSEVINAMTDGGADYSFECIGISSVMTEAVRSTKSGRGKTIILGVEKDSQPLCLPSFEFLFGKCVMGSLFGGAKPKTDIPILAEKCMNKELELEKLVTHEVGLTEINTAFDLLLQGKSLRCIIWMDK

SEQ ID NO: 61303 - protein, 99 aa, Triticum aestivum
  misc_feature (58)..(58): Xaa can be any naturally occurring amino acid
  misc_feature (90)..(90): Xaa can be any naturally occurring amino acid
MAPTVMASSATSVAPFQGLKSTAGLPVSRRSNGASLGSVSNGGRIRCMQVWPLEGIKXFRDLSYLPPLNTEASSSKSTTLIPLQVGPCSXFNKVGFIFP

SEQ ID NO: 61304 - protein, 507 aa, Zea mays
  misc_feature (339)..(339): Xaa can be any naturally occurring amino acid
MAAAVASLYRRVLPSPPAVDFASPEGKRLFAEALAAGTMEGFFPLVSVFQTQSEPAFCGLASLAVVLNALAIDPGRRWKGPWRWFDESMLDCCEPLDKVKAEGITFGKVACLAHCSGADVQSFRTNRVTIHDLRRHLIRCVSSQDCHLIASYHRRPFGQTGTGHFSPIGGYHAGQDMVLILDVARFKYPPHWVPLQLLWEAMNTTDDSTGLLRGFMLISRKVAAPSLLYTVSCRDENWKRMSKYCVEDLPSLLKAGNLDDVPALLSRLIESLPADAESLIKWVVEVRRKEEGGPSLNKEEKERLFLKENVLKQVRDTRLFTIVHDLQYANKPCYNCSSXARKDSITKFHCVVCCQGAAMLSGNLVPRDAFCCRETSFECVQANGDGLKTVISGSVVCEGSEQGVDMLLPMSSPGASSCNSNLKSNAVKYPSSVDVLTVLLLALHPNTWLGIKDEKLKAEFQTLISTDSLPDDLKREILHLRRQLYYLKACKEEEWEDAEQPSPKQQC

SEQ ID NO: 61305 - protein, 506 aa, Vibrio vulnificus YJ016
MTQQLEQNLATAQKYLARFRDNTLGHFINGEWTLGSKGETFDNLTPTDNTSLGKVVKGTAEDVDAACEAAQQAFTAWAEMSGAERKKILHKLADKIEQRAEEIALVESMDCGQPLRFMRQAAIRGAANFRFFADKSPEAKNGLSLHQDTHTNYTIRTPIGPVGVITPWNTPFMLSTWKIAPALAAGCTVVHKPAEFSPLTAAILAECAKEAGLPDGVWNMVNGFGEVAGKTLTEHKAIKAVAFVGETVTGSMIQAQGAPTLKRVHFELGGKNPVIVFDDADFERALDAVVFMIYSLNGQRCTSSSRLLIQNGIKPKFIEALKQRVESLQVGHPLDPETEVGPLVHQSHYNKVMSYMTAAEEDGATIAVGGRKLPEKGAGNYLTPTLFTDADNTMRIAREEIFGPVLTCIGFDSEEEALEIANDTDYGLSGYIWTSNTGRAMRMATKVEAGMIWVNSENNRNLPSPFGGVKMSGIGRDGGDWSFDFYMETKNVCIAHDLHRVPTLGK

SEQ ID NO: 61306 - protein, 202 aa, Triticum aestivum
MQGLAASSMLSLTVVVVVFLIGMADHSDGRRRVISSSSDEPCKEMTLYLHDILYNGANNSANATSAAATKPTALSTTHWKNGTFFGTLVVFDDPVTVGKALPVAEAGEEPAIRAQGFYFYDKKESYNAWVGFSIVFNSTAATGTINLMGADLMYEVTRDISVVGGTGDFFMTRGIATLRLDAYEGTVYFRLQMDIKLYECYI

SEQ ID NO: 61307 - protein, 552 aa, Hyphomonas neptunium ATCC 15444
MYRYDQFDARIVAERVAQFRGQVARRLSGELLEDEFKPLRLQNGVYLQLHAYMLRIAIPYGQLSPVQLRRLAEVARDYDRGFGHFTTRQNIQFNWVALKDIPDVLEKLAEVEMHAIQTSGNCIRNTTTDHFAGAAQDEVFDPRPWCEIIRQWSTFHPEFAFLPRKFKIAVTAAEHDRAAIRVHDVGLHIRQKDGVTGFEVWVGGGQGRTPVIATLVNPFVPESQILDYLEAIMRVYNRYGRRDNKYKARIKILVTELGDAEYIRQVEEEFAAQRAHEKIDMPADEIARIHAYFAPPQLAEKPAVSRTLELATAADPAFARWVRINLHPHKVPGYASVTVSLKPIGIAPGDATDTQMELVADLAEKFGHGDIRVSHAQNLILPHVALDDLPEIYAALHAAGLSAANESRITDMIVCPGLDYCNLANARSIPVSLEVQKLFADPAYEEDIGRLHINVSGCINACGHHHVGHIGILGVDKKGEEFYQILLGGRADEKAALGNIVGPGLKAEEVPGAIHRVVEYYRAQRTSKDEKFIDTLERLGHQPFQEALYAAD

SEQ ID NO: 61308 - protein, 343 aa, Arabidopsis thaliana
MEGDVGIGLVCQNTMDGKASNGNGLEKTVPSCCLKAMACVPEDDAKCHSTVVSGWFSEPHPRSGEAHSLKVEKVLFKDKSDFQEVLVFESATYGKVLVLDGIVQLTEKDECAYQEMIAHLPLCSISSPKNVLVVGGGDGGVLREISRHSSVEVIDICEIDKMVIDVSKKFFPELAVGFDDPRVQLHIGDAAEFLRKSPEGKYDAIIVDSSDPVGPALALVEKPFFETLARALKPGGVLCNMAESMWLHTHLIEDMISICRQTFKSVHYAWSSVPTYPSGVIGFVLCSTEGPAVDFKNPINPIEKLDGAMTHKRELKFYNSDMHRAAFALPTFLRREVASLLAS

SEQ ID NO: 61309 - protein, 230 aa, Cytophaga hutchinsonii ATCC 33406
MKNVVVLTGAGISAESGINTFRDSGGLWEGHDVMEVASPEGWRKNPELVLEFYNIRRKDALKAQPNEAHLALVELNKHFPVKIITQNVDDLHERAGSTDVLHLHGKLFESRSTANHRLIYPIDGWELKPGDRCTRGSQLRPNIVWFGEAVPLMDDAVKLTAKADVFIVIGTSLQVYPAASLVDYAGPDTEVIVIDPNMPAVKNHPLLTLVAEKASIATPRIVRELIEKYK

SEQ ID NO: 61310 - protein, 262 aa, Rhodopseudomonas palustris CGA009
MTASSPHVALVTGAARGIGLAAAKRFLADGWSVALLDRDDDGLRAAMQALALPERTIALHCDVADRGSVARDIAAVTERFGRLDALVNNAGIAVFKPLMETTPDEWQRVMDVNLTGPFLMTQAAVPLMRDSGGGAIVNITSISSLRASTLRVAYGSSKAGLAHFTKQCAVELAALGIRVNGVAPGPVDTAMAKQVHTADIRSDYRDAIPMARYGLEEELAEAIFFLCSDRASYITGQILAVDGGFDAAGIGLPSLRGERKNS

SEQ ID NO: 61311 - protein, 327 aa, Bordetella bronchiseptica RB50
MSAQIRLMPSQLEALRRHTVVVADTGDFEAMRALRPTDATTNPSLILKAVQQEAYRPLLVQTARAHQGASPAEITDRLLVAFGRQILDIVPGRVSTEVDARLSFDTRATVERARGLIALYQAAGVPRERVLIKIASTWEGIQAARVLQAEGIRCNLTLLFCLPQAAACADAGVQLISPFVGRIYDWHKKNAGAEWVEDARRGANDPGVQSVSRIYRYYKRFGIETEIMGASFRNVDQILALAGCDLLTISPELLTRLSQTEGEVPAALSPQAGHDDADAVRLDGGEVAFRTQLNEDAMASEKLSEGIRLFVADARKLDALIESHGAA

SEQ ID NO: 61312 - protein, 1080 aa, Bordetella bronchiseptica RB50
MPKRTDLKSILIIGAGPIIIGQACEFDYSGAQACKALKAEGYRTILVNSNPATIMTDPETADVTYIEPITWQAVEKIIEREKPDALLPTMGGQTALNCALDLAHHGVLKKHNVELIGANEHAIEKAEDRQKFKQAMTDIGLESAKSGVAHSMDEAWEVQRRIAADIGTAGFPVVIRPSFTLGGSGGGIAYNAEEFEVICRRGLEASPTKELLIEESLLGWKEFEMEVVRDKADNCIIVCSIENLDPMGVHTGDSITVAPAQTLTDKEYQIMRNASIAVLREIGVDTGGSNVQFAVNPQNGRMIVIEMNPRVSRSSALASKATGFPIAKVAARLAVGYTLDELRNEITGGATPASFEPTIDYVVTKVPRFAFEKFPQADARLTTQMKSVGEVMAMGRTFQESFQKALRGLEVGVDGLNQKTTDREKLQIELGEPGPERIWYVGDAFAQGFTLDEVHGLTRIDPWFLAQIKEIVDIELALEQKTLADLDYATLWELKRRGFSDRRLAFLLDSSESEVRKLRHQLNVRPVYKRVDTCAAEFATNTAYMYSTYEEECESQPTDRKKIIVLGGGPNRIGQGIEFDYCCVHAALALREDGYETIMVNCNPETVSTDYDTSDRLYFEPLTLEDVLEIVHKENPVGMIVQYGGQTPLKLARALEANGVPIIGTSPESIDVAEDRERFQKLLNKLGLRQPPNRTARTEAEALAHASEIGYPLVVRPSYVLGGRAMEIVHEQQDLERYMREAVKVSNDSPVLLDRFLNDATEVDVDCLADGQTVFIGGVMEHIEQAGVHSGDSACSLPPYSLSAEVIAEIKRQTTMMAKALNVSGLMNVQFAIQGGDVYVLEVNPRASRTVPYVSKATGLQLAKIAARAMAGRTLADQGITREVVPPYFSVKEAVFPFVKFPGVDTILGPEMKSTGEVMGVGNSFGEAFVKSQLAAGVRLPDSGTVFISVRNQDKPRAVEVARGLHNLGFKLVATRGTAAEIEAAGIPVQVVNKVTEGRPHIVDMVKNGEVSLVINTVEERRNAIADSRTIRTQALANRITFFTTIAGARAAVEGMQFMRQGLGLQVYPLQELHAGLTAQ

SEQ ID NO: 61313 - protein, 490 aa, Hordeum vulgare
MVVTVAATGPDTAETLHSTTFASRYVRDQLPRYRMPENSIPKEAAYQIISDELMLDGNPRLNLASFVTTWMEPECGKLIMDSVNKNYVDMDEYPVTTELQDRCVNMIAHLFNAPIGEDETAIGVSTVGSSEAIMLAGLAFKRKWANKMKEQGKPCDKPNIVTGANVQVCWEKFARYFEVELKEVKLTEGYYVMDPKKAVEMVDENTICVAAILGSTLTGEYEDVKLLNDLLVEKNKETGWNVPIHVDAASGGFIAPFLQPELEWDFRLPLVKSINVSGHKYGLVYPGVGWVIWRSKDDLPEELIFHINYLGADQPTFTLNFSKGQQIIAQYYQLIRLGFEGYKHIMENCKLNAAVLKEGIDATGRFDVLSKADGVPLVAIRLKDSTNFSVFDISENLRRFGWIVPAYTMPADAEHVAVLRIVIREDFNRSLAQRLLADINKIIGELDAHAVHAIKLSTAAAGGDGASKSAVDAATEAFKDLAGKKKAGVC

SEQ ID NO: 61314 - protein, 552 aa, Oceanospirillum sp. MED92
MYQYNEVDQKLVDERVEQFRDQTRRFLAGELSEDDFLALRLMNGLYVQRHAPMLRVAGPYNMYNSAQFRKLAHIARTYDKGYAHFTTRTNLQFNWPKLEEVPDILAELATVQMHSIQTSGNCIRNTTTDQFAGVIAEEVEDSRPYCEIIRQWSSLHPEFAYLPRKFKIAISAAPDDRAATQVHDIGLHIIKNEAGEVGFEVIVGGGLGRTPMIGKQINPFLAKEDLLSYLEAIIRVYNMNGRRDNKYKARIKILVQAMGIDKFREEVEAEWAHIRDTDLKLPQEEIDRVKAFFKPFDYDESAAQDNSLEAKLAEDEAFNTWYERNTVAHKVDGYRIAYVSLKPYLKPAGDITADQLDLVADLADRYSFGEIRATHNQNLVLADVKKADLYAVWQVLAEAGLARPNMGTITDMTVCPGGDFCALANARTIGVADQINEKFESLDYLHDLGELKLNMSGCMNACSHHHVGHIGILGVDKKGEEWYQITLGGDDGSDAALGKVIGRAVASDQVANTLEKVVEVYVEKRLEGERFIDTFHRIGMAPFKEYVYAPAN

SEQ ID NO: 61315 - protein, 150 aa, Thermus thermophilus HB27
MKVKDLMTQDPVVLGPEATLEEAARRILETRYGGFPVVDGEGRLLGVVQVEELLPHPENVPFSDVEALQLFGEWVDEDALAEIYRRYQRTPVKAVMRTEIPKVHPEDPLGKALKVVLTTDLRHLPVVDEEGKVVGILTRSDFLKLILGRG

SEQ ID NO: 61316 - protein, 318 aa, Medicago truncatula
MNNEKLSSSSSFTLTKGINGLDKVLLRESRGASAEIYLYGGHVTSWKNDHAEELLFLSSKAIFKPPKAIRGGIPICFPQFANHGNLESHGFARNRVWAIEDDPPPFPTNNLSKAFVDLILKPSEEDMKIWNHSFEYRLRVALGPGGDLMLTSRIRNTNSDGKPFSFTFAYHTYLSVSDISEVRVEGLETLDYLDNLQNKERFTEQGDALTFESEVDKIYLSTPTKIAIIDHEKKRTFVLRKDGLPDAVVWNPWDKKAKAMADFGDDEYKHMLCVEAANIEKAITLKPGEEWKGRLELSAVPSSYCSGQLDPQRVLQGS

SEQ ID NO: 61317 - protein, 294 aa, Vigna unguiculata
  misc_feature (266)..(266): Xaa can be any naturally occurring amino acid
MEQYEKVEKIGEGTYGVVYKARDRVTDETIALKKIRLEQEDEGVPSTAIREISLLKEMQHRNIVRLQDVVHSEKRLYLVFEYLDLDLKKHMDSSPEFVKDPRQVKMFLYQILCGIAYCHSHRVLHRDLKPQNLLIDRRTNSLKLADFGLARAFGIPVRTFTHEVVTLWYRAPEILLGSRHYSTPVDVWSVGCLFAEMVNRRPLFPGDSEIDELFKIFRILGTPNEETWPGVTALPDFKSTFPKWPPKDLATMVPNLDAAGLNLLSXMLSLDPSKRITARIAVEHEYFKDIKFVP

SEQ ID NO: 61318 - protein, 426 aa, Lactobacillus acidophilus NCFM
MAQKEVSHKKAAVLGLQHLLAMYSGAVAVPLLIGTALKFNSQQMTYLVSIDIFMCGFATLIQLFRNKYFGIGLPVVLGCAIQAVAPLEMIGQKFSINTMYGAIIVAGIFVFLIAGWFSKIKKLFPPVVTGTLITVIGLTLIPVAVQNMGGGNAQAKDFGDAKNLIAAFLTIIIIVAIEVWTKGFLRSISVLIGLIAGTVIAGFMGLVSLKPVAEASWFHLPQLFYFGVPEFEWSSCLTMIIIALVSMVESTGVFFAIGDLLHKDITEDDLKKGYRAEGIAQIFGGLFNTFPYTTFSQNVGLLQLSGIKTKRPIYWAAGLLMAMGLLPKIGALVTIIPDSVLGGAMLVMFTMIAVQGIRMLTKVDFDNNRNILVVAISIGLGLGVTVYPQLFQTLPQTIQLFLGNGIVVASISATLLNLLFNGRRDA

SEQ ID NO: 61319 - protein, 483 aa, Vibrio vulnificus YJ016
MNLNYPELFQQRCYIDGQWVAESGQTQAVTNPSTGKVIGEIPVFGEQQAKECITAAQAAFELWKKTTADYRADVLRRWYELMMVNIDDLAAILTLEQGKPFTEAKGEITYAASFVQWYSEEARRAYGEIIPSHRENGKIVVTKEPIGVVAAITPWNFPAAMITRKAAPAFAAGCSMVLKPAQETPFTALALAKLAEDAGLPKGLFNVITGDSRSIGGVFTSDKRVRKVSFTGSTNVGKILMNKSASTIKKLALELGGNAPFIVFEDADIDAAVEGAMIAKFRNAGQTCVCANRLFVHHAVYDEFAEKLANRVKQLKVGDGFADGVAIGPLINSSSVAKVQEHVDDAVAKGAKVLCGGLLNDEQLFVAPYVLTDMSDDMLVAEEETFGPVAPLFRFKDEAEVLERANDTESGLAGYFYTRSLGRAWRVADALEVGMVGINEGLISTAAAPFGGIKESGLGREGSRHGMDEYMEMKYMLMGGLDS

SEQ ID NO: 61320 - protein, 459 aa, Mycobacterium smegmatis str. MC2 155
MTDAPPRAGAPLPSPEELLYRREQIVADVVRQGFIDDLHPLCGVIDLDTLDELMASLHAAYPADLPALHTIAAKAISLRPVLARFAAAGFGCEVASPGELELALAAGFPAERIVFDSPAKTPTEIARALELGVSFNVDNFEELARIDAAVARNGRPRSVIGVRVNPQTGAGTIDAMSTATSTSKFGIGLADHRDEIIDAFATRPWLTQLHVHSGSQGMSLEHAAEGVRLTTDLAADIDARAGSRQIQRIDVGGGLPVNFRSDDVTPTFADHRAALQAAAPRLFDGTYTVVTEFGRALTAKAGTVVARVEYTKVTGGRPIAITHAGVQVATRSIFAPEAWPLRVEVYDAHGRRRDDPPRVQDVAGPACFTGDMLAVGRELPPVHAGDLVAVPDTGGYYFSTHFSYNALPRPAVYTVGTDQHGDRRWSLARRAQTIEQIVAEAGEPSLEPLTFRPPNRPSD

SEQ ID NO: 61321 - protein, 516 aa, Lactobacillus acidophilus NCFM
MAKNLEDFDKIIVLDFGSQYNQLITRRIRDFGIYSELLPHDLSIEKIKEMNPKGIIFSGGPNSVYDDGALKVDPEIFKLGIPILGICYGMQLMSYDLGGKVERAENKEYGRANITVEDPDSALFKGLPTKQYVWMSHGDLVTQAPEGFEVTASSKNCPIAAIANPDKKFYGIQFHAEVRNSEYGLDILKHFAFDVCGAVANWTMADFIDMQVDEIRKEVGDKKVILGLSGGVDSSVTATLLHKAIGDQLTAIFVDHGMLRKDEGDQVMKALNKDLGVNIIRVNAQERFLNKLKGVTDPEQKRKIIGKEFIEVFNEEAKKLKDVDFLAQGTLYTDVIESGTNTAQTIKSHHNVGGLPEDMNFKLIEPLRKLFKDEVRELGEKLGIPHDLVWRQPFPGPGLGIRVLGEVTEDKLKIVRESDAILREEIKKAGLQEKIWQYFTVLPGIRSVGVMGDGRTYDYTIGIRAVTSIDGMTADFAQIPWDVLGHISDRIVNEVDNVNRIVYDVTSKPPSTIEWE

SEQ ID NO: 61322 - protein, 118 aa, Candidatus Blochmannia floridanus
MKSNDLFIKIIQKKIKTNILYQDELVTAFCDLYPKAPIHILIVPNELIPTVNDVKSHHEITLGRLFIVAAKIANQKNIHISGYRLIINCNVNAGQEIYHLHMHLLGGKQLGPLLDERY

SEQ ID NO: 61323 - protein, 120 aa, Magnetospirillum magnetotacticum MS-1
EMVIPSLLPVLTPIVLFFVIQAIAGKSQAFATVGASLLGVILTGLYVAISMTSGGGAWDNAKKFIEDGHHGGKGSDAHKAAVTGDTVGDPYKDTAGPAVNPAIKITNIIALLLLAVLAHA

SEQ ID NO: 61324 - protein, 156 aa, Brassica napus
MASDQSTNPPIMESKPRHPLHQIADTPTHKLLLKQWLKEEELILNRVSHKESQIDSVRREITQLYIFFFLFHSISLLLLFHASSASASSSACKRSWIPSLCALVSSLGIIWAVRYKSEVESHLEKLLEREKEDAKLLRKCVEELKKKGVEFDLLKE

SEQ ID NO: 61325 - protein, 278 aa, Streptococcus agalactiae NEM316
MIVGEQEARALIKPRPKSSHKGDYGSVLLIGGFYPYGGAIIMAALACVKTGAGLVTVATQSCNIPSLHSQLPEVMAFDSDDYKWLEKSIVQSDVIVIGPGLGVSESSRKILNQTMEKIQSHQSVIIDGSALTLLSEGAFPQTKAKNLVLTPHQKEWERLSGIAVSQQTKENTQTALKSFPKGTILVAKSSHTRIFQDLDEKEIIVGGPYQATGGMGDTLCGMIAGMLAQFKEASPLDKVSVGVYLHSAIAQELSKEAYVVLPTTISDEIPKEMARLSK

SEQ ID NO: 61326 - protein, 427 aa, Oceanospirillum sp. MED92
MSASSFAELALCPELQFTLKNLGYEQPTPIQSQAIPLVLRGDDLLAEAQTGTGKTASFALPIIEKLSKNPIDGYRPVRALVLAPTRELAIQVADNTLEYGRDLGMRVISVYGGVPVENQIKRLKRGTDILVATPGRLLDLLRQKAISLEKLEYLVLDEADRMLDLGFIDPIQKIMDYAADDRQTLLFTATADESVEVLAEFYLNNPTKIKVTPRNSTAKQIRQFAYQVDYGQKADILSYLITEGKWGQTLVFVRTKKRVDELTQYLCKEGINAAAIHGEKSQRERVRMLNEFIAGDLHVLVATDVAARGLDIESLPYVVNYDLPNQPEAYVHRIGRTGRAGETGEAVSLVAPAEREFLQRIEKLIKQKIKLRPVPRIEDGKRLEIDDFADKPMKRKPAKAKQQKRKKVESYQPDKSKKAIRPSLFNK

SEQ ID NO: 61327 - protein, 524 aa, Magnetospirillum magnetotacticum MS-1
MRFERGAREGDSIMITQRNVCVIGSGISGLAAAKAFRERGHHVTVLERGPDLGGVWEPSRSYPDVKTQTPKDIYAFSELPMPTAYPEWPSGGQVFAYLRSYAERFGLIPLIRYGQSVTGLKKRTGLGWDVTTKGQDGAASTQSYDFVAICTGQFSHMNKPAHPGADAFRANGGTILHSSEHNDAESVRGKRIVVLGYSKSATDVAVSAVKHGASAVTLVFLEPTWKIPYFFGGLINFKRILYCRAAESMFLPYNAGPVRRIAQKLATPLIWANWRGLETLLTRQFKLNKNGLRPKTRIEDDIHCNLAVETPGFYKLVTEGKITAIQGTIASYEGSQAVLTTGRKVPADLVVMATGWRQDVPVLDATDRAKLIDADGQYRLYRWVVNPDLPDLGFVGFNSSFATNLSAELGANWLVRYMDGQLAHPPTRAEMERDISRLRTWRQAERPSAKGYGGLCIAPYHNHHFASLLADIGVPTREANPVTAVFAPLRPPVYADLLARAPVYRAEAAPRPTALKSVETSRAA

SEQ ID NO: 61328 - protein, 231 aa, Triticum aestivum
  misc_feature (38)..(38): Xaa can be any naturally occurring amino acid
LLHSRQAPGDTAIDRWTPSTAPSPCDGHRTVWSEPSEXRPPGRTKFKETRHPLYRGVRRRGPAGRWVCEVRVLGMRGSRLWLGTFTTAEMAARAHDAAVLALSGRAACLNFADSAWRMLPVLAGPFSTAKEIKDAVAVAVLAFQRQHPVASMAPLSPARTTDDEKEIDGSPAPSALFMSSELLNEHWFVGIDPGSCYSEGLFMESPDTRPWREDLELGGVETPPWSLVRLK

SEQ ID NO: 61329 - protein, 802 aa, Listeria innocua Clip11262
MLVSYNWVKEFFQDFPLTAEELGEAITRTGIEIEGVEELSASLKNVVVGEVLSCERHPDAEKLNKCLVQTDEEEPVQIICGAPNVAAGQKVIVAKVGARLPGGLKIKRAKLRGEVSEGMICSLAELGFESKVVPKAYADGIYVLPEHVETGVSAITLLGLDDAILDMAITPNRADALSMNGVAHEVGAIIHQKPAQPTEPDVSEKGKADDFISVEVENPTETPYYAIKMVENIEIKESPLWLQTKLMKAGIRPHNNVVDVTNYINLLYGQPLHSFDYDKIGSKKIVVRSAKDQEEITTLDGEKRILQTGHTVITNGTEPIAIAGVMGGEFSEVTETTTTVALEGAIFSSSSVGKASRELYLRTEASIRYDKGSDAWKVEKALAHGGALIAELSGGTLVGGVVEVDNREKAVNKIETSLTRINRILGTEISLSEIETIFDRLGFVLEVKEDTLIIEVPTRRWDITIEADILEEVARIYGYDEIPVTLPATSTTGGLSDSQKARRVMRAYLEGAGLNQALTYSLTSKKDATRLALSDEKTVALSMPMSEEHSHLRTSIVPQLIRSASYNIARKNMDVALYEMGTVFYATEGDNLPIEQEHLAGLITGNWHTADWQKTPKPVDFFVLKGIVEGLVNKLGIEAELHWKQIEKEELHPGRTASIQLEGKEIGYLGALHPAVEASYDLKETYVFEINVKALLDATKEKVVYHPIPRYPEMTRDLALLVDKDTDHATISQVIKEHGGNLLVDIELFDIFEGESLGENKKSLAYTLTFLDSERTLVEEDVQKATNKVVEALQAKLHAIIR

SEQ ID NO: 61330 - protein, 173 aa, Hyacinthus orientalis
MDEVLTATDVSSASSAAAAAGQSPLPLATNLPFVSALLAFSIAQFLKLFTTWFKEKRWDSTRLLGSGGMPSSHSATVTALAVAIGLQEGTGGSLFALAAILASIVMYDASGIRMHAGRQAELLNQFVCELPPEHPLFNVRPLRDSLGHTPLQVCAGALLGCFVSLIMRNSSSV

SEQ ID NO: 61331 - protein, 115 aa, Glycine max
DKKEDQKKKEKQMAALGGFTDITGAQNSIDIENLARFAVDEHNKKENAVLEFVRVISAKKQVVSGTLYYITLEANDGVTKKVYETKVLEKPWLNIKEVQEFKPITVAVNPLSVTV

SEQ ID NO: 61332 - protein, 220 aa, Hyacinthus orientalis
ADLNIAIGTHHEVSHPGALKAALAEFISTLIFVFAGQGSGIAFSKLSGGGPATPAGLISAALSHAFALFVAVSVGANISGGHVNPAVTFGAFLGGNITLFRGLLYWVAQLLGSTAACLLLRFSTGEETGSFGLSGVSVWNALVLEIVMTFGLVYTVYATAIDPKKGSLGTIAPIAIGFIVGANILAGGAFDGASMNPAVSFGPPLVSWEWPNHWVYWAGP

SEQ ID NO: 61333 - protein, 993 aa, Delphinium 'MagicFountains dark blue'
MKSIFKKLHIGSSSRSSSSTNHDPNRSNELSSSQSLPATTSDHGTNSVQFTTAPTPLTSSYPGIPVSTPATLASDRTDYFSSEEEFQLQLALAISASSNSEFREDPDKDQIRAATLLSLDRNRNDLRRQENESAESLSRRYWDYNVLDYMEKVVDGFYDIYGLSSNPSSQGKMPSLVDIQRDHGDPNFEVVMVNRAVDPALVELEQIAHCIVLDCPSSNVGLLVQRLADLVTEHMGGPVMDANIMLARWMERISNLRTSLHTSVIPIGSVNIGLSRHRALLFKVLADNVGVPCRLVKGSHYTGIDDDAVNIIKLENQREFLVDLMAAPGTLIPADFLSTNDSSGNSYNPRLSETLTSWATQESEVGRSRGETSFGEHNGGDRKSAINYETALDRKSSFDKVPEPSVPIASSGLPFVSFGNGYSEDSKGVDSAKQLYIGSSFPYKGNQEGTSVGDVFKTFDAPPYTQDNVDSKALFADLNPFQMVGVGKDSVKSKPTESDGNNLQRQKERLNLGPGRPPLPLVWKNRSANEVPRTKQYGFVEGPFPKNNQEDRGYNTSIPLSSSGNLEKLYPNVNAAEFSGVSSVARKSIGDGSSSHHGNSTSESSANQHNRLHADRVGNTDTTQTSNQFRDENHHQRDGEILRNSIVDETKECEKNFLAEHDRRKYTHDRYMGGRVIAMDTGGNSSSVDSGRSRPDPMLDDVAELEIPWEDLSIGERIGLGSYGEVYRADWNGMEVAVKKFLDQDFYGDALDEFRSEVRIMRRLRHPNIVLFVGAVTRPPNLSIVSEFLPRGSLYRILHRPNCQIDEKRRIRMALDVAMGMNCLHTSIPTIVHRDLKSLNLLVDDNWNVKVCDFGLSRLKHNTFLSSKSTAGTPEWMAPEVLRNEPSNEKCDVYSFGVILWELATLRLPWTGMNQMQVVGAVGFQNRRLDIPKELDPLVATIIRECWQTDPNLRPSFSQLTAALQSLQRLLIPSHQDQQSFPLPQEISVSSTP

SEQ ID NO: 61334 - protein, 274 aa, Triticum aestivum
  misc_feature (195)..(195): Xaa can be any naturally occurring amino acid
MSRFGRSGPPPIRDTYSLLVLNITFRTTADDLFPLFDKYGEVVDIYIPRDRRTGDSRGFAFVRYKYEDEAQKAVDRLDGRLVDGREMMVQFAKYGPNAERIQKGRIMETVPKPRGRSRSRSPRRGYRDYHRGRDSRRRSRSRSGDRYGRDRYRERDHHRRSRSRSTSPDDYKRRGRDRSPSRSRSRSYSPDDDKXGRDSLSPARRSTSRSPRKTPPPREGSPAKRNDDRSPAKRNDDRSPVRRNDDRSPVRRNDDRSPVRRNDDRSPDSRSPST

SEQ ID NO: 61335 - protein, 405 aa, Vibrio parahaemolyticus RIMD 2210633
MAGVLGMILAGGEGSRLRPLTESRSKPSVPFGGSYRLIDFALNNFVNADLMRIYVLTQFKSQSLFHHLKKGWNINGITDRFIDPIPAQMRTGKRWYEGTADAIYQNLRFMELEEPDQVCIFGSDHIYKMDIKQMLNFHTEKKASLTVSALRMPLKEASQFGVIEVDAEGRMIGFEEKPANPKSIPGEPDFALVSMGNYVFEAQVLFSELVEDADNEASSHDFGKDIIPKMFPRGDVFVYDFSTNRISGEKEEVYWRDVGTIDAYWQAHMDLLEKDAPFSLYNRKWPLHTYYPPLPPATFTDSDNGRVQIIDSLVCNGSYVRGSRIEKSVLGFRSNIASACDISECILLGDVKIGEGCVLRRVIVDKDADIAPGTQIGVNLQEDKKHFHVSEEGIVVIPKGARVGY

SEQ ID NO: 61336 - protein, 598 aa, Oryza sativa (indica cultivar-group)
MYSLQSLVLSRNRLNGTVPKLSGLAFLDELDLGHNRLGPAFPEVGNAVVRLVLADNNFTGKIPAEVSSLGQLQFLDVSGNRLQGWIPSSIFALPALRHIDLSRNQLAGQLPASTACADALAFVDVSDNLLAGARPACMRGNSSARTVLDAGNCFRDARSQRPSTYCNPGALAAVLPPAQGTGGEQGSGGKGGQVGMALGIVGGVVAGAALIALVMMAVLRRARRQNPEVSVLPKSLPPAKKKAAADGGKAPAKVTQRIVTPAEKRHASQAARVNTLEVPAYRVYTLEELQEATNNFGSSNLIKSSPVVKHYNGQLQDGSRVSLRCLKLKPKYSPQSLTQYMEIISKLRHRHLVSIIGHCIVEDQENPNIASSLCLLSECVTNGSLRSHLTEWRKREMLKWPQRVSAAIGVARGIQFLHDVTAPGIVHNDLSIENILLDKTLTSKISNFNLPLISTSKNGKIFSESPFATSEDNDLGSVPSTEQGDKDDIYQFGLILLEVITGKPTESPKDLDSLKTQISEAIAEDPDLLKDMADPTIRGTFAVESLSTVAEIALNCAASDTSSRPSIEDVLWNLQYSMQVQDGWASSESLSMSTRSQG

SEQ ID NO: 61337 - protein, 797 aa, Thermus thermophilus HB27
MRWVRFFHEVGLEDVPLVGGKNASLGEMIRELSPLGVRVPEGFATTSEAYWHFLEHNGLKEAIARELGELDPEDPKALQRVSRRLRNLILKGEYPQDLREEILEAYRRLSEEAGEEEIPVAVRSSATAEDLPTASFAGQQESFLYVQGEEDLLLHVKRAMASLFTARAISYRAHMGFDHLKVALSVGVQRMVRADEAASGVIFTLDPDTGHRGFVYLTAIYGLGENIVQGRVTPDGYYVHKETFREGFRAVVYRRLGAKELTLAFDPREGRLKNRPTPLHLRNRFALRDEEVLLLADWALKIEDHYSRKRGSPTPMDIEWAKDGPTGELFVLQARPETVHSQKTPVLRVFRLLKRGEVLAEGLAVGEAIAAGRARILKDPKEMDRFQEGEVLVTETTNPDWEPIMKKAAAIVTERGGRTSHAAIVARELGVPAVVGAVGATRSVPEGEEVTVSCAEGERGVVYRGRLPFEVEEIRPETLPRTRTRILVNVGTPEEALRTSLLPTDGVGLLRMEFVFASHVRVHPLALTRFETLPKEVRRQVEEVTEAYPDKRAYFVERLSEGIGLIAAAFYPRPVLLRFSDFKTNEYARLLGGHLFEPKEENPMLGWRGASRYYHPDYKEGFLLEVAAVKRVREEMGLKNLMVMVPFCRTPEEGEKVLEVMAEGGLRRGEGGLEVHVMAEIPSNVLEAEAFAEIFDGFSIGSNDLTQLALGLDRDSERVAHLFDERRETVKRLAAMLIEKAHAKGKKVGICGQAPSDYPEFAAFLVERGIDSLSLNPDALLRTVREVAEVERRLGIG

SEQ ID NO: 61338 - protein, 680 aa, Oryza sativa
MAPPPPSPPCRPRVKPERALLCFSLLLLLTATTANASITDCPTTSSTNSSHVDDGAFGANLRALLSSLSAAAAASSSGFAENATGAAPDTAYGLAQCRGGIVGGGNGTSCRSCLDDSVRDAAKACPGEKSAVIISDYCLVRYSNASFAGAADERTVKLWWNTDNATQPERFKSLLGTLMGNLTDAAARASSPLMFAAGETDLPPFTKIYGMAQCTRDLAAGDCYRCLVGAVNNIPKCCDGKQGGQVITRSCSIRFEVYPFFDAQAAKAAMSPAPAPAPVTTPTGVNGSNHTVSKSVIVPVTVGVAVLLVVILLLIALCLCKRNRKPHKHMMIGSVDLGDEDEMRGSESLLYDLSTLRAATANFSEENKLGEGGFGPVYEGTLQNGQEIAVKRLSATSHQGQLEMKNEVVLVAKLQHKNLVRLLGCCIEEREKILVYEFLCNKSLDTILFDTSRQQDLNWEQRFKIIEGIGRGLLYLHEDSRLKIIHRDLKASNILLDVDMNPKISDFGLAKLFNMEASVANTSRIAGTYGYMAPEYALHGIFSAKSDVFSYGVLLLEIVTGRRNTCLHDSEDLLAFVWRHWSRGGAGELLDGCPAAGRRPQELLRCIHVGLLCVQEDPQLRPGMAAVVVMLNSRSVTLPAPSAPAFVSASRGIGGSPPPAAAAGDAPARSTDHEVPTAAR

SEQ ID NO: 61339 - protein, 415 aa, Burkholderia sp. 383
MSADAAPASPSVQDRIQHVFVLMLENRSFDHLFALSGYPDIVAASPGNSNAYGDAVYPFGGGAPDRMPTDPCHEFTDVLEQLCGAGVPFVKGQPYPPVGNTGFVSNYATSHSEGTPPQPADAGKIMQGVNIATQAPSLSALANAFVLCDAWHASMPGPTWPNRFFLHGASSAGLDHSPTKEEMAGWDAFDGFPYPKGSIFAALGDDNWRIYQDQTGDPLGHVPQVASLKGISFFDIDDLAHFEADLAAGYTARYTFIEPGYGDIVHGTYQNGSSQHPMDGLAGGDQLAARVYNAIRNSPVWNNSLLVICYDEHGGFYDSVRPAAAPPPNDGAAATLNASGFGFDVYGVRVPAIVISPWVAAGQVDHTPYDHASVAATLERLFGFAPLTDRDRLANDLLALVTATCRTDCPQRIGS

SEQ ID NO: 61340 - protein, 339 aa, Brassica napus
  misc_feature (46)..(46): Xaa can be any naturally occurring amino acid
  misc_feature (136)..(136): Xaa can be any naturally occurring amino acid
MAGGKIKIGINGFGRIGRLVARVVLQRDDVELVAVNDPFITTEYMXYMFKYDSVHGQWKHNELKVKDEKTLLFGEKPVTVFGIRNPEDIPWGEAGADFVVESTGVFTDKDKAAAHLKGGAKKVVISAPSKDAPMFXVVGVNEHEYKSNLDIVSNASCTTNCLAPLAKVINDKFGIVEGLMTTVHSITATQKTVDGPSMKDWRGGRAASFNIIPSSTGAAKAVGKVLPQLNGKLTGMSFRVPTVDVSVVDLTVRLEKAATYDQIKKAIKEESEGKLKGILGYTEDDVVSTDFIGDSRSSIFDAKAGIALSDNFVKLVSWYDNEWGYSTRVVDLIVHMSKA

SEQ ID NO: 61341 - protein, 327 aa, Escherichia coli
MSERHLPDDQSSTIDPYLITSVRQTLAEQGAALQNLSKQLDSGQYQRVLNLIMNCKGHVILSGMGKSGHVGRKMSATLASTGTPSFFIHPTEAFHGDLGMITPYDLLILISASGETDEILKLVPSLKNFGNRIIAITNNGNSTLAKNADAVLELHMANETCPNNLAPTTSTTLTMAIGDALAIAMIHQRKFMPNDFARYHPGGSLGRRLLTRVADVMQHDVSAVQLDASFKTVIQRITSGCQGMVMVEDAEGGLAGIITDGDLRRFMEKEDSLTSATAAQMMTREPLTLPEDTVIIEAEEKMQKHRVSTLLVTNKANKVTGLVRIFD

SEQ ID NO: 61342 - protein, 147 aa, Triticum aestivum
MRGVGGPLLTVSDLLSDLAVEGGDDHLDGGGDASVPSSPLAAHQVEEADPSELQRLFAEDYDNLMKSLQENDPSWPSLMLKLCRALKTSDKLLSCANVKAEQLLEKVEKLEHVLERGDRAVGSIIEVLQSMQLTEDHQTSKSHPPSK

SEQ ID NO: 61343 - protein, 465 aa, Pseudomonas syringae pv. phaseolicola 1448A
MQPETLDNDDLIYGLNDRPRPLTAILAAFQHVLASFVGIITPPLIIGSTLGLTQYLPYLISMALMVSGTGTFIQARRPFGIGAGMICLQGTSFAFLGAVLSAGFLVKQRGGSPEDIMAMIFGVCFFGALVQIVLSRCIGQLRRVITPLVTGIVITLIGVSLIKVGVTDLVGGFNATDFGAPLNLALGAFVLAVIIVLNRSNTPWVRLSAIIIGLAVGSLAAWFSGKLIPQPIHDLPLISVPVPFRFGFSFDWTAFLPVALIYLISSIETVGDLTANCMLARQPISGPSYVARLKGGVLGDGVSCMIAATFSAFPNTTFAQNNGVIQLTGVASRYVGLYIGAVLFVLGLFPHIGAIVQQIPKPVLGGARLVMFGSVAAAGVRILAQSPLDRRSMLIIATSLGVGLGIAAQPALLHQMPKLVQNLFDSAITSGGITAIVMCLLIPEGKVAVTRNDSATEPNPLEQPR

SEQ ID NO: 61344 - protein, 340 aa, Oryza sativa (japonica cultivar-group)
MATTQLLSTVEHRETLPEGYARPESDRPRLAEVATDSNIPLIDLASPDKPRVIAEIAQACRTYGFFQVTNHGIAEELLEKVMAVALEFFRLPPEEKEKLYSDEPSKKIRLSTSFNVRKETVHNWRDYLRLHCHPLEEFVPEWPSNPAQFKEIMSTYCREVRQLGLRLLGAISVSLGLEEDYIEKVLGEQEQHMAVNYYPRCPEPDLTYGLPKHTDPNALTILLPDPHVAGLQVLRDGDQWIVVNPRPNALVVNLGDQIQALSNDAYKSVWHRAVVNPVQERMSVASFMCPCNSAVISPARKLVADGDAPVYRSFTYDEYYKKFWSRNLDQEHCLELFKGQ

SEQ ID NO: 61345 - protein, 336 aa, Streptococcus pyogenes
MVVKVGINGFGRIGRLAFRRIQNIEGVEVTRINDLTDPNMLAHLLKYDTTQGRFDGTVEVKEGGFEVNGNFIKVSAERDPENIDWATDGVEIVLEATGFFAKKEAAEKHLHANGAKKVVITAPGGNDVKTVVFNTNHDILDGTETVISGASCTTNCLAPMAKALHDAFGIQKGLMTTIHAYTGDQMILDGPHRGGDLRRARAGAANIVPNSTGAAKAIGLVIPELNGKLDGAAQRVPVPTGSVTELVVTLDKNVSVDEINSAMKAASNDSFGYTEDPIVSSDIVGVSYGSLFDATQTKVMEVDGSQLVKVVSWYDNEMSYTAQLVRTLEYFAKIAK

SEQ ID NO: 61346 - protein, 183 aa, Fagus sylvatica
DGHGGSHVAMRCRDRLHDIVKEEVESVTEGMEWKDTMEKSFDRMDKEVQEWLVPIKTTNCRCDVQTPQCDAVGFTAVVAIVTPEKIIVSNCGDSRAVLCRNGVAFPLSSDHKPDRPDELVRIQDAGGRVIYWDGARVLGVLAMSRAIGDNYLKPYVISEPEVTITDRTAEDECLILASDGLWD

SEQ ID NO: 61347 - protein, 143 aa, Oceanospirillum sp. MED92
MSQLPPNLNSTDKVILFDGACKLCNGWANFIIKHDKARQFKLCSVQSEQGKVILEHFGYPRSFYETMLYVEGGQCFEKSEAFLNIVLQLGYPWKTLNLFRVLPSAIRNWLYDRIALNRYKLFGKYDYCQLPSPDYQGRFLDDN

SEQ ID NO: 61348 - protein, 206 aa, Fagus sylvatica
DGHGVLETSRYVNNHLFQHLKRFTLEQHSMSVEVIRKAYQATEEGFLSQVTKQWPLKPQIAAVGSCCPVGVICGGTLYIANLGDSRAVLGRVMKATGEVLSIQLSAEHNVAIESVRQELHSLHPEDPQIVNLKHNVWRVEGLIQISRSIGDVNLKKAESNREPLYAKFRLREPFKKPILSADPAISVHQLQPHDQFVILASDGLWD

SEQ ID NO: 61349 - protein, 288 aa, Azoarcus sp. BH72
MSDKDSGHRLPPQHQDEQPGRENEMRPQPEDRMHGYRGSDKLAGKVAIITGGDSGIGRAVAIAFAKEGADVAVAYLEEHEDAEQTRREVELQGRRCLLMAGDIGNESFTAKLVEQTLSAFGRLDIVVNNAAEQHPQENFEDISREQLERTFRTNLFSMFDLCRHALPHLQQGACIINTTSVTAYRGSAHLIDYSATKGAIVSFTRSLAQALAAKRIRVNAVAPGPIWTPLIPATFKAEEVEKFGAKEPLGRPGQPDEVAPSFVFLASQDASYVTGQVLHPNGGEIVNG

SEQ ID NO: 61350 - protein, 456 aa, Pasteurella multocida subsp. multocida str. Pm70
MFFPTQLNSKVRYVLHKKLRQTHRISRKSLEFSALLIGAALVALFSLGFAKLADLGLEWNAHWSAQYPLTVWLVLPSGLALLAWFTAKYTPYVAGSGIPQVIAAISLPHGNNKSRLVAFWQTLWKIPLTFLAMLIGASVGREGPSVQVGAAVMLAWGNLCRKKGIAFNGLSANELMATGAAGGLAAAFNAPLAGVIFAIEELGRGVLLRWERRVLLGVLAAGFILVAIEGNNPYFPQYHGETSVPYLFLWVSLCGVVCGFFGGIFARLLVKGLAGLSPSKIRGWIRRHPIYVAFILGLFLAALGTYTQGKTYGTGYYVVADALDGQPLSSEFGLLKLLSTVATYWTGIAGGIFTPALTTGAGIGAQIWAMTGSIVDQRLLVLLCMAGFLAGATQSPVTASVVVMEMTGCQPVLFWLLICCLVSSIISRQFHPKPFYHFAAGRFRQRIQEDTREQEK

SEQ ID NO: 61351 - protein, 497 aa, Zea mays
  misc_feature (218)..(218): Xaa can be any naturally occurring amino acid
  misc_feature (227)..(227): Xaa can be any naturally occurring amino acid
  misc_feature (235)..(235): Xaa can be any naturally occurring amino acid
MASKRANAGDEQQKLSPSGLPVHKIPGSYGVPFFTPLRDRLDYFYFQGAEEYFRFRVAKHGGATVLRVNMPPGPFLSGDSRVVAVLDARSFRVLLDDSRVDKDGTLDGTYMPSLALFGGHRPLAFLDGADPRHAALKRVMIRLAAAGMQHVAPAFGAAFTATFDAVEAGMAGGASAVEFNKHNMRHMLDFTCASLFGGKLPSKAIGDGAAAKAFKWLXPWPLEDLLXHTFRLPPXLVRRDYAELTAYFADVAAGVLDDAEKAEPGAVPRDELLHNLIFLAIFNAYGGYKIFLPHVVKWLARSGPELHARLADEVRAVVPPGSASAGDAITLSDVEKMPLVKSFVWETLRMNPPVEFQYGRARQDMVVESHDAAYEVKKGEMLFGYQPLATRDERVFRRGREFVPDRFAVCSDDERRRLLDHVVWSNGPETGAAAERNKQCPGKNAVVAVGRLMVAELFRRYDTFVASVHETPVEPVVTFTSLTRASSAAGHGSSVKP

SEQ ID NO: 61352 - protein, 216 aa, Nocardia farcinica IFM 10152
MTDTTLRHRTARVERVTKESSIVVELDLDGTGRTDISTGVPFYDHMLTALGAHASFDLSVRAEGDIQIEAHHTVEDTAIVFGQALGKALGDKAGIRRFGDAFIPMDETLAHAAVDVSGRPYCVHTGEPEHLLHAVIPGSPVRGTGEPGAPYSTVLNRHVFESIALNARIALHVRVLYGRDQHHVTEAEFKAVARALRAAVEFDPRVSGVPSTKGTL

SEQ ID NO: 61353 - protein, 60 aa, Oryza sativa
RPEQARIVEEAVACTDMALERGGAYIRAQGALSRMFDPDLILYIKRAVTIPFMAIARIGH

SEQ ID NO: 61354 - protein, 668 aa, Prochlorococcus marinus str. AS9601
MVAASVSLESLCVNSIRMLAVDAVNKSNSGHPGLPMGCAPMGYALWQNILNHNPNNPKWFNRDRFVLSAGHGCMLLYSLLHLTGYKSVSIEDIKEFRQWGSKTPGHPETFETEGVEVTAGPLGAGISNAVGLAIAETHLAAKFNKPDCNIVDHYTYVIMGDGCNQEGIASEACSLAGHLKLGKLIALYDDNQITIDGRTDVSFTEDVLKRYEAYGWHVQHVEDGNHDVKGITEAIEKAKLITDKPSIIKISTTIGYGSPNKSDTAGIHGAAVGEEEAALTREFLNWEYPPFKIPDEVYTHFRKSINKGENLEQEWDSKFEEYQKKYPSEGAELKRMLEGQLPENWDSDLPSYSPNDKGLATRKHSQICLGALGPNLPELIGGSADLTHSNYTDIKGETGSFQPHSPEKRYLHFGVREHAMAAVLNGIAYHNSGLIPYGGTFLVFADYMRGSMRLSALSELGVIYVLTHDSIGVGEDGPTHQPIETIPSLRAMPNMLVFRPGDGNETSGAYKLAIQNRKRPSALCLSRQGMPNQENTSIDKVALGGYVVSDCEGTPDLIFIGTGSELNLCIEASKELSSLGKKIRVVSMPCVELFEEQEESYKESVLPSSVKKRVVVEAAHSFGWHKYTGFDGLCITMDRFGASAPGGECMKNFGFTVENVVNKTKEIL

SEQ ID NO: 61355 - protein, 416 aa, Pasteurella multocida subsp. multocida str. Pm70
MDYFQYQQAQLMAEQVPVKHIAQQYGTPLYIYSRATLERHWHAFNNALGDHPHLICFAVKSNPNIAILNIMARLGSGFDIVSQGELERVLAAGGEPSKIVFSGVAKTETEIARALEVGIRCFNVESVAELYRINQVAGEMGKTAPISLRVNPDVDARTHPYISTGLKENKFGISVAEARNVYQLANQLPHIQITGMDCHIGSQLTELQPFLDATDRLIVLMEQLKQDGIQLKHLDLGGGLGVPYTNENPPHPSEYASALLDKLKAYHELEIILEPGRAITANAGILVTKVEYLKHNEDRHFAIVDAGMNDMIRPALYQAYMNIIEVDRTLTRDKAVYDVVGPICETSDFLGKQRELAIAAGDYLAQRSAGAYGASMSSNYNSRSRTAEVMVDGDQVHLIRRRETLEELWALERLLP

SEQ ID NO: 61356 - protein, 456 aa, Prochlorococcus marinus str. AS9601
MRSSWIKPRLGKDNVTQMNFARNGYITEEMDFVAKKENLPSSLIMEEVARGRLIIPANINHLNLEPMSIGIASRCKVNANIGASPNASDINEEVEKLKLAVKYGADTVMDLSTGGVNLDEVRQAIIQESPVPIGTVPVYQALESVHGSIDRLTEDDFLHIIEKHCQQGVDYQTIHAGLLIEHLPKVKGRITGIVSRGGGILAQWMLHHFKQNPLYTRFDDICEIFKKYDCTFSLGDSLRPGCLHDASDDAQLAELKTLGELTRRAWEHNVQVMVEGPGHVPMDQIEFNVRKQMEECSEAPFYVLGPLVTDISPGYDHISSAIGAAMAGWYGTSMLCYVTPKEHLGLPNAEDVREGLIAYKIAAHAADIARHRAGARDRDDELSHARYNFDWNKQFELSLDPERAKQYHDETLPEEIFKKAEFCSMCGPKHCPMNSKISDESLDQLKDKLEECNTSV

SEQ ID NO: 61357 - protein, 307 aa, Triticum aestivum
  misc_feature (201)..(201): Xaa can be any naturally occurring amino acid
  misc_feature (232)..(232): Xaa can be any naturally occurring amino acid
KELEEQQARSRIWDETWLSGFFYKPCNYELFVKQSLNMEMAIVMARESGMDWIMHLDTDELLYPGGASEYSIRRLLADVPEDVDMVIFPNYESSVERDDIKDPFSEVSMFKKNYDHLPKDTYFGMYKEATRGNPNYFITYGNGKSAARIQDHLRPNGAHRWHNYAKSPNEIKLEEAAVLHYTYTKFSDLTSRRDRCGCKPXRRKDVKGCFMLDFDRAAFIIASTASEEDMLXWYNERVVWNDKQLTLKLLRKGVLTRIYAPMAIVQGLRESGVFTSVIRAAVDNAKVRLKESVDRNSTDPDYAKLCR

SEQ ID NO: 61358 - protein, 172 aa, Zea mays
MASLSSMQMVHTSQIGVKSQLVSSANRTSQSVCVGARSSGSALSSRLHYAASFPLKKQFPGAYATIKNQRTACVKSMAAEEEEVIEPQAKVTNKVFFDVEIGGEVAGRIEMGLFGDVVPKTVENFRVLCTGEKKYGYKGSSFHRIIKDFMIQGGDFTEGNGTGGISIYGAKF

SEQ ID NO: 61359 - protein, 230 aa, Streptococcus pneumoniae
MVKLVFARHGESEWNKANLFTGWADVDLSEKGTQQAIDAGKLIKEAGIKFDQAYTSVLKRAIKTTNLALEASDQLWVPVEKSWRLNERHYGGLTGKNKAEAAEQFGDEQVHIWRRSYDVLPPNMDRDDEHSAHTDRRYASLDDSVIPDAENLKVTLERALPFWEDKIAPALKDGKNVFVGAHGNSIRALVKHIKGLSDDEIMDVEIPNFPPLVFEFDEKLNVVSEYYLGK

SEQ ID NO: 61360 - protein, 268 aa, Hyacinthus orientalis
ALRFLAMAIALAASSVLAVDEADVRPTPVKFSKSSFPSGFVFGSASAAYQIEGAAKEGGRGPSIWDYFIDKHPVFFTEKIADRSNADVAIDFYHRYKEDIELMKDTGINAFRLSLSWSRILPNGKISGGINKEGVEFYNNVFNELLSKGIQPYVSIFHWDLPQSLDAEYGGFLSHRIVEDYKAYTDLVFELYGDRVKHWITFNEPFSFCFYGYASGDVCAWALLQISWGVPRGTLAVSLTSLPITCCLLMPLLLSSTETNFRHHKREP

SEQ ID NO: 61361 - protein, 440 aa, Triticum aestivum
MDSRHQRLATLTKALTAHVNAGRHREALAFFARMASDPALPPLADPSFAYALPLALKSAAALRLPSSAAAAPIHALARKCSGLLSNPFVASALVVSYGACAGSSPESARRLFDELPGRTAVVWSAMISVYVRSGDVAAAARALGEMDVVPTASCFNSVIAAVAESGDRPARAVELYRRMQGMGVRPSLITLLALVPVCTALGALGSVREVHSFALRHDMFASCHLGSSLIEAYGQCGSLVGAQRVFDLVDERDVVVWSAMVSAYAFHGHGNVAMSLFRRMELDKVRPDGIMFLGVLKACGHAGRADEALKYFDVLTKTHGVEACGDHYSCLVDVLGRAGRLHQAYDVIRTMPVRVTAKAWGALLAACRKYGEVGLAEVAARALFEIEPENAGNFISLANIYSGLGMHEEAERVRRDMEQRGLQSSPGSSWTIHRKSSELV

SEQ ID NO: 61362 - protein, 159 aa, Hyacinthus orientalis
TKQTAPLQQKKMEQTFIMIKPDGVQRGLVGEIISRFEKKGFYLKAMKLITVERSFAEKHYEDLSSKPFFGGLVEYIISGPVVAMVWEGKNVVLTGRKIIGATNPADSAPGTIRGDYAIMVGRNIIHGSDAVESARKEIGLWFPEGISNWQSSLNPWIYE

SEQ ID NO: 61363 - protein, 296 aa, Hyphomonas neptunium ATCC 15444
MIPRSAAIPKNWKTFDIPSFFSAFGYPAIGIGLFTTMILLGIFVSELTFHWWYLPIAFGVVAFSVFWCNLGIGPMHRILQHRAGEMKWPAQVLTMLNIIIAMQGNLRDWVNYHSQHHRFADGPGDPHNPFESKRWAWVGWILFRDRKDTARPMAAWLKQHPVIVWMDRFYNEISIVIHFVIPAVIYLIVWAAGGSLVLTALLHASVIIGRAIQFHATVYGINVLGHLKTPVWADHLMALLTGGEAFHDHHHDEPQSALHRPRKGVWNRIVDYNGTVLLLLEKIGWVKDLKIAPRFA

SEQ ID NO: 61364 - protein, 308 aa, Clostridium perfringens
MSNEKLFPTTFPVQNQSIHPGVEDEMNPLPIYDLPQYINDGKRLKNKVAIITGGDSGIGRAVSLAYAREGAKVCIIYLSDEEDKDANKTKELIESAGSEALVIKRDISDIDFCNSSVKKVIEKWGKLDILVNNAAVQHDSKTLDDIGPEQIENTFKINVFGTFYMTKAAVKYMECGSSIINTTSITAYRGNEILFDYSCTKGALTTMTRTLATMLVKNGIRVNAVAPGPIWTPLIPSSMNKKKVSEFGVNSPMGRAGQPVELAGAYVFLACNEASYISGITIHVNGGEIINGVVSMILTVLEYNILMI

SEQ ID NO: 61365 - protein, 314 aa, Azoarcus sp. BH72
MRLHLKPVSDQTIVVTGATSGIGLATVRMAVAQGARVVMAARNAQALATLAEGFHHLGRSAVAVPADVANVQDVQRIRDAALEAFGGFDTWVNNAGVSIFGRYEDVPLQDMRRLFETNFWGVVHGSMIALEILRERGGALINLGSEVSDIALPLQGMYSASKHAVKGFTDSLRMEVEAAGYPVSVTLIKPAAIDTPFVPHAANYMDVQPRLPSPLYAPEVVADAILYAAHQPKRDIYVGGAAKAFSASNRMMPRVMDKVSERFMIDQQRSERPVAHPTQATLYHPGGGLREMRGDSRPVHHRSLYTRLTTSIGR

SEQ ID NO: 61366 - protein, 270 aa, Pasteurella multocida subsp. multocida str. Pm70
MINKETQLCISLAGKPGNFGTAFHNYLYQKLGLNYIYKAFTTSDIEHAVKGVRALGIRGCAVSMPFKESCMPFLDEISASAKAIESVNTIVNEDGYLKAYNTDYIAISKLIQQYQLDKHHKVIVQGSGGMAKAVVAAFKNAGFHDLSVYARNATTGQYLANLYGYQYINHLEGNEASILVNATPMGMSGGEENTLAFPESLIEQASSIFDVVALPAETPLIQYAKQQNKQTISGAEVIVLQAVEQFELYTHQRPSETLIAEAAEFARSIR

SEQ ID NO: 61367 - protein, 115 aa, Nocardia farcinica IFM 10152
MSLDPAIAARLKRNEAGLVAAVAQERATGDVLMMAWMDDEALARTLATRKATYYSRSRQQYWVKGETSGHTQYVHEVRLDCDGDTVLLIVDQEGAACHTGTHTCWDGDVLLAEPA

SEQ ID NO: 61368 - protein, 333 aa, Candidatus Blochmannia floridanus
MITKIGINGFGRIGRVIFREAQERTDIEIVAINDLLNIEHIAYLLKYDSTHGKFQGNIKTYSDHLIINDKTIHYTSKKKPIDLNWKNLGVDVVIESTGMFLTQEYAQGHILSGAKKVILTAPPKDDNIPMFVMGVNHDSYQGSKIISNASCTTNCLAPIAKIIHDHFGIIEGFMTTIHAVTSTQKTVDSPIHKDWRSGRSAYQNIIPSSTGAAQALGKVITDLHGKLTGMAFRVPILNVSVIDFTVRLKKSVSYKNICDVIKDASEHTFKDIIGYTEEKLVSSDLNGEKLISIFDAKSSMLLNNHFVKLISWYDNETGYSNKVIDLSNYIMKN

SEQ ID NO: 61369 - protein, 332 aa, Prochlorococcus marinus str. AS9601
MKKKKVICIGEALIDRIRNKSNKGFTDFLGGAPANVACALRKLKIDSIFMGSLGNDDYGKKFISQFDQLGVNLDFLQLNNDSSTRVVNVNRDQFGDRFFSGFEESSHACYADEVLSKKLIEKEILNLEKSFLEIKYLVTGTNLLSSPISAETIFFLIEQANKFEVKIVIDLNWREVFWDHASFSSEISKAARVNLIKNFLNYANVLKLAKEEAILFFEDENPLLISQRLSNRPDVIITDGKNPVLWSINGFQGITETPTSQKIVDTTGAGDAFLAGFISKLISSGYPTSDLEIEDCIKFAGVCGLLTCLGEGAIEQQPYYEKVNKFLGSLIS

SEQ ID NO: 61370 - protein, 751 aa, Aspergillus nidulans FGSC A4
MRFILSLLLLLPFTTAGFSPTCIRVVTALAARPNDLFNKFQREICDQGCQPTVPHWDLWTRNNTFVPAVRSLMQTLNAPKQEEALLKLGDDAADIIKRQCGPKLEGRDICADGHTLAAFGNCFKTNFLKAAIANLPTLLPMVSEPVCRKPVPARTYRRTRKWLRRFFYLSLATGIVYVFDNQFYASSITRTARTFSLGVLVALDYKINFRPNPPLAGSIADVHARNAERLSDLLRHNGGLYLKIGQAIAMQSAILPPEFQKMFARMFDDAPQNSWKDVEKVIREDFGKSAEEVFGVSFSGDPTKGVMERVARASASVAQVHWARLADGREVAIKIQKREIAQQIQWDLWAFKVVTWIYSRIFDLPFYSLVPYVSERLFLETDFENEADNSEMMAKLVAGESRLRDRVYVPKVWRELSSKRVMTAEWIEGVRLWDKDAITRTWRGGWREGSPGCGGTPLDSPRANRSAPARSSFKIKPERNDWRGRNGRGGLGLSLKEVMTTMVDLFSAQMFLWGLVHCDPHPGNIFIRRKPNGHSELVLIDHGLYIHMDPEFRHQYARFWKALLTFDNATINEIVKGWGVNNPDIFASATLMKPYRGGNLSTQQGIERLSKAERAQRHYDMQQASRKAVREILGDETKWPQQLIFIGRNLRIVQGNNQFLGSPVNRIKITGLWASRALVESPDLRLTEKIRNYGRHLLFRVVLFSSDLFFWFTKVRQFLHLGGGMEDDLEAQMQSVAKDMGVELNHSIFEG

SEQ ID NO: 61371 - protein, 337 aa, Zymomonas mobilis subsp. mobilis ZM4
MTAINSATDRNQAASLKPLMHLVASDMQAVNQVILDRMQSEVPLIPELAGHLISSGGKRMRPMLMLACSRLIGEPRDIHYKLAAAIEFIHTATLLHDDVVDHSDLRRGKRTANNIWGNGPTVLVGDFLLSRAFEMMVESGSLRALEILSNAAAIITQGEVDQLVSQYQVETDEARYLSIIGAKTAVLFAASCRIAAVMAGCSKDKEQSLADYGQYLGIAFQLTDDAIDYMSDSQTMGKGVGDDFRDGKVTLPVILAYQRGEKADRDFWREAIEGRRVADSDLDIAKILLVNTDALSDTLERARLYGEKAIQSLKAFPDGAVKEALVEAVEFTIARAY

SEQ ID NO: 61372 - protein, 478 aa, Oryza sativa
MELGVPLPRRPVPGSYGVPFVSAVRDRLDFYYLQGQDKYFESRAERYGSTVVRINVPPGPFMARDPRVVALLDAKSFPVLFDVAKVEKRDVFTGTFMPSTSLTGGYRVCAYLDPSEPNHAKIKQLLLSLLVSRKDAFVPVFRSNFGALLDTVQSQLASGGGKSDFTALNDATSFEFIGKAYFGVRPSASSSLGTGGLDQGRLWLLWQLAPLTTLGLPMIIEDPLLHTLPLPPFLISSDYKALYAYFAAAASQALDAAEGLGLSREEACHNLLFATVFNSYGGFKLLLPQILSRVAQAGEKLHERLAAEIRSAVADAGGNVTLAALEKMELTRSVVWEALRLDPPVRFQYGRAKADLEIESHDASFAIKKGEMLFGYQPCATRDPRVFGATAREFVGDRFVGEEGRKLLQYVYWSNGRETENPSVDNKQCPGKNLVVLVGRLLLVELFLRYDTFTAEAGKKVVITGVTKASTSAVNRTA

SEQ ID NO: 61373 - protein, 171 aa, Brassica napus
MFRQSIAFTPPVHGSDAPPPPPQQQQSQQQPTVVNVSESSRRQQIAAASSSPVKSHPLHNFPLSDLRWAMNHANTHRLRKPSGRSPLREATNHGKGTEEVNEASGSSSFELKPEKQKKKDVVSESAADRSGTKSTAADGRSKIFIRIRTKNNEETSDVATTAVSAATVVAD

SEQ ID NO: 61374 - protein, 831 aa, Aspergillus nidulans FGSC A4
MTQLDLVEVDSLEAHVLIDNDLDPLSTISPDTVQVSGLMGHLAMNSPHHLKDRGDAHRELQMEDICCSAHGLSIILTATKGDQQHSILFDAGPEEEAWERNVRRMKPDLSSIELVQLSHWHRDHSGGLLRAVRMITEAKEAKGLSKDLIADLHPNRPDYRGFSIGENIISLQADPSFEELEAAGATVQKHDSAHTVLDDFFLISGEIPRRTPYEAGLKHGMRFDKEDNEWTSDEAIADERFIMCNVKADKGIVMLTGCSHAGVVNCTQHALELAGGSIPLHAVIGGFHLATSDANQIERSIKDLLKFDPAVLLPGHCTGWRAKFAIEKRQPGLLLLPTEYSKRPIRLFLYDRRFYLKGGIHAPMIPRDIISVTRFFFAVVKAQNEHRLYEFFKKSLEHGDPASPNCVESNIFGSFRVIQTREPEHLKAVLTGKFADFGKGELFHKLWIPFLGDSIFTTDGKEWQGSRNLIRPMFIKDRISDLDIFERKTQTMLSLYSPCGEPTDVVDLFYRMTLDAITEFLLGKGINSLENPQADFALAFADVQRIQTLLTMLGPAQYLYPRGRYNQGLKVINDFVWPFVHDTLGFQADDLKSSDKSFTFLHALANYTRSPKTIRDQVVSILLAGRDTTAATLSWAFYELSHYPEAYSKLRAEILDKVGPTRAPTYDDLKNMPYLRHTINEVLRLYPAVPYNIRFALTDTTLPIGGGVNGDLPITILKGDAVAYSTYAMQRRADLYPPVSEKFADPAIFSPERWEVWSPKPWHYVPFNGGPRICIGQNFALAEMGYTIVRILQRYERIEYVGDWERQFHKSEIVGTPGMGVKLRLYEARKP

SEQ ID NO: 61375 - protein, 737 aa, Clostridium thermocellum ATCC 27405
MNTTANIDEVYKVINAEHHDPFSVLGMHRLESENAMVVRAYLPNAKEIEVVELSKNNTYPMEKIDERGFFEVVIKDRNDFFKYNLRATDYVGNTFTFYDPYCFMPVISDYDLYLFNEGNHHKIYEKLGTHRMTIDGVEGTLFAVWAPCAKRVSVVGNFNQWDGRRHQMRVRGSSGVWELFIPGVGEGELYKYEIKTPHNEIYIKADPYAFYSELRPNTASIVYDIEGYEWHDADWMRERDSSNSFDKPISIYEVHLGSWKRVSNDENGFYSYRELADMLVEYVKYMGYTHIELLPIAEHPFDGSWGYQVTGYYAATSRYGQPKDFMYFVDKCHQNGIGVIIDWVPAHFPKDGHGLARFDGTALYEHYDPKQGEHPDWGTHIFNYGRNEVKNFLIANAMFWFDKYHIDGLRVDAVASMLYLDYGKKDGEWIPNRWGGKENVDAIEFMRQLNSTVFQYFPGVMMIAEESTAWALVTKPPYTGGLGFSYKWNMGWMNDFLRYMSMDSVYRKYHQNLITFSLMYAFSENFILVLSHDEVVHGKCSMINKMPGDYWQKFAGLRASYGYLYGHPGKKLLFMGGEFAQFIEWNYKQSLDWFLLDYDMHKKMQDYVRDLNKLYRSEKALYEVDFHYDGFEWIDCNDTEHSIISFMRKGKDWHNSLIFVCNFTPVPHEDYRIGSPFNTTYDEIFNSDWEKYGGSNVGNFEPIKAEEISMHNKPYSMRLRIPPLATIVLKPRFDRKD

SEQ ID NO: 61376 - protein, 504 aa, Bordetella bronchiseptica RB50
MKEHDAAQGGTRTETEVLLIGTGFSGLGMAVALKREGRRDFIVLERAGDVGGTWRDNHYPGAACDIQSHLYSYSFRPNPRWSRVYAPQPEILQYLRDTARDEGILDHVRFGANVVRAAWDAAQAAWLVDTTAGRFKAQVLISAAGHLSDPSFPDIEGLASFRGAVFHSANWDHSYDLAGKRIGVIGTGASAIQIVPELARNAGQLTVFQRSAPYVIPRRDHVYSEAEKGLFARFPEAAQELRDELFWGNESRFPQRRQVPAFIEQVTAMALSHLRKQVPDEALRAQLTPHYAIGCKRVLISNDYYPALQQPNVALETAGIARIDEQGVVLKSGGRVDLDLLVVATGFEAAELPIAERIHGRQGRRLSDQWRAGGQAFACTAVSGFPNFFLMLGPNTGLGAGSMIFMVETQINYIKGAVAFIFEHGAIVDPDPDAQRDYVESIYRRSAGTVWLDGGCSSWYLHPQSGKLTTLWPDFMTQFRKENGTFSRQGYQVALRAPHAAEQA

SEQ ID NO: 61377 - protein, 502 aa, Rhizobium leguminosarum bv. viciae 3841
MLHQKIVESPFKLKYGNYIGGEWREPVEGKYFENLTPVTGGKLCDIPRSNEKDINLALDAAHAAKEKWGRTSAAERSNILMKIAQRMEDKLELLAQAETWDNGKPIRETMAADIPLAIDHFRYFASCIRAQEGSIGEIDHDTVAYHFHEPLGVVGQIIPWNFPILMATWKLAPALAAGNCVVLKPAEQTPASILLWAELVGDLLPPGVLNIVNGFGLEAGKPLATSPRVAKIAFTGETTTGRLIMQYASQNLIPVTLELGGKSPNIFFADVMAEDDDFLDKALEGFAMFALNQGEVCTCPSRALVQESIYDRFMEKAVKRVEAIKQGNPLDTATMIGAQASSEQLEKILAYLDIGKQEGAEVLTGGARNDLGGELANGYYVKPTIFKGHNKMRVFQEEIFGPVVSVTTFKDEKEALEIANDTLYGLGAGVWSRDANRCYRFGREIQAGRVWTNCYHAYPAHAAFGGYKQSGIGRETHKMMLDHYQQTKNMLVSYSPKALGFF

SEQ ID NO: 61378 - protein, 273 aa, Glycine max
MCIALFLWQCHPLYPFLLLNNRDEYHNRPTKPVSWWEDCDILAGRDEIAMGTWLACSTQGRVAFLTNVLELHTLPEAKSRGDLPVLFLKSSKKPKEFAESLKSEAHYYNGFNLIVADIVSNSMVYISNRPKGQPITIQEVPPGLHVLSNDKLDSPWHKALRLEFSFKEHVAKHGEGEIPVKEVIQKLMKDTVKADKNSLPRICSLDWEFNLSSIFVEVETPLGLYGTRSSAALTVRSSGEASFYEVYLDDTKWKEHVIDFRIGKLNYVTDEVA

SEQ ID NO: 61379 - protein, 119 aa, Glycine max
  misc_feature (115)..(115): Xaa can be any naturally occurring amino acid
MASLDSDVTMVPAGESSSSVAPSSSSTKKAKRFEVKKWSAVALWAWDIVVDNCAICRNHIMDLCIECQANQASATSEECTVAWGVCNHAFHFHCISRWLKTRQVCPLDNSEWEFXKYGH

SEQ ID NO: 61380 - protein, 245 aa, Triticum aestivum
  misc_feature (175)..(175): Xaa can be any naturally occurring amino acid
MPSFIDGPSLRSLLRPSTNGRRTKTPDSAGGGEGGGGHGHGGGIFKMFKLMPMLSSGCKMVALLGRHNSRALLADHATTVTLFGHRRGRVSLAIHEDTRAPPVFLIELPMLTSALHKEIASGVVKLALESDTRSARRRLVEEYVWAVFCNGRKAGYSIRRKDASDDQRHVMRLLXGFSMGAGVLPRRPRKGPPALPPGPRRPSFPYVRRPRSSGVLRLPRTPEGVLTGSNPQQGAGVWKATVGAG

SEQ ID NO: 61381 - protein, 204 aa, Glycine max
MATSENNNARPQRVAKKRAAAAICELHRNAAKRKRVVLGDLTNVSSNYVAVTEKEIQKQKKVKREQPARPVSTPEKVEERHDPQLCGPYVSDIYEVFRVMEVDPSKRPLPDYVQKVQRDVNANMRGVLVDWLVEVAEEYKLVSDTLYFCVAYIDRFLSLNALSRQKLQLLGVASMLIASKYEEIKPPDVEDFCYITDNTYSKGK

SEQ ID NO: 61382 - protein, 363 aa, Methanothermobacter thermautotrophicus str. Delta H
MTYTSGRILGSMCTSSHPLARRVYCDFLESNLGDPGLFRGTRELESGVIGMLGELLSEPDAAGHIITGGTEANLMAMRAARNMAGAEKPEIIVPKSAHFSFRKAADILGLRLREAELDQDYRVDVESVRKLISENTVAVVGVAGTTELGRIDPVEELSEICLDEDIHLHIDAAFGGFIIPFLRETGAELPEFDFKLQGVSSITVDPHKMGLAPIPSGCILFRDASYLDAMSIETPYLTEKQQSTIVGTRTGASAAATWAIMKHMGREGYRKLALRVMGVTRRLRDGLVELDYQLVVEPELNIVAFNHPAMGPHELADRLEELGWAVSVSSCPPAIRVVLMPHIMEEHIELLLRDLEGIRLREE

SEQ ID NO: 61383 - protein, 684 aa, Methanothermobacter thermautotrophicus str. Delta H
MTGARNWLNKPLIFFKFNNHHTASPGDKMVKYVAFFEELGKDDVGIAGGKGANLGELTQAGIPVPPGFVVTAATYDKFMTDTGLQPVVMEMLENLDVNDTKELQRVSAEIKDIITSTEVPEDIQTLIIESYNALCQRIGKDDVYVAIRSSATAEDLPEASFAGQQDTFLNIRGAEDVLDYVRRCWASLFEARAIFYREENNFDHSKVYIAVVVQEMVDAEKAGVMFTVHPSTGEDRILIEGSWGLGEAVVSGSVTPDTYWVDKGTGKLLEFTVGEKNIMFTREDGRTVKKEVPPELRNKRVLSDGEIAALAEMGRRIQDHYGSPQDTEWAIMDGDVYMLQSRPITTLGEATEETEVKSREILVKGLGASPGLASGRVKIIREIHELDKIQIGDILVTVMTTPDMVPAMKRASGIITDEGGVTCHAAIVSRELGIPCVVGTGNATEVLKENQVVSIDGNRGLVYEGSVIEGEKKEAEAETVTVESPLLTVTEVKVNVSMPEAARKAAATGADGVGLLRTEHMMLTTGVHPRKFIEEGREDELVNTLAENILKVADEFYPRPVWYRTLDAPTDEFKTLEGGENEPYEHNPMLGWRGIRRELDEPEILRAEFRAIKKLHEQGYTNIGIMIPLVQHPDELRKAKMIAEEAGLKPHRDVEFGIMVETPAAALIIEDFIEEGIDFVRLEP

SEQ ID NO: 61384 - protein, 558 aa, Photobacterium profundum SS9
MYENNKTLYLPYAGPTLLENALLNKGSAFSPEERQNFSLMGLLPAAIESITEQEERAYSQYQTFNDDMDKHIYLRNIQDTNETLYYRLIDNHIEEMMPIIYTPTVGAACEQFSNIYRRGRGLFLGYPDKGNIVDILNNAARQDVKIIVITDGERILGLGDQGIGGMGIPIGKLALYTACGGINPANTLPIVLDVGTNNTQLLSDPMYMGWRHPRITGQEYDDFVEEFIQAVKSRWPNALIQFEDFAQKNAMPLLNRYKDKVCCFNDDIQGTAAVTVGSLLAACKAAGSELSEQRITFVGAGSAGCGIAEAIVAQMIAEGLSDSAARARIFMVDRWGLLTDNMQNLLDFQQKLAQKSATVSQWNETGNISLLDVVSNGKPTVLIGVPGLFSQEVIMEMHAHCKRPIVLPLSNPTSRVEATPSDIIRWTEGDALIATGSPFDPVIFNEKTYPIAQCNNSYIFPGIGLGVLASGATRVTDEMLMESSRVLAECSPLAQNGNGALLPPLKDIHQVSHCIALAVAKKAVEQNKAPQRTEKQLLEKIESYFWKPEYLKYKRTAL

SEQ ID NO: 61385 - protein, 170 aa, Triticum aestivum
  misc_feature (30)..(30): Xaa can be any naturally occurring amino acid
MAAEEGEKKMITLKSSDGEEFQVEEAVAMXSQTIRHMIEDDCADNGIPLPNVDSKILSKVIEYCKKHVQASPKPADSGAAVDASSSTSTAAAAPTEDLKSFDAEFIKVDQNTLFDLILAANYLNIKGLLDLTCQTVADMIKGKTPEEIRKTFNIKNDFTPEEEAEIRKEN

SEQ ID NO: 61386 - protein, 143 aa, Cytophaga hutchinsonii ATCC 33406
MNIFVGSLPFSLEENELREFFEEYGEVSSVKIISDKFTGRSKGFGFVEMPDDAAAQKAIDELNGAEVNGRTIVVNKSEEKKDGPRRSGFSGGGNRGGGGGYSGGGNGGGGYGGNRSGGGGYGGGGNSRGFGGSGTGRNSRGDR

SEQ ID NO: 61387 - protein, 172 aa, Campanula carpatica
ECALWMPARSGSILQLSHSLHNLIPFGSTVPMNLPIVHEVFNSAEAIRIPHTCPLARIRPPVGRYNPPEVVAVRVPLLHLSNFQINDWPDLSAKDYAVMVLILPLNGVRNWRDHELELVEVVADQVAVALSHAAILEESMRARDQLMEQNIALDLARQEAELAIRARNDFLA

SEQ ID NO: 61388 - protein, 112 aa, Urtica dioica
MMMRFLAAVVIMSSAMAVGLVSAQRCGSQGGGGTCPALWCCSIWGWCGDSEPYCGRTCENKCWSGERSDHRCGAAVGNPPCGQDRCCSVHGWCGGGNDYCSGSKCQYRCSSS

SEQ ID NO: 61389 - protein, 413 aa, Zea mays
MDLLGKGGAQQKKSKKSSPTSRKSTVVPAMASAGSAGVAAPSTGGRSSSHPFSVVWDGMALGGSFASESSPTSSEWLYPPGGFVNSLRMPFPYATYPNGSQLPENSHFVGCTSNKGTPSPTNDKGTPIAEVHDSIDIDADDTLEPARTDKRLNWSHEEDVRLVSSWLQNSLDPVDGNDKKSDYYWTDVTNTYNSTTPSNRRRNRNQLKIRWDRVKKPLSEFHGCWVRTTRVFQSGQSDDQRTDNALQLYASEHNGKPFLLQHIWRVVRHERKWAAYVDKLINAKDNRATPSPVVNVEDSPTKRPTGKKKAKEERFGKRKAPEAISAIGEKLEKFIEASSKVEKMAQVQQCLADKKLEVAKINHKAAQEQTKCKMIDLYKDLLCGSTAGLSEEALAERSKALECMRLSLFAPDN

SEQ ID NO: 61390 - protein, 178 aa, Campanula carpatica
ECALWMPARSGSDLQLSHSLHNLIPFGSTVPINLPIVNEVFNSAEAIRIPHTCPLARIRPPVGRYNPPEVVAVRVPLLHLSNFQINDWPEMSAKDYAVMVLILPLKGVRNWRDHELELVEVVADQVAVALSHAAILEESMQARDQLMEQNIALDLARQEAEMAICARNDFLAVMNHEM

SEQ ID NO: 61391 - protein, 239 aa, Zea mays
MEGWASAAAYTAAALASAAAATVVALRLVHRHLLHYAEPTHQRFIVRIILMVPVYAVMSFLSLVLPHQAIYFNSIREIYDAWVIYNFFSLCLAWVGGPGNVVVSLNGQSLKPSWLLMTCCLPAIPLDGRFIRRCKQGCLQFVILKPILVVITFILYAKGKYEDGNFSVNQSYLYITIIYTISYSMALFALALFYAACRDLLQPYNPVPKFIIIKSVVFLTYWQGVLVFLAAKSGFIKNA

SEQ ID NO: 61392 - protein, 498 aa, Azoarcus sp. BH72
MPALPLRFPLLAAALPHGARPLSPAPHADPASTPGSSRFSGEADFLDATGQPRRSRSAADLASRETAIARHRIVIVGGGAGGLELAARLGDSVGRDGAAEIILVDAALTHVWKPLLHEVAAGTLGSQENELDFLQQARDHHFRFHLGRLESLERAHRSIWLAPLVDDDGMEVAPRRPLAYDTLVIAVGAVDNDFGTPGACEHAISLNNADEARRFHRRLLALCARAEMTTGEPVHIAIVGGGATGVELAAELTGAAGEIASYGRELRRLGLPLRISLIEAGDRLLASVPQGLGRKAGEDLAARGVDIRVQAKVAEVCADSVLLKGGERIAADLVVWAAGVQGPEVLEKLDGLVTNDRRQLLVRPTLQTTVDDDIFAFGDCASCTPGPDDKPVPPKAQAAQQQALLLTRSLQRRLAGKPPLRFSYRDHGTIVSMGPEQALGEVRTAHGRRYVLRGIRARFGYWLLYRRHLAVLVGAARTVLVTVGHWLTRRAHPRVKLH

SEQ ID NO: 61393 - protein, 496 aa, Thermus thermophilus HB27
MPLITTETGKKMHVLEDGRKLITVIPGDGVGPECVEATLKVLEAAKAPLAYEVREAGASVFRRGIASGVPQETIESIRKTRVVLKGPLETPVGYGEKSANVTLRKLFETYANVRPVREFPNVPTPYAGRGIDLVVVRENVEDLYAGIEHMQTPSVAQTLKLISWKGSEKIVRFAFELARAEGRKKVHCATKSNIMKLAEGTLKRAFEQVAQEYPDIEAVHIIVDNAAHQLVKRPEQFEVIVTTNMNGDILSDLTSGLIGGLGFAPSANIGNEVAIFEAVHGSAPKYAGKNVINPTAVLLSAVMMLRYLEEFATADLIENALLYTLEEGRVLTGDVVGYDRGAKTTEYTEAIIQNLGKTPRKTQVRGYKPFRLPQVDGAIAPIVPRSRRVVGVDVFVETNLLPEALGKALEDLAAGTPFRLKMISNRGTQVYPPTGGLTDLVDHYRCRFLYTGEGEAKDPEILDLVSRVASRFRWMHLEKLQEFDGEPGFTKAQGED

SEQ ID NO: 61394 - protein, 360 aa, Nocardia farcinica IFM 10152
MSDAKAVRLGLIDGDGIGPEVVRATRAVVDEALVAAGGAAVVWVPLLIGHRAIEEYGTPLPQQTLDGLAAVDAWILGPHDNASYPGEHRGAVPPGGAIRKHFDLYANIRPARALPGVRAAAPDIDLVIVRENSEGFYADRNMVAGSGEFQPSIDLAMAVAVVSRQATERIAHEAFRLAQTRRKKVTIVHKANVLPRTMGLFRDVCYEVAASYPGVVVDDEHVDAAAAHLVRAPGDYDVVVTENLFGDILSDLAGQLSGSLGTAASLNCSATRAMAQAVHGAAPDIAGHNRANPVALQCSAAMLLRWLAIRRGESVLSRAAERIERAVAATFAAGIATADLGGQASTAEFTEQVCARVHRR

SEQ ID NO: 61395 - protein, 245 aa, Oryza sativa
MAGRSELVVSFGEMLIDFVTLRADGEREFMFYRNPSADMLLTHAELNVELIKRAAVFHYGSIGLIAEPCRSAHLRAMEIAKEAGALLSYDPNLREALWPSREEARTKILSIWDQADIVKVSEVELEFLTGIDSVEDDVVMKLWRPTMKLLLVTLGDQGCKYYARDFRGAVPSYKVQQVDTTGAGDAFVGALLRRIVQDPSSLQDQKKLEEAIKFANACGAITATKKGAIPSLPTEVEVLKLMESA

SEQ ID NO: 61396 - protein, 483 aa, Streptococcus thermophilus CNRZ1066
MIVSTYYPKIFYCDKLILLHLLEESMKNHNYENEGQFQRKMTSRHLFMLSLGGVIGTGLFLSSGYTIAQAGPLGAILSYLVGAVVVYLVMLSLGELAVAMPVTGSFHTYATKFISPGTGFTVAWLYWICWTVALGTEFLGAAMLMQRWFPSVPAWIFAAFFALVILGINALSVRSFAEAESVFSSIKVIAILVFIILGLGAMFGLVRFEGHHEAIMFKHLTANGLFPNGGLAIVSVMLAVNYAFSGTELIGIAAGETDNPKEAVPRAIKTTIGRLVIFFVLTIVVLASLLPMKEAGVSSAPFVDVFDKMGIPFAADIMNFVILTAILSAGNSGLYASSRMLWSLANEGMLNKKLVTINKHGVPMTALLISMAGAVLSLFSSIYAADTVYLALVSIAGFAVVVVWLSIPMAQINFRKQWKLEHSEDELDYKTPFNPILPYITIVLLAISVLGIAWDSSQRAGLYFGIPFMIFCYLYHYLCFNKW

SEQ ID NO: 61397 - protein, 362 aa, Clostridium thermocellum ATCC 27405
MGKYKIAVLPGDGIGPEVIEQAVKVIEAVGEIYNHSFELKEGLLGGCAIDATGEPFPKETLELCKSSDAVLLGAVGGPKWDNLPGDKRPEAGLLGIRGALGLYANLRPAVIYQALKGASPLRSDIVKDGIDIMVVRELTGGMYFGERGRVQTENMGQAAFDTEKYSEFEVERIARLAFETAMKRNKKLTSVDKANVLESSRLWREVVNRVASDYPEVELNHMYVDNAAMQLVRNPAQFDVIVTSNMFGDILSDEASMITGSIGMLPSASLGEGSLGLYEPIHGSAPDIAGQDKANPIATILSVAMMMKYSFGLEDAFRAIENAVVNVLGMGYRTADIASPDTPRENIVGTKEMGRLIISKLK

SEQ ID NO: 61398 - protein, 92 aa, Zea mays
ALIADFELSEGIYSCAKIEDTDSVCLWLGANVMLEYSCDEANALLKKNLENAKASLEVLVADLHFLRDQQTITQRSLAIAKLLGTFCPASEL

SEQ ID NO: 61399 - protein, 462 aa, Streptomyces coelicolor A3(2)
MKAHDGMYIDGAWRPADGRDTIDVVNPVDEQVIGKVPAGSALDVDTAVRAARAALSGWAATPPAERAARLAALRDVLVARKDEIAETVTAELGSPLKFSQAVHAGAPIAVAGSYAELAATHAFEEKVGNSVVHHEPVGVVGAITPWNYPLHQIVAKAAPALAAGCTMVLKPAEDAPLVAQLFAEAVHEAGIPAGVFNLVTGLGPVAGQALVEHPGVDLVSFTGSTAVGRRIGATAGAAVKRVALELGGKSANVILPSADLAKAVNVGVANVMSNSGQTCSAWTRMLVHRDQYDEAVSLAAEAAAKYGDRIGPVVNAEQRERVRGYIGKGVAEGARLVAGGPEAPREQGYFVSPTVFADVTEEMTIAQEEIFGPVLSILRYEDEDDALRIANGTVYGLAGAVWAGDEADAVAFARRMDTGQVDINGGRFNPLAPFGGYKQSGVGRELGAHGLTEYLQTKSLQF

SEQ ID NO: 61400 - protein, 444 aa, Triticum aestivum
VAHNSVSLLVRLAPFSQAATKLRAASASMASCCCPIIAWFVSFLLVFPVLVSSATAGNGSTFGEEQLGLRRMKARLARVREASVKTIQSPDGDVIDCVPSHLQPAFDHPRLRGQKPEDEPAARPGNAGAVADDEEEVLPQTWRSSGEWCPKGTIPVRRATEGDLLRASSVRRFGMKPRSAAARRDSTSNGHEHAVGYVSGGQFYGAKASLNVWPAHVSSPAEFSLSQIWVISGSFGNDLNTIEAGWQVSPELYGDNSPRFFTYWTNDAYQETGCYNLHCAGFVQTNGRVVIGAAITPVSAYGGRQFDITLMIWKDPKKGNWWLQLGPSGALVGYWPSSLFTHLGARGRGGADMVQFGGEAVNTRPSGSHTPTQMGSGRFPGEGYGRAAYFRNVQVVDWDNNLIPAAGLRLLADHPGCYDIAGGQGGAWGSYFYYGGPGRNVRCP

SEQ ID NO: 61401 - protein, 300 aa, Glycine max
MCAFCEFLQYEKVEKIGEGTYGVVYKGRDRVTNETIALKKIRLEQEDEGVPSTAIREISLLKEMQHRNIVRLQDVVHDEKRLYLVFEYLDLDLKKHMDSSPEFAKDPRQVKMFLYQILCGIAYCHSHRVLHRDLKPQNLLIDRSTNALKLADFGLARAFGIPVRTFTHEVVTLWYRAPEILLGSRHYSTPVDIWSVGCIFAEMVNQRPLFPGDSEIDELFKIFRIMGTPNEDTWPGVTSLPDFKSAFPKWQPKDLKNVVPNLEPAGLDLLSSMLYLDPSKRITARSALEHEYFKDIKFVP

SEQ ID NO: 61402 - protein, 484 aa, Bacillus licheniformis ATCC 14580
MEQSNTNRQNFQRKMQTRHLIMLSLGGVIGTGLFLSSGYTISQAGPAGTILAYLAGALIVYLVMLCLGELSVAMPVTGSFHMYASRFIGPGTGFTVAWLYWLTWAVALGSEFTAAGLLMQRWFPDTSVWMWSAVFAALIFALNAVSVRFFAESEFWFSSIKVLAIILFIILGGAAIFGIIPIQNADAAPLLSNFAGEGGLFPNGFLPIFMAMLSVNFAFSGTELIGIAAGESAEPEKNIPKAIKTTLWRLVLFFIGTIFVLSCLIPVKEAGVIKSPFVDVFDRIGVPYAADIMNFVILTALLSAANSGLYACSRMLWSLSKEKTLHPVFQKLTSRGIPLNALIFSMLGGILSLLSSVFAPDSVYIVLVSISGFAVVAVWMSIAASQFMFRRRFLAEGNTADDLKYRTPLYPAVPIAAFLLCLASCIGIAFDPNQRIALFCGVPFMALCYTIYYATNRKNSWNPSEPVKNASLHVSFSEYEEKKN

SEQ ID NO: 61403 - protein, 336 aa, Oceanospirillum sp. MED92
MALRIAINGYGRIGRNILRALYESKHRNNLQIIAINDLCDPEVNAHLTEYDSVHGKFKHKVSSSDNKLIVDGDQITVFREKALSALPWGGLDIDIVFECTGLFTDKTTAMQHIHNGAKRVLVSAPAKDADATVVYGVNHTSIKTEDIVISNASCTTNCLAPMAKVINDRFGITSGTMTTIHAYTNDQHLTDAFSGDLYRARAAATSMIPTRTGAAQAVGLVLPELEGKLSGMAVRVPTSNVSLVDLSFIPNKPCSVEDLNQLLLEAASNQFKEIIAYNDKPLVSVDFNHHSESCIFDATQTISCDNLKKVFAWYDNEWGFSNRMLDTASYLGRFLR

SEQ ID NO: 61404 - protein, 368 aa, Erythrobacter sp. NAP1
MKTRAAVAFEAKKPLEIVELDLEGPKAGEVLVEIMATGICHTDAYTLDGLDSEGIFPSVLGHEGAGIVREVGAGVTSVAPDDHVIPLYTPECRQCKMCLSGKTNLCSAIRATQGQGLMPDGTSRMSYRGETIYHYMGCSTFSNFIVLPEIAVAKIRTDAPFETSCYVGCGVTTGVGAVVNTAKVEPGDNVVVFGLGGIGLNVIQGAKMAGADRIVGVDINPAKREWGEKFGMTDFVNPKETSDVVAHLVELLDGGADYSFDCTGNTDVMRDALECCHKGWGTSIIIGVAEAGKEIATRPFQLVTGRNWRGTAFGGAKGRTDVPKIVDWYMNGKIAIDPMITHTLSLEEINKGFDLMHAGESIRSVVVY

SEQ ID NO: 61405 - protein, 300 aa, Prochlorococcus marinus str. AS9601
MITDKTECNNPLFGRILTAMVTPFTENGDVDYELAIKLSNYLFENGSDGIVLCGTTGESPTLSWAEQHDLFIAVKGSLDASCKVIVGTGSNCTSEAVEATKKAYDSGADGALVVVPYYNKPPQEGLYKHFSSIAKSAKDLPLMLYNIPGRTGCNLLPDTVKKLMDFSNILSIKAASGRIEEVTELRAICGSELSVYSGDDSLLLPMLSVGAVGVVSVASHLVGLQLKEMIHSFQSGKVSNALAIHEKLQPLFKALFMTTNPIPIKAALELSGWDVGNPRSPLSPLNNDMKKQLSFILNSL

SEQ ID NO: 61406 - protein, 360 aa, Rickettsia marmionii
VIDISMVSAEADCFTYDPGFMSTASCQSTITYIDGDKGILRHRGYDIKDLAEKSDFLEVAYLLIYGELPSGEQYNNFTKQVAHHSLVNERLHYLFQTFCSSSHPMAIMLAAVGSLSAFYPDLLNFKEADYELTAIRMIAKIPTIAAMSYKYSIGQPFIYPDNALDFTENFLHMMFATPCTKYTVNPIIKNALNKIFILHADHEQNASTSTVRIAGSSGANPFACISTGIASLWGPAHGGANEAVINMLKEIGSSEYIPKYIAKAKDKNDPFRLMGFGHRVYKNYDPRAAVLKETCKEVLKELGQLDNNPLLQIAIELEAIALKDEYFIERKLYPNVDFYSGIIYKAMGIPSQMFTVLFAI

SEQ ID NO: 61407 - protein, 149 aa, Triticum aestivum
MSVELVLWLFSFASVMALVGLTAYQLICLSDLEFDYINPYDSSSRINAVVIIEYTLQGVLCASFLLTLNWFPFLVMAPVTYYHVKLYMNRKHLIDVTEIFRQLHGEKKYRMIKLAFYFALFIISIYRLVMTAVLLFIDEDANLVETRTI

SEQ ID NO: 61408 - protein, 94 aa, Oryza sativa
MLNKKYALPYRVVDELVNHFSTFIQEERLLPVLWHQSLLTFIQRYKNDLTFEQKEIIKAVCRAQTHTLITQEVRRELANSVLRGEKPPSSMELL

SEQ ID NO: 61409 - protein, 503 aa, Thermus thermophilus HB27
MVLVLDFGSQYTRLIARRLRELRAFSLILPGDAPLEEVLKHRPQALILSGGPRSVFDPDAPRPDPRLFSSGLPLLGICYGMQLLAQELGGRVERAGRAEYGKALLTRHEGPLFRGLEGEVQVWMSHQDAVTAPPPGWRVVAETEENPVAAIASPDGRAYGVQFHPEVAHTPKGMQILENFLELAGAKRDWTPEHVLEELLREVRERAGKDRVLLAVSGGVDSSTLALLLAKAGVDHLAVFVDHGLLRLGEREEVEGALRALGVNLLVVDAKERFLKALKGVEDPEEKRKIIGREFVAAFSQVARERGPFRFLAQGTLYPDVIESAGGHGAAKIKSHHNVGGLPEDLEFELLEPFRLLFKDEVRELALLLGLPDTLRLRHPFPGPGLAVRVLGEVTEERLEILRRADDIFTSLLREWGLYEKVAQALAVLTPVRSVGVAGDERKYGYVLALRAVTTEDFMTADWARLPLEFLDEAARRITRRVPEIGRVVYDLTSKPPATIEWE

SEQ ID NO: 61410 - protein, 222 aa, Zea mays
PRVRLDGTIRAWDLFRYRNFRTFTTPSPRQFVSLTADQSGEVICAGTLDSFEIFVWSMKTGRLLDVLSGHEGPVHGLMFSPINAILASSSWDKTVRLWDVFESKGAVETFQHSHDVLTLAYRPDGRQIACSTLDGLIHFWDPSDGLLMYTIEGRRDIAGGRLMTDRRSAANTSIGKYFTTLCYSADGSSILAGGNTKYICMYDVGEQVSKSFLARLYLYIEA

SEQ ID NO: 61411 - protein, 542 aa, Oryza sativa
MPCINAEARRHERGNQERTPASRKLNSHRPMEKLKSELWMTAVATCMSLLLYLTILRRRHASGGRSLALPPGPTPLPLIGNLLCLGGIFHQTLAKLARVHGPVMTLKLGLTTAVVVSSAEAAREAYTKHDQRLAARPVPDAFRANGFSERSIVFSPSSDPQWKNLRGIHATHIFSPRALAALRGIRERKVRDIVGYIRTVAGEEMCVREVVHNGVLNLISTSFFSMDMADVRSESARGLRGLIEDIIATVAGPNVSDFFPFLRQLDLQGLRRQTGSHLGIVFGLLDDIIDRRMAETRDHPDKQRHGDFLDALISLASAGKIPRYHITYLLFDVFAAGADTMTTTVEWAMAELLRNPRVMAKVRAEVTDALGGRESFDEGDAASLTYLQCVFKEAMRLHPVGSILVPHLAVQDGVEIGGYAVPKGTTVIFNAWAIMRDPAAWESPDQFLPERFLHKEESSSPPLELRGKDYEYIPFGSGRRLCPGLPLAERAVPFILASLLHAFEWRLPDGMSPDDMDMTEKFATANVLATPLKAVPVASHTS

SEQ ID NO: 61412 - protein, 324 aa, Bacteroides fragilis NCTC 9343
MYTASQLLDKINSHISDIRFTRTPAGLYDPIKYVLSMGGKRIRPVLMLMAYNLYKEDVSSIYDPATAIEVYHNYTLLHDDLMDRADMRRGKTTVHKVWNDNTAILSGDAMLVLAYQYMAASSSEHLKEVMDLFSLTALEICEGQQMDMNFESREDVKEEEYLEMIRLKTAVLLAASLKIGAILGGASPEDAENLYDFGMQIGVAFQLQDDLLDVYGDPAVFGKNIGGDILCNKKTYMLIKALERADRDQLEGLNHWLSATSFCPEEKISAVTELYTQIGIKAVCENKMREYYTRAMTSLGAVSVIEDKKSELKKLMKHLMYREM

SEQ ID NO: 61413 - protein, 389 aa, Corynebacterium glutamicum
MSTLETWPQVIINTYGTPPVELVSGKGATVTDDQGNVYIDLLAGIAVNALGHAHPAIIEAVTNQIGQLGHVSNLFASRPVVEVAEELIKRFSLDDATLAAQTRVFFCNSGAEANEAAFKIARLTGRSRILAAVHGFHGRTMGSLALTGQPDKREAFLPMPSGVEFYPYGDTDYLRKMVETNPTDVAAIFLEPIQGETGVVPAPEGFLKAVRELCDEYGILMITDEVQTGVGRTGDFFAHQHDGVVPDVVTMAKGLGGGLPIGACLALRAAELMTPGKHGTTFGGNPVACAAAKAVLSVVDDAFCAEVARKQLFKELLAKVDGVVDVRGRGLMLGVVLERDVAKQAVLDGFKHGVILNAPADNIIRLTPPLVITDEEIADAVKAIAETIA

SEQ ID NO: 61414 - protein, 382 aa, Moorella thermoacetica ATCC 39073
MAKRDYYEVLGVSRDASEAEIKKAYRQLARKYHPDMNPGDKEAEEKFKEVQEAYEVLSNAEKRARYDQFGHAGTEAGGGPGFGGFDFGGAGADFGFGDIFDMFFGGGFGGAARRQGPQRGDDLRLDLEISFEEAAFGVEKEVGIPRQEKCPECGGSGAAPGTHPKTCPTCHGTGQIRIAQRTPLGQFQTIRTCHQCHGQGTIIETPCPRCRGRGVVQRTRKIRVKIPPGVDTGARLRMAGEGESGLRGGPPGDLYIYINVRPHKLFRRDGYDVFCEVPVSMVQAALGDSIKVPTLDGKEELHIPPGTQSGTSFRLKGKGIPRLNGVGRGDQHVRIHVETPTNLNEKQKELLREFARLYGSEPRGAREQDKGFFRKVKDAFMG

SEQ ID NO: 61415 - protein, 326 aa, Bacteroides fragilis NCTC 9343
MGTVKCVGILTSGGDAPGMNAAIRAVTRAAIYNGLQVKGIYRGYRGLVTGEIKEFKSQNVSNIIQLGGTILKTARCKEFTTPEGRKMAYDNMVKEGIDALVVIGGDGSLTGARIFAQEYDIPCIGLPGTIDNDLYGTDTTIGYDTALNTILDAVDKIRDTATSHERLFFVEVMGRDAGFLALNGAIASGAEAAIIPEFSTEVDQLEEFIKSGFRKSKNSSIVLVAESELTGGAMHYAERVKNEYPQYDVRVTILGHLQRGGSPTAHDRILASRLGAAAIDAIMEDQRNVMIGIEHDEIVYVPFSKAIKNDKPVKRDLVNVLRELSI

SEQ ID NO: 61416 - protein, 289 aa, Bacteroides fragilis NCTC 9343
MERKLAVITGADGGMGTEITRAVACAGYDVIMACYSSSKAETKCRELVKETGNEKIEVWQIDLASLASVRAFADRMLRQKTPVALLMNNAGTMETGLHITEDGLERTVSVNYVGPYLLTRLLLPLMGEGTRIVNMVSCTYAIGKLDFPDFFLWGRKGSFWRIPIYSNTKLALLLFTIELAERLRARGITVNAADPGIVSTNIIRMDQWFDPLTDIFFRPFIRTPLQGAATAIGLLLDAEVEGRTATFNLNNHCRLLPEKYTRPDRRAQLWEETERILSEKGFLPINDKR

SEQ ID NO: 61417 - protein, 114 aa, Moorella thermoacetica ATCC 39073
MAEDCIFCQIAAGKIPSEVVYQDDRVVAFKDIRPVAPVHILIIPRKHIPDLTAITPEDGDLIGYIHLVAVKLAREFGLADRGFRVVNNCKEEGGQAVYHLHFHLLGGRQLQILG

SEQ ID NO: 61418 - protein, 116 aa, Brassica napus
ANHERRAIQQWGRKKGLPEFEETAPDGFDPANPYKDPVAMVEMREHIVREKWIQIEKAKILREKVKWCYRVEGVDHYQKCRHLVQNYLDSTRGVGWGKDHRPVSLHGPKPEAVEAE

SEQ ID NO: 61419 - protein, 327 aa, Bacillus licheniformis ATCC 14580
MNEVLEERYDARFWQSRLEDLVEHYRPFSSSGRNAEYIPALGKIDSNQLGICVIGSDQTMIKAGNSDVSFTLQSISKVISFIAACLTKGISYVLDRVDVEPTGDAFNSIIRLEMHKPGKPFNPMINAGALTVSSILPGESALGKIESLHDVIEKMIGKRLEINEEVFRSEWQTAHRNRALAHYLKETGFLEADVEETLEVYLKQCSMEGSTEDIALIGMILANDGYHPFRREHVIPKDVARLTKALMLTCGMYNASGKFAAFVGIPAKSGVSGGIMCAVPASVKREQPFQHGCGIGIYGPAIDDYGNSMTGGMLLKHIAREWDLSIF

SEQ ID NO: 61420 - protein, 607 aa, Deinococcus radiodurans R1
MSIDHSRISTQPFPASEKRYLGGSLFPEVRVPVRAITLSPTVEAFSGVTRTLPNPPLLVPDTSGAYTDPAVATDLQRGLPHARPWLARSERTEETARFSALADMDGPLPYPHVLTPRRARSESRGGQGITQMQAARRGEITPEMEFVALRENLRQQEQAELAHQHPGESFGASLPRLYTPEFVRDEVARGRAVIPANVNHPELEPTIIGRNFRVKINANLGTSIVTSSIEEEVEKMVWATRWGADTVMDLSTGRHIHQTREWIVRNSPVPIGTVPIYQALEKVDGKAEELTWEVYRDTLIEQAEQGVDYFTIHAGVRLAHVPLTARRRTGIVSRGGSILAKWCLAHHQENFLYTRFAEICEIMAAYDVTFSLGDGLRPGSIEDANDAAQFAELGTLGELTRVAWDHGVQTMIEGPGHVPMQLIRENMTRQLDVCQEAPFYTLGPLTTDIAPGYDHITSAIGAAQIAWYGTAMLCYVTPKEHLGLPDKQDVRDGVITYKIAAHAADLAKGHPGAQARDNAISKARFEFRWQDQFNLALDPEKARALHDETLPADAAKTAHFCSMCGPAFCSMKLSHDIRAGDVLAGLEAKAREFRELGGEIYVEGSDD

SEQ ID NO: 61421 - protein, 480 aa, Deinococcus radiodurans R1
MRFPAQALSSAHSKLSHPRRERVTATPSPTVHPVDEVPAAQNLLVFGLQHVMSMYAGIVAVPLILAGALGLDATTAARIVSASFFMCGLATLVQTLGVGPFGAKLPIVQGTTFAAVGTMILVGKEFGLPGIYGAVIAGGLFTILLAPYFSRLLRFFPPVVSGTVITMIGISLLPVAFNWAGGGVGNPNFGSPGNLGLAAITLLIVLLISRFGRGYLGRIAVLLGLVIGSVIAALFGQVNGAPISSAAWVGFTPPLAFGAPTWHLVPILSMLLVMLVVMVETTADLLAIGEITGKKVGPREVAAGLRADGLSTAVGGLFNSFPFTAFAQNVGLVRFTGIKSRFVVAAAGVILLLMGFFPKLSALVASIPLPVLGGAGLVLFASVAVSGIQTLAKVDLSDTRNLTVVSVSLALGLIPSTVPGLYAHLPAQAQLFLGSGITAASLCAILLNILFNIVGSDRPRPSATATVAEHAPEPGDLAEH

SEQ ID NO: 61422 - protein, 304 aa, Solanum lycopersicum
MAKLKIVNIVFFVLLGIGICSAARTLLTYDHVGVGGEVGAYAGGGGGGSGGGGAYAAGGHDGGYAGGGGSGSGAGGGHAGGGYAGGGGGGSGAGGTHAGGGHDGGYASGGGEGGGAGGGHAGGGYAGGGGGGSGAGGAHAGGEHDGGYAAGGGEGGGSGYGGAGSADGGYAAGGGGGSGGGGGGAVAGGGAHGGGAYAGGSGGGTGGGYGAGGAPGGGYGGGGGHGGGGGSAYAGGEGGASGGGYGSGGGAGGGAGGAHGGAYGGGGGSGAGGGGAYAGGEHAGGYGGGAGGGEGGGHGGGYAP

SEQ ID NO: 61423 - protein, 83 aa, Sesamum indicum
MADMRGSGVVCDDRCGCPSPCPGGIACRCSTGGGDDTTTEHKQCTCGEHCGCNPCTCSKSEIRGTGKAFCRCGTGCTCPTCAA

SEQ ID NO: 61424 - protein, 499 aa, Shewanella sp. MR-7
MAQDLSSLPTALYTQQQVRAAELLAVSEGETTLYQLVERAGRAAFECFTEQRELHSQLEGMPLLVLAGSGNNGADALVCARLALEAGHQVKVYLLKTRGTAEFEQALSAYLNQGGVIDSPNIEAIQQAPVIIDGLLGTGVKGAVREDIAALIHAVNQSEAWVLSLDLPSGIVADTGVVAQAAVMADVTLCFGGLKQGLLTSKARHHCGYLAFADLGLTPFFDTESATRVGGEMLKDHFAARARDSHKGQSGKVTLIGGDFGMAGAIRLASEACLRAGAGLVTVISRPEHQLTVNVSRPELMFWGCELVDMEVYLRLGWAQVVVLGPGLGKHDWGYNLFKAAGLSDRPCVLDADALNLLSQEPRRQTNWVLTPHPGEAARLLGCSVADIELDRFAAVRALQQKYGGVVLLKGAGTVIFDGKQMVVAPVGNPGLASGGCGDVLSGIIGALMAQGMDNMQATVVGVVVHGCAADLAAVQGERGMLASDLMPFIRQLVNSDLL

SEQ ID NO: 61425 - protein, 252 aa, Bacillus subtilis
MRKPIIAGNWKMNKTLGEAVSFVEEVKSSIPAADKAEAVVSPALFLEKLASAVKGTDLKVGAQNMHFEESGAFTGEISPVALKDLGVDYCVIGHSERREMFAETDETVNKKAHAAFKHGIVPIICVGETLEEREAGKTNDLVADQVKKGLAGLSEEQVAASVIAYEPIWAIGTGKSSTAKDANDVCAHIRKTVAESFSQEAADKLRIQYGGSVKPANIKEYMAESDIDGALVGGASLEPQSFVQLLEEGQYE

SEQ ID NO: 61426 - protein, 511 aa, Bacillus subtilis
MSKKPAALIILDGFGLRNETVGNAVALAKKPNFDRYWNQYPHQTLTASGEAVGLPEGQMGNSEVGHLNIGAGRIVYQSLTRVNVAIREGEFERNQTFLDAISNAKENNKALHLFGLLSDGGVHSHINHLFALLKLAKKEGLTKVYIHGFLDGRDVGPQTAKTYINQLNDQIKEIGVGEIASISGRYYSMDRDKRWDRVEKAYRAMAYGEGPSYRSALDVVDDSYANGIYDEFCIPSVITKENGEPVAKIQDGDSVIFYNFRPDRAIQISNTFTNKDFRDFDRGENYPKNLYFVCLTHFSETVDGYVAFKPINLDNTVGEVLSQHGLKQLRIAETEKYPHVTFFMSGGREAEFPGEERILINSPKVATYDLKPEMSAYEVKDALVKEIEADKHDAIILNFANPDMVGHSGMVEPTIKAIEAVDECLGEVVDAMVAKGGHAIITADDGNADILITESGEPHTAHTTNPVPVIVTKEGITLREGGILGDLAPTLLDLLGVEKPKEMTGTSLIQK

SEQ ID NO: 61427 - protein, 498 aa, Bradyrhizobium sp. BTAi1
MTPTAATRTTPSATASLRERLKDGSLLREQCYIDGSWVGVPVFPVNNPATGAELAKVAQLGAAETTQAVEAAARAFPAWAKLTAKQRSNLLRKWFELIVANREDLALILTSEQGKPLNEALGEVDIGAAYIEFFAEEARRVYGETIPTQKPDARLLALKQPIGVCGAITPWNFPNSMITRKVSPALAAGCTVVLKPANETPLSALALAVLAERAGIPKGVLNIITGDAPPIGKVLCEHPAVRFVGFTGSTEVGKILYRQSAGTVKKLGLELGGNAPFVVFDDADVDAAVEGAIVSKYRNMGQTCVCANRLYAQDGIYDAFVEKLAARVAAMKIGDGTEAGVVQGPLINEEAVEKVERHIADAVKGGATIVTGGKRHALGRTFFEPTVLSNVKADALVAHEETFGPLAPVIRFQSEADVIAMCNASPFGLASYFYARDLGRVWRVAEALESGMVGVNTGLITTEVAPFGGVKESGLGREGSHHGIEEYLEIKYVMMAGV

SEQ ID NO: 61428 - protein, 430 aa, Bacillus subtilis
MPYIVDVYAREVLDSRGNPTVEVEVYTETGAFGRALVPSGASTGQYEAVELRDGDKDRYLGKGVLTAVNNVNEIIAPELLGFDVTEQNAIDQLLIELDGTENKGKLGANAILGVSMACARAAADFLQIPLYQYLGGFNSKTLPVPMMNIVNGGEHADNNVDIQEFMIMPVGAPNFREALRMGAQIFHSLKSVLSAKGLNTAVGDEGGFAPNLGSNEEALQTIVEAIEKAGFKPGEEVKLAMDAASSEFYNKEDGKYHLSGEGVVKTSAEMVDWYEELVSKYPIISIEDGLDENDWEGHKLLTERLGKKVQLVGDDLFVTNTKKLSEGIKNGVGNSILIKVNQIGTLTETFDAIEMAKRAGYTAVISHRSGETEDSTIADIAVATNAGQIKTGAPSRTDRVAKYNQLLRIEDQLAETAQYHGINSFYNLNK

SEQ ID NO: 61429 - protein, 333 aa, Bradyrhizobium sp. BTAi1
MTDAKYDVLGIGNAIFDVLVHADEAFLAKHAMTKGSMALIDEARAAAIYRDMGPATEMSGGSGANTIVGLASLGARAAYVGKVRDDQIGRMYSHDIRAAGVTFDTAPATDGPATGCCYILVTPDGERTMNTYLGAAQNLTAADIDPAQIAAARIVYLEGYLWDPKEAKEAFVKAATVAHDAGREVALTLSDSFCVDRYREEFLDLMRGGTVDIVFANEAELHSLYQTSDFDGALKQLREDATLGIVTRSDKGCVVVSNDGVIAVPAHPIETLVDTTGAGDLFAAGFLFGLVRKTGYEMAGRLGGLAAAEVIQHIGARPQVSLKELAAQNGLKA

SEQ ID NO: 61430 - protein, 120 aa, Glycine max
MAPTVMMASSATAVAPFQGLKSAASLPVARRSTRSLGNVSNGGRIRCMQVWPAYGNKKFETLSYLPPLSTDDLLKQVDYLLRNGWIPCLEFSKLGFVYRENSTSPCYYDGRYWTMWKLPM

SEQ ID NO: 61431 - protein, 497 aa, Staphylococcus aureus
MSKVQNESNNVVKRGLKDRHISMIAIGGCIGTGLFVTSGGAIHDAGALGALIGYAIIGIMVFFLMTSLGEMATYLPVSGSFSTYATRFVDPSLGFALGWNYWFNWVVTVAADITIAAQVIQYWTPLQGIPAWAWSALFLVIIFSLNSLSVRVYGESEYWLALIKVITVIVFIAIGLLTIVGIMGGHVVGFEIFNKGEGPILGGNLGGSLLSILGVFLIAGFSFQGTELIGITAGESENPERAVPKAIKQVFWRILLFYILAIFVIGMLIPYDSSALMGGSDNVATSPFTLVFKNAGFAFAASFMNAVILTSVLSAGNSGMYASTRMLYSMSKDKLAFEAFGKTNKNGVPYMSLLVTAIIVVIILVLQSLTKGAYEYIVAASGLTGFIAWVGIAVSHYRFRRAFDKQNYDKSKLKYTAKLFPFGPLFAGFLCIVVIIGQDVDFIKTGDFNFSRFLITYMGIPVFLAFFIYHKLRYKTKKIPLEQVDLRQDVSMDEIKG

SEQ ID NO: 61432 - protein, 314 aa, Yarrowia lipolytica CLIB122
MLRTTTRRLVARGSATRRTSVRQLSTVDIVRPVETALNAIHDFSGLPWWAVIPLVTLTLRSTVTLPIAISTRLRAQKQHELRPLISALGPILRAKLAFNANKAETALTAPQIEMLAMKERRKRRVKLYKEHGCEMWKSLFIGPLVQLPIWITMSLAVRAMCGWTVVKGIPVVKSMGTEGALWFPDLLMMDHSGVLPAAVGIITLLNVELTTKAQAQAMGTTGSEGPKLPKMMANFARVGAIALFSIAAQTPTAVCLYWISSSGFSLIQNVLLNKYMPLREEPPMFTAANYEALEKIGKTDQIEVIIPKLKGIEH

SEQ ID NO: 61433 - protein, 250 aa, Campylobacter lari RM2100
MHSKSPRMHNNALQALKEEAVYTRYHLKDKTKLKEIVQKLDGVNITIPFKEVACEIADFKDESVMRIGSANTLLNKDNKIYAYNTDYLGFLKAIEDFSFVKSALVLGAGGTAKALAYALKSINIEVTVANRSSVRFENLTSYPCFLYNQLDLSKKFDLIINTTSAGLNDEKLPCQEEILKSIFQHAKYAFDVIYGKNTPFLKLARENGLKIKDGAQMLLWQGVFALELFLECQKKEEIFKAMEMALKLPQ

SEQ ID NO: 61434 - protein, 425 aa, Pseudomonas syringae pv. phaseolicola 1448A
MTQQEFNDPLWRTILSGAQMLFVAFGALVLMPLITGLDPNVALFTAGLGTLLFQIVTGRQVPVFLASSFAFITPIILAKGQFGLAATMGGVMAAGFVYTFLGLAVKIKGTGFIDRLLPPVVIGPVIISIGLAMAPIAANMAMGKTGDGVVLIPYQTAMLISMPALLTTLIVAVFGKGIFRLVPIISGVLVGFALSFYFGVVDTKKIADAAWLALPHFTAPEFNWQAILFIVPVALAPAIEHIGGVIAVGSVTGRDYLKKPGLHRTLFGDGIATTAAGLFGGPPNTTYAEVTGAVMLTKNYNPQIMIWASFFAITLAFIGKFGALLQSIPVPVMGGILCLLFGSIAAVGMNTLIRHKIDLAEARNLVIVSVTLVFGIGGVLIGTGNGPNDFGLKGIALCAITAIILNLVLPGHDSWKRNKPDDQLL

SEQ ID NO: 61435 - protein, 373 aa, Campylobacter lari RM2100
MELNYYEILEISQTSDKETIKKAYRKMALKYHPDRNQGDKEAEEKFKLVNEAYEVLSNDEKRSIYDRYGKEGLKGQAGGFGGFGDVDLGDIFSSFFGDGFGFGSSTRKKEKGNKYPQDLKITTKISFKEAVFGCKKKIDFSYKSFCKSCKGSGSENGKLDTCPHCGGKGQVGVRQGFMTFVQSCDHCKGSGQIIKDKCKTCHGNGYEEIKDHIELDIPEGIDSGMSLRVQNKANELPNSSQRGDLYIKIIVEDDDKFIRHDDDIYTIVPVFFTQAALGKTIKVSTIRGEADLKLPVGAKDKQKFELTNEGVKNIHNGKLGSHIVQIEIKFPKNLTDEQKNLLLQLEKSFGLADEEAFIEQESLFDKIKSWFSH

SEQ ID NO: 61436 - protein, 376 aa, Medicago truncatula
MDPTNNQSNTQNSSDYPFSYQNQFPNSHPQNPNQFPNQYPQNPNQFLNQHPQNPNQFPNQNPQNMSNFGFASNFNHPSFVPNNFNPYFRSMMGYSSQTPPFNGYMPMVNENFQSVGEYPEFSSQINRGGMTRDNEVAPTPEDTTPKSKRNQQPSWNTEQNLVLISGWIKYGTCSVVGRNQTSESYWGKIAEYCNEHCSFDSPRDVVACRNRFNYMNKLINKWVGAYDSAKRMQGSGWSEDDVFKKAQELYGCGKNVQFTLMEEWRALRDQPRYGSQVGGNVDSGSRDAAKKKGKKKSKGETLEKVEKEWVQFKELKEQEIEQLKELTLVKQQKNKLLQEKTQAKKMKMYLKLRDEEHLDDRKNELLGKLERELFEN

SEQ ID NO: 61437 - protein, 560 aa, Oryza sativa
MEVRRRAPLPPPPGRVQAGDALPLPIRHTNLIFSALFAASLAYLMRRWREKIRSSTPLHVVGLAEMLAIFGLVASLIYLLSFFGIAFVQSIVSSSDDEEEDFLVGPARGSSAAAAVAPRAPSSPAQCSLLGSPHDDAARERMPEEDEEIVSSVVAGKVPSYVLETKLGDCRRAAGIRREAVRRITGRQIEGLPLDGFDYASILGQCCELPVGYVQLPVGIAGPLLLDGQRFYVPMATTEGCLVASTNRGCKAIAESGGAVSVVLRDGMTRAPVARLPTARRAAELKAFLEDSVNFNTLSMVFNRSSRFARLQGVQCAMAGRNLYMRFSCCTGDAMGMNMVSKGEQNVLDYLQDDFPDMDVISISGNFCSDKKPAAVNWIEGRGKSVVCEAVIKEDVVKKVLKTNVQSLVELNVIKNLAGSAVAGALGGFNAHASNIVTAIFIATGQDPAQNVESSHCITMLEAVNDGRDLHISVTMPSIEVGTVGGGTQLASQAACLDLLGVKGANRESPGSNARLLATVVAGGVLAGELSLLSALRAGQLVKSHMKYNRSSKDMSKVIS

SEQ ID NO: 61438 - protein, 475 aa, Erythrobacter sp. NAP1
MATLAKSPEDNTTQEAASEEAAPKHWSEGVPEDDALDHIPGEKGWPLVGNTFRTLADPHAFTSYMVENYGKVYKTHAFGGWNVALIGAEANELVLFNKDKIFSSEQGWGPVLDQLFPRGLMLLDFDHHRIDRRALSIAFKPGPMRHYAGSLNSGISREVAKWEGEMKFYPAIKSLTLDLAADSFLGIPWGPEADAINTAFVDMVQASVAPVRSPLPFTKMKKGVDGRKFMVEFLTAETIRRRKEGGGQDMFSQFATATREDGELLPVDEVVDHMSFLLMAAHDTITSSATSLIYYLAINPEWQEKLREEIVAVTGGPDGDGNPRPLDYDDLGKLELTDMAFKEALRMMPPVPSMPRRALKSFEFGGYRIPAGTHVGINIYWTHYSDEYWDDPQTFDPMRFTPEKVKARHKYAWVPFGGGAHMCLGLHFAYMQVKVLMAQLLQRYRIEAPEGYAPDWQPWPIPQPKDGLKVTFKPL

SEQ ID NO: 61439 - protein, 726 aa, Azoarcus sp. BH72
MTAALQMTLEAGQAYPLGATWTGDGVNFAVFSAHASRMELCLFDEAGRNEIARMDLPELTDEVWHGFLPGAGPGLVYGYRAHGPYVPEEGHRFNPHKLLLDPYATELVGRLRWGPPIFGYELRNKRPGHGFDKRDSAACTLKARVAAPWPSASRPARRGQRVPWECMVIYEAHVRGLTRQHPAVGAEHRGTIAGLGSAAVIDHLKALGVTSVELLPVHAYVDDAYLTDKGLRNYWGYNSIGFFALEPRYLAGEGAAEFRDTVARLHDAGLEVILDVVYNHTAEGNELGPTLSFKGLDNASYYRLNPDDRRYYINDTGTGNTVNLSHPRVLQLVMDSLRYWVTQMEVDGFRFDLATILGREAAGFDPGCGFFDAVRQDPVLNRVKLIAEPWDCGPGGYQPGNFPPGWAEWNDGFRDTVRAFWRGDEGQAPGLATRLAGSADRFNHHGRRPWASINFITAHDGFTLHDLVSYNDKHNEANGEDNRDGHDDNRSWNCGAEGPTDDPEVLALRERQKRNLLATLLLAQGTPMLLAGDEIGRSQQGNNNAYCQDNEISWVHWAGVDADGERLRAFVRSLLLIRRALPVLRPARFATGGDPGHVLRDVIWLAPNGVELTPEGWADAQMRCFAMLADGRAHLGTGPEPAADAVVLVVLNAAHEAVECTLPQAAGITRWVRLVDTAQAEVADFAESAPGEGYSAAGRSLQLFVAAPTPQAAECVARLTARLGEG

SEQ ID NO: 61440 - protein, 515 aa, Solanum lycopersicum
MAKISRLFGSTVKAAITAQAGFHGKRIPAVSSLQEHIVKSTPARYNSTQACLENDISGTDNKGFKGHDMLAPFTAGWQSTDVDPLIIEKSEGSHVYDMQGRKYIDTLAGLWCTALGGNEPRLVDAATKQLNTLPFYHSFWNRTTKPSLDLAKELLDMFTAKKMAKAFFTNSGSEANDTQVKLVWYYNNALGRPNKKKFIARAKAYHGSTLISASLTGLPALHQNFDLPAPFVLHTDCPHYWRYHLPGETEEEFSTRLAKNLEDLILKEGPETIAAFIAEPVMGAGGVIPPPATYFDKIQAVVKKYDILFIADEVICAFGRLGTMFGSDMYNIKPDLVTLAKALSSAYMPIGAVLVSPEVSDVIHSQSNKLGSFSHGFTYSGHPVACAVALEAIKIYKERNMVERVNRISPKFQEGLKAFSDSPIIGEIRGLGLILATEFANNKSPNDHFPPEWGVGAYFGAQCQKNGMLVRVAGDTIMMSPPFVVTPEELDELIRIYGKALRETEKRVEELKSQK

SEQ ID NO: 61441 - protein, 404 aa, Azoarcus sp. BH72
MIAGKSVLAFVMAGGEGSRLHPLTAERSKPSVPFNGRHRIVDFVLSNLVNSEIYSIYLLVQYKSQSLIEHIRRSWVLTPLIPHHFITVVPPQMQCGPEWFQGTADSVYQNLHLIDLIKPDLVVVFGADHVYRMDIRQMVQYHVDTHADATVAAIPIPLEQVSSFGIIRTDSAGRIRDFQEKPQSAEPMPNRPGVALASMGNYVFSTDVLVDALTRAHSKGGHDFGKNLLPAMCESHRLMAYDFSSNRVPGIRDFEDASYWRDVGTIDAYYAAHFDTLGECPAFCMSNPRWPIYAAPDQTEAAQVHDGHIRSASLGAGVLVRRATIERSLIRREVVVEEGAEVADSIVMDRTVIGAGAKIRRAIIDQNNFIPPGMRIGYDREADRARFHVTDSGIVVVAKGQLKP

SEQ ID NO: 61442 - protein, 458 aa, Solanum lycopersicum
MAKTNGFMGHDMLAPFTAAWMIDMGPLVIDKAEGSYVYGVNGKKYLDSLSGLWCTVLGGSEPRLIEAASKQLNKSAFYHSFWNRTTKPSLDLAKELINMFTANKMGKVFFTSSGSEANDTQVKLVWYYNNAIGRPNKKKIISRKNAYHGSTYMTAGLSGLPSLHLKFDLPPPYILHTDCPHYWNYHLPGETEEEYSTRLANNLENLILKEGPETVAAFIAEPVMGGAGVIIPPATYFEKIQAVLKKYDILFIADEVICGFGRLGTMFGCDKYNIKPDLVSIAKALSGGYIPIGAVLVSEEISKVIMSQSNQLGVFCHGFTYSGHPVACAVALEALKIYKEKNITEVVNKLSPKLQEGLKAFIDSPIIGEIRGTGLVLSTEFVDNKSPNDPFPPEWGVGTYFGSQCQKHGMLVSFSGDHVNMAPPFTLSLEELDEMISIYGKALKDTEKRVEELKSQKK

SEQ ID NO: 61443 - protein, 520 aa, Solanum lycopersicum
MAKITSLIGSGIVAATNQVGPHVKHIPAVGNLQKQIVSDQIQVRWSSTETSLKNDISATDVRGYKGHDMLAPFTAGWHSTDLEPLVIQKSEGSYVYDVNGKKYLDALAGLWCTSLGGNEPRLVAAATKQLNELAFYHSFWNRSTKPSLDLAKELLDLFTANKMAKAFFTNSGSEANDTQVKLVWYYNNALGRPDKKKFIARTKSYHGSTLISASLSGLPALHQQFDLPAPFVLHTDCPHFWRFHQPGETEEEFSTRLANNLENLILKEGPETIAAFIAEPVMGAGGVIPPPATYFEKVQAILKKYDILFIADEVICGFGRLGTMFGCEKYNIKPDLVSVAKALSSGYMPIGAVLVSPEVSDVIYSQSNKLGTFSHGFTYSGHPVSCAVALETLKIYKERNIIEQVNRISPKFQEGLKAFSDSPIIGEIRGTGLLHGTEFTDNKSPNDPFPPEWGIGAYFGARCEKHGVLVRVAGDNIMMSPPYILSLEEIDELIIKYGKALKDTENRVEELKSQKKIKSS

SEQ ID NO: 61444 - protein, 532 aa, Zea mays
MEENFQDVETTNQLDSHAAVPHHISWDAPKPTLPTDCEHDPVVPCSACSLDASHTETIIPSTQIRDIASSTERTSPDILSEFFAYADSSAQSSSPFIDPIHSLNMPNYEPQRWSFFRNLAQNEFPKKDEAQDLAKIEEGVYPLDHLEHDTTNVKNLDLQSDTTVEVPSIVSRTNVDPSISIPGFVSSQIDNPTTTKNVEGFQVDNPFTNMHEMMPPHLDFEGQKTEEGRAVGPVMDTSFKDNDFEYLQIIKNEDLEELRELGSGAFGTVYHGKWRGSDVAIKRIKKSCFTGRSSELERLAHEFWREAEILSKLHHPNVVAFYGVVKDGPGGTLATVTEFMVNGSLRHVLQRKDKYLDRRKRLIIAMDAAFGLEYLHSKNIVHFDLKCDNLLVNLKDQSRPICKVGDFGLSKIKRNTLVSGGVRGTLPWMAPELLNGSSNKVSEKVDVFSFGIVMWEILTGEEPYANMHYGAIIGGIVNNTLRPHVPASCDPEWRRLMEQCWAPDPAQRPAFTEIAGRLRSMSVAANQAKATK

SEQ ID NO: 61445 - protein, 278 aa, Streptococcus thermophilus CNRZ1066
MKVDDDLVRQVIRPRLRESHKGSYGRVLLVGGLYPYGGAIIMAAIACVNSGAGLVTVATDRENIIALHAHLPEAMAFDLRETERFLDKLRAADVILIGSGLGEEETADWALELVLANIRSNQNLVVDGSALNLLAKKNQSSLPKCHLILTPHQKEWERLSGLAISEQSVSNTQRALEEFQSGTILVAKSHKTAVYQGAEVTHLEVGGPYQATGGMGDTLAGMVAGFLAQFASTDSYKAVIVATWLHSAIADNIAENAYVVLPTRISKAIPSWMKKLSL

SEQ ID NO: 61446 - protein, 276 aa, Arabidopsis thaliana
MASHDHHHHHHDHEHDHDRKSDGGEGKASWVGKDGKVYHSHDGLAPHSHEPIYSPGYFSRRAPPLHDRNFSERAFTVGIGGPVGTGKTALMLALCRFLRDKYSLAAVTNDIFTKEDGEFLVKNGALPEERIRAVETGGCPHAAIREDISINLGPLEELSNLFKADLLLCESGGDNLAANFSRELADYIIYIIDVSAGDKIPRKGGPGITQADLLVINKTDLAAAVGADLSVMERDSLRMRDGGPFVFAQVKHGLGVEEIVNHVMHSWEHATGKKRQ

SEQ ID NO: 61447 - protein, 177 aa, Triticum aestivum
  misc_feature (16)..(16): Xaa can be any naturally occurring amino acid
MVYHSSFIDDDGIGTXAKACGCPLLPLKTHIKGPAPAADSDKADIVDEAITFFRANVFFKNFHVKSPADKLLIYLTSYINMALKRLETCRTLAVGTKAIINLGLETVPVPGEPGFPFPALFTLPQSQEEAELLRNYLKQIREETSGRLLNCAYRANGTPNKWWLAFAKRKFMNLVIL

SEQ ID NO: 61448 - protein, 163 aa, Triticum aestivum
  misc_feature (39)..(39): Xaa can be any naturally occurring amino acid
  misc_feature (109)..(109): Xaa can be any naturally occurring amino acid
  misc_feature (111)..(111): Xaa can be any naturally occurring amino acid
  misc_feature (147)..(147): Xaa can be any naturally occurring amino acid
NSCSCKLWPQVYTAIISLTGMGYGSMVVAANNRATCHGXRLLKDTQTITRFDSLHKLLAHDAYILNCLLSPEFCDPNMYLATASSDHTAKIWNVDVFKLDKTLFAHHRXFXDCGFSVYGAYLITASPDTTPRLCAMSTVEAIRMNQXHHISTVCCALHDGARS

SEQ ID NO: 61449 - protein, 333 aa, Fagopyrum esculentum
MAPELITIGADHSILPAESLIPVDRAYVTFLAGNGDYVKGVVGLAKGLRKVKAAYPLVVAVLPDVPLEHRRLLEAQGCIVREIEPIYPPENNCEFAHAYYVINYSKLRIWEFVEYSKMIYLDGDIQVYQNIDHLFDQPDGYFYAVMDCFCEPSWSKTIQYKIGYCQQCPEKVAWPLEAGPKPSLYFNAGFFVYEPSLETYKDLIDTLKVTTPTSFAEQDFLNMYFKDKFKPLPIDYNLVLAFLWRHPEKVDLNRVKVVHYCAAGSKPWRYTGKEENMDREDIKLLVKKWWDIYNDESLDLKKPVHLVQQPTEVLKAALSEARPVKYVAAPSAA

SEQ ID NO: 61450 - protein, 1442 aa, Saccharomyces cerevisiae
MTASDLLTLPQLLAQYSSSAPQNKVFYTTSTKNSHSSFKGLESVATDATHLLNNQDPLNTIKDQLSKDILTTVFTDETTLVKSIHHLYSLPNKLPLVITVDLNLQDYSAIPALKDLSFPILISSDLQTAISNADSSYKIATSSLTPVFHFLNLEKIGTSTAIEQDIDFPTLEIANEETKVALSEATDSLTNFELVKGKESITTVIVNLSPYDAEFSSVLPSNVGLIKIRVYRPWNFSKFLEILPSSVTKIAVLQGVSKKSQSNEFQPFLLDFFGNFNELVSRNIEQVVLTNIGNVNDYGNVINTVISNINKKEPDNNLFLGESNEKAEEQAEVTQLISSVKKVVNLEDAYIKVLKQLFSSNLQILNQFSSETIEPSNPEFGFGRFLKQEAQREELISLAKTSLDPSLYLSEDANKIVQLLSKWLSFNGRDLDEAQLQEANATGLEIFQLLQSNQDSSTVLKFLKIAPTSDSFIFKSSWLIGSDAWSYDLGHSGIQQVLSSRKNINVLLIDSEPYDHRKQNQDRKKDVGLYAMNYYSAYVASVAVYASYTQLLTAIIEASKYNGPSIVLAYLPYNSENDTPLEVLKETKNAVESGYWPLYRFNPVYDDPSTDKEAFSLDSSVIRKQLQDFLDRENKLTLLTRKDPSLSRNLKQSAGDALTRKQEKRSKAAFDQLLEGLSGPPLHVYYASDGGNAANLAKRLAARASARGLKATVLSMDDIILEELPGEENVVFITSTAGQGEFPQDGKSFWEALKNDTDLDLASLNVAVFGLGDSEYWPRKEDKHYFNKPSQDLFKRLELLSAKALIPLGLGDDQDADGFQTAYSEWEPKLWEALGVSGAAVDDEPKPVTNEDIKRESNFLRGTISENLKDTSSGGVTHANEQLMKFHGIYTQDDRDIREIRKSQGLEPYYMFMARARLPGGKTTPQQWLALDHLSDTSGNGTLKLTTRATFQIHGVLKKNLKHTLRGMNAVLMDTLAAAGDVNRNVMVSALPTNAKVHQQIADMGKLISDHFLPKTTAYHEVWLEGPEEQDDDPSWPSIFENRKDGPRKKKTLVSGNALVDIEPIYGPTYLPRKFKFNIAVPPYNDVDVLSIDVGLVAIVNPETQIVEGYNVFVGGGMGTTHNNKKTYPRLGSCLGFVKTEDIIPPLEGIVIVQRDHGDRKDRKHARLKYTVDDMGVEGFKQKVEEYWGKKFEPERPFEFKSNIDYFGWIKDETGLNHFTAFIENGRVEDTPDLPQKTGIRKVAEYMLKTNSGHFRLTGNQHLVISNITDEHVAGIKSILKTYKLDNTDFSGLRLSSSSCVGLPTCGLAFAESERFLPDIITQLEDCLEEYGLRHDSIIMRMTGCPNGCSRPWLGELALVGKAPHTYNLMLGGGYLGQRLNKLYKANVKDEEIVDYIKPLFKRYALEREEGEHFGDFCIRVGIIKPTTEGKYFHEDVSEDAY

SEQ ID NO: 61451 - protein, 269 aa, Zea mays
MSYYERRGGDRGSGRIQGSGGRGGHVLRGRSGLAPRGLLGVNSRPSARTIAKSFSRTKDMTWRPDLFSDSMAASGIETGTKLYISNLDYGVSNEDIKELFSEVGHLKRFAVHYDGYGRPNGTAEVVFTRRSDAIAALKRYNNVLLDGKAMKIEVIGNDLGLPMTPRINVVGASNGRATRTVVMTPEFSQRGRGSSSRPLSNRFNNRGGFQAGRGRGQFQSWGRGRGQFQSRGRGRAQFQGRGRGRKPEKTADELDKDLESYHAEAMKTD

SEQ ID NO: 61452 - protein, 446 aa, Streptomyces coelicolor A3(2)
MRYGEATVTVVDPRSYMTYQPFLPEAAAGSISPRHVVVPLRRVLPKAEVLTGRVTTIDQDRKVATVAPLVGEAYELPFDYLVIAMGAVSRTFPIPGLAEQGIGMKGIEESIGLRNHVLEQLDKADSTTDEEIRRKALTFVFVGGGFAGAETIGEVEDMARDAAKYYNNVSREDMRFILVDAADKILPEVGPKLGQYGKEHLEGRGVEVYLSTSMDSCVDGHVVLKNGLEVDSNTIVWTAGVKPNPALARFGLPLGPRGHVDTQATLQVQGTDYIWAAGDNAQVPDLVGRKAGNENAWCPPNAQHALRQAKVLGDNVISGMRGFPQKPYSHANKGAVAGLGLHKGVAMIVMGKMKIKLKGRLAWYMHRGYHGMAMPTFNRKIRVFADWTLGMFLKREVVSLGAMETPREEFYEAAKPAPKPAAAKAADQGDQSEKAAKQEKTEAKAS

SEQ ID NO: 61453 - protein, 884 aa, Moorella thermoacetica ATCC 39073
MASKKYVYLFSEGKADMRLLLGGKGANLAEMTNIGLPVPQGITITCEACNEYNRLGQQFPEGLEEEVAARLKDLEAINGKKLGDPENPLLVSVRSGAPVSMPGMMDTILNLGLNDNSVKGLAAQTGDERFALDCYRRFIQMFGNVVLGIEHNDFEAVLEKHKERLGVKFDHELTPDALREVIAEYKDVVKSRSGRDFPQDPREQLYMAIRAVFDSWNNPRAIVYRKINKIPDDLGTAVNVQTMAFGNMGPTSGTGVAFTRNPSTGEKGIYGEYLINAQGEDVVAGIRTPKPISSLKEEMPEVYRQFEDICQLLEKHYRDMQDIEFTIEKGKLFILQTRNGKRTAAAAVKIAVDMVNEGLITKEEAVLRVDADQLIQLMHRRIDPSAKLEVVAKGLPASPGAASGQVVFDADDAEKMGLDGQKVVLVRTETTPDDIHGIVQAQGVLTARGGMTSHAAVVARGMGKPAVTGCDAIKIDVENKRFFIGDLVVKEGDVISIDGSTGNVMLGEVPLIDPQLTGEFETILEWADSFRRLKVRANADTPEDARRSREFGADGIGLTRTEHMFMQVDRLPVVQQMILAKTKEERQAALDKLLPMQQGDFYGILKAMEGLPVTIRLLDPPLHEFLPNIEELLVDVTRLQATNGDSKELEEKQALLREVRARHEFNPMLGHRGCRLGITYPEIYAMQVRAIFQAVAQLVKEGVKVLPEVEIPLVIHVNELQRLHAMVDEVAAAVKKETGVDFDYKVGTMIEMPRACATADEIAREAEFFSFGTNDLTQTTFGFSRDDAEGKFLHQYVDEKILKEDPFIVLDRDGVGKFMKMAVELGRSTNPKLEIGICGEHGGEPSSVEFCHQIGLNYVSCSPFRVPVARLAAAQAALKEKKGK

SEQ ID NO: 61454 - protein, 511 aa, Campylobacter lari RM2100
MKKADILVLDFGSQYTQLIARRLREQGVYAEILPFNVSLDEIKAKEPKGIILSGGPASVYANDAYFCDKGVFDLNIPVLGICYGMQLMAHHFGANVAPAGHKEYGKATIDIQNDSDLFKNLPKKQTVWMSHSDKVENLPQGFEVLATSENSPFCVFGDEKRKFFALQFHPEVQHSEFGKSILKNFAKYACNCDSVWNMGSFAKTQAQKIKEEVGNDKVLCAVSGGVDSSVVAALLASAIKDQVVVVFVDNGLLRSGEKEQVEYMFKHTLGIDLISIDAREIFLSRLAGVRDPEQKRKIIGNTFIEVFEEEAKKHKDVKYLAQGTLYTDIIESSVVGASKTIKSHHNVGGLPEKMNLKLIEPLKEIFKDEVRALGMELGLSKDVVYRHPFPGPGLAIRIMGEVNEPSLELLRKADVILIEELKSSGWYDKTWQAFCVLLNVQSVGVMGDNRTYDNAVCVRVVNASDGMTATFSHLPYELLENISRRIINEVNGINRVVYDISSKPPATIEWE

SEQ ID NO: 61455 - protein, 1155 aa, Medicago truncatula
MDDRNIDDDEKESLAGLSSVPPRRKTHSYSQQLRDTSTHKRHHQVRKHSLDDSLISNNIVESSSFYEESDTDDDDFFANSNSVGAEDYIESGGISDDLSHYQPLQEFIGSGGGTGVFKAPIRMAVHPGRPPCLELRPHPLRETQVGKFLRNIACTETQLWAGQECGVRVWEFQKAYEHGCGLGGRVRRGDEDAAPFYESADTSPTFCLTVDNGNKMVWTGHKDGKIRSWKVDQQFSTPFKEGLSWQAHRGPVLAMIISSYGDLWSGSEGGVIKIWPWESIEKSLSMSPEEKHMAALLVERSFIDLRTQVTVNGVCSISSQEVKCFLSDHIRGRVWCATALSFSLWDARTKDLLKVFNIDGQAENRVDMSSVQQDQAVEDEMKVKFVSNSKKEKSQSTSFLQRSRNAIMGAADAVRRVATKGAGAFVDDTKRTEALVQTNDGIIWSGCTNGLLVQWDGSGNRLQDFNRHPCAVQCFCTFGTRIYVGYVSGIIQILDLEGNIIAGWVAHNSPVLKLAVGNGSVYSLATHGGIRGWNIASPGPVDNIIRTELASKELTYTRRHGIRILIGTWNVGQGRATQEALLSWLGSVVSDVGIVVVGLQEVEMGAGFLAMSAAKETVGLEGSAMGQWWLDTIGKALEEGKAFERMGSRQLAGLLISLWVRKNLRKHVGDIDAGAVPCGFGRAIGNKGGVGLRIRVYDRIMCFVNCHLAAHLEAVNRRNADFDHIYKNMVFSRSSTLLNTAAGMLPYLFLYCSLAFSTYLFWLLYSCGLPFILSVAAGVSTSAHMLRSTNAMGSSSEDAKPELSDADMVVFFGDFNYRLFGISYDEARDFVSQRCFDWLREKDQLREEMKNGKVFQGMREAVIKFPPTYKFERHLPGLGGYDSGEKKRIPAWCDRIIYRDTRPAAVSDCNLDCPVVSSILQYDACMDVTESDHKPVRCKFNVRISHADRSIRRKEFGEIMTSNEKIRSMLEESRYVPECNVSPDNLVLENQEASFLLITNRSTNDKAVYKITCDGQSTVKNDGEAPDYTPRGAFGFPRWLEVSPSIGIIKPEQTLEVSVRHEDVHASEELVDGIPQTWWSEDTRDKEVILVVHVQGSSSVQTSSHKIHVRHCFSGKPTRTDSKSNSARRSHVFDEATSQELTSAFTFAPLSPWRA

SEQ ID NO: 61456 - protein, 323 aa, Azoarcus sp. BH72
MILCGDIGATKSLLGLAEARGGAIHIKLVRRYENREWPGFGELVDDFLAEAAAARGEAVELTVAGFGIAGPVGPDGVHMTNLDWYIGPGPLRSVLGGAPVRLLNDFEASALGIGDLGGDGCLPLQPAPALSTAPQLVIGAGSGLGVALRVPTANGVVVVPGEGGHVGYAPRNEEQLALWRQLRAGSGRLSVEHVVSGPGLGRIYEWLAETRASTGPCGELVWERAVEGNLHARHAIDLFLDSYGAVAGDFALATLARGGVYLTGGIGPRLLTAPAAAARFLAAFRDKAPHGALMTQMPVHLVVDDKLPLLGAARAATDLLPTA

SEQ ID NO: 61457 - protein, 317 aa, Moorella thermoacetica ATCC 39073
MAKVITIGEILVEIMTKYTGQEFTAPGELLGPYPSGAPAIFIDQVARMGVEAGIIARVGDDDFGLLNLTRLRDDGVDTSHIYKTKGYTTGTAFVTYYANGERKFIFHFPHAAAGQLGPADVDENYIKTAEYLHVVGCSLTASASLRQAIWKAVKIAKENKVKVSFDPNLRPELLNEQEIKNVYDDILDAADIILAGKSEMIALSGEGDLVKGIARLKKRDGTMLVLKDGARGASLYYGEECYHVPPVKVQEVDPTGAGDCFDGAFIAALACGKGLKEALQIANVAGALSVTRKGPMEGAAFKEDILALYSRHNSSKV

SEQ ID NO: 61458 - protein, 307 aa, Helianthus annuus
MANFPVINMENLNGSERGVTMEKINDACENWGFFELVNHGIPHDLLDKVEKMTKDHYKKCMEQRFKEMVAAKALEGVKAEVTDMDWESTFFLRHRPTSNISEIPDLVDEYRELMKDFAGKLEKLAEELLDLLCENLGLEKGYLKKAFYGSKGPNFGTKVSNYPPCPTPDLIKGLRAHTDAGGIILLFQDDKVSGLQLLKDGEWIDVPPMRHSIVINLGDQIEVITNGKYKSVMHRVIAQTDGTRMSIASFYNPGNDAVIYPAPTLLEKEPTEKEQSYPKFVFDDYMKLYAGLKFQAKEPRFEAHESS

SEQ ID NO: 61459 - protein, 489 aa, Arabidopsis thaliana
MLFKMRSFVAFVLLLSWFGSCCSLKDQAVDFLQSEDSLKKDLSSDEDSTYLKAFGFHRKTLVRNPYKDLPSRKDRKNRVVAATTTPSSSPKPAPKHVSTKASTVSEPQKRSSTQDVSPSPSAPLANSPIPRNSHSSVPLVVGCVGGAFFLLLVATGLYFFTSKAGKTVNPWRTGLSGQLQKVFVTGIPVLKRSEIEAACEDFSNVIGSCPIGKLFKGTLSSGVEIAVASFATTTAKDWKDSTEIHFRKKIEMLSKINHKNFANLLGYCEEKEPFTRILIFEYAPNGSLFEHLHYKESEHLDWGMRLRIAMGLAYCLDHMHQLNPPIAHTNLVSSSLQLTEDYAVKVSDFSFGSSETETNINNNTVIDTHISALNPEDNVYSFGLLLFEMITGKLIESVNKPDSVDSSLVDFLRGETLAKMVDPTLESYDAKIENIGEVIKSCLRTDPKERPTMQEVTGWLREITGLSPNDATPKLSPLWWAELEVLSTA

SEQ ID NO: 61460 - protein, 349 aa, Aspergillus oryzae
MPITNRQAIYANTPSPAIDPSLSNGTFKISTTTISDNVPDDKVLVRVHYLSLDPAMRQWLTAKRSYIAPVERGSVMRGQSIAQVIGVGSNLKTQYKAGDWVIAYSGWQEYALLGQKEAQKVVIPPGCRPTDAMSVLGMTGLTAYFGMTEVGQPKPGDTVVVSGAAGATGMVAGQIAKIKGAKRVVGLAGSAEKCAFLRNELGFDAAINYKDKDWKKQLKDATPEYIDVFFDNTGGEILDACLARAARDARFAICGAISQYNSAKPQGPASFMTVIGFIVFDYAKKYPIALKDLSEWLTQGKIKRKEHIVPGGLEAAPQGLVDLYGGVNTGKMMVEVAPVSEAIGAKAKL

SEQ ID NO: 61461 - protein, 422 aa, Rhizobium leguminosarum bv. viciae 3841
MNHFEYRDGVLHAENVPVPEIAKAVGTPFYVYSTATLERHYRVFSEAFADMDSMVCYAMKANSNQAVLKTLGRLGAGIDVVSEGELRRALAADIPANRIMFSGVGKTPSEMDFALEAGIYCFNVESEPELEILNQRAVSAGKKAPVSFRINPDVDAKTHSKISTGKKENKFGISWERARAIYAHAARLPGIEVTGIDMHIGSQITELQPFDDAFKLLHDLVATLRADGHTIHHVDIGGGLGIPYKDDNNPPPLPDAYAAIVKNQLRGLDCKIITEPGRLIVGNAGILVTEVLYVKDGGEKTFVIVDGAMNDLIRPTLYEAYHEIRPVTISAANAPRIRADVVGPVCETGDYLALDREMAMPKPGDLMAVSTAGAYGAVQAGTYNSRLLVPEVLVRGSDFHTIRPRRTYAELISLDSVPAWLD

SEQ ID NO: 61462 - protein, 387 aa, Aspergillus oryzae
MSQLQNSYGTCTTHRHQLKLKFPEHKSSLKLLSALTFPNVLARCWLPRESTDDEERQTLLTPSSTAPSTLTERYGLSTIILHYGVHSSVRVCTRKSPSAGASRQLHVVKILRRSSDALVRATQRFEQSLSSAVSHPNLLQTIDVLQNEHGETCLVMDYCAGGNLNALIATAEDSIDALQADCFFKQIMRAVTYLHDNAIAHRGLKTENILLTAHGAVKVADFGSAEWLLDEVADGEHAENRIRLQLSSLYSPRKLRGSIPYLPPEEFSNYATVDPRAGDVWAAGLVYMAMRCGRLLWRMPCADEDGGYSAYLRGRQTYDGYPPIEALEEVRFSSGFQGLGESLFTRCRNVIYAMLHPDPVRRIKASEVLRSEWVYYVQVCDAGEIGW

SEQ ID NO: 61463 - protein, 944 aa, Yarrowia lipolytica CLIB122
MSEYLPPPPPLSPFSEWFEFGDTDLQIDKLQLAPDQSTATAPSTAGTTSASAPTQPPPPPPAPFISARESSMNVGPQHLPRDMGRPPQPTHSQSQPSHSQIHTQIPKHAPPPIPTLKKPPPPIRHYSSPSNGSSAANAIPGANHPPPQAQSQHSQAAQAAQQAHAALHAAQSASAPVSAVSPVSNTPLVTSWDKTKVAEWLRSLKCAEYIPMFEQNEICGEVLLEIDQKLLKDMGVVKVGDRVRINVAIKDLRSQHRKTTLQNQQPTPHQRSQHRTGKTLSYLDEQCVSPFASHGLGISSSSGTPVTPDRASSAGSDFSSHLRPQTARAPSSTTSTGDVKGILSMDQVRQGTVKFIYTMGQSKTVNISGCFNAESIIRTALKKFAIKDSPNNWCIHVSDNAFATSTRIVSDNELVTICHSPSRAERRRLMLCLNDMPPTQKQFAKSQSVLLESVDTNTNSSSSSGNYSANQPTISQLSGDYFSSDPQKMAPLPRSNLPHNSRRLQRFGHRPPSELISSNLAEYFPQAGSKVLEQTIRNSIRFSNRMSRMSTSTASNYHYNRMSIATISSFMNNEGGIGSENDSDNIPAVPEIPSDLSMPQTLTRESMQPSRTQSSSQVERGSSLRKSTASIPATLETLSQQEEAASAAASATASLVDPPHSATPSEDDMSDEQIIAMQSEAPKNWIKGTLIGQGSFGCVHLGMNSLTGELMAVKQVSLGDFSKTSHKQAMVDALQREMNLLRDFQHDNIVQYLGSSSDEEYLNIFLEYVPGGSVSSMLTKYGQFEEPLVKHFVRQILKGLDYLHSRNIIHRDIKGANVLVDNKGNVKISDFGISKKIEASSSNRQSLQGSVYWMAPEVVKQTSYTLKADIWSLGCLIVEMLTGSHPFPQFSQMQAIFKIGTSGRPDIPENCSEDTKDMLRQTFEQDYNKRPSAAELLAHEFLNT

SEQ ID NO: 61464 - protein, 448 aa, Sphingomonas sp. RW5
MSDYDYDLIVIGAGSGGVRAARVAAAHGARVAIVEEYRVGGTCVIRGCVPKKLLIYGAHFAEDLRDARQFGWQVPDCQFDWPTLRDNVLAEVDRLEGLYRNTLGSHGVTILPGRGTIIGPHGVRIAGGQDVTSRMILVATGARPLLPSFDGAEHGISSNEAFHLDDVPRRIAIVGGGYIANEFAGIFNELGSAVTVINRSGQLLRGYDHSVRDRLVEISTRKGIAFRFDASFEKVIKLADGSLSVQLAGEDAFSVDCLMFAIGRVPNSSDLGLEEQGVEIDPLGAIIVDDDGRSTVGSIFAVGDVTNRIQLTPVAIREGQAFADTQFGGKPHRVDYRHVPSAVFSHPPIAFVGLTEQQARDQVGEVKIYTSDFRPMKNVLAKRDERALYKMICDADTDRILGLHMIGPDAPEILQAAAIAVKAGLSKAAFDETIALHPTMAEELVLLR

SEQ ID NO: 61465 - protein, 317 aa, Erythrobacter sp. NAP1
MNLMTDNQSANEIASVSLAKPLEEIADELGRSFGEFGFAVVRDHGIPQDLIDRAEATSKAFFALPEDVKRAYKIEGGGGARGYTPFGTEKAKDAEVFDLKEFWHVGRSLPEGHDLAEYMAPNVWPDEIKEFEDTFSELYAAFEQTGLRVLEAIALHLGLDRNFFAPTVEDGNSVMRLLHYPPLPEDAPEGAIRAAAHGDINTITLLLGAEEAGLQLLTKSGEWHPVYAEEGSLVINVGDMLERLTAGVLRSTTHRVVNPSGEGARRSRYSMPFFLHFRPDYMITPLESCVSEKGAKPQEPISSHDFLMQRLREINLA

SEQ ID NO: 61466 - protein, 334 aa, Streptomyces viridochromogenes
MTTEEGKPAMSAEPRAVRLYRTMRLIREFEERCLAMSLSGEIVGGIHPYIGQEAVAAGVCAALTDDDVVTSTHRGHGHVLAKGADPKRMLAELCGTTAGLNRGRGGSMHAADVSLGVYGANGIVGAGAPIAAGAAWSFQRRGDGRVAVAFFGDGALSQGVVLEAFNLAALWRLPVVFVCENNGYATSLPLDRALAGDPVERAAGFGLTARAVDGMDADAVADAAAEAVERCRRGGGPTFLDCRTYRFNGHHSFEEQVGLNYRDDAEVGEWRARDPLRTQSTRVDGATAGAIDAETSTLIDEAVEFARAGRAPDPAEALHHLYADGTTPRPGVMI

SEQ ID NO: 61467 - protein, 320 aa, Streptomyces viridochromogenes
MAALAYITALNQALHDEMARDDRVCVFGEDVRIGLTQVAKGLHERFGDGRVVDTPLSEQAFTSLATGAAMAGQRPVVEYQIPSLLYLVFEQIANQAHKFSLMTGGQVEVPVTYLVPGSGSRSGMAGQHSDHPYSLFAHVGIKTVLPATASDAYGLLLSAVRDPDPVAVFAPSALMGTVEEVSGELGPVPLGSARIHRTGEDVTVVATGQCVHVALAVAEAMADEASIEVVDPRTIYPVDWETIRASAEKTGRLVVIDDANRMCGFGGEVLATAAEQFDLTARPRRVTRPDGAVIPYALVLDQALLPDAAQLTDAIRAVLK

SEQ ID NO: 61468 - protein, 515 aa, Medicago truncatula
MIVLSYPVFLSYAPNSPLSTQSTTILGIINEHINFQVTSGQPSLISDDPEAVTLTGSSQEAANQTNQKEIHWGLLEDSLEERLEKPGALLSDSEKGDGEAKEGENDENKKRSIEVGKQGASSKKMKKDRGGTATGKSAKPEVTTVSAAPRVKAELPLPIIPTEVEHSILEDLRNRVQLSSVALPSVSFYTFINTHNGLSCSSISHDGSLVAGGFSDSSLKVWDMAKLGQQPSSSLSQGENDTSQNEQMLGKSGGKRQYTLFQGHSGPVYAASFCPVGDFILSSSADSTIRLWSTKLNANLVCYKGHNYPVWDVQFSPMGHYFASSSHDRTARVWSMDRIQPLRIMAGHLSDVDCVQWHANCNYIATGSSDKTVRLWDVQSGECVRVFVGHRGMILSLSMSPDGRYMASGDEDGTIMMWDLSSGRCVTPLVGHTSCVWSLAFSSEGSILASGSADCTVKLWDVNTSTKVSRTEEKNGNANRLRSLKTLPTKSTPVNTLRFSRRNLLFAAGALAKNA

SEQ ID NO: 61469 - protein, 857 aa, Erythrobacter sp. NAP1
MNISYNPKALTECDREPIHNIAAVQSFGGMLVTNSEWVISQRSVNCAKLLAIDALPEPGTNLADIIESAALQALREAASRLEGADAVERIFGIRFTEEAELFDCALHCSEGKFIIEFEPHDAKGYADHLMLMGPALAQLEPIRDLDTLCRKAAKLVKQMLGYDRVMIYKFYPDESGEVIAEEKREDLQSYEGLRYPRADIPQQARELFRRNRFRIIADMEEAPVLIEPTLSIKNEPLDLSMSTLRAHSQMHVQYMKNMGVKASLAIAIVRHGELWGMISCHHYEPRLPAYSLRTVADMFSQMFSLMIDRLLIDRSEELRSRGRALHDQLMVRLAGGAKLSEHLPMLEELLNHLIQHDGMSVLMDETYMTSGVAPTREQFLAITPTLGSMPISENFATSEIQSQIPQAMGFKDVAAGALALPISRSPRDYLVLWRRPLTQKVTWAGNPEKAVATPGERLQPRGSFDAWEQTVEGCSEEWSDDELQIAEGLRVTLLEIVLRMTDEISRERKKAQEQQELLIAELNHRVRNILNLISSLVQQSQGAAHDVKDFASIIGGRIAALASAHDNITRENWAPAPLSSLIESEFAAYAAGNENRCRLVGDDMLVTPEAYTVLALVLHELVTNSVKYGALSNETGRIEVTVGLSSAGALKLGWRESGGPPVKPPTRRSFGSIIIERSIPFELSGEADLRFTLGGVEADFVVPARFVGEKTEMPQEATKSRKAADASGTSGKTSGKTPKKSLPNRVLLVEDNMIIALGTEDNLRILGVEDIDVQSTVAGTLEAIKSTPPDFAILDFNLGTESSLAVSEELRAREIPFVVATGYSEIDDQINELGAEGVIQKPYGLEEIELALTTIIN

SEQ ID NO: 61470 - protein, 277 aa, Lotus japonicus
MCEALKSQYQLCEEIGRGRFGTIFRCFHPISTDTFAVKLIDKSLLADSTDRHCLENEPKYMSLLSPHPNILQIFDVFEDDDVLSMVIELCQPLTLLDRIVAANGTSIPEVEAAGLMKQLLEAVAHCHRLGVAHRDVKPDNVLFGGGGDLKLADFGSAEWFGDGRRMSGVVGTPYYVAPEVLMGREYGEKVDVWSCGVILYIMLSGTPPFYGDSAAEIFEAVIRGNLRFPSRIFRNVSPAAKDLLRKMICRDPSNRISAEQALRHPWFLSAGDTVNVT

SEQ ID NO: 61471 - protein, 569 aa, Shewanella sp. MR-7
MLTDMDISRRADLKDIAALGAEFGLLPDEMQLFGKTKAKVDLRVQQRLAEQQGKLIIVTAVTPTPHGEGKTVTTIGLTQSLKALGNKVCACIRQPSMGPVFGVKGGAAGGGYAQVVPMQELNLHLTGDIHAVSSAHNLGAAAIASRLYHETRLGKAEFELQSGQNYLDIAPNGIRWHRVVDHNDRCLREIEVGLGENNGPAYTSGFDITAASELMAILALSRNLADMRARIGKLVLAVNRQGAAISAEDLGVAGAMTALMADAVKPTLMQTLNGAPCLIHAGPFANIAHGNSSVIADDIALKLADFVVTEGGFGSDMGFEKFCNIKARQSGLAPSTAVLVTTLKALKANSGLTSDADINAPDQARLEAGFANLNWHINNVARYGIPVVVAINRFATDTDAELNWLIEAVSGTAAFGCELSETFSQGEAGALALAQTVMRACEQPSEFTLLYPDDMALEAKLSTLAEVGYGAAGVSLSEAAKLQLQELSALGYAHLPVCMAKTPLSISHDPQLKGVPQGFIVPVRELVLNAGAGFITALVGNVMTMPGLGLVPGYLKIDIGADGEITGLG

SEQ ID NO: 61472 - protein, 194 aa, Coccidioides immitis RS
MVVATIKCVVVGDGAVGKTCLLISYTTNKFPSEYVPTVFDNYAVTVMIGDEPYTLGLFDTAGQEDYDRLRPLSYPQTDVFLVCFSVTSPASFENVREKWFPEVRHHCPGVPCLIVGTQTDLRDDPAVREKLSKQKMAPVRKEDGERMARELGAVKYVECSALTQYKLKDVFDEAIVAALEPPSTRKKSRVCKIL

SEQ ID NO: 61473 - protein, 472 aa, Daucus carota
MVFFRSVSLLNKLRSRAVQQSNLSNTVRWFQVQTSASDLDLRSQLKELIPEQQERIKKLKAEHGKVQLGNITVDMVLGGMRGMTGLLWETSLLDPEEGIRFRGLSIPECQKLLPGAKPGGEPLPEGLLWLLLTGKVPTKEQVDALSAELRSRAAVPEHVYKTIDALPVTAHPMTQFATGVMALQVQSEFQKAYEKGIHKTKYWEPTYEDSITLIAQLPVVAAYIYRRMYKNGQSISTDDSLDYGANFAHMLGYDSPSMQELMRLYVTIHTDHEGGNVSAHTGHLVASALSDPYLSFAAALNGLAGPLHGLANQEVLLWIKSVVSECGENVTKEQLKDYIWKTLNSGKVVPGYGHGVLRNTDPRYICQREFALKHLPDDPLFQLVSNLFEVVPPILTELGKVKNPWPNVDAHSGVLLNHYGLTEARYYTVLFGVSRAIGICSQLVWDRALGLPLERPKSVTMEWLENHCKKSS

SEQ ID NO: 61474 - protein, 299 aa, Zea mays
MAAAAPTHAPVSSSACRAGFSSSGVSFPNFRSAAASAPGWRRREPYPAVSVVSSSPQSVAGAITVDTEVDTLLDSVKWDSKGLAVAIAQNVDTGAILMQGFANKEALAKTISTRKATFFSRSRSSLWTKGETSMNFINVHDIFLDCDHDSIIYLGKPDGPTCHTGAETCYYTSVYDALQSSKPNEGRQVMTTLYSLEDTISRRHEEKVTDGGGKPSWTKKLLLDNQLLCSKIREEAGELIQTLLENEDQSRAASEMADLLYHAMVLLRVKDVKMEQVLEVLRKRFSQSGIEEKASRNKS

SEQ ID NO: 61475 - protein, 305 aa, Miscanthus sinensis var. sinensis
IESVGEGVTDVAPGDHVLPVFTGECKECPHCKSAESNMCDLPRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASRIIGVDLNPSRFEEAGKFGCTEFVNPKDHKKPVQEVLAEMTNGGVDRSVECTGNINAMIQAFERVHDGWGVAVLVGVPHKDAEFKTHPMNFLNERTLKGTFFGNFKPRTDLPNVVELYMKKELEVEKFITHSIPFAEINKAFDLMAKGEGIRCIIRMEN

SEQ ID NO: 61476 - protein, 427 aa, Dechloromonas aromatica RCB
MTSRNQQLFERAQRHIPGGVNSPVRAFRSVGGTPCFFQKGVGAKVQDADGKWYTDYVGSWGPMILGHAHPDVIAAVQAAVVDGLSFGAPTEKEVDIADLLCELVPSMDMVRLVSSGTEATMSAIRLARGHTGRDVLIKFEGCYHGHSDGLLVKAGSGLLTFGNPSSSGVPAGTAETTMVLTYNDPQELADAFAKHGDKIAAVIVEPVVGNMNLIAPTQAFLNAMRDLCTKNGSVLIFDEVMTGFRVGLKSAQGLFGITPDLSTFGKVVGGGMPLGAFGGKREIMEKIAPLGPVYQAGTLSGNPIATAAGLATLKLIQAPGFYEALTAKTKALCDGLVAAAKKHGVAFSAQNIGGMFGLYFAEQCPGTYDEVLACDKEAFNRFFHAMLDAGHYFAPSAFEAGFVSAAHSDADIAGTIAAADAYFASLK

SEQ ID NO: 61477 - protein, 305 aa, Miscanthus sinensis var. sinensis
IESVGEGVTDVAPGDHVLPVFTGECKECAHCRSAESNMCDLLRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASRVIGVDLNPSRFEEARKFGCTEFVNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSIPFAEINKAFDLMAKGEGIRCIIRMEN

SEQ ID NO: 61478 - protein, 274 aa, Dechloromonas aromatica RCB
MSDLYCVFGNPIAHSKSPAIHAAFAVQTAQDLRYEARLAALDGFGLAIAEFVAVGGKGANVTVPFKEEAYRLATRLSDRAARAGAVNTLVFDGPEVFGDNTDGAGLVRDITNNLGFSLVGKRILLLGAGGASRGVIAPLLAEKPASLIIANRSADKAVALAQAFADMAPLGGGSFAETAGKSFDLVINATSASLSGASLPLPPGIFAPGSLAYDMMYGKGETPFLTLARQQGAARCADGLGMLVEQAAEAFFVWRGIRPGTAQVLAELRAKLVA

SEQ ID NO: 61479 - protein, 305 aa, Miscanthus sinensis var. sinensis
IESVGEGVTDVAPGDHVLRVFTGECKECPHCKSAESNMCDLLRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASRIIGVDLNPSRFEEARKFGCTEFVNPKDHKKPVQEVLAEMTNGGVDRSVECTGNINATIQAFECVHDGWGVAVLVGVPHKDAEFKTHPMNFLNERTLKGTFFGNFKPRTDLPNVVELYMKKELEVEKFITHSIPFAEINKAFDLMAKGEGIRCIIRMEN

SEQ ID NO: 61480 - protein, 305 aa, Miscanthus transmorrisonensis
IESVGEGVTDVAPGDHVLPVFTGECKECPHCKSAESNMCDLLRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASRIIGVDLNPSRFEEARKFGCTEFVNPKDHKKPVQEVLAEMTNGGVDRSVECTGNINAMIQAFECVHDGWGVAVLVGVPHKDAEFKTHPMNFLNERTLKGTFFGNFKPRTDLPNVMELYMKKELEVEKFITHSVPFAEINKAFDLMAKGEGIRCIIRMEN

SEQ ID NO: 61481 - protein, 305 aa, Miscanthus transmorrisonensis
IESVGEGVTDVAPGDHVLPVFTGECKECPHCKSAESNMCDLLRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGALRIIGVDLNPSRFEEARKFGCTEFVNPKDHKKPVQEVLAEMTNGGVDRSVECTGNINAMIQAFECVHDGWGVAVLVGVPHKDAEFKTHPMNFLNGRTLKGTFFGNFKPRTDLPNVVELYMKKELEVEKFITHSIPFVEINKAFDLMAKGEGIRCIIRMEN

SEQ ID NO: 61482 - protein, 389 aa, Arabidopsis thaliana
MGWWRKKKKPKSEIASERGAKLLKDLIECCDGKSNPIKFFSADEIRKATNNFGVSNLVSELSHDFDYKWYSGKNENHDMILVRKAFSQSVYYKDTFFRDIAVSSMVSGHKNFLKLIGYCLEFEEPVMVYHGVKKHYHLESSGQPWKRRMKIAEDIATALAYLHTAFPRPFVYRCLSLTNILLDEDGVAKLMDFSFCVSIPEGETFVQVDYTAGTVDYLKPNYLKHGVVSEETDVFAVGHSMQMLLMGEKIFDRIMRRPFPTSKFMEEPKMDEIADPEMGEISEEELCQMKAFLLLSLRCTGHVGEVPTMVEVAKELKSIQRCLHNDTFSPSVETQFDSHQDISSSVILSNQTKDTRALLRCIACHVFDEMFQWVMMNWFRFFRRNRRIC

SEQ ID NO: 61483 - protein, 338 aa, Aspergillus nidulans FGSC A4
MTTPSIPIIDLEPARSGGPEELANLAHEIYQAFKHVGFAYIKNHGVPQDLIDEAFSWSAKFFALPESEKNKAPHPPEGSYHRGYSGIGREKVVQMVFDSDSIAERRKTPDVKESFEIGNENDTKMRNIWIPEESLPGFRGFFAKFFNICSDLETLMLRLIALGMGLDENFFLKYHSERTNQCRLLHYPAVEEELLRAGKAERIAAHTDFGTMTILFQDEVGGLEVEDIHEKNKFNPAPYIPGTAVVNIGDLLMRWSNHELKSTMHRVRAPPLVDVEDGSTVEKKRRMTRPRYSIPYFISPDRDKMIECLPNCHGEGRPKLYEPITSSEYIAMRMNATY

SEQ ID NO: 61484 - protein, 242 aa, Triticum aestivum
  misc_feature (121)..(121): Xaa can be any naturally occurring amino acid
  misc_feature (129)..(129): Xaa can be any naturally occurring amino acid
  misc_feature (197)..(197): Xaa can be any naturally occurring amino acid
MSGGHGDARMASGKMAKLKELLDRSENRICADCSAPDPKWASANIGVFICVKCSGVHRSLGTHISKVLSVTLDKWTDDEIDSMVEVGGNSQANAIYEAFLPEGYRKPHPDSAREERQKLIXSYYDVPRXFLEPSLRIVSNHPSDAGKQASNSHSASSKSEIGMVEFIGILNVKVIGGTKLAIRDVSSSDPYVVLTLXGQQKGQTSVIKGNLNPAWNEELKLSGPRKYGPLELQVLDPDRFQH

SEQ ID NO: 61485 - protein, 297 aa, Prosthecochloris aestuarii DSM 271
MQASRRRSEAPSSRSATIFSTQWYRSGSMKQGVACITGSTDGIGRAAAFELAAAGHTVVLHGRSFERLEHTRREIEEQTGNHSIHTVLADFTDLCQVRRMADQLEKLCSVIDILINNAGVYMPRCQITTAGIETTFAVNHLAHFCLTTLLEPLLIESRTRVVNVSSVDHHSAGFSANSITGGTRYTGYQAYAFSKLCNVAFTLEHADRLRRTGVTVNTLDPGILATKLLHAGWSLQGDDVSCGAPPLLYLACSSKVADITGTYFENNHPAICSPIAHDPEIRRELWEISEEIVERNS

SEQ ID NO: 61486 - protein, 866 aa, Lens culinaris
MASLLFGRGQKLKGTVILMQKNVLDINALTAAQSPSGIIGGAFGVVGSIAGSIIDTATAFLGRSVRLRLISATVADASGKGKVSKEAFLEGLLTSIPTLGDKQSAFSVHFEWDSNMGTPGAFYIENFMQGGEFFLVSLTLDDVPNVGSIKFACNSWIYNDKKYQSDRIFFANKTYLPSATPAPLVSYRQEELKTLRGDGTGERQEWDRIYDYDVYNDLGAPDQKATLGRPVLGGSSTLPYPRRGRTGRKKTVKEPQSESRSDTVYLPRDEAFGHVKSSDFLVYILKSASQNIVPQLRSVVTLQLNNPEFNTFEDVRSLYDGGIKLPTDVLSKISPIPLFSELFRSDGEAALKFPPPKVIQVDHSAWMTDEEFAREMIAGVNPHIIKEVLSFPIKSKLDSQLYGDNTSKITKEHLEPNLGGVTVEGAIQTNRLFTPDHHDALFPYLRKINATATKAYATRTVLFLQDNGTLKPLAIELSTPHPDGDSFGPVSKVYLPASEGVEASIWLLAKAFVVVNDSCYHQLVSHWLNTHAVVEPFIIATNRHLSVVHPIHKLLLPHYRDTMNINALARNVLVNAEGIIESTFLWGNYAMEMSAVVYKDWVFPDQGLPNDLIKRGVAVKDPSSPHGVRLLIEDYPYASDGLEIWAAIKSWVEEYVNFYYKSDAAIAQDAELQAFWKELVEVGHGDLKSATWWFKMQNRKELIEACSILIWIASALHAAVNFGQYPYGGYILNRPTKSRKFMPEKGTPEYDDLAKNYEKAYLRTITPKNDTLTDLTIIEVLSRHASDEQYLGERIEGDDWTTDSVPKEAFKRFGKKLAEIEEKLTQRNNDESLRNRYGPVKMPYTLLYPSSEEGLTCRGIPNSISI

SEQ ID NO: 61487 - protein, 524 aa, Deinococcus radiodurans R1
MTQPNPTQPSPTQQNHDLARQLRESRLSRGLQHFIGGEWVDAHSGKTFDAHSPVDNDFLVKVAEGDASDIDRAAKAAHDAFQTWREVSGAERRKILHKVADLIEKRAQEIAVLESVDTGQAIRFMKSAAARGAENFRFYADRAPGAQDGQSLPAPGFINYSIRQPIGPVGVITPWNTPFMLSTWKIAPALAAGCTVVHKPAEWSPVSATLLTEIMDEAGLPGGVHNLVHGFGESAGKSLTEHPLVKAVAFVGETTTGSHIMRQGADTLKRVHFELGGKNPVVVFDDADLDKALDAVVFMIYSLNGERCTSSSRVLIQEGIYDEFTRRIAERAANIRVGDPLDPDTEVGPLVHPRHFEKVMSYFECARQEGATIAAGGERVGEAGNFVRPTLFTAARNDMKIAQEEIFGPVLTAIPFKDEADALELANDVNYGLAGYLWTNDLTRAHRFAHGLEAGMIWVNSENVRHLPTPFGGVKNSGIGRDGGDYSFEFYMETKNIAISLGTHKTAKLGVGQAPAVGKKEAGE

SEQ ID NO: 61488 - protein, 861 aa, Solanum tuberosum
MIGQITSGLFGGHDDSKKVKGTVVMMNKNVLDFTDLAGSLTGKIFDVLGQKVSFQLISSVQGDPTNGLQGKHSNPAYLENSLFTLTPLTAGSETAFGVTFDWNEEFGVPGAFIIKNMHINEFFLKSLTLEDVPNHGKVHFVCNSWVYPSLNYKSDRIFFANQPYLPSETPELLRKYRENELLTLRGDGTGKREAWDRIYDYDIYNDLGNPDQGKENVRTTLGGSAEYPYPRRGRTGRPPTRTDPKSESRIPLILSLDIYVPRDERFGHLKMSDFLTYALKSIVQFILPELHALFDGTPNEFDSFEDVLRLYEGGIKLPQGPLFKALTAAIPLEMIRELLRTDGEGILRFPTPLVIKDSKTAWRTDEEFAREMLAGVNPVIISRLQEFPPKSKLDPEAYGNQNSTITAEHIEDKLDGLTVDEAMNNNKLFILNHHDVIIPYLRRINTTITKAYASRTLLFLQDNGSLKPLAIELSFPHPDGDQFGVTSKVYTPSDQGVESSIWQLAKAYVAVNDVGVHQLISHWLNTHAVIEPFVIATNRQLSVLHPIHKLLYPHFRDTMNINASARQLLVNAGGVLESTVFQSKFAMEMSAVVYKDWVFPDQALPADLVKRGVAVEDSSSPHGVRLLIEDYPYAVDGLEIWSAIKSWVTDYCSFYYGSDEEILKDNELQAWWKELREVGHGDKKNEPWWPEMETPQELIDSCTTIIWIASALHAAVNFGQYPYAGYLPNRPTVSRRFMPEPGTPEYEELKRNPDKAFLKTITAQLQTLLGVSLVEILSRHTTDEIYLGQRESPEWTKDKEPLAAFDRFGKKLTDIEKQIIQRNGDNILTNRSGPVNAPYTLLFPTSEGGLTGKGIPNSVSI

SEQ ID NO: 61489 - protein, 860 aa, Solanum lycopersicum [sequence omitted]

SEQ ID NO: 61490 - protein, 429 aa, Triticum aestivum
  misc_feature (54)..(54): Xaa can be any naturally occurring amino acid
  misc_feature (187)..(187): Xaa can be any naturally occurring amino acid
EKRPRLGQEISQILGTVLFSEVVCKDASESISILYRLIQDPSSSADALRTKELXAITNLTNYLTEESRAEELRNLLTQLRPFFSLIPKAKTAKIVRGIIDAVSKIPGTSDLQISLCKEMGEWTRAEKRTFLRQRVGARLAALLLENKEYTEALTLLTGLIKEVRRLDDKLLLVDIDLLESKLHFSLXRNLPKAKASLTAARTAANAIYVPPAQQGTIDLQSGILHAEEKDYKTAYSYFFEAFEAFNALDDPRAIFSLKYMLLCKIMVNQADDVAGIISSKASLKYVGPDVDAMKAVADAYSKRSLKYFETALRDFKAQLEEDPIVHRHLSSLYDTLLEQNLCRLIEPYSRVEIGHVAQMIELAVDDVEKKLSQMILDKKFAGTLDQGAGCLIIFEDQKTEAIFPATLETISNVGKVVDSLYMRSAKIMA

SEQ ID NO: 61491 - protein, 251 aa, Glycine max
MGKSPGKWIKTVLFGKKSSKSNISKGREKLVNQEEGVVVTSKVLETGLALEPTSDTIARHEEDLELENEEAENVIPGNQEIDTVGSINEDAALDPEKIRLEEAATKAQAAFRGYLARRAFRALKGIIRLQALIRGHLVRRQAVATLCSMYGIVKFQALVRGGIVRHSDVGSEIQEKCNILNPLDGKLVKPIAISMKITKLSANAFIRKLLTSSTRIMVLQLQYVPGDPNSVLSWLERWSASHFWKPVPQPK

SEQ ID NO: 61492 - protein, 272 aa, Arabidopsis thaliana
MAICKVFRNYCKENGIQLHDKNFTLSYDTNIPRQTGLSGSSAIVSAALSCLLDFYNVRQSIRIEVRPNLILNAEKELGIVAGLQDRVAQVYGGGLVHMDFSKEHMDKVGYGIYTIMDINLLPPLHLIYAENPSDSGKVHSTVRRRWLDGDEFIISSMAEIAKLAEEGRTALLKKDYSNLKELMNRNFDLRRSMFGDECLGAMNIEMVEVARKIGAAAKFTGSGGAVVVFCPEGPSQVKLLEEECRKSGFIVEPVKLVPTRLSSSDIKTLSKT

SEQ ID NO: 61493 - protein, 305 aa, Miscanthus transmorrisonensis
IESVGEGVTDVAPGDHVLPVFTGERKECPHCKSAESNMCDLLMINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASRIIGVDLNPSRFEEARKFGCTEFVNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSIPFAEINKAFDLMAKGEGIRCIIRMEN

SEQ ID NO: 61494 - protein, 229 aa, Oryza sativa (indica cultivar-group)
MGRGRVELKRIENKINRQVTFAKRRNGLLKKAYELSVLCDAEVALIIFSNRGKLYEFCSGQSMTRTLERYQKLSYGGPDTAIQNKENELVQSSRNEYLKLKARVENLQRTQRNLLGEDLGTLGIKELEQLEKQLDSSLRHIRSTRTQHMLDQLTDLQRREQMLCEANKCLRRKEKLEESNQLHGQVWEHGATLLGYERQSPHAVQQVYSRADEQLMRDCLHADMATLNS

SEQ ID NO: 61495 - protein, 305 aa, Miscanthus transmorrisonensis
IESVGEGVTDVAPGDHVLPVFTGECKECPHCKSAESNMCDLLRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASRIIGVDLNPSRFEEARKFGCTEFVNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSIPFAEINKAFDLMAKGEGIRCIIRMEN

SEQ ID NO: 61496 - protein, 298 aa, Saccharomyces cerevisiae
MSEFKVKTGLAQMLKGGVIMDVVTPEQAIIAERAGACAVMALERIPADMRKSGQVCRMSDPRMIKEIMEAVSIPVMAKVRIGHFVEAQILEELQVDYIDESEVLTPADWTHHIEKHNFKVPFVCGAKDLGEALRRINEGAAMIRTKGEAGTGDVSEAVKHITKIKAEIQQYKENLKTESDFAAKATELRVPVDLLKTTLSEGKLPVVNFAAGGVATPADAALLMQLGCEGVFVGSGIFKSSDPEKLACAIVEATTHYDNPAKLLQVSSDLGDLMGGISIQSINEAGGKNGARLSEIGW

SEQ ID NO: 61497 - protein, 305 aa, Miscanthus transmorrisonensis
IESVGEGVTDVAPGDHVLPVFTGECKECPHCKSAESNMCDLLRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASGIIGVDLNPSRFEEARKFGCTEFVNPKDHKKPVQEVLAEMTNGGVDRSVECTGNINAMIRAFECVHDGWGVAVLVGVPHKDAEFKTHPMNFLNERTLKGTFFGNFKPRTDLPNVVELYMKKELEVEKFITHSIPFAEINKAFDLMAKGDGIRCIIRMEN

SEQ ID NO: 61498 - protein, 305 aa, Miscanthus transmorrisonensis
IESVGEGVTDVAPGDHVLPVFTGECKECPHCKSAESNMCDLLRINTDRGVMIGDGKSRFPINGKPIYHFVGTSTFSEYTVTHVGCVAKINPQAPLDKVCVLSCGISTGLGASINVAKPPKGSTVAIFGLGAVGLAAAEGARIAGASRIIGVDLNPSRFEEARKFGCTEFVNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSVPFAEISKAFDLMAKGEGIRCIIRMEN

SEQ ID NO: 61499 - protein, 170 aa, Zea mays
  misc_feature (122)..(122): Xaa can be any naturally occurring amino acid
  misc_feature (133)..(133): Xaa can be any naturally occurring amino acid
  misc_feature (145)..(145): Xaa can be any naturally occurring amino acid
  misc_feature (151)..(151): Xaa can be any naturally occurring amino acid
  misc_feature (158)..(158): Xaa can be any naturally occurring amino acid
  misc_feature (166)..(166): Xaa can be any naturally occurring amino acid
MTFSMLSSGTVNISPARASMSAPFTGLETSTAYPDSSKTDSDMTSMTRNGGRVNCMKAGAQVSKKKIETVSYLPDLTDGEASNEVDYHLLNKRIPCVKLEEEHEFVYREQINTPTYYDVHNXQMRKFPLDACXDSAHVISQLHEXKNEYPXSFIRIIXFDNNRLVXCINF

SEQ ID NO: 61500 - protein, 305 aa, Miscanthus transmorrisonensis
IESVGEGVTDVAPGDHVLPVFTGECKECPHCKSAESNMCDLLRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASRIIGVDLNPSRFEEARKFGCTEFVNPKDHKKPVQEVLAEMTNGGVDRNVECTGNINAMIQAFECVHDGWGVAALVGVPHKDAEFKTHPMNFLNERTLKGTFFGNFKPRTDLPNVVELYMKKELEVEKFITHSVPFAEINKAFDLMAKGEGIRCIIRMEN

SEQ ID NO: 61501 - protein, 114 aa, Zea mays
  misc_feature (14)..(14): Xaa can be any naturally occurring amino acid
  misc_feature (101)..(101): Xaa can be any naturally occurring amino acid
ELINYLINFATSEXVIRLSHNTTCQNIMHYTLTNFACSKAASEVILQTPVSYNKHITTPSHTANMINLSTKIISQDHLIHVMPTIANSYASITAYKFHFLXSYISDDDIFSSYL

SEQ ID NO: 61502 - protein, 531 aa, Aspergillus oryzae
MTTLKVLLNHPRSDHIDSSYTMLGGAITPSESVYRPSSHQTSHPSSHLDTGSSRSTSTNTTPTSSTAPPSTSAAASARLHSHSSHDVPAYINRSSHTPSQPSTRESSATPGSTYTQPPSMSSTHVPYADSSTYPAFHRSQHVSTNQAAAAPITGSHRESHSSPASPRLKPTHQSLRSLGGSEANSPSRIKVRDLSHIQSFASEEFLAQSQRDQVPGQWSQERQYEISSMPVTDIIEMVAGLLTKITTTNDTHHEQIHRHIPPPDGTASLSPQATSVLAFHGKNVPSISILSYLTRIHKYCPTTYEVFLSLLVYFDRMTELVNKGQLERLQRRWGHIQPDSASRPGSQESAVKPAHGSPMVTPPSSAGMRAQDPTSPSSISPSLHPQEEDDYFSQFFVVDSFNIHRLVIAGVTCASKFFSDVFYTNSRYAKVGGLPLVELNHLELQFLLLNDFRLSIPVEELEAYGTMLVEFYAREIVAQQQQQQQIASQTGVPRAFGSSTGTDPQSDAMYMRSYEKRRPDQPEIRQTPTPP

SEQ ID NO: 61503 - protein, 148 aa, Zea mays
  misc_feature (145)..(145): Xaa can be any naturally occurring amino acid
KLTNIRSHHLRFKAMARTKQTARKSTGGKAPRKQLATKAARKSAPTTGGVKKPHRYRPGTVALREIRKYQKSTELLIRKLPFQRLVREIAQDFKTDLRFQSHAVLALQEAAEAYLVGLFEDTNLCAIHAKRVTIMPKDIQLARRXRGE

SEQ ID NO: 61504 - protein, 513 aa, Bacillus cereus ATCC 10987
MTFLFNYLKIITRFHITEYIPQYGKTSNFILSTTKVRKTMAQVNNTNNELKRTMKSRHLFMIALGGVIGTGLFNGSGFIISQAGPGGSVLAFMAGGLLMYFVMLCLGELAVAMPVSGSFQEYATKFINPATGFTIGWLYWLSWANTTGLEFTTAGITMQRWFPDIPVWVWCLIFGVTIFTINALSARSYAETEFWFSSIKVSAIIAFIILGGAAMFGFIDLKGDEPAPLLSNFVNHGGLFPNGLAAILLTMVTVNYSFQGTELVGIAAGESEDPAKTLPRSIRNIIWRTMFFFVLAIFVLVALIPWEEAGLTKSPFVAVFDNIGIPYAADIMNFVILTAVLSVANSGLYAATRMLWSLSKNEMAPAFLKKLSSRGIPLNALIMTIAISAFSLLTSVVAAETVYLWLISISGVITIIVWMSICVSQFFFRKHYLADGGKLEDLKFKTPLYPLVPILGFGLYGIILISLIFIPEQRLGIYCTVPFIIFCYTYYHLKVKKRISTNTNSETKISETM

SEQ ID NO: 61505 - protein, 1434 aa, Alteromonadales bacterium TW-7
MKIITMSKYLLIALGLMILAGCGGTDKVESGQQLLTCNVPQVPNEAGSQCVDPEPITCAAPTVPDEKNESCVVGADPTLPDPIVFAGEGEAVLFYNRLADDNYEGYRLHSWNNDVCDAYAPPFDTSDWANGHEYDGIDPNYGAYWIIDLKEGYNECANFIVHIGTEGSGKAFGDVDLTMPLMQDDEKFQRMNFTIHGEPSVFEYPILSLGERPVAIDGASAHWIDLNTVLYKPSNELTQIIKLHSSAAADLVVDLDTGLNGETVELTASELTDEQAAKVPHLTDWTAYEGSWDADAAKQLIKQQLVVAGYDADGKLLEATFVQTAKALDALYTQGEDDANEALLGVNYGNNTIDVTVWAPTANNMVLNVFDDAKTQVHSTPMTLNTQTGIWQVSLDTQYDRHYYRFNFDVYHPLTQQIESLWSTDPYSLNVSANGLYSQLINLADEDTKPEGWDERIVPTITNPEDAVIYEGHVRDFSVRDQSVSEANRGKYLAFTELESVPMQHLKQLADKGLTHFHLLPVTDIGTIEEDASQRVEITDTLGKLCERINDEADACKIEDKNSTIVDIMQSYLPGSDDAQALASAMRDLDGFNWGYDPHHFIAPEGSYASSSDGIARVVETRAMVQSLQEVGLRVVLDVVYNHTTSSGIWDKSVFDKLVPGYYHRYSEVSGEIERSTCCENTATEHVMMDKFVTDSMVILAREFGYDSFRFDVMGHMPKSSILAAREAVQAVDPDNYFYGEGWDFGEVANNRLFTQAKQADMAGSEVGTFNDRIREAVRGGAMFSNNPTDGNLAEQDTLRLSLAGNLQNYILKDFKGNSSKGNSFTWNTQPTAYALDPADSIHYVSKHDNETLWDQLQYKHASSMSIEERVRAHNVALSIPLMSQGIPFMQLGADLLRSKSMDRDSYNAGDWFNAVDLTKENNNWNIGLPNAEKNQEKWSEIMPISANADAQAMPQDIAYAGDVFQEFLAIRSASPLFRLTTEQDVIDRVGFHNVGKNQQHGLIVMSIDDGEELTDLDPVLDALVVIINATEQTLSHTIATAAGFELHDVLKNSVDASMASANFAEGDNEGTFTVPPYTLAVFAKNQGESQGTGLSANATIGAPDVVPYGSNAVFVRGTLNDWGTRDAFEYIGEGEYRIAIALSAGDYEFKIASEDWSTVDFGALSDADKDVVENQSEPLTRSGANMTFNAAIDATYVFSLDASNPENPTLTLFNEEPFVGTAIYVRGTLNDWGVTDELSYQGKGIYTFTKTLSAASYEFKIASEDWSTVDYGSGESDANVMIGTAEQLSVAGANMSLDIAEEGEYQFVFDASDLNNVTLKVLNAEMFAQTPVFIRGSLNGWGTDNPLMYEGNAVYSTSIELEAGDYEFKVASEDWSTVDYGGAGDAPVATIGELTSLEAIGANIALNITEQGTYTFKVIGPDRENVSILIDKQ

SEQ ID NO: 61506 - protein, 859 aa, Solanum lycopersicum
MSLGGIVDAILGKDDRPKVKGRVILMKKNVLDFINIGASVVDGISDLLGQKVSIQLISGSVNYDGLEGKLSNPAYLESWLTDITPITAGESTFSVTFDWDRDEFGVPGAFIIKNLHLNEFFLKSLTLEDVPNYGKIHFVCNSWVYPAFRYKSDRIFFANQAYLPSETPQPLRKYRENELVALRGDGTGKLEEWDRVYDYACYNDLGEPDKGEEYARPILGGSSEYPYPRRGRTGREPTKADPNCESRNPLPMSLDIYVPRDERFGHVKKSDFLTSSLKSSLQTLLPAFKALCDNTPNEFNSFADVLNLYEGGIKLPEGPWLKAITDNISSEILKDILQTDGQGLLKYPTPQVIQGDKTAWRTDEEFGREMLAGSNPVLISRLQEFPPKSKLDPTIYGNQNSTITTEHVQDKLNGLTVNEAIKSNRLFILNHHDIVMPLLRKINMSANTKAYASRTLLFLQDDRTLKPLAIELSLPHPDGDQFGTVSKVYTPADQGVEGSIWQFAKAYVAVNDMGIHQLISHWLNTHAVIEPFVVATNRHLSVLHPIHKLLHPHFRNTMNINALARETLTYDGGFETSLFPAKYSMEMSAAAYKDWVFPEQALPADLLKRGVAVEDLSSPHGIRLLILDYPYAVDGLEIWAAIKSWVTEYCKFYYKSDETVEKDTELQAWWKELREEGHGDKKDEAWWPKLQTRQELRDCCTIIIWIASALHAALHFGLYSYAGYLPNRPTLSCNLMPEPGSVEYEELKTNPDKVFLKTFVPQLQSLLEISIFEVSSRHASDEVYLGQRDSIEWTKDKEPLVAFERFGKMLSDIENRIMIMNSHKSWKNRSGPVNVPYTLLFPTSEEGLTGKGIPNSVSI

SEQ ID NO: 61507 - protein, 874 aa, Yarrowia lipolytica CLIB122
MDSPTEEKFNDKKSPFEKDAIEVDFEAAEVTDISFVDYVGEKLNFVPDENGEHTKNVRLMASFVAEMTEEEAEEILLKFIPLHEDDYNLRLEQKEYLKSLVKGEKEAPDPTTYSMDLRIEAAAIKHWSPYVEVRAVTDCWDDMDEPCETIRSYAIGLVWLLVGCFVNQFFIFRFPSISISSDVLQLLTYPCGEFLARVLPDWGFTFRGTRITLNPGPWTRKEQMFATFFLSGGDGSTYVSAYNLPTQLLPMYYDQKWATFGYQIMLTLSSQYIGFGFAGILRRFAIYPTKAMWPMQMPTLALNRALLDPERKQSINGWTISKYWFFLVVFAGSFVYYWIPDYLFAALSNFNWMTWIAPNNVNLALLTGQSGMGINPIPTFDLNVIGVGNVVTPWWSVVNILVGAILGTFTIIGVYWSNIRWTAYLPMNTPGIFNNKGGSYKVTKILTNGVFDEEKYQKYGPPLWGAANLVLYGSFFSLYTLGFVYTMLAYWRDMCTAAVDFYNGIAFWNGRKRTEVDSPFARQLKKYPDVPDWWFFLILLISIGFCIGTVKGWPTSTPVWGIFFVLGINVVFLVPICLLQAYTGNGFALNVLVEIICGYALNGRPTALNILKAYGVNVDSTSQGFVSVWKTGMYAYVPSRAIFRTQILSTLINAFVTVGILQYQLTLTDICTPAQRATTKFTCPNQNVFYSASVLFGAIGSKRVFGTGGGDGLYPFLKWCFLIGAVVALIFFAIQYTIPAYIGKRYPERKEAMVRLSERLGKINPVVINMGFLQFAPGNLSYITGGVYLAAFWTLYLKKRYTEWWAKYTYVMVAGVNVGIALAAIIVFFALQYSDIELSWWGNNVPYAGADGNETPLLTLAPGQLIGPQPGHFP

SEQ ID NO: 61508 - protein, 248 aa, Candida albicans SC5314
MARQFFVGGNFKANGTKQQITSIIDNLNKADLPKDVEVVICPPALYLGLAVEQNKQPTVAIGAQNVFDKSCGAFTGETCASQILDVGASWTLTGHSERRTIIKESDEFIAEKTKFALDTGVKVILCIGETLEERKGGVTLDVCARQLDAVSKIVSDWSNIVVAYEPVWAIGTGLAATPEDAEETHKGIRAHLAKSIGAEQAEKTRILYGGSVNGKNAKDFKDKANVDGFLVGGASLKPEFVDIIKSRL

SEQ ID NO: 61509 - protein, 166 aa, Triticum aestivum
  misc_feature (89)..(89): Xaa can be any naturally occurring amino acid
  misc_feature (99)..(99): Xaa can be any naturally occurring amino acid
  misc_feature (116)..(116): Xaa can be any naturally occurring amino acid
MASQDHHHHRGGHSHNDDDHHHHHHHGDAAGKGAGAGAGSWVGEDGRVWHSLDGLAPHSHEPIYSAGDFSKRAPPLDSRSSPHRAFSVXGIGGPVGTGXKTALMLALCTSLRDKYXVLQGVTNDIFHQRGTEDFLGQAWEFLPDIRVISWPKEPWEAWPLVAVLSL

SEQ ID NO: 61510 - protein, 126 aa, Synechococcus sp. CC9311
MTIYIGNLSFQAEQEDLLDLFGQYGEVKSASLPLDRETGRKRGFGFVEMATDEDEQKAIDDLQNVEWMGRMIRVNKATPRERTGGGGGGGGRGGYGGGGGNGGGGGYGGGGGGNGGGGGYGGGNRW

SEQ ID NO: 61511 - protein, 278 aa, Glycine max
MGVFSEDPNPNPNPIVIREVWASNLESEFELIRELIDRYPFISMDTEFPGVIFRPHVDPTKPFNHRNRPSDHYRLLKSNVDALNLIQVGLTLTDAAGNLPDLAGNRSIWEFNFRDFDVARDAYAPDSIDLLRRQGIDFARNTADGVDSTCFAELMMSSGLVCNDAVSWVTFHSAYDFGYLVKILTRRNLPTRLEEFLKTVKVFFGDNVYDVKHMMRFCDTLYGGLDRVARTLNVERAVGKCHQAGSDSLLTWHAFQKIVDIYFVKEEHRKHAGVLFGL

SEQ ID NO: 61512 - protein, 638 aa, Dechloromonas aromatica RCB
MNATEQFLAANAHVDEAAVQPLPNSRKIYVEGSRPDIRVPMREVSQDDTPTAFGGEKNPPIYVYDCSGPYSDPAAKIDIRSGLPALRAQWIAERGDVEALADLSSEFGRQRAADPKLDELRFPGLHRKPLRAKAGQNVSQMHYARRGIITPEMEYVAIRENNNRRAYIESLKATGPMGNRMADILGRQHKGQDFGASIPEEITPEFVRSEIARGRAIIPNNINHPESEPMIIGRNFLVKINANIGNSALGSSIQEEVEKMTWSIRWGGDTVMDLSTGKNIHETREWIIRNSPVPIGTVPIYQALEKVNGKAEDLTWEIFRDTLIEQAEQGVDYFTIHAGVLLRYVPMTANRLTGIVSRGGSIMAKWCLAHHKESFLYTHFEEICEIMKAYDVAFSLGDGLRPGSIYDANDEAQLGELETLGELTKIAWKHDVQVIIEGPGHVPMHMIKENMDLQLKHCDEAPFYTLGPLTTDIAPGYDHITSGIGAAMIGWYGTAMLCYVTPKEHLGLPDKDDVKEGIITYKLAAHAADLAKGHPGAQIRDNALSKARFEFRWDDQFNLGLDPDKAREFHDETLPKESAKVAHFCSMCGPHFCSMKITQEVREFAAQQGLDEAAALEKGMEVKSVEFVKAGAEVYSKI

SEQ ID NO: 61513 - protein, 305 aa, Miscanthus transmorrisonensis
IESVGEGVTDVAPGDHVLPVFTGECKECPHCKSAESNMCDLLRINTDRGVMIGDGKSRFSINGKPIYHFVGTSTFSEYTVMHVGCVAKINPQAPLDKVCVLSCGISTGLGASINVAKPPKGSTAAIFGLGAVGLAAAEGARIAGASRIIGADLNPSRFEEARKFGCTEFVNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSVPFAEINKAFDLMAKGEGIRCIIRMEN

SEQ ID NO: 61514 - protein, 262 aa, Streptomyces nogalater
MPDTDGRVAVVTGGTSGIGLAVVKALAATGYACRSLCARSQDAVDSTVEELRDEKLEVDGRSCDVRSTDDVREFIGFATRRFGGVDVLVNNAGRNGGGPTARITDELWLDVIETNLTSVFRVTREVLTTGGMLAAGRGRIINIASTGGKQGVVLGAPYSASKHGVVGFTKALGLELAKSGITVNAVCPGYVETPMGERVGRGYAEVWDTSEEAVLERFQAKIPLGRYAQPEEVAGLVTYLTTPTADSITAQALNVCGGLGNY

SEQ ID NO: 61515 - protein, 305 aa, Miscanthus transmorrisonensis
IESVGEGVTDVAPGDHVLPVFTGECKECPHCKSAESNMCDLLRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASRIIGVDLNPSRFEEARKFGCTEFVNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSVPFAEINKAFDLMAKGEGIRCIIRMEN

SEQ ID NO: 61516 - protein, 305 aa, Miscanthus transmorrisonensis
IESVGEGVTDVAPGDHVLPVFTGECKECPHCKSAESNMCDLLRINTDRGVMIGDGKSRFSINGKPIYHFVGTSTFSEYTVMHVGCVAKINPQAPLDKVCVLSRGISTGLGASINVAKPPKGSTVAIFGLGAVGLAAAEGARIAGASRIIGVDLNPSRFEEARKFGCTGFVNPKDHKKPVQEVLAEMTNGGVDRSVECTGNINAMIQAFECVHDGWGVAVLVGVPHKDAEFKTHPMNFLNERTLKGTFFGNFKPRADLPNVVELYMKKELEVEKFITHSVPFAEINKAFDLMARGEGIRCIIRMEN

SEQ ID NO: 61517 - protein, 305 aa, Miscanthus transmorrisonensis
IESVGEGVTDVAPGDHVLPVFTGECKECPHCKSAESNMCDLLRINTDRGVMIGDGKSRFSINGKPIYHFVGTSTFSEYTVMHVGCVARINPQAPLDKVCVLSCGISTGLGASINVAKPPKGSTVAIFGLGAVGLAAAEGARIAGASRIIGVDLNPSRFEEARKFGCTEFVNPKDHKKPVQEVLAEMTNGGVDRSVECTGNINAMIQAFECVHDGWGVAVLVGAPHKDAEFKTHPMNFLNERTLKGTFFGNFKPRTDLPNVVELYMKKELEVEKFITHSVPFAEINKAFDLMAKGEGIRCIIRMEN

SEQ ID NO: 61518 - protein, 305 aa, Miscanthus transmorrisonensis
IESVGEGVTDVAPGDHVLPVFTGECKECPHCKSAESNMCDLLRINTDRGVMIGDGKSRFSINGKPIYHFVGTSTFSEYTVMHVGCVAKINPQAPLDKVCVLSCGISTGLGASINVAKPPKGSTGAIFGLGAVGLAAAEGARIAGASRIIGVDLNPSRFEEARKFGRTEFVNQKDHKKPVQEVLAEMTNRGVDRNVECTGNINAMIQAFECVHDGWGVAVLVGVPHKDAKFKTHPMNFLNERTLKGTFFGNFKPRTDLPNVVELYMKKELEVEKFITHSVPFAEINKAFDLMAKGEGIRCIIRMEN

SEQ ID NO: 61519 - protein, 148 aa, Geobacillus kaustophilus HTA426
MTNNSGNKVQDIMTKNVATISPNQTVQEAAQIMSQKNIGALPVVENGQVKGMITDRDITLRVSSQGKDPSTVKVAEVMTNQVVTGTPNMSVQEAANVMAQHQVRRLPIVENNQLQGIVALGDIATNSASNEAAEQALTNISEPSQPQG

SEQ ID NO: 61520 - protein, 301 aa, Saccharomyces cerevisiae
MKLKVTGAGINQVVTLKQDATLNDLIEHINVDVKTMRFGYPPQRINLQGEDASLGQTQLDELGINSGEKITIESSDSNESFSLPPPQPKPKRVLKSTEMSIGGSGENVLSVHPVLDDNSCLFHAIAYGIFKQDSVRDLREMVSKEVLNNPVKFNDAILDKPNKDYAQWILKMESWGGAIEIGIISDALAVAIYVVDIDAVKIEKFNEDKFDNYILILFNGIHYDSLTMNEFKTVFNKNQPESDDVLTAALQLASNLKQTGYSFNTHKAQIKCNTCQMTFVGEREVARHAESTGHVDFGQNR

SEQ ID NO: 61521 - protein, 271 aa, Frankia sp. EAN1pec
MRTIVLVGATSGLGRHAAHILKEAGHRLVLVGRDPKRAAQLAHDLPTATVIAADISTAAGIDLVAEKVHAVVDRVDTLVNNAGVMLPTRRTTSEGIELNLAVHHLAPYSTTARLLPLLRHGDGRIINVNSEGHRAPMRGAGPVHLDLTDLNSERRYDPFLTYSRTKLANLLFTYELQRRHPELTVAAVHPGMVRTNLGRHFPRLRVALLLPFMMSPRQGARPVIHLASAPTISAGRYYDRLRPVSSSPASYDTNTARRLWEITSDIRGPFG

SEQ ID NO: 61522 - protein, 324 aa, Oryza sativa (indica cultivar-group)
MAEAKQQQQQPQAATAAAASGVWKTVKPFANGGASGMLATCVIQPIDMVKVRIQLGEGSAASVTKKMLANEGISAFYKGLSAGLLRQATYTTARLGSFSKLRLSALPPDTPTSRVLTNKAVEANDGKPLPLVQKAGIGLTAGAIGACVGSPADLALIRMQADSTLPAAQSRNYKNAFHALYRIAADEGVLALWKGAGPTVVRAMSLNMGMLASYDQSVELFRDTLGAGEVTTVLGASAVSGLCASACSLPFDYVKTQIQKMQPDASGKYPYTGSLDCAMKTLKSGGPFKFYTGFPVYCVRIAPHAMMTWIFLNEIQKLEKRLGL

SEQ ID NO: 61523 - protein, 351 aa, Mycobacterium avium 104
MTQLADRPTGHGETLTAAVQDVALGAQALTMVQALNRALHDAMAADERVLVFGEDVAVQGGVFRVTEGLAEAFGESRCFDTPLAESAIIGIAVGLALRGFVPVPEIQFDGFSYPAFDQVVSHLAKYRTRTRGAIDMPVTVRVPSFGGIGAAEHHSESTESYWAHTAGLKVVVPSNPADAYWLLRHAIACPDPVMYLEPKRRYQGRGLVDAGRPEPPIGRAMVRRAGTDVTVVTYGSLVATAVGAAEEAQHQRGWSLEVIDLRSLVPLDFDTIATSIHRTGRCVVMHEGPRTLGYGAELAARIQEELFYELEAPVLRACGFDTPYPPARLEKWWLPGPDRLLDCVERTLELP

SEQ ID NO: 61524 - protein, 477 aa, Medicago truncatula
MLEEEIVRNRSHSIDGIPSQLDPEYFDDDGRPKRTGTIWTTSSHIITAVIGSGVLSLAWATAQLGWIGGPLAMILFSLITLYTSSMLAECYRCGDPVYGKRSYTFVDAVRSILGGRQYTVCGIVQYMYLYGSAIGYSIAAPISMMEIKKSRCLHLSGGKDPCHISSNPYMIGFGVIEIFVSQIPEFHNTWWLSVIAAIMSFGYSTIGVFLAISQTAENGTFKGTLTGGSTENVSTTTEVWGIFQALGDIAFAYSYSQILIEIQDTIKSPPSEIKTMKNAAALSVAVTTAFYLLCGCMGYAAFGEQAPGNLLTGFSMYNPAWLIDFANAAVVIHLVGAYQVYVQPVFAFVEKGAAKRWPQTKVEHKIPIPGFRPYNLNLFRLVWRTAFMILTTFVAMLIPFFNDVLGFLGAVGFWPLTVYYPVEMYILQRKIPKWSPKWILLQIISVICFIVSGAAALGSTASIIEDLKHYKPFSSEY

SEQ ID NO: 61525 - protein, 373 aa, Mycobacterium avium 104
MTKPLTDTAPVDPGVQRGSMPLTNRIQGAVTSVGVKVIPWIPTAVRRGLVRGRSVIIDGNTLDPTLQLMLSGLRAVGIDGLVVDDDPELSRAQMHESTVGFPGPQIHVDVAELALPGPAGDIPARHYRPAGGETQAPLLVFYHGGGWSIGDLDTHDSLCRLTCRDAGIHVLSIDYRLAPEHPAPAAIDDAYAAFTWAHEHAGELGAIPGRVAVGGDSAGGNLAAVVSQLARDAGGPAPVLQWLIYPRTDFTARTRSLSLFSRGFLLTKRDIDWFESQYLRNSGLDRTDPRVSPALAESLAGLAPALIAVAGFDPLRDEGQSYAEALRAAGTPVDLRYLGSLTHGFANLFQLGGDSMVATSELISALRAHLSRV

SEQ ID NO: 61526 - protein, 324 aa, Pyrococcus furiosus DSM 3638
MIALGIEGTAHTLGIGIVTENKVLANVFDTLKTEKGGIHPKEAAEHHAKLLKPLLRKALEEAGVSMEDIDVIAFSQGPGLGPALRVVATAARALAIKYNKPIVGVNHCIAHVEITKMFGVKDPVGLYVSGGNTQVLALEGGRYRVFGETLDIGIGNALDVFARELGLGFPGGPKIEKLALKGEKYIELPYAVKGMDLSFSGLLTEAIRKYKSGKYRVEDLAYSFQETAFAALVEVTERALAHTEKEEVVLVGGVAANNRLREMLRIMAEDRGVKFFVPPYDLCRDNGAMIAYTGLRMYKAGIKFKLEETIVKQKFRTDEVEVVW

SEQ ID NO: 61527 - protein, 466 aa, Medicago truncatula
MEVEHSIEAVPSHKDSKLYDDDDRLKRTGTVWTTSSHIITAVVGSGVLSLAWAIAQLGWVIGPSVMIFFSLITWYTSSLLAECYRIGDPHYGKRNYTFMEAVHTILGGFNDTLCGIVQYTNLYGTAIGYTIAGAISMMAIKRSDCLHSSGGKDSCHISSNPYMIAFGVIQIFFSQIPDFDKMWWLSIVAAIMSFTYSFIGLGLAIAKVAENGSFKGSLTGVSIGTVTKAQKVWGTFQALGNIAFAYSYSQILIEIQDTIKNPPSEVKTMKQATKISIGVTTAFYMLCGCMGYAAFGDTAPGNLLTGIFNPYWLIDIANAAIVIHLVGAYQVYAQPFFAFVEKIVIKRWPKINKEYRIPIPGFHPYNLNLFRLIWRTIFVITTTVIAMLIPFFNDVLGLLGAVGFWPLTVYFPVEMYIKQKKIPKWSYKWISMQILSVVCLVVSVVAVVGSVASIQLDLKKYKPFTM

SEQ ID NO: 61528 - protein, 1322 aa, Ralstonia eutropha JMP134
MATTTLGVKLDDASRDRLKRVAQSIDRTPHWLIKQAIFTYLEQIERGHLPHEAMAGGAGEADGADGAEMSHADGAPQPFLEFAQSIQPQSVLRAAITSAYRRPETDCVPVLLEQARLPQQQAEAAIKMAKKLATALREQKVGTGREGLVQGLIQEFSLSSQEGVALMCLAEALLRIPDKPTRDALIRDKISGANWQSHLGQSPSLFVNAATWGLLLTGKLVATHTESGLSKALTRIIGKGGEPLIRKGVDMAMRLMGEQFVTGETISEALANARKYEAQGFRYSYDMLGEAAMTEEDAQRYLASYEQAIHAIGQASRGRGIYEGPGISIKLSALHPRYSRAQHERVINELYERLKSLTLLARQYDIGINIDAEEADRLEISLDLLERLCFEPELAGWNGIGFVVQGYQKRCPFVIDYLIDLARRSRHRLMIRLVKGAYWDSEIKRAQVEGLEGYPVYTRKVYTDVSYVACARKLLSVPDAIYPQFATHNAHTLSAIYQIAGHSYYPGQYEFQCLHGMGEPLYDQVVGPIADGKFNRPCRIYAPVGTHETLLAYLVRRLLENGANTSFVNRIADDTISLDELVADPVAVVETMHRDEGTLGLPHPKIPSPRGLYGKSRANSAGIDLANEHRLASLSSALLAGTSERVVADPMLGTEVPRAADAITTPVLNPADHRDVVGQVTEASQADVDAALQAAANAAPIWQATPPDVRASALERAADLMEAQMQSLMGIIMREAGKTFSNAIAEVREAVDFLRYYAAEVRRSFDNETHRPLGPVVCISPWNFPLAIFTGQVAAALAAGNTVLAKPAEQTPLIAAAAVRILREAGVPAGAVQLLPGRGETVGAALVGDARVKGVMFTGSTEVARILQRNIAGRLDAAGRPIPLIAETGGQNAMIVDSSALAEQVVGDVVNSAFDSAGQRCSALRVLCLQEDVADRVLAMLKGAMNELTMANPDRLSTDVGPVIDEEARGNIVRHIDAMRAKGRRVHQADPNAPQGASCRHGTFVPPTLIELDSIDELKREVFGPVLHVVRFPRAALDTMIGQINGTNYGLTMGIHTRIDETIAQIVQHAEVGNLYVNRNIVGAVVGVQPFGGEALSGTGPKAGGPLYLHRLLSVCPQDAVVRSVRHAEASGNPPAAPERPVAAQALKDWAKTEMPEVAAACDRFAEASAAGISVTLRGPTGERNTYSLLPRHHVLCLAAQEQDLAIQLAAVLAVGSQAVMAENPVSRGLFARLPKGVQSRVRIVSDWTSPEPAFDAVIHHGDSDQLRTVCEQVAARPGPIIGVQGLAQGEPNIALERLLIERSLSVNTAAAGGNASLMTIG

SEQ ID NO: 61529 - protein, 428 aa, Lactobacillus crispatus
MLKSVIENVHALEIFDSRGNPTVEVHVTLSNGVVGKAEVPSGASTGENEAVELRDGGSRLGGKGVSKAVNNVNTEINDALKGMDPYNQPKIDKTMIDLDGTPNKGRLGANAILGVSMAVAVAAANDARLPLYRYLGGTDLEMPQTFHNVINGGEHADNGIDIQEFMITPVAKTSFRDGFEKIVNVYHTLKKVLEDMGYETGLGDEGGFAPNMKNSEEALKALHESIIKAGYKPGEDIAIACDCAASYFYNKDDHKYHLEGKVLTDEELADYYDKLLDEFPELISMEDPYDENDVDGMVKFTKSHKDRIQIVLDDFICTNPALLTKAIKEGAGNASLIKLNQIGTVTETLETIRLSRKNGYNTMISHRSGETGDTFIADLAVAVNGGQLKTGAPARSERVEKYNRLLEIEEELGDGERLAFFPDDVDHD

SEQ ID NO: 61530 - protein, 376 aa, Oryza sativa (indica cultivar-group)
MLGAARRQLGSGPMLGQVLRRLRPATAAAADAARAYSAAAKEMTVREALNSALDEEMSADPSVFLMGEEVGEYQGAYKISKGLLDKYGPDRVLDTPITEAGFTGIAVGAAYQGLRPVVEFMTFNFSMQAIDHIINSAAKSNYMSAGQISVPIVFRGPNGAAAGVGAQHSQCYAAWYAHVPGLKVLAPYSAEDARGLLKAAIRDPDPVVFLENELLYGESFPISAEVLDSSFALPIGKAKIEREGKDVTITAYSKMVGYALQAADILSKEGISAEVINLRSIRPLDRATINASVRKTNRLVTIEESFPQHGIGAEICMSVVEESFEYLDAPVERIAGADVPMPYAANLERMAVPQVDDIVRAAKRACYRAVPMAATA

SEQ ID NO: 61531 - protein, 651 aa, Coprinopsis cinerea okayama7#130
MTFPPIPNNTLPALSLVKSTLPANLDPASVDAKAIAQGWLAAFRQVVSEQPSPDAVVSLFVPASSGAQVWWRDMLALTWDFRTFVGADAIRQFATDRLSGSAAQELNLHDIQLVETASDITLPPVYTPASPDLVWIQFFITFKTAVGHGSGIIRIVPVGVSDLPSFQDSKNWKAHIIYTNLEGLLDHPERIGALRDPRPNHGLWAGARQKEVECEGEKGKPTVLIVGGGQSGLEIAARLKVLGVKSLIIEQNERVGDNWRNRYDALCLHDPVWYDHMPYLPFPPNWPVYSPSVKLANWLEHYAEIMELNIWLSSTVQSVKQDPETGKWDFTILRKVKGPDGTVKEQVREFKAIHHLVMASGLGSGVPEIPSIPGQDKFRNNGGIILHSTEHKRAADHQGKKVVVVGACTSAHDICADYYHNGVDVTMFQRSSTYIMSVENGWKVMFEGVYDENSPPVDVADRLTASFPHWASIPLNQGKVKQVAALDKPILDALHKVGFRTNLGYQDSGFALLAWGRAGGYYLDTGASGLIAEGKIKLKNDSQIKEFTERGLRFEDGSELQADVVLFATGLGDPLKRVGRLLGEDLAKQCTGLWGFNQEGEILGAWRDMGIKRFWYMIGNLALCRFHSKHVALQIKAQEEGLLGKRYSASA

SEQ ID NO: 61532 - protein, 305 aa, Miscanthus transmorrisonensis
IESVGEGVTDVAPGDHVLPVFTGECKECPHCKSAESNMCDLRRINTDRGVMIGDDKSRFSINGKPIYHFVGTSTFSEYTVMHVGCVAKINPQAPLDKVCVLSCGISTGLGASINVAKPPKGSTVAIFGLGAVGLAAAEGARIAGASRIIGVDLNPSRFEEARKFGCTEFVNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSVPFAEINKAFDLMAKGEGIRCIIRMEN

SEQ ID NO: 61533 - protein, 332 aa, Xylella fastidiosa 9a5c
MSIATTLHTALSLPQIQSFAASDMAAIDTLIHDRLTSDIVLINQIADHIICSGGKRLRPMLTMLAGHAIGPTGPHHHQLAAIIEFIHTATLLHDDVVDGSELRRSRSTANALWGNAPSVLVGDFLYSRSFQLMTELANLEVMQILAETTNRISEGEVLQLLHVHNPDTDETTYLRVIERKTAILFAAAAQLGALASHADTQTQTRMYEYGMQLGYAFQITDDVLDYTANNSQLGKNLGDDLAEGKATLPVIHAMTHSDAATCERLRMIISKGDRDAMPEVLNAIRTTGSLDYSRQRASAYAATAERALDGLLETEAVAALRGLARYAIQRTY

SEQ ID NO: 61534 - protein, 651 aa, Coprinopsis cinerea okayama7#130
MSFPPIPNNTLPALSLVKSTLPANLDPASVDAKAIAQGWLAAFRQVVSEQPSPDAVISLFVPASSGAQVWWRDMLALTWDFRTFVGADAIRQFATDRLSGSAAQELKLHDIQLVETPSDITLPPVYTPASPDLVWIQFFITFKTAVGHGSGIIRIVPVGVSDLPSFQDSKNWKAHIIYTNLEGLLDHPERIGALRDPRPNHGLWAGARQKEVECEGEKGKPTVLIVGGGQSGLEIAARLKVLGVKSLIIEQNERVGDNWRNRYDALCLHDPVWYDHMPYLPFPPNWPIYSPSVKLANWLEHYAEIMELNVWLSSTIQSIKQDPETGKWDVTVLRKVKGPDSAVKEEAREFEAIHHLVMATGQGSGVPEIPSIPGEDRFKRNDGTVLHSTEHKRAADHRGKKVIVVGACTSAHDICADYYHNGVDVTMFQRSSTYIMSVDAGWKGLFEGVYDENSPPVDVADRLTASFPHWASIPLNQDKVKYVAELDKPILDALHKVGFRTNLGYQDSGVALLAWGRGGGYYLDTGASGLIAEGKIKLKNDSQIKEFTERGLRFEDGSELQADVVLFATGYGDPMKRISRLLGEDLAKECTGLWGFNQEGEILGAWRDLGIKRFWYMIGNLALCRFHSKHLALQIKAQEEGLFGKRYSATS

SEQ ID NO: 61535 - protein, 451 aa, Salinibacter ruber DSM 13855
MPFDTPSSTSDRPHVVIVGAGFAGLEAAKTLRDAPVRVTLVDRNNYHKFQPLLYEVAMAGLEPDDIAHNVRNIFQGNETVNFRLGTVVDIDPARQQVHLHGSQSLSYDHLILAAGAVSTDFGIPGVEEHAYPLKNVPDAVNLRNRVLRQFERYDRQRAAAGEGALTFVVVGGGPTGVEMAGAFVELFDTLNDDFAQFDTREEARCLLLEMEDDLLPPYKAPQRAYTRQVLEARGVDVQTNTAVERVAPDRVHLADGRVLPTQTLVWAAGVKASPVANLLDAEQDRADRVVVSPDLTVPEHPDVYVVGDMAAIEGEDGYEPQLAQVAIQSGRHAADQIQRRLRDATTERFEYWDLGQMATIGRNAAVAEFAGGIAFRGFMAWFLWVVIHIAKLVGFRNRLSALVNWAYNYFTYNRSARLILDAVPLSDDGPMEGEAEGEQVTERPQTVGPQP

SEQ ID NO: 61536 - protein, 305 aa, Miscanthus transmorrisonensis
IESVGEGVTDVTPGDHVLPVFTGECKECPHCKSAESNMCDLLRVNTDRGVIIGDGKSRFSINGKPIYHFVGTSTFSEYTVMHVGCVAKINPQAPLDKVCVLSCGISTGLGASINVAKPPKGSTVAIFGLGAVGLAAAEGARIAGASRIIGVDLNPSRFEEARKFGCTEFLNPKDHKKPVQEVLAEMTNGGVDRSVECTGNINAMVQAFECVHDGWGVAVLVGVPHKDAEFKTHPMNFLNERTLKGTFFGNFKPRTDLPNVVELYMKKELEVEKFITHSIPFAEINKAFDLMAKGEGIRCIIRMEN

SEQ ID NO: 61537 - protein, 428 aa, Arabidopsis thaliana
MMTSRSIVPQQSTDDVVVVDGKNVAKGRNRQVLGDIGNVVRGNYPKNNEPEKINHRPRTRSQNPTLLVEDNLKKPVVKRNAVPKPKKVAGNPKVVDVIEISSDSDEELGLVAAREKKATKKKATTYTSVLTARSKAACGLEKKQKEKIVDIDSADVENDLAAVEYVEDIYSFYKSVESEWRPRDYMASQPDINEKMRLILVEWLIDVHVRFELNPETFYLTVNILDRFLSVKPVPRKELQLVGLSALLMSAKYEEIWPPQVEDLVDIADHAYSHKQILVMEKTILSTLEWYLTVPTHYVFLARFIKASIADEKMENMVHYLAELGVMHYDTMIMFSPSMVAASAIYAARSSLRQVPIWTSTLKHHTGYSETQLMDCAKLLAYQQWKQQEEGSESSTKGALRKKYSKDERFAVALIPPAKALLTGTESA

SEQ ID NO: 61538 - protein, 206 aa, Saccharomyces cerevisiae
MNSEYDYLFKLLLIGNSGVGKSCLLLRFSDDTYTNDYISTIGVDFKIKTVELDGKTVKLQIWDTAGQERFRTITSSYYRGSHGIIIVYDVTDQESFNGVKMWLQEIDRYATSTVLKLLVGNKCDLKDKRVVEYDVAKEFADANKMPFLETSALDSTNVEDAFLTMARQIKESMSQQNLNETTQKKEDKGNVNLKGQSLTNTGGGCC

SEQ ID NO: 61539 - protein, 305 aa, Miscanthus transmorrisonensis
IESVGEGVTDVAPGDHVLPVFTGECKECPHCKSAESNMCDLLRFNTDRGVMIGDGKSRFSINGKPIYHFVGTSTFSEYTVMHVGCVAKINPQAPLDKVCVLSCGISTGLGASINVAKPPKGSTVAIFDLGAVGLAAAEGARIAGASRIIGVDLNPSRFEEARKFGRTEFVNQKDHKKPVQEVLAEMTNRGVDRNVECTGNINAMIQAFECVHDGWGVAVLVGVPHKDAEFKTHPMNFLNERTLKGTFFGNFKPRTDLPNVVELYMKKELEVEKFITHSIPFAEINKAFDLMAKGEGIRCIIRMEN

SEQ ID NO: 61540 - protein, 264 aa, Oryza sativa (japonica cultivar-group)
MRKKGRGERGIELGGGQEGIADAQQGEGDGPRRGRLAVAMDTTTSTHNVGCLDREKKERGEVAFFIYLFLDWFIRHHAVGQNHSGLGQGDAVVGVADGVGGGGAEVDAGGEGEEEGTLEDEGVTVGGVDEVVGEEGPGLSQRHQLRAQRWLDTRAVRGGRERADAPHDLHGGGQAEVQRFYNCGNISDSYTEYLKDIEAGKIENVPTPPIAIDYWRLPADATLKDVVVVVCADEAHHRDVNHFASDVHFQGMDLKDTPALLDYH

SEQ ID NO: 61541 - protein, 305 aa, Miscanthus transmorrisonensis
IESVGEGVTDVAPGDHVLPVFTGECKECPHCKSAESNMCDLLRINTDRGVMIGDGKSRFSINGRPIYHFVGTSTFSEYTVMQVGCVAKINPQAPLDKVCVLSCGISTGLGASINVAKPPKGSTVAIFGLGAVGLAAAEGARIAGASRIIGVDLNPSRFEEARKFGCTEFVNPKDHKKPVQEVLAEMTNGGVDRSVECTGNINAMIQAFECVHDGWGVAVLVGVPHKDAESKTHPMNFLNERTLKGTFFGNFKPRTGLPNVVELYMKKELEVEKFVTHSVPFAEINKAFDLMAEGEGIRCIIRMEN

SEQ ID NO: 61542 - protein, 348 aa, Geobacillus kaustophilus HTA426
MQHIVDVLVIGASQAGLAMGYYLKQNNILFAIVGKENRIGDVWRNRYDSLVLFTPRWFSSLPGMALKGDPNGYPTKDEIADYLEDYAQKFELPIHLNTEVISLQKEDEIFKVTTNNGNYVAEKVVVATGPFQKPYIPPFAESLSDKVYQVHTSRYLNPSQLQEGSVLVVGAGNSGAQIAVELSEDREVYLSVGHKMKFFPLEIMGKSIFWWFKKLGLLNVHINSSLGQFISKQSDPIFGKELKHLIQEGKIKIKPRTESILGDVISFADNSQIQVQNVIWATGFYSDYSWIQIPNVLDHRGKPIHQRGVTSVKGLYFLGLPWQYRRGSALIGGVGADAEYLINDILNH

SEQ ID NO: 61543 - protein, 118 aa, Geobacillus kaustophilus HTA426
MSENIKKLPLVVEEGWRKKRTQPTLPEVYRSLRIPKTGSWMKKFLAFAGPGYLVAVGYMDPGNWATDIAGGSQFGYTLLSVILLSNLMAILLQALAGKLGIVTGRDLAKLVATITASL

SEQ ID NO: 61544 - protein, 265 aa, Frankia sp. EAN1pec
MTDKYGPWGIIAGGSDGVGAAFAHEMATRGLNVVLVARRVPVLEAFAEEIRAKHGVEVRTVALDLSVPGALASLADATSDLEIGLFVYNAGGDDTSALFLDKDLDTHLKLIHRNCDSVLEAAYRFGGPMVARRRGGLVLVTSGAAWAGGATLATYGATKAFDLLLAEALWAEWHTSGVDVLALVLGRTDTPSMRRVFDAKNEPYGDAADPADVAKQALDHLADGPTWIFGSPNPTGGSPFGATSRRDAVLMMSQGSSTSSASTGS

SEQ ID NO: 61545 - protein, 483 aa, Medicago truncatula
MVEHSSGTNLSYRGDIVGMEGGTSLQDDSKYYDDDGRVKRTGTIWTTCSHIITAVIGSGVLSLAWSIAQMGWVAGPGAMIFFSIITLYTSSFLADCYRCGDTEFGKRNYTFMDAVSNILGGPSVKICGIVQYLNLFGSAIGYNIAAAMSMMEIKKSLCVHTSDGKDACHISGNPYMIAFGVAQLFLSQIPDFHNMWWLSIVAAVMSFFYSTIALALGISKVAENGTVMGSLTGVSVGTVTPAQKVWGVFQGLGNIAFAYSYSFVLLEIQDTIKSPPSEGKAMKIAAKISIAVTTTFYLLCGCMGYAAFGDNAPGNLLAGFGVSKAYWVVDAANAAIVIHLFGAYQVYAQPLFAFVEKEAAKKWPKIDREFKVKIPGLPVYSQNIFSLVWRTVFVIISTLIAMLIPFFNDVLGVIGALGFWPLTVYFPVEMYIVQMKIPKWSRKWIILEIMSTFCLIVSIVAGLGSLVGVWIDLQKYKPFSLSN

SEQ ID NO: 61546 - protein, 415 aa, Triticum aestivum
  misc_feature (110)..(110): Xaa can be any naturally occurring amino acid
MAGPEQRVVAVIMVGSPTKGTRFRPLSLNVPKPLFPLAGQPMVHHHISACRRIPNLAQIYLIGFYEEREFALYVSSISNELRIPVRYLREDKPRGSAGGLYSFRDYIMEXSPAHIVLLNCDVCSSFPLPDMLEAHKKYGGMGTLLVNKVSAESANQFGELVADPETNELLHYTEKPETFVSDLINCGVYIFTPKILIAIEDVLKQKKDRANLRRVSSFEALQSATKAIPADYVRLDQDILSPLAGKKELYTYQTLDFWEQIKTPGMSLRCSGLYLSQFRHTSPHLLASGDGKKGATIVGDVYIHPSAKVHLTAKIGPNVSISANARIGAGARLISCIILDDVEIMENAVVIHSIVGWKSTVGKWSRVQGEGDHNAKLGITILGEAVDVEDEVVVTNSIVLPNKTLNASVQDEIIL

SEQ ID NO: 61547 - protein, 440 aa, Erwinia chrysanthemi
MADPTPPVAAEAGSLFANGYVEEIPVANIADRIGTPFYVYSARQLRRQLQQLRQQLPTGTAIYYSLKANPNLSVVRALAEQGAGCEVCSPAELKTALAAGVSPQHILYVGPGKSLPALKLAIDCGIRAIVVESVTELDNLNRLAARANTVQTVALRINPDFSSAHARLVMSGKPTQFGMMRDTLHTVLASLHRWPSISLRGFHVYLGTRILNAQAIADNTRNILQLALDLRDTHRLTLDFVDVGGGFGVPYFPKETPLDLPALGAAIASIVADFRRRAADTQIIIELGRYLVAEAGLFVTRVNTLKTAGGKTFAVCDGGANCHSAAAGLNSMLRKNFPLLRLGDNQGRPLQPYQVSGPLCTPTDLLGDNVLLPTLEVDDLIGITHSGAYGLTASPGSFLSFGYPVEVMVDGRRLTLIRQPETTEQLLARQQPVDLCGDTP

SEQ ID NO: 61548 - protein, 900 aa, Coccidioides immitis RS
MARSTSSPSRSLAERRINDDVDDESSALLPVTSPPSPSTLRRGHGIQFTGLGRPSRRSQDMGERSSLLGGDHTQRSYTTIPSSTRPDAFFRHNSAAGSVRMSKNHSRANSQATKFGPNGAVEWSNSPLSQEETRFSDNRVWYDQFTSTDWVHDTIADGIRLRELRSRRDIRGRFLAWLDGAQGWILVAVIGIVTACFAYFVDVTERALYDLKEGFCTDNWFSSKHHCCLGEDDCSSWSTWADIFRLPKADKAWVDFLAFVAWAVILATASCLLTLLTKTVVPSSISLSTLDEDLAAGGAGSSEYVFSRNDGKAGSDASVTDFEESAPPMVYYSAAGSGVAEVKVILSGFVIHGYLGMKTLIIKTLALVLSVASGLSVGKEGPYVHIATAIGNICCRIFSKYQHNDGKRREVLSASAASGVGVAFGAPIGGVLFSLEEVSYYFPPKTLFRTFFCCIVAALSLKFLNPYGTGKIVLFQVHYVSDWEIFEVALFMILGALGGAAGALFIKASKIWAQSFRKIPAIKRWPMLEVILVALLTGIMSWWNRYTKLAVSELLFELASPCDYAQASNTGLCPTKEEIPQVIRYLIIAFVIKAFLTIVTFGIKVPAGIYVPSMVVGGMMGRIVGHIAQYFVVHYPNFFLFGSCPSSRGPLACVNPGVYALIAAGSTMCGVTRLSVTLVVILFELTGSLDHVLPFSLAILCAKWTANAMEPLSIYDLLTDMNSYPYLDNNLNPITDAELGEIVPSVRKSRIIDITESPLVPASELRTKLDILLRGGELDSGLPILRDSILVGFIPAPELEFALDKLETEDAMCLMSMHSTWAGWSSVEEQEGLEPTDFTPYIDPSPVALDVHSPINLVHQCFVKLGLRYMCVLRDGKYAGLVHKKWFVKFMKETHKSEEA

SEQ ID NO: 61549 - protein, 507 aa, Mycobacterium avium 104
MTVFARPGSAGALMSYESRYDNFIGGQWVAPARGRYFENPTPVTGQTFCEVARSDEADVDKALDAAHAAAPAWGKTAPPERAAILNKIADRIEENLESLAVAEVWDNGKPIREALAADIPLAADHFRYFAGALRAQEGSLSQIDDDTVAYHFHEPLGVVGQIIPWNFPILMGAWKLAPALAAGNAVVLKPAEQTPVSVLYLMSLIGDLLPPGVVNVVNGFGAEAGKPLASSNRIAKIAFTGETTTGRLIMQYASQNLIPVTLELGGKSPNIFFSDVMAKADDYQDKALEGFTMFALNQGEVCTCPSRSLIQADIYDEFLELAAIRTKAVRQGDPLDSETMLGSQASNDQLEKVLSYIAIGKDEGATIITGGERAELGGDLSGGFYMQPTIFAGNNKMRIFQEEIFGPVVAVTSFTDYDDAISIANDTLYGLGAGVWSRDGNTAYRAGRDIQAGRVWVNCYHAYPAHAAFGGYKQSGIGRENHKMMLDHYQQTKNMLVSYSNKAQGFF

SEQ ID NO: 61550 - protein, 522 aa, Acidobacteria bacterium Ellin345
MHFPGRLRSCFQAACFLSILLGSANLFALCTLNTQNQTVTICTPAPNATVSSPVNVQAGVTDSNAVKALQIYVDGVKVYEIVAKTLNTNVTMANGAHRLTVQAQDSTGAVFKSTENINVSTAGAGTINDVKHIIFMVEENRSFDSYFGMMGAYRTKLGYGGTFNGVPLNASLSDYKGTGNVSPFHYQTVCTDNMTPAWNESHYSWHAGKMDYFMKVEGSLPSSIDPQGTRIMGYYDQTDLPYYYELATQYATSDTWHTPILSDTIPNRMYLFTATSFGHIRPQDVPPSGGWTQPTIFRDLSQHGITWRYYYQDNSVYLASFSDWNAYQNNVYNISHYYTDIQNPSTLPEVIFIERGSQTGVDEHPLNNIQKGAADVAKIINSFLTSPSYSSSVFILTYDDPGGLYDHVPPFSEPAPDSIPPMVRSTDIKGDFLESGFRVPLIVVSPWTKPHYVSHVNRDYTAMLKFIEKRFGLPALTKRDAAQDDMTEMFNFATPQIPTPPAMPTQPTSGVCNKNLEKAPGY

SEQ ID NO: 61551 - protein, 608 aa, Orobanche ramosa
SGKPFYAIIHRVTGSLIIDFEPVKPHEVPMTAAGALQSYKLAAKAITRLHALPNGSMKRLCDTMVQEVFELTGYDRVMIYKFHDDDHGEVFTEITKPGLVPFAGLHYPATDIPQAARFLFMKNKVRMICDCRANHVKVIQDENLPFDLTLCGSTLRAPHSCHLQYMENMDSIASLVMSVVVNEGDEDGPDSSSGPDKRKRLWGLVVCHNTSPRFIPFPLRYACEFLAQVFAIHVNKELELDNQMVEKNILRTQTLLCDLLLRDAPLGIVSGNPNMMDLVKCDGAVLLYRITKYRLGLTPTDFQIRDIVSWLDEYHLDPTGLSTDSLYDAGFPGALALGDAICGMAAVRITDKDWLFWFRSHTAAEIRWSGARHEPGEKDDGRKMHPRSSFKAFLEVVKTRSLPWKEYEMDAIHSLQLILRNASKENKEKDMEKREIHARLNELQIDGAKEIEVVTSEMVRLIETASVPIFAVDLDGLVNGWNTKIADLTGLGVDEAIGRHFLALVEDSSADTVNKMLELALQGKEERDVEFEIKTHGQRSESGPITLIVNACASRDVNENVVGVCFIAHDITTQKSMMDKFTRIEGDYRSIIQNPNPLIPPIFGTDEF

SEQ ID NO: 61552 - protein, 379 aa, Glycine max
MSTAGQVIKCRAAVAWEAGKPLSIETIEVAPPQKGEVRLKILFNSLCRTDVYWWDAKGQTPLFPRILGHEASGIVESVGEGVTHLKPGDHALPIFTGECGECTYCKSEESNLCELLRINTDRGVMLSDGKTRFSKNGQPIYHFVGTSTFSEYTVLHEGCVAKINPAAPLDKVAIVSCGFCTGFGATVNVAKPKPNNTVAVFGLGAVGLAACEGARVSGASRIIGVDLLPNRFEQAKKFGVTDFVNPKDHNKPVQEVIAEMTNGGVDRAIECTGSIQASISAFECTHDGWGTAVLVGVPKKDVEFKTNPMKFMEGRTLKGTFYGHYRPRTDIPGVVEKYLNKELELDKFITHSVPFSKINTAFDLMLKGEGIRCLICMEE

SEQ ID NO: 61553 - protein, 203 aa, Arabidopsis thaliana
MCLIMETDDHNGDVLAPPSNFSMVEDGIYRSGFPRPENFSFLKTLNLRSIIYLCPEPYPEENLKFLEANNIKLYQFGIEGKTDPPTPMPKDTVLDALKVLVDVRNHPILIHCKRGKHRTGCLVGCLRKVQSWCLSSVLEEYQKNAGLKWRQRDLNFIEAFDIVSLRQCLLSIMYQYHGYGFKRRRLAYEEENVKTPKPQAARV

SEQ ID NO: 61554 - protein, 488 aa, Legionella pneumophila subsp. pneumophila str. Philadelphia 1
MEIYKMYIDGKFTLAKSGATRDIFDPANGDLIAKVPESAKEDAILAIKAARKAFDEGEWRKSLALDRGKLLFKLADLIRANAKMLAELETRNCGKPLLEAEFDVTDAANCFEFYGGLATKIHGETMSVPANSFSYVVREPIGVCGQIIPWNFPLLMAAWKLAPALAAGNTVVLKPSELTPITALELFKLIDECGFPAGVVNLITGPGIGVGEELASNAMVDKVAFTGGSATGRKIMQAATGNLKKISLELGGKNPNIVFADSDLEMAIDGALFGAFANQGEVCSAGSRLLVERSIHKKIVEGMLKKIPNIKLGHGLDAGVKMGPLVSSAHREKVESYVKLGMEEGAKLLCGGKRPTGNEFAKGHFFEPTIFDEVKSTMRIAREEIFGPVLVVIPFDTEEEAIRIANDTDYGLSGAVWTKSVTRAHRVTSQIRAGILWVNHYHPTYNEMPWGGYKQSGAGRELGLYGIESYLEVKQVNINLDETPIGWY

SEQ ID NO: 61555 - protein, 450 aa, Legionella pneumophila subsp. pneumophila str. Philadelphia 1
MKHQLVGTKLMKKIHIKTPIPGPKSQQLMELRRQHVARGPFHATPIFVKQAKGSFVEDVDGNVFLDFSSGFGVVNTGHCPDSVVNAIKLQAEKFIHTGFNIIPYESYIKVCEKLNDHTPGHFEKKSLLLNSGAEAVENAIKIARAYTGKQAVICFDHAFHGRTYMAMTLTSKNKPYKHGFGPFPSEIHRAPFPYEYRWKGANCVEECFDEFTDLANFRVGVENIAAVIIEPVLGEGGFIQSPALFLQKLREFCTTNDIVFIADEIQSGFGRTGNLFAMNTLGVPPDLTISAKGLGGGVVLAGVTGKAEIMDAAMEGGLGGTFGGNPLSCAAALEVFHIFEEGSLLQNVTHLAKALQSRLSGFKEKYKVVGDVRGLGVMQAIELVKDKNTKEPNKEATVQLAQFCLEHGLIILTCGTYGNVIRLHMPLSTGVKDLELGLSIIEEGLKKLSV

SEQ ID NO: 61556 - protein, 310 aa, Legionella pneumophila subsp. pneumophila str. Philadelphia 1
MSSKLLTIQLLEELVHAAELNQEGKTADYIPELANVNQELTAIAVQALGEKTLAYSNNPLHPVTLQSTGKMIPLIGLLEEFGADQLFEWVKVEPSGDDFASITRLEQFGPKPSNPMLNAGAIALCSRIPGIGEQQFRWLEHWVQKLFNQRLSINPLVFASEKRTGNRNRALAYLLKSRNNLGADVHETLDLYFALCSYEAMLDQMLYLPTLLANRGKDPDTGEQILSTETCKITLAIMATCGLYDETGTHMVKTGMPAKSGVSGYTIAVVPGKAGIVVLSPRVNAKGNSIRGEIMLEGLSKAMNWHFALP

SEQ ID NO: 61557 - protein, 462 aa, Staphylococcus aureus subsp. aureus NCTC 8325
MIKKRIIPCLDVKDGRVVKGIQFKGLRDIGNPVDLAMYYNEAGADELVFLDISKTEEGHSLMLEVIEQTASRLFIPLTVGGGIQSLDDITQLLNHGADKVSLNSSALKNPQLIKQASDKFGRQCICIAIDSYYDPERKAHYCCTTGGKKMTNIKVYDWVQQVEQLGAGELLVTSMGHDGMKQGFDIEHLANIKSLVNIPIIASGGGGNAQHFVELFDQTDVSAGLAASILHDRETTVQSIKEVIRQGGYSSKMTKYKIDFSKGLVPAILQDNQTKQVLMLGYMNQEAFDKTIEDGVVCFYSRSKQRLWTKGETSGHTQRVKDIHVDCDNDTILIDVIPNGPTCHTGSQSCFNTEVPFSVQTLAQTVQDSAQSNNEKSYTKYLLTEGIEKITKKYGEEAFEVVIEAIKGDKKAFVSEVADELYHLFVLMHALGVDFSEIEAELARRHHKRNNFKGERQNIEQW

SEQ ID NO: 61558 - protein, 337 aa, Sinorhizobium meliloti 1021
MMGVRHATADAHAGGTVLESIGRTLTTATNGIKALADHLTSDQAFAGALVDAVELMGDGDGRVVVSGVGKSGHIGRKIAATLASTGTSAHFVHPTEASHGDLGMITAQDALVLLSWSGETAELANMLTYAKRFKVPIVSICSNRESTLARNSEIALVLPKVPEACPHGLAPTTSAMLQLAVGDALAIALLERRGFSAEDFKTFHPGGKLGAQLRLVQELAHGTGQMPLLSVGRPMSEAVIEMSAKGFGVVGITDESGKLIGVITDGDLRRHMAGDLLAQPVQEVMSRNPRVIKGDVLASAAMEFMQDHKVTVLFLVDEAGAPVGILHIHDLLRAGVA

SEQ ID NO: 61559 - protein, 364 aa, Pseudomonas putida
MNSAIGPYKGGLRFHPSVNLGVLKFLAFEQTFKNSLTSLPMGGGKGGSDFDPKGKSDAEVMRFCQAFMSELYRHIGADVDVPAGDIGVGAREIGFLFGQYKRLSNQFTSVLTGKGMTYGGSLIRPEATGFGCVYFAEEMLKRRGQSVEGKRVAISGSGNVAQYAARKVMDLGGKVISLSDSEGTLYCEAGLSEAQWLALLELKNIKRGRISELASAHGLEFRAGQHPWSLPCDIALPCATQNEVDAGAARTLLRNGCVCVAEGANMPTTLAAVDIFIEAGILFAPGKASNAGGVAVSGLEMSQNAMRLLWTAGEVDSKLHAIMQSIHHACVHYGEDNGQINYVKGANIAGFVKVADAMLAQGVV

SEQ ID NO: 61560 - protein, 180 aa, Triticum aestivum
  misc_feature (6)..(6): Xaa can be any naturally occurring amino acid
  misc_feature (170)..(170): Xaa can be any naturally occurring amino acid
MEDERXSTQSYQGGEAAEQVEVTDRGLLGNLLGKKKAEEDKEKQEELVTGMEKVSVEEPEVKKEEHEDGEKKETLFSKLHRSSSSSSSSSDEEEEEVIDDNGEVIKRKKKKGLKEKLKEKLPGHKDTEGEHVTGLPAPAAPASVQTHHDTDVVVEKIDGDVKTEAAPAVXPEEEKKGFLE

SEQ ID NO: 61561 - protein, 375 aa, Yarrowia lipolytica CLIB122
MSYYSRRNRDAQAAPPAAASKKVPIEKSQQLLKSLLRESDNKVCADCKTATHPRWASWNLGCFICIRCSGIHRGMGTHISRVKSVDLDAWTEEQLASMMKWGNTRCNMFWEAKLPKGHVPDDNKIENFIRTKYDMKKWAASTTVPDPDTLGGASHAAAPVQAPPKDTKIAGPPQVTKKAPATQQSSLIGLDFDEPQQHQHKPAQLQQPQQTQKNDDFLSFAQSPPQTQQQSPQQHQQSPPQQQFQAQQPFPSASAPDSSRPDLKKSILSLYANSRQAPVVQQQQQQQQFQQQQFQAQQQFQQQQPQFQQQQGGDFGGFGNMQQQTNSGFGNMQQANSGFGGFGGAPQQQNNAHNDWADAAAPKKQEDDVFANVWK

SEQ ID NO: 61562 - protein, 464 aa, Aspergillus oryzae
MLAFYGSSNSRCLFHVMNKPIELRDTNPTFSWTEDLGKVETLCSADSRTIHRAFIIYRTSGRNDFTLNLNPSSGGHVILSLYTEAFWLDVVKRRFSLVRETNRPYFYREAYLPGATAQNHASNLLLLPNGDVLCAWFGGSMEGKPDISIYLSRLRSGEQSWSEAIRMTHDNTRSEQNPVLFRTPTGDLWLLYTSQHAGNQDSAIVKRRVSKDDGITWGKEEVLFPDSGIFIRQPAIVLDDGAWVIPVFKCRVEPGERWLGNNDISCIRVSRDEGQTWTESVIPESTGCVHMEIQRLKDCSYLGLFRSRWADHIYLATSPDGLSWSPPQPTILPNPNAGICFDVLPSGRVVVVYNHSSKLDATGRRQGLYDDIADGVDERRDQSSTQDGRESFWGAPRAPLCVAWSDDSGKTWERRVLEDGDGYCMTNNSEKKLNRELSYPSMVLDEGKIHIAYTFWRQRIKQNT

SEQ ID NO: 61563 - protein, 623 aa, Amaranthus hypochondriacus
MLVLCSRSRLTSSLIRRLKDQIANVSNHRSFATSEGHRLAIVNKRSLDILQDPWFNKGTAFSMTERDRLDLRGLLPPNVMTTEQQIERFTADLRVLELTTKDGPSDTYDLAKWRILNRLHDRNETMFFKVLIENIEEYAPIVSTPTVGLVCQKFSGLYRRPRGMYFSSDDRGEMMSMVYNWPAEQVDMIVVTDGSRILGLGDLGVHGIGVAIGKLDLYVAAAGINPQRVLPVMIDVGTNNEDLLKNPLYLGLQKKRLDGEEYLAVMDEFMEAVFTRWPNVIVQFEDIQNKWALTLLQRYRHKYRTFNVDVQGTSGVAIAGLLGAVRAQGRPMIDFPKQKIVVAGAGSSGVGVLNAARKTMARMLGNDESAFDRARSQFWVVDDKGLITEKRANLDPEVQPFAWKENEISLQGLNEGAKLVEVVRQVKPDVLLGLSAYGGLFSKEVLEALKDSTSTRPAIFAMSNPTKNAECTPEEAFSIVGDHVVYASGSPFKDVDLGNGKIGHVNQGNNMYLFPGIGLGVLLSGSRIISDSMFQAAAERLAGYMTDEEVINGVIYPSISRIRDITKEVAAAVIKEAVEEDLAEGYRDMDARELQKLNEEQILEYIEKNMWNPEYPTLVYKKR

SEQ ID NO: 61564 - protein, 189 aa, Zea mays
VAMSAIISLGLIGAGTNNARIAGMLRNLSSYYYKDMSLLFCVRIAQGLVHMGKGLLTLSPFHSERFLLSPTALAGIVTLLHACLDMKPIILGKYHYVLYFLVLAMQPRMMLTVDENLKPLSVPVRVGQAVDVVGQAGRPKTITGFQTHSTPVLLAAGERAELATDKYIPLSPILEGFIILKENPDYREE

SEQ ID NO: 61565 - protein, 585 aa, Mesembryanthemum crystallinum
MGGSNALNEMTNGSDGITGGVADVYGEEFATQDQLVTPWSFSVACGHSLLRDPQHNKGLAFTEKERDAHFLRGLLPPVVLSQELQEKKFLTTLRQYQVPLQKYMAMMDLQERNEKLFYKLLVDHVEELLPLVYTPTVGEGCQKYGSIFRRPQGLFISLKDKGRILELLRNWPEKKIQVIVVTDGERILGLGDLGCQGMGIPVGKLSLYSALGGVCPSACLPITLDVGTNNQKLLDDEFYIGLKQKRATGEEYAEFVQEFMSAVKQNYGEKILVQFEDFANHNAFELLEKYRTTHLVFNDDIQGTASVVLAGLIASLKLLGGTLADHKFLFLGAGEAGTGIAELIALEMSKKTKAPVEQMRKKIWLVDSKGLVVSSRKETLQQFKLPWAHEHEPITTLIDAVQAIKPTVLIGTSGKGKQFTKEVVEAMANINAKPLILALSNPTSQSECTAEEAYTWSQGHAIFASGSPFDPVEYEGRTFVPGQANNAYIFPGFGLGLIMCGAIRVHDDMLLAASEALASQVTGEHFIKGLIYPPFKDIRKISAHIAAGVAAKAYELGLASRLPQPADLVKFAESCMYNPTYRSFR

SEQ ID NO: 61566 - protein, 394 aa, Pisum sativum
MEGGGGAPAADAVMEDAAPQQQEPQQQAAMGIENIPATLSHGGRFIQYNIFGNIFEVTAKYRPPIMPIGKGAYGIVCSAHNSETNEHVAVKKIANAFDNKIDAKRTLREIKLVRHMDHENVVAIRDIVPPPQREVFNDVYIAYELMDTDLHQIIRSNQALSEEHCQYFLYQILRGLKYIHSANVLHRDLKPSNLLLNANCDLKICDFGLARVTSETDFMTEYVVTRWYRAPELLLNSSDYTAAIDVWSVGCIFMELMDRKPLFPGRDHVHQLRLLMELIGTPSEADLGFLNENAKRYIRQLPLYRRQSFQEKFPHVHPEAIDLVEKMLTFDPRQRITVENALAHPYLTSLHDISDEPVCTTPFSFDFEQHALTEEQMKELIYREALAFNPEYQQ

SEQ ID NO: 61567 - protein, 669 aa, Synechococcus sp. CC9311
MAAATASLDTLCVNSIRMLAVDAVNKSNSGHPGLPMGCAPMGYTLWDKFLKHNPKNPKWFNRDRFVLSAGHGCMLQYALLHLTGYDSVTIDDIKQFRQWGSKTPGHPETFETPGIEVTTGPLGAGISNAVGLAIAESHLGAKFNKADAKVVDHFTYVIMGDGCNQEGVASEAASLAGHLKLGKLIALYDDNHITIDGRTDVSFTEDVLKRYEAYGWHVQHVADGDTDVNAIAKAIEAAKAVTNKPSIIKVTTTIGYGSPNKSDTAGVHGAPLGAEEAELTRKQLGWTHGPFEIPQEAYDQYRQAVERGASQEAEWNQSLANYRSKYPTESAEFERMLRGELPQGWDKDLPTYTPDDKGLATRKHSQICLGALGANLPELIGGSADLTHSNYTDIAGETGSYQPETPEKRYLHFGVREHAMAAVLNGIAYHNSGLIPYGGTFLVFADYMRGSMRLSALSMLGVIYVLTHDSIGVGEDGPTHQPIETIPSLRAMPGMLVFRPGDGNETSGAYKLAIENRNRPSAMCLSRQGMANQANSSIDKVAFGGYILEDCAGTPDLILIGTGTELDLCVQAAKQLTSEGKNVRVVSMPCVELYDEQSDAYKEEVLPNAVRKRIVVEAAETFGWHRFIGLDGDSITMNRFGASAPGGTCMEKFGFTVDNVVAKSKALLG

SEQ ID NO: 61568 - protein, 376 aa, Xanthomonas campestris pv. campestris
MSKRDYYEVLGVARGASDEELKKAYRRCAMKYHPDRNPGDAAAEATFKECKEAYEVLSDGNKRRAYDAHGHAAFEHGMGGGGGGPGGPDMGDIFGDIFGNIFGGGAAGPRAARRGADVGYVLELDLEEAVAGIERRIEIPTLIECEPCHGSGSEDGKVEVCATCHGRGQVRIQRGIFAMQQSCPHCDGRGTLIQNPCKTCHGAGRVEEDKVLSIKVPAGVDTGDRIRLAGEGEAGPAGTPPGDLYVEVRVREHAIFQRDGDDLHCEVPIRISQAALGDTVRVATLGGEAEIRIPAETQTGKLFRLRGKGVRSVRSRSEGDLYCRVVVETPVNLTADQRELLKQFEATFTGEDARKHSPKSATFIDGVKGFWDRMTS

SEQ ID NO: 61569 - protein, 971 aa, Candida glabrata CBS 138
MTAEALVNGTSYTTLVAHSQESFKNAVEFYKNFLSLMKLNDKNANEATLYNSSVCLKIVLEEDSSKNQAAMHRVTKLSEMSKKQDWRAQVKDSLVFNIVDIQSIQKSLIANNFPIQAYPTTLQPMQLFTIDPLGNVVGVTCTKNAASTRPTKPQADVTTVPPSALASNVPSALPSKVQSFTDLSYCMKTTDHYPSLPTKATRVTPESKKAIAVMTSGGDAPGMNSNVRAIVRSALFKGCRAFVVMEGYEGLVRGGPEYIKEFSWEDVRGWSTQGGTNIGTARCMEFRERKGRLLGAQHLIEAGVDALIVCGGDGSLTGADLFRSEWPSLIDELLKENRIDNDQYERYKHLNICGTVGSIDNDMSTTDATIGAYSALDRICTAIDYVEATANSHSRAFVVEVMGRNCGWLALLAGIATSADYIFIPEKPATSSEWQDQMCDIVAKHRSRGKRTTIVIVAEGAIANDLTPISPSDVHKVLCDRLGLDTRITTLGHVQRGGTAVAYDRILATLQGIEAVNAVLESKPDTQSPLIAINENKITRKPLVESVKLTKSVADAIQAKDFKKAMSLRDTEFIEHMKNFMAINSADHNEPKLSEDKRLKIAIVNVGAPAGGINSAVYSMATYCMSQGHKPYAIYNGFSGLARHESVRSLKWQDMLGWQSRGGSEIGTNRVTPEEADLGMVAYYFQKYQFDGLILVGGFEAFESLHQLERARETYPAFRIPMVLIPATLSNNVPGTEYSLGSDTALNALMEYCDIVKQSASSTRGRAFVVDVQGGNSGYLATYAALAVGAQVSYVPEEGISLEQLSQDIEYLAEAFEVAQGREGFGKLILKSTNASKALTAEKLAEVITAEANGRFDAKAAYPGHVQQGGLPSPIDRTRATRFAIRAVDFIEEQQSVIANARAANDVFVADDKDVESTATVLGVKGSQIVFSSIRQLYDFETEVGKRMPKVIHWQNARAIADHLVGRKRVD

SEQ ID NO: 61570 - protein, 571 aa, Arabidopsis thaliana
MSSFNLSVDVNQNGNIKNVDSLSTLDDIDDIDFAKLLEKPRPLNIDRLRSLDERSLTELTGSPQLRNADNASRAPDHADYVISPSFGRRSGFNTPRSQPGFESHPMVGEAWDALRRSMVYFRGQPVGTIAAVDNSEEKLNYDQVFVRDFVPSALAFLMNGEPDIVKNFLLKTLRLQSWEKKIDRFQLGEGVMPASFKVFHDPVRNHETLIADFGESAIGRVAPVDSGFWWIILLRAYTKSTGDSSLADMPECQKGIRLILSLCLSEGFDTFPTLLCADGCCMIDRRMGVYGYPIEIQALFFMALRCALLLLKHDGEGKDMGQQIVKRLHALSYHMRSYFWLDLKQLNDIYRYKTEEYSHTAVNKFNVIPDSLPEWVFDFMPPHGGFFIGNVSPARMDFRWFALGNCIAILSSLATPEQSTAIMDLIESRWEELVGEMPLKVCYPAIESHEWRIVTGCDPKNTRWSYHNGGSWPVLLWLLTAACIKTGRPQIARRAIEVAEARLHKDHWPEYYDGKVGRYVGKQSRKNQTWSVAGYLVAKMMLEDPSHVGMVCLEEDKQMKPVMRRSNSWTC

SEQ ID NO: 61571 - protein, 384 aa, Synechococcus sp. CC9311
MVIIGGGMAGLSCAASLARRGISDVILLEGKTLAHARASSFGETRMFREMYSDPVLCRLAQEANRLWREEETHAGEILRDTHGLLFYGESWDEETIEGSIPGARLVMDDQGIPYEALSAAQIAERFPLKPKADFTGLFEPTAGAVRSDKVIAHWVRTARTAGHQLEEHSPVSSIDADGGGVTLEGGHHISAGHVVVACGIWSQLLLAPLGLAPKLEIWPMLWAHYTVDPALASRYPQWFCFQKERGDDGGLYYGFPSLSTTADGRPRIKAGIDWSPKELRVAEPNAMCTEAPARLLELLDTFLFNELDGVQERVETVMSPYSMTSDVNFVLDRLTPKLSLFAGGSGQSFKFAPLIGDSLARLASGDQPAADISCWSHQRDAVRA

SEQ ID NO: 61572 - protein, 328 aa, Erythrobacter sp. NAP1
MNQALLTTHVSSALKTLDIEIGGLKDLKRALSDSGLGNAFERAVDAFNSNKGRIIVTGIGKSGHIARKIAATFVSTGTSALYLHPGEASHGDLGTISRDDVVFAITWSGTTQELSDIVNFCGINNQQLVVATAHPQSWIGKAADICLTLPMVREACPNELAPTSSTTMQMVLGDALAVALIEARGFSPQNFGILHPGGLLGARLTTLEKVMATGEALPMVSLDATLRGATIEMSRKRYGCTAIVDQDNRLVGAFTDGDLRRSIAANDLDDNIASHMSPNPVTASPKMMAVDALALMNDSAVSVLFVTEQEDRLVGIVHMHDLVRLGIG

SEQ ID NO: 61573 - protein, 636 aa, Arabidopsis thaliana
MIIMMNCFPCFTSQKSRNAPCTTNETNDDNVEHDEFRPPVVATTKRTEEREPAEQQPPVKTFNFRELATATKNFRQECLLGEGGFGRVYKGTLQSTGQLVAVKQLDKHGLHGNKEFLAEVLSLAKLEHPNLVKLIGYCADGDQRLLVFEYVSGGSLQDHLYEQKPGQKPMDWITRMKIAFGAAQGLDYLHDKVTPAVIYRDLKASNILLDAEFYPKLCDFGLHNLEPGTGDSLFLSSRVMDTYGYSAPEYTRGDDLTVKSDVYSFGVVLLELITGRRAIDTTKPNDEQNLVAWAQPIFKDPKRYPDMADPLLRKNFSERGLNQAVAITSMCLQEEPTARPLISDVMVALSFLSMSTEDGIPATVPMESFRDKSMSIALSRHGSCSVTPFCISRKDVGNKSSSSSDSEDEEEEKEQKAEKEEESTSKKRQEQEETATDSDDESDSNSEKDQEEEQSQLEKARESSSSSSDSGSERRSIDETNATAQSLKISYSNYSSEEEDNEKLSSKSSCKSNEESTFSRYDSGRDHDDSSRNTSMRINSLAHDDKEEDEEENHETRSYSDHDDSPRNTSMRINSLSHDDDEEEEEENHQTRLEHIHSSKSEDQSVYSDDDAGESGESSLHRIEAKEEEHISSDHD

SEQ ID NO: 61574 - protein, 664 aa, Bacillus subtilis subsp. subtilis str. 168
MPQENNTFYITTPIYYPSGKLHIGHAYTTVAGDAMARYKRLKGFDVRYLTGTDEHGQKIQQKAEQENITPQEYVDRAAADIQKLWKQLEISNDDFIRTTEKRHKVVIEKVFQKLLDNGDIYLDEYEGWYSIPDETFYTETQLVDIERNEKGEVIGGKSPDSGHPVELIKEESYFFRMGKYADRLLKYYEENPTFIQPESRKNEMINNFIKPGLEDLAVSRTTFDWGVKVPENPKHVVYVWIDALFNYLTALGYDTENDELYQKYWPADVHLVGKEIVRFHTIYWPIMLMALDLPLPKQVFAHGWLLMKDGKMSKSKGNVVDPVTLIERYGLDELRYYLLREVPFGSDGVFTPEGFVERINYDLANDLGNLLNRTVAMINKYFDGQIGSYKGAVTEFDHTLTSVAEETVKAYEKAMENMEFSVALSTLWQLISRTNKYIDETAPWVLAKDPAKEEELRSVMYHLAESLRISAVLLQPFLTKTPEKMFEQLGITDESLKAWDSITAFGQLKDTKVQKGEPLFPRLEAEEEIAYIKGKMQGSAPAKEETKEEEPQEVDRLPEITIDQFMDVELRVAEVIEAEPVKKADRLLKLQLDLGFEKRQVVSGIAKHYTPEELVGKKLVCVTNLKPVKLRGELSQGMILAGEADGVLKVVSIDQSLPKGTRIK

SEQ ID NO: 61575 - protein, 572 aa, Oceanicola granulosus HTCC2516
MARHLITSAIPYINGIKHLGNLVGSQLPADLFARYQRARGHEVLFLCATDEHGTPAELAAAKAGKPVAEYCAEMWQVQADLAEGFGLSFDHFGRSSSPQNHALTQHFAGVLAEQGLIEEVSETQMYSPADGRFLPDRYIEGTCPNCGFESARGDQCDNCTKQLDPVDLIDAYSTISGSRELEMRATKHLYLRQSVLKDELAAWIDTKTDWPVLTTSIARKWLNDGDGLQDRGITRDLDWGVPVKRGSEDWPGMEGKVFYVWFDAPIEYIACAQEWVEAGKGDDWARWWRTDRGADDVRYTQFMGKDNVPFHTLSFPATILGSREPWKLVDYIKSFNYLNYDGGQFSTSRGRGVFMDQALEILPADYWRWWLLSHAPESADAEFTWENFQASVNKDLADVLGNFVSRVTKFCNAKFGPQVPEAGAHGPDEAALIEELEGRVRAYERHMDAIEVRKAAAELRAIWVTGNEYLQKAAPWTVIKTDEARAKAQIALGLNLIRLYAILSAPFVPNASARMLEALGVSDAAWPGDVAGALTALPAGHGFEVPEVLFAKIADASRAEWQKRFAGTRDAA

SEQ ID NO: 61576 - protein, 488 aa, Coxiella burnetii RSA 493
MTVLYQNRQIRELERLAVESGISEYELMCRAGEAAFKALLARWPEAQEITVCCGKGNNGGDGLVLARLAYENGLKVTVYLAGQRHQLKGAAAQAANACEASNLPILPFPEPLLFKGEVIVDALLGSGLSGEVKAPYDHLIAAINQAGQYVLALDVPSGINVDSGEVQGTAVKANLTVTFIAPKRGLYTDKAPAYCGELIVDRLGLSESFFRAVFTDTRLLEWKGVFPLLPKRARDAHKGSYGHVLVIGGDYGMGGAVRMAAEAAARVGAGLVTVATRPEHVPIVSGPRPELMCHQVAAADDLKPLLTAATVVVIGPGLGKSDWAKSLLNKVLETDLPKVLDADSLNLLAESPSQREDWILTPHPGEASRLLGISCNEVQRDRFQAINDLQEKYQGVLVLKGVGTLIKDESQAYYVCPAGNPGMATGGMGDILSGIIGGLVAQRLSLASAAQAGVFIHSMAADRAAEEGGERGLLATDLFPHLRVLVNP

SEQ ID NO: 61577 - protein, 115 aa, Glycine max
  misc_feature (14)..(14): Xaa can be any naturally occurring amino acid
  misc_feature (27)..(27): Xaa can be any naturally occurring amino acid
  misc_feature (69)..(69): Xaa can be any naturally occurring amino acid
  misc_feature (82)..(82): Xaa can be any naturally occurring amino acid
MALFGEGDKRRILXTRPHRTNAHTCHXSETNCLHWTKTLLTRLLTNLPIIYCEGNTLLKTYVVFSPYAXEAYINVPKEKRTXGYEISLTLNWAGEAKDSPGTSLSRSPYPGNPYI

SEQ ID NO: 61578 - protein, 366 aa, Zea mays
GEKPSLKDWRSFIEIKGRVKLSAFQEFVDQLPKSKSRAIMTIDAYISDERVGLAEPAEGIELYLCPPHGKTVEILSRHLPKEHQESLAVAGSSFIGVVVWRRPSISRAPTSHHNNRHDGSKRQSILGKPPVTNPAAARPSLPLNSYGAPPGFPNQRHQEEEDVTDDAPPGFGPGVARDEDDLPEFNFVKSSHHAANVTAHAYKGPWPHVPPPSARPAEQMRELVQKYGKRSSVQEAPRAWDDDDDDIPEWNPTHQTIKQPPLPHAPQQLPLPPPPVQQMNAAYQQQYHIPSAVQPQVPITSLPHAYLRTQQPQPGQAWQQPSNAWWPAQGVAAPAAQQPQYGVVPGSSGVQGYDSSNAGGMAWRPR

SEQ ID NO: 61579 - protein, 645 aa, Clostridium difficile 630
MSKPSFYVTTPIYYPSGGLHIGHTYSTVAADTIARFKRFCGYDVKFLTGTDEHGEKIQKKAIEQGMSEIEYLDGMIKDIKALWNTMDISYDDFIRTTEKRHTDIIQKIFTKLYEQGDIYKGEYEGRYCTPCESFWTESQLLEGNKCPDCGRETYLVKEESYFFRLSKYEDRLKELFKDDSFCFPAARKNEMVANFLDKGLEDLSVTRTTFDWGIKVPFDEKHVIYVWVDALCNYITALGYMTDNDEEFKKYWPANVQIVGKEIVRFHTIIWPALLMALGLEVPKQVFGHGWILFADDKMSKSKGNVVYPEPIIERYGIDTLKYFLLREFAFGQDGSYTHRNFVTRINYDLANDLGNLISRTVAMVEKYNNGIIPTAKVSTDFDADLKEQAVSTRENFEAEMDKMQFHEALESVWKLVRRTNKYIDETMPWALAKDETKKGELDTVLYNLCESIRIIATLINPIMNETANKIYEHIGIKGQDDITTWESTKTFGLIGENVKVFKGEPLFPRLDVEKEIEELTKMFSGKPPVEEKPLEHKEEITIDDLDKIELRVGKIISCEKHPKANKLLVSQVKIGPETRQIVSGIAEYYKPEDLVGKEVTVVCNLKPVKLRGVESQGMILAAGDDGEPYVLPFTQGAKDGCEVR

SEQ ID NO: 61580 - protein, 654 aa, Arabidopsis thaliana
MVGGGGGSSGRGGGSGSGSSKQQRGFSMNPKDYKLMEEIGHGASAVVYRAIYLPTNEVVAIKCLDLDRCNSNLDDIRRESQTMSLIDHPNVIKSFCSFSVDHSLWVVMPFMAQGSCLHLMKTAYSDGFEESAICCVLKETLKALDYLHRQGHIHRDVKAGNILLDDNGEIKLGDFGVSACLFDNGDRQRARNTFVGTPCWMAPEVLQPGNGYNSKADIWSFGITALELAHGHAPFSKYPPMKVLLMTIQNAPPGLDYDRDKKFSKSFKEMVAMCLVKDQTKRPTAEKLLKHSCFKHTKPPEQTVKILFSDLPPLWTRVKSLQDKDAQQLALKRMATADEEAISQLIDDDDLEESKEDEEILCAQFNKVNDREQVFDSLQLYENMNGKEKVSNTEVEEPTCKEKFTFVTTTSSLERMSPNSEHDIPEAKVKPLRRQSQSGPLTSRTVLSHSASEKSHIFERSESEPQTAPTVRRAPSFSGPLNLSTRASSNSLSAPIKYSGGFRDSLDDKSKANLVQKGRFSVTSGNVDLAKPTAQPQTIKEHSSHPTSSSPIMPQLQHLFQQNSIQQDLIMNLLNSLQPVEATEGSQSGKLPPLPRSDSNGNVEPVASERERLLLSSISDLRARLDDLTEELDIEKSKYSQLQQKLKAFTGREH

SEQ ID NO: 61581 - protein, 481 aa, Bacillus clausii KSM-K16
MKLDLRRQQMLLAGEWVDRTETMEVRNPENDQLVAIVPKASKTDMEQAIARAKEGAKASAALPVYKRMAILNRAADFVDAHKERFARTIATEGSKTIREARKETGRCVETLRLCAEEARRVTGETIPFDQSPGGTGRFGYYERHPLGIIGAITPFNDPLNLVAHKIGPAIAAGNAIVLKPATATPLSALLLAEAFMEADLPKGILSVMTGLGSEVGDVLITHPDVRMVSFTGGMEAGLEIAKKAGLKKKSMELGSNSPVIVLEDAQIEDAVKANVSGAFWAAGQNCIGVQRLYVHEEVYDRFKELFVKQSCAYLMGEKLSEKTDMGPLISEKEAKRVAFMVDDALRMGAALLCGGKRRGAFYEPTVLENVPDECMLAKEEIFGPVVLLYKIKSLAEGIERANQSDYGLHAGLFTESMNAVFQAIQELEAGGVMVNDSSDFRIDAMPFGGTKQSGLGREGVKFSILEMTEQKVVCFKLRDNG

SEQ ID NO: 61582 - protein, 530 aa, Aspergillus oryzae
MSDARTTLMETWFTPALVAAIVAARLLFSLYSAWRHAQRARSLNCQEAPLYPSRDPFGVATLLETLRADRDKFLPKLSQKRVDLISSQQNRYVSTFRVRQAGRENFFTVDPKNIQAMLATQFNDFFLGDMRRNAGAPVIRSGIFVSDGADWSHSRSLIRPQFTRTQINNLELEERHVQNALRAMPTQSNGWTSEVDIQTILFRLTLDSATEFLFGKSCNSQLTALEKDAGEMSDSFLNSFDRCAWYLAARLRFERLYWIVNNKEFRECTRVVHELVDGYVHAALQRAQQAEKPADPERGSHYVFVDALTATTQDPNQLRDECLNVLIAGCDTTASLLSWNILLLARHPDIFQRLRKEIIERFGTYSEPRDINFSSLKSCQYLQHFINETLRLHPVVPFNRRCANKDTTLPRGGGKDGNSPVYLQKGQPVLYSSYVLQRRKDIWGEDAEEFNPDRWYGRKAIWEHIPFSGGPRTCIGQQFAITNTSFVLVRLLQRFDSIEDVYPEREIRYGVTLTNCPADRVTVRMHQAEL

SEQ ID NO: 61583 - protein, 316 aa, Campylobacter upsaliensis RM3195
MKETLKIAKEVFEIEAEAIRNLSENLDHNFSKAIELILDIKGRCIISGMGKSGHIGAKIAATLASTGTPSFFIHPGEALHGDLGMITSEDVLIAISNSGETEELLKIIPAVKRRQIPLIAMSGNIKSTLAKQAEIFLNIAIKKEACPLQLAPMSSTTATLVMGDAIAAALMKARKFQPDDFALFHPGGSLGRKLLTKVKDLMVSKKLPIVNPQTEFNELVNVMTSGKLGLCIVLENDKLVGIITDGDLRRALKANAKPRFDFKAKEIMSHNPKIIDQEAMATEAEQLMLKHKIKEIVVGKNGRVVGIIQLYAIGNV

SEQ ID NO: 61584 - protein, 164 aa, Oryza sativa (indica cultivar-group)
MENYQGQHGYGADRVDVYGNPVAGQYGGGATAPGGGHGVMGMGGHHAGAGGQFQPVKEEHKTGGILHRSGSSSSSSSSEDDGMGGRRKKGIKEKIKEKLPGGNKGNNHQQQQMMGNTGGAYGQQGHAGMTGAGTGTGVHGAEYGNTGEKKGFMDKIKEKLPGQH

SEQ ID NO: 61585 - protein, 350 aa, Listeria monocytogenes str. 4b F2365
MTYKITSLAGDGIGPEIMTSGLQVLEAVAKKYNHTFEIESHPFGGAGIDVAQDPIPSSTLKACRDADAILLGAIGGPKWDNAPKRPEDGLLALRKALGLFANIRPIQVPSSITHLSPLKKEIVENTDFVVVRELTGGLYFGEPKYWDNEAAVDSLTYTRAEIERIIEKAFEIAATRNKKVTSVDKANVLASSKLWRKIADEVASRHPDITLEHLYVDAAAMLMIQRPTTFDVIVTENLFGDILSDEASVITGSLGMLPSASHAENGPSLYEPIHGSAPDIANQNIANPMSMISSVSMMLRQSFSLFEEADAIDAATARTMQAGFLTADLGGNTSTTDFTNEVLKQIEGGE

SEQ ID NO: 61586 - protein, 393 aa, Mycobacterium avium 104
MTVSRLRPYATTVFAEMSALAARVEAVNLGQGFPDEDGPAEMLKAAQEAIADGVNQYPPGIGIAPLRHAIAAQRHRRYGIEYDPDTEVLVTVGATEAIASAVIGLVEPGSEVLLIEPFYDSYSPVIAMASAQRVAVPLVPHGRGFALDADALRRAVTPRTRALIVNSPHNPTGTVLGATELAAIAEVAVESDLLVITDEVYEHLVFDDHRHLPLAGFDGMAERTITISSAAKMFNCTGWKIGWACGPAHLIAGVRAAKQYLSYVGGAPFQPAVALALETQDAWVADLRDRLRARRDRLAAGLIDIGFEVHDSAGTYFLCADPRPLGYDDSVAFCAALPEKVGVAAIPLSPFCDPAGAHGPADVWNHLVRFTFCKRDDTLDEAIRRLAALRGTG

SEQ ID NO: 61587 - protein, 480 aa, Pyrococcus furiosus DSM 3638
MKIEDVYIWDINAKWLGITPYQLMENAGAGVAKTIEEKFGKNLRIAVFCGTGNNGGDGFVAARHLSFENDVTVFLIGDESKIRSEEAKLNWNILKNLDFIKIEILKDSSQIKELNLEEFDVIIDALLGAGTRGEPKEPIKSAIEKINEYAGKAKIVSIDLPSGYPSNLRVKADFAVTFQWDKEEYSGFERIVVKIGYPRELYHLAGPAHVKFAFQRRGEHKGQNGKLLIIGGSENYYGAPYLAAKSASYLVDLVYLLTPERVAKKISDPNLIVREVKGENLSLESIDKALELSERVDAVVLGPGLGIKEETKDFVKEFVKRVSKPLVIDADGLKIVSENLDILKGKEFVLTPHAGEFKTLFGVKPEGGLREKAKIVIEKAREIGGVVLLKGKYDIISDGEVWLYNKTGNRGMTTGGTGDVLAGTVGAFLALKNSLLRSAAAGAFLVGFAGDLVAQEKGESFVASDVAEKIPIALKKILEM

SEQ ID NO: 61588 - protein, 457 aa, Candida glabrata CBS 138
MSTDTSQVKVKFFTREKDESLHVDDVPMYAPISLKRYGLSEIVNHLLESETPIPFDFLIDGELLRTSLQEYLTKKGLSSETTLTVEYTRAVLPPSFLANFNNDDWVSALDVSDDFRHIYSGSYDGVVRTWNMSGKVEKQYSGHTGAVKAVKYISNTRIVSAGNDRSLRLWKTKNDDGSVSNNTGDENDEENIEDGKTLAILEGHKAPVVSLDVASNSRILSASYDNTVALWSTIYKEMTAIDHLEEIQNPNNKISTAAKKRRKLTLKDGTIRRRAPLSLLESHTGPVEQVIFDHGDNTVGYSVSQDHTIKTWDLVTARCIDTKTTSYPLLSIAQMPTLNLLACGSSVRHITLHDPRVSSSAKITQKQLVGHKNFVVGLDTCSENEYLLCSASHDGTVKVWDVRSTSPMYTITRQDPTVEKGVNDKVFAVKWAKSIGIISGGQDKKIQINKGDNIFKN

SEQ ID NO: 61589 - protein, 377 aa, Pyrococcus furiosus DSM 3638
MNTEKYLAKGLEDVYIDQTNICYIDGKEGKLYYRGYSVEELAELSTFEEVVYLLWWGKLPSLSELENFKKELAKSRGLPKEVIEIMEALPKNTHPMGALRTIISYLGNIDDSGDIPVTPEEVYRIGISVTAKIPTIVANWYRIKNGLEYVPPKEKLSHAANFLYMLHGEEPPKEWEKAMDVALILYAEHEINASTLAVMTVGSTLSDYYSAILAGIGALKGPIHGGAVEEAIKQFMEIGSPEKVEEWFFKALQQKRKIMGAGHRVYKTYDPRARIFKKYASKLGDKKLFEIAERLERLVEEYLSKKGISINVDYWSGLVFYGMKIPIELYTTIFAMGRIAGWTAHLAEYVSHNRIIRPRLQYVGEIGKKYLPIELRR

SEQ ID NO: 61590 - protein, 525 aa, Streptomyces avermitilis MA-4680
MPSAPSAAAPDTVLVVDFGAQYAQLIARRVREARVYSEIVPSTMPVAEMLAKNPAAIILSGGPSSVYAEGAPRLDREIFEAGVPVFGMCYGFQLMATTLGGTVDNTGAREYGRTPLHVSKSGSTLFEGTPDEQPVWMSHGDACSAAPEGFTVTASTDVVPVAAFENDEKRLYGVQYHPEVMHSTHGQQVLEHFLYRGAGLTPSWTTGNVIDEQVELIREQVGTRRAICGLSGGVDSAVAAALVQKAIGSQLTCVYVDHGLMRQGETEQVEKDFVAATGVQLKVVDAEERFLTALKGVSDPEEKRKIIGREFIRVFEQAQAEIIADEGPEVAFLVQGTLYPDVVESGGGTGTANIKSHHNVGGLPEDLEFELIEPLRKLFKDEVRMVGQELGLPDEIVQRQPFPGPGLGIRIVGEVTKERLDLLREADAIAREELTAAGLDREIWQCPVVLLADVRSVGVQGDGRTYGHPIVLRPVSSEDAMTADWSRLPYDTLAKISTRITNEVADVNRVVLDVTSKPPGTIEWE

SEQ ID NO: 61591 - protein, 200 aa, Streptomyces sp.
AWNTGAVENNRGYKVRYKGGYFPAPPVDHFADLRAEISLELDKNGLQVERQHHEVGTAGQAEINYKFNTLLAAADDLMLFKYIVKNVAWRNGKTATFMPKPIFGDNGSGMHVHQSLWSGGEPLFYDEQGYAGLSDTARYYIGGILKHAPSLLAFTNPTVNSYHRLVPGFEAPVNLVYSQRNRSAAMRIPITGSNPKAKRV

SEQ ID NO: 61592 - protein, 179 aa, Photorhabdus luminescens subsp. laumondii TTO1
MSDTQHSNHVFVLMGVSGSGKSAVASAVAYKLDSAFLDGDFLHPRSNINKMAEGYALNDEDREPWLKSLNHAIFAMQRTNPISLIVCSALKKHYRDILRDNNKNLSFLYMKGDFDLIKSRLKARKDHFFKSQMLVSQFEVLEEPGSDEQDVYLVDIRSSLDEVINHSIRIINSVISGEK

SEQ ID NO: 61593 - protein, 290 aa, Streptococcus pyogenes MGAS10394
MDKLARIDEAIRRYYKTTSNGVSEELIDAILYSVDSGGKRIRPLILLEMIEGFGVSLQNAHFDLAAALEMIHTGSLIHDDLPAMDNDDYRRGRLTNHKQFGEATAILAGDSLFLDPFGLIAQAELNSEVKVALIQELSLASGTFGMVGGQMLDMKGENQALSLPQLSLIHLNKTGKLLTFPFKAAALVTEQAITVRQQLEQAGMLIGHAFQIRDDILDVTASFEDLGKTPKKDLFAKKATYPSLLGLEASYQLLTESLDQALTIFQTLESDVGFKPQIITKLIEGLRLNA

SEQ ID NO: 61594 - protein, 125 aa, Bacillus subtilis subsp. subtilis str. 168
MTKAVHTKHAPAAIGPYSQGIIVNNMFYSSGQIPLTPSGEMVNGDIKEQTHQVFSNLKAVLEEAGASFETVVKATVFIADMEQFAEVNEVYGQYFDTHKPARSCVEVARLPKDALVEIEVIALVK

SEQ ID NO: 61595 - protein, 486 aa, Pseudomonas sp. S-47
MKEIKHFISGAFVGSASGKLFDNVSPANGQVIGRVHEAGRAEVDAAVRAARAALKGPWGKMTVAERAEILHRVADGITARFGEFLEARMPGHRQAEVAGQPHRHSARRANFKVFADLLKNVANEAFEMATPDGAGALNYGVRRPKGVIGVISPWNLPLLLMTWKVGPALACGNCVVVKPSEETPLTATLLGEVMQAAGVPAGVYNVVHGFGGDSAGAFLTEHPDVDAYTFTGETGTGETIMRAAAKGVRQVSLELGGKNAGIVFADCDMDKAIEGTLRSAFANCGQVCLGTERVYVERPIFDAFVARLKAGAEALKIGEPNDPEANFGPLISHKPREKVPSYYQQAVDDGATVVTGGGVPEMPAHLAGGAWVQPTIWTGLADDSAVVTEEIFGPCCHIRPFDSEEEAIELANSLPYGLASAIWTENASRAHRVAGQIEAGIVWVNSWFLRDLRTAFGGSKQSGIGREGGVHSLEFYTELKNICVKL

SEQ ID NO: 61596 - protein, 493 aa, Triticum aestivum
  misc_feature (179)..(179): Xaa can be any naturally occurring amino acid
  misc_feature (281)..(281): Xaa can be any naturally occurring amino acid
  misc_feature (289)..(289): Xaa can be any naturally occurring amino acid
MTKDVEMAARNGGNGAVAGEAYYPSPPAQGGDADVDDDGKQRRTGTVWTASAHIITAVIGSGVLSLAWATAQLGWVVGPITLMLFAAITYYTSGLLADCYRTGDPLTGKRNYTYMDAVASYLSRWQVWACGVFQYVNLVGTAIGYTITASISAAAINKANCFHKNGRAADCGVYDSMYXVVFGVVQIFFSQVPNFHDLWWLSILAAVMSFTYASIAVGLSLAQTISGPTGKATLTGTEVGVDVDSAQKIWLAFQALGDIAFAYSYSMILIEIQDTVRSPPXPENKTMKXATLVGVSTTTAFYMLCGCLGYAAFGNGAKGNILTGFGFYEPYWLIDFANVCIVVHLVGAYQVFCQPIFAAVETFAAATWPNAGFITREHRVAAGNGKRLGFNLNLFRLTWRTAFVMVSTLLAILMPFFNDILGFLGAIGFWPLTVYFPVEMYIRQRGIPRYTTRWVALQTLSFLCFLVSLAAAVASIEGVTESLKNYVPFKTKS

SEQ ID NO: 61597 - protein, 202 aa, Brassica napus
MILANLPNDLESEILARVPAKSLQELKTTCKRWYTLFKDSKFVEKNKKLSSEAARETFLLSNHEVYSIAGDLHSSGDVAQPLEFTGKLSKDLDLYTISHCDGLMLCQAKNNSSVVVWNPCTGETKMIKPRTRYQIRDRFALGYDDSRRGYKILRFGYYQNEEKVWFVECEMYDLSSGSWRVVDSFTLDYRMYCSGVSLRGDT

SEQ ID NO: 61598 - protein, 412 aa, Candidatus Kuenenia stuttgartiensis
MTKEMAEVARIEGLDPEYIRGRIAEGKIVIPVNHKRNSRKLCGIGAGLKTKVNANIGTSADYADIDKELEKLRAAEEAGADAVMDLSTGGELRTIRKAIIESASVSIGSVPIYEAAVNSIKRKQAIYDMTARDMIEAIQLHCEDGVDFITVHCGATMGVLKHLREDKRICGVVSRGGAFLVEWMIHNKKENPFYEEFDEILAIAKEYDVTISLGDALRPGALADAFDRAQVYELNVLAELTQRTLEADVQVIVEGPGHVPLNQITAHVQLQKELCKGAPFYVLGPIVTDIAPGYDHITSAIGGAIAASAGADFLCYVTPTEHLSLPGPEDVRTGVMAARIAAHAADLVKGVKSAWEWDKKMSHYRKNRDWEGQFNTCIDPVIAKKIREKGRPKNEDVCSMCAEYCVFKLGDA

SEQ ID NO: 61599 - protein, 519 aa, Glycine max
MPAVGGISNGGGKEYPGSLTPFVTVTCIVAAMGGLIFGYDIGISGGVTSMDPFLLKFFPSVFRKKNSDKTVNQYCQYDSQTLTMFTSSLYLAALLSSLVASTVTRRFGRKLSMLFGGLLFLVGALINGFAQHVWMLIVGRILLGFGIGFANQSVPLYLSEMASYKYRGALNIGFQLPITLVFLVANVLNYFFGKIHGGWGWKIEVWEGAMVPALIITVGSLVLPDTPNSMIERGDREKAKAQLQRIRGIDNVDEEFNDLVAASESSSQVEHPWRNLLQRKYRPHLTMAVLIPFFQQLTGINVIMFYAPVLFSSIGFKDDAALMSAVITGVVNVVATCVSIYGVDKWGRRALFLEGGVQMLICQAVVAAAIGAKFGTDGNPGDLPKWYAIVVVLFICIYVSAFAWSWGPLGWLVPSEIFPLEIRSAAQSINVSVNMLFTFLIAQVFLTMLCHMKFGLFLFFAFFVLIMTFFVYFFLPETKGIPIEEMGQVWQAHPFWSRFVEHDDYGNGVEMGKGAIKEV

SEQ ID NO: 61600 - protein, 277 aa, Oryza sativa (japonica cultivar-group)
MAARPETAATQLKGNKDLAEPCESLALTTQIDATRAQYSPYISPVCTTNCQLQKARVQWKKQMVAVQTVHAALLPSTTTTRRRPSPGRLPRRSPIRARAGSSETSSPRGRENWRVQEALARVAEIQVLKVRIASFLDDCSENLLWLAENAALDATAQDSLRVLDLDGAADDEIMERLYYEGVSVESIGEEAKHEHVLVARESGRYRTRRNVYLGVMGLIWVGLMQTTVFAAPNVELDKFAALCLIFLAHIVQVCFKEETDKKQVCVNHETQISGRQR

SEQ ID NO: 61601 - protein, 283 aa, Mycobacterium avium 104
MNLDLSLAVDALPRPGETVLASSLRQAPGGKGGNQAVAAARAGARVQFVGAVGDDAAAGQLRAHLQANGVGLDGAVEIPGPSGTAIVVVDANAENTIVVAPGANGRFTLNDERARAVLAGCDVMLTQLEIPVATAVAAARHARSGGAVVVVNASPAGRDPDSLSELAAAADVVITNEEEASEWPWRPRHLVVTLGSHGARYVGADGEYSVPSPDVDAVDTTGAGDVFAGVLAANWPLEPGSPDQRRLALRRACAAGALATLVPGAGDCAPRAEEIERALRGKS

SEQ ID NO: 61602 - protein, 93 aa, Zea mays
KKVLAETFFGPPDVGGFSPSVQNTLFLMAKEVLSRFPDILSVPLRMPNLPFFPVNLGGKEAPLGKFADDGFPPAGEPPGAVEATLISRPLSKL

SEQ ID NO: 61603 - protein, 152 aa, Synechococcus sp. CC9311
MAAERSFIAIKPDGVQRGLVGEILGRFERKGFKLVGLKQLTPSRELAEQHYGVHKERPFFGGLVDFITSGPVVAMVWEGDGVITSARKMIGATKPLEAEPGTIRGDLAINIGRNVIHGSDAPETAEFEIGLWFNPSELSDWTPSDQTWRVEG

SEQ ID NO: 61604 - protein, 504 aa, Mycobacterium avium 104
MSAPTDQATERVQALVGDGQLTRAQAGGKAWSIQHMLSLNIPVPPGFVLTTDVCREYHDRGRVLPAGVTRDIARAMENLESRSGRRFGHVDHPLLVSVRSGAAISMPGMMDTILNLGMNSSIEEALAAETGDARYAADTRHRFTEQFTRVVGVEPPENHWEQLDLAIRAVLESWNSKRALAYRRSHGIPDDGGTAVTVQAMVFGNLDDRSGTGVLFSRDPLSGAAQPYGEWLPRGQGEDVVSGRKDALHLDHLAATMPSVHRDLLAAAATLERHGRDMQDIEFTVQSGKLWLLQSRAAKRSPQAALRCAVQLQREGVISTKEALDRLTAEHVRALQRPTLDPAAVAASPPVASGKPASPGIATGLVVIDADEAEDLADKGRAVILARPTTDPDDVAAMSASVAVVTELGGSTSHAAVVCREMAVPCVVGCGMDSVTALAGRVVTVDADTGTVHLGELPVRPLLEADDEDLRTIERWLRDDLENYDPSYDVVALIERRQQRGATR

SEQ ID NO: 61605 - protein, 117 aa, Zea mays
MAAAATAIATPSVAPEAGDRKAVAPPVDAVDLELELELEEKHVLAVDDSSVDRAVIAKILRSSKYRVTTVDSATRALELLALGLVPDVNMIITDYWMPGMTGYELLKHVSRLCSRIR

SEQ ID NO: 61606 - protein, 430 aa, Pyrococcus furiosus DSM 3638
MENPYEIVGVVAREILDSRGNPTVEVDVYTHVGMGRAAVPSGASTGTHEALELRDGGKRYHGKGVRRAVENVNKIIAPELIGMDVRWQREIDALLLELDGTENKSNVGANAILAVSLAVAKAAANSLELPLYQYLGGVNAYVLPVPLSNVINGGVHAGNDLDFQEFMIMPIGADSFREAIRWVSETYHVLKKVIMEKYGKNAVNVGDEGGFAPPMKEVTEPLDVLIKAIEEAGYKPGDEIALALDVASSELFNEETGKYVVGGKEYDRGELLELYKDLTSTYPIVSIEDPFHEEDWEGFVMITKELGHKVQIVGDDLFVTNPKRLRKGIELGAANALLLKVNQIGTLSEAMDAAFTAFRAGYGVIVSHRSGETEDATIADLAVALNAGQIKTGAPARSDRNAKYNQLIRIEEELEGVAVYAGKRFRKVFF

SEQ ID NO: 61607 - protein, 285 aa, Salinibacter ruber DSM 13855
MPLDATTQLVTLLGHPVEHSLSPRIHNTAFRAQDVNAAYVATPVRPEALGDAVAGLRALQFLGANVTTPHKEAVLPVLDEVTERARAVGAVNTIVRDGGRLHGDNTDIAGFLRPLEERGGDALEGAPMLVFGAGGAARAVVYGLLSHYRPERLTIVARRPDQAEGLAADLAAHDPDGALRVSSFEEAALSVRTSRLVVNATPLGMAPDRRGQTPWPNPVDFTADHVVYDLVYTPEETRLLREAAAEGATPIGGLDMLVEQAAAAYRQWTDRGMPQAAVYDALRAD

SEQ ID NO: 61608 - protein, 415 aa, Oryza sativa (japonica cultivar-group)
MAAAAAAASSAKRALLPWARDAHHALARALQGCGGGGGLGLRGALPTAGGRWSLLQCRWRSSLPQLDSADRSDEESGGEIDWDNLGFGLTPTDYMYVMRCSLEDGVFSRGELSRYGNIELSPSSGVINYGQGLFEGLKAYRAANQQGSYMLFRPEENARRMQHGAERMCMPSPSVEQFVHAVKQTVLANRRWVPPQGKGALYIRPLLIGSGPILGLAPAPEYTFLIYAAPVGTYFKEGLAPINLVVEDSIHRAMPGGTGGVKTITNYAPVLKAQMDAKSRGFTDVLYLDAVHKTYLEEASSCNLFIVKDGVVATPATVGTILPGITRKSVIELARDRGYQVEERLVSIDDLVGADEVFCTGTAVVVAPVSSVTYHGQRYEFRTGHDTLSQTLHTTLTSIQMGLAEDKKGWTVAID

SEQ ID NO: 61609 - protein, 149 aa, Arabidopsis thaliana
  misc_feature (39)..(39): Xaa can be any naturally occurring amino acid
MDYQQKPRNSFDPPPSPPHPPPAIRSPDTPSQNQNNQIXDIIACVTALDAVLLPSLPATELQAIDRSPHPFHQIHVERDASHLMDAAKKLQLYFMALKRDARAPSSAQSLQKDIAVMEEELQTKHELIKKHMRLFQQSQKLVKEHIEKH

SEQ ID NO: 61610 - protein, 127 aa, Candidatus Kuenenia stuttgartiensis
MKKMVISTKAAPAAIGPYSQAIKAGNLVFVSGQIPIIPETGETLHGDAAVQTRQVLNNLRNILDAAGASLDKVVKTTIFMKDLNDYAAVNDVYKEFFQNEPPARAAVQVSRLPKDVAIEIEAIATAG

SEQ ID NO: 61611 - protein, 477 aa, Mycobacterium tuberculosis
TEKTPDDVFKLAKDEKVEYVDVRFCDLPGIMQHFTIPASAFDKSVFDDGLAFDGSSIRGFQSIHESDMLLLPDPETARIDPFRAAKTLNINFFVHDPFTLEPYSRDPRNIARKAENYLISTGIADTAYFGAEAEFYIFDSVSFDSRANGSFYEVDAISGWWNTGAATEADGSPNRGYKVRHKGGYFPVAPNDQYVDLRDKMLTNLINSGFILEKGHHEVGSGGQAEINYQFNSLLHAADDMQLYKYIIKNTAWQNGKTVTFMPKPLFGDNGSGMHCHQSLWKDGAPLMYDETGYAGLSDTARHYIGGLLHHAPSLLAFTNPTVNSYKRLVPGYEAPINLVYSQRNRSACVRIPITGSNPKAKRLEFRSPDSSGNPYLAFSAMLMAGLDGIKNKIEPQAPVDKDLYELPPEEAASIPQTPTQLSDVIDRLEADHEYLTEGGVFTNDLIETWISFKRENEIEPVNIRPHPYEFALYYDV

SEQ ID NO: 61612 - protein, 365 aa, Streptomyces avermitilis MA-4680
MQRPHVQEAEATAAPQQRTGASATFAELLKRVKAEGLLDLDPRYYIGRLALNTTLLLVGFAAFFALGDSWWQLVVALWMGLCGGQSAFMWHDAGHKAMFRSKKAASAVGYFHANLVNGVSFGWWVNHHNRHHSNPNHLDMDPDIGRRTAIFDIKQYPTRRGTQKFIVRYQSVLFFALLVTESFKMLKTAVLSIAQGKTKRPVLESFLLLARAAVYLTLVFTVLSPVLAVAFVLVQQAALGVYFGMIFAPNHKGMEVRDGDEETLDWLERQVLTSRNIRPSLFIDFLYGGLNYQVEHHLFPAMPQKNLARARELTRAYCAERGVPYHEVGFWASYREVASFLHEVSAPVRRGDVEEQIRRQAGQAA

SEQ ID NO: 61613 - protein, 345 aa, Trichodesmium erythraeum IMS101
MTQSFKTPTQTPLLGLSLAKLTEWVQQQGQPAYRGKQLYQWIYQKGAKSLADITVFSKQWREEISNFPIGRSVIHHRSVAPDATVKYLLKLSDGNIIETVGIPTYKRLTVCVSSQVGCPMACDFCATGKGGFSRNLEAHEIIDQVLTVQEDFERRVSHIVFMGMGEPLLNTKNVLAAVRSLNQDLGIGQRLITISTSGIRDRIRQLAQHKLQVTLAVSLHASNQRLREHLIPSAKFYPLADLISECREYVKITKRRISFEYILLASFNDLPDHARELAKNMRGFQCHVNLIPYNPISEVDYQRPTQEMIKTFANALAEQNIAVSIRYSRGLEANAACGQLRASRV

SEQ ID NO: 61614 - protein, 604 aa, Oryza sativa (japonica cultivar-group)
MSKKCDGALRPFVAAGGGGGGGGGGGAVPSGSSAAVPDLRRCKSFSCGRGGDVLAGGCGDEPQRRSCDVRGRSTLWALFHQDDRERVRDGTAFGAFPASSSAAAAALASEVQPQPPPPPPPCVPEVFLEEEIAMAEESDEITPVVEPILVVDTSGEMETEANGGREAKAMKDHIDLECSQAKKPQPKDLKEIAGSFWLAASVFSKKWQKWRRKQKLKKQDAAGSKAAAAAMPPPEKPSKPSFLRRSRLRGEACSEFAGGRRSCDTDPRFSLDAGRMSVDDVGFSWDEPRASWDGYLFGAGTGIGLGRAPPPLSRLPPILSAMEDSPAGIVERSDGQIPVEDDSQPEPDPDADTPGGSVQTRDYYDTSSSSRRRRSLERTSSVRRPSFEVTDAKPVLPAAAAITSVKDSPLIGSSEFYHFQHAEDLLEHHRFSTSSLIEDFPMSLDAAFPGPDKKPRRWRKAWSLWGLIHRRAAGRRGGASDVADRAFSEPWPELRVRGCNARMQRCNSNASARSSFSSNSGGLGSSRRSYVDGNGNVVKRRREECALERNRSARYSPGHADNGMLRFYLTPMRSASGRRAPGLPAKGGRQLRSQSFARSMLRLY

SEQ ID NO: 61615 - protein, 498 aa, Bacillus clausii KSM-K16
MSQVPTGENSLKTRLVSFLNGGSKKLLINGEWVDAVSGQTFETMNPATGDTLAIVAEAGQEDIDSAVKAARKAFDEGPWSKMSAAERSRLIYKLADLIEEHKEELAQLETLDNGKPIRETANADVPLAIEHFRYFAGWATKIVGQTIPVQGNYFNYTRHEAIGVVGQIIPWNFPLLMAAWKLGAALATGCTVVLKPAEQTPLSALYLGELINEAGFPKGVVNIVPGFGHSAGTAIVNHPAVDKVAFTGSTNVGKLIMKQASESLKRVTLELGGKSPNIILPDADLSKAVPGSLMGIMFNQGQVCCAGSRLYVQKKQYDHVVADLVSLTKKINQGDGLLEHTTMGPLISTQQQKRVKNYIDRGVEEGAELLAGGTIPYDQGYFVSPTIFADVDHSMTIAKEEIFGPVVAAMPFESVDDLIGKANDSDYGLAAGVWTQDIKKAHYIAHRIKAGTIWVNCYNVFDAASPFGGYKQSGIGREMGSYALDNYTEVKSVWVNMD

SEQ ID NO: 61616 - protein, 308 aa, Glycine max
  misc_feature (215)..(215): Xaa can be any naturally occurring amino acid
  misc_feature (240)..(240): Xaa can be any naturally occurring amino acid
MVATLSLPIIDLSSPHRLSTANSIRQACVEYGFFYLVNHGVDTDFVSKVFDQSCKFFSLPVQRKMDLARKEYRGYTPLYAETLDPTSLSKGDPKETYYIGPIEDTSIAHLNQWPSEELLPNWRPTMKSLYWKLLAAGKSLLSLIALPLNLEEDYFEKIGALNKPASFLRLLHYPGELGSDEQICGASPHSDYGMITLLMTEGVPGLQICKHKVNXLQVLEDVPHVEGALIVNIGEMMERXTNCLYRSTLHRVMPTGKERYSVAFFFDPASDCVVECFESCCSESSPPRFPPIRSGDYLNERFRLTYGS

SEQ ID NO: 61617 - protein, 540 aa, Cicer arietinum
LPTDILSKISPLPALKEILRTDGEQVLKFPPPHVIQVSKSAWMTDEEFGREMVAGVNPCVIRLLQEFPPKSTLDTIVYGDQSSTITKEHLEVNLGGLTVEEALNGNRLFILDYHDAFMPYLERINLTAKAYATRTILFLKDDGTLKPVAIELSLPHSNGVQYGAESKVFLPSDVGEESTIWLLAKAHVIVNDSCYHQLISHWLNTHATIEPFIIATNRHLSVLHPINKLLYPHYRDTININGLARQALINADGIIEQTFLPGPNSVEISSAVYKNWVFTDQALPADLIKRGLAIEDSSSPHGLRLVIQDYPYAVDGLEIWDAIKTWVQEYASLYYPTDEAVQKDTELQTWWKEAVEKGHGDLKDKPWWPKMQTLQDLVQSCSIIIWTASALHAAVNFGQYPYGGYILNRPTLSRRFIPEKGTPEYDEMVKSPQKAYLRTITPKYQTLVDLSVIEILSRHASDEVYLGERDSKFWTSDSRAVQAFQKFGSKLTEIEGKIIERNKDSSLKNRYGPIQLPYNLLLRSSEEGLTFRGIPNSISI

SEQ ID NO: 61618 - protein, 249 aa, Nicotiana benthamiana
MSNLDVSLDDLIKRNKSSSSRNPRPRTSGSGSGTGSGGPSPRRRFPSRAANRSAPYSSGPVHAPDSTWDHNMFAEHAPAYPAARGAGGISGIETGIKLLISNLDYGVSNEDIKELFSEAGDIKRYSIHYDKSGRSKGTAEVIFSRRRDAEAAIKKYNNVQLDGKPMKIEFAGPNIGAPTLPPLRNRLYRNPNPAPRSQQRGGGFRRPPRGGRGSMRKEGGRGRGRVENITAEDLDADLEKYHAEAMQTN

SEQ ID NO: 61619 - protein, 485 aa, Streptomyces avermitilis MA-4680
MPGHMGAERDRTGDAMGATDARDNGAGGSTGNAGETDAARVARRDEAVRAAVGQGLLGADAPIVALLDVAGIRGSAAALRAAFDAVVAPGTPVLHAFAVKATPLVPVLRLLGEAGIGAEVASPGELALAQAAGVAPERTVLDSPAKTPAELREALALGIAVNADNPQELDRIDALVRSAPSGSPVGIRVNPQVGGGSIDALSTATATSKFGVALRDEGAREWILRAYADRPWLTRLHAHSGSQGMPLSLMARGIAETYALAEEINRHVGRRQIDTIDIGGGLPVNFGSDATTPTYARYARLLAESVPGLFDGRYGLVTEFGRSLLAKHGTVVARVEYAKSAGGRAVAVTHAGVQVATRTVYAPASWPLRITAYDAKGHPKAGPEVVQDVAGPACFAGDLLAVGRALPLLEQGDHVAALDTGAYYFAHHYAYNSLARPGIYGFATGGVGGGAGGSGVRFAVVREPQAVEEIVMESGGGHASALSAL

SEQ ID NO: 61620 - protein, 474 aa, Rhodopirellula baltica SH 1
MKTARHELVILGGGPAGYVAAIRAAQLGIDVACIDDNPRFGGTCVRVGCIPSKALLESSHLYEEAQHKFADHGLNVSNVEVDLDVMMKRKEKIVESLTGGIDMLFDRRGVTAYHGRGRLRDVDSIEITPSEGAAEDQPTLVTADQIMLCPGSVPAQLPFVEEDGDRIGNSTTALSFPEVPEELVVIGGGYIGLELGSVWNRLGSNVIVLEAFDRIMPGLDKEMATLAHRSFKKQGMDIRTGTFVASAKVDPKPGDKKPCVIKIKNGETIRCDRVLLATGRAPATKSMGLEEAGVKLDERGFIQVNHQFETSVTGIYAIGDCIGGAMLAHKAMEEGIVCVEQMAGIASEMNYEVIPAIVFTHPEIAMVGKTEEELKEAGIEYNKGVCPLGANGRARTLGDIDGRVKILADAATDRVLGVHIIGPRAGDMIAEAAAAMEFGASSEDIARTCHAHPTLSEAVHEAALAIDDRAIHTA

SEQ ID NO: 61621 - protein, 252 aa, Nicotiana benthamiana
MAEAALDMSLDDLIKKNKTDTGGKRRGRGRGGASGPGPARRFPNRSANRAAPYSTAKAPEAAWNHDMFAAADQAFPFGQAGGDQAASSISTGTKLYISNLDYGVSNEDIKELFSEAGDLKRYAIHYDRSGRSKGTAEVVFSRRQDALAAVKRYNNVQLDGKPMKIEIVGTNIATPAAPAFNGAFGFGDTNGGPRTDQARSGGFGRSRGGRGRGRGFRGGSRGRGRGDRGEKVSAEDLDADLMKYHTEAMQTN

SEQ ID NO: 61622 - protein, 429 aa, Clarkia delicata
AAHLKQKIDRMNNGDHINSTENRSVLHVALRAPRNSVICSDGKNVVPDVWNVLDKIKDFSERVRNGSWVGATGKELKDVIAVGIGGSFLGPLFVHTALQTDPEASKNARGRELRFLANVDPIDAARNISGLNPETTLVVVVSKTFTTAETMLNARTLREWISSALGVSAVAKHMVAVSTNLPLVEKFGIDPNNAFAFWDWVGGRYSVCSAVGVLPLSLQYSFAVVEKFLQGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEQLKKENVSEHLIPHKTFTGNRPSLSILLPTLDAYRIGQLLGIYEHRVAVQG

SEQ ID NO: 61623 - protein, 1544 aa, Arabidopsis thaliana
MEENCEDCMKWEEELYWTHFQTLHFTQLLLPGFHNRLVIPRKFSTHCKRKLPQIVTLKSPSGVTYNVGVEEDDEKTMAFRFGWDKFVKDHSLEENDLLVFKFHGVSEFEVLVFDGQTLCEKPTSYFVRKCGHAEKTKGIIDFNATSSRSPKRHFNPDDVETTPNQQLVISPPVDNELEDLIDIDLDFDIDKILNPLLVASHTGYEQEEHINSDIDTASAQLPVISPTSTVRVSEGKYPLSGFKKMRRELSNDNLDQKADVEMISAGSNKKALSLAKRAISPDGFLVFMKRSHVVSKCFLTIPYKWCVKNMLITRQEVVMQVDQTKWEMKFNIFGARGSGGISTGWKKFVQDNNLREGDVCVFEPANSETKPLHLNVYIFRGEETERTNNVDPVYTISMNNTSSHYKTQARCPLQEHFLPRKPSKENLDRFIPNRSAMNFDYAHFALTEGRKGKDQTAAVSSPSKEAYRKQLAETMNLNHTRILAFRNKPQAPVELLPSNHSASLHQQPKSVKPRRYIPQTSERTLDAPDIVDDFYLNLLDWGSANVLAIALDHTVYLWDASTGSTSELVTIDEEKGPVTSINWAPDGRHVAVGLNNSEVQLWDSASNRQLRTLKGGHQSRVGSLAWNNHILTTGGMDGLIINNDVRIRSPIVETYRGHTQEVCGLKWSGSGQQLASGGNDNVVHIWDRSVASSNSTTQWLHRLEEHTSAVKALAWCPFQANLLATGGGGGDRTIKFWNTHTGACLNSVDTGSQVCSLLWSKNERELLSSHGFTQNQLTLWKYPSMVKMAELTGHTSRVLYMAQSPDGCTVASAAGDETLRFWNVFGVPETAKKAAPKAVSEPFSHVIQEAGALSTVNCLNRCPLQEHFLPRKNSKENLDRFIPNRSAMNFDYAHFALTEERKGKDQSATVSSPSKEAYRKQLAETMNLNHTRILAFRNKPQAPVELLPSNHSASLHQQPKSVKPRRYIPQTSERTLDAPDIVDDFYLNLLDWGSANVLAIALDHTVYLWDASTGSTSELVTIDEEKGPVTSINWAPDGRHVAVGLNNSEVQLWDSASNRQLRTLKGGHQSRVGSLAWNNHILTTGGMDGLIINNDVRIRSPIVETYRGHTQEVCGLKWSGSGQQLASGGNDNVVHIWDRSVASSNSTTQWLHRLEEHTSAVKALAWCPFQANLLATGGGGGDRTIKFWNTHTGACLNSVDTGSQVCSLLWSKNERELLSSHGFTQNQLTLWKYPSMVKMAELTGHTSRVLYMAQSPDGCTVASAAGDETLSPNDKALSFWLLNPRFVLSANLLCTFLSDLSKFEETDAKGTETEKEKEAEMGVEIQSPQEQSSYTVEQLVALNPFNPEILPDLENYVTSQTYSLEVNLCLLRLYQFEPERMNTHIVARILVKALMAMPTPDFSLCLFLIPERVQMEEQFKSLIVLSHYLETGRFQQFWDEAAKNRHILEAVPGFEQAIQAYASHLLSLSYQKVPRSVLAEAVNMDGASLDKFIEQQVTNSGWIVEKEGGSIVLPQNEFNHPELKKNTGENVPLEHIARIFPILG

SEQ ID NO: 61624 - protein, 211 aa, Brassica napus
RPRVRDNGTVPLEVQIRTQEMHLQAEFGFAAHWRYKEGDCEYSSFVLQMVEWARWVVTWHCETMSKDRSSICSSDSIKPPCKFPSHSEDCPASYKPNSSQDGPVYVIVIENDKMSVQEFPASSTVSDLLSRAGPGSSRWSMYGIPAKEELRPRLNQRPVSDLKWKLKMGDVVELTPPIPDESLPEYREEIQRMYDRGLAFSRPGTMVGWGS

SEQ ID NO: 61625 - protein, 640 aa, Triticum aestivum
  misc_feature (110)..(110): Xaa can be any naturally occurring amino acid
  misc_feature (327)..(327): Xaa can be any naturally occurring amino acid
MSLIDHPNVIRAYCSFVVEHSLWVIMPFMTEGSCLHLMKIAYPESFEEPVIASILKETLKALEYLHRQGQIHRDIKAGNILIDSAGVVKLGDFGVSACMFDRGDRQRSRXNTFVGTPCWMAPEVLQPGTGYNFKADIWSFGITALELAHGHAPFSKYPPMKVLLMTLQNAPPGLDYDRDRRFSKAFKEMVAMCLVKDQTKRPTAEKLLKHSFFKTAKPPESTMKGMLTDLPPLWERVKALQLKDAAQLALKKMPSSEQEALSLSEYQRGVSAWHFDIEDLKAQASLIYEDEPSETKEDDVAARIIESEKSLYSRTPSGQSSSANENXCSEETSTTNPDCRRMPNGHENSRSENDSLPSTSKEPESKYWRTNVGQKQQTTGGPVEGGVNSSTTERSHNFERDATADKHGSDTRRAANLSGPLSLPTRASANSYSAPIRSSGGYVDSLGDKSKRSVVHIKGRFSVTSENVDLAKVQEIPLSSISRKSPQPRLRRKSASVGDWIVNAKPTSNSHHLKELCNSSVSSSVLIPHLENLVQQTTLQQDLIVNLLSSMQQNEKADGAQSGTSSQVRNMQSETVVETSNTEKERSLLVKISELQSRMITLTDELISAKQKHVQLQQELNALYCREEIEDIRDEDNEET

SEQ ID NO: 61626 - protein, 280 aa, Candidatus Phytoplasma solani
QNHNSSEIKRIYDLMQVSYDYFIKTTDKAHQASVQAIFDKLHQQGDIYLGRYQGLYSVAEEAYISEKDLVDGKTFNGETPILITEKTYFFKLSKYQSKLLDYLESNPDLIKPKTQRKELLNLLKEPLDDLSISRTSFKWGIPVSFEQKHVIYVWIDALSNYLTGLGYHPNETSQQFLHYWPCDLHVIGKDILRFHLIYWPILLMALKIKLPKQFLIHPWILFDKNKMSKSKGNVLYVDDLLKIFSVDTIRYFVLHEIPYANDGNITYELLAERHNSDLVL

SEQ ID NO: 61627 - protein, 172 aa, Ralstonia eutropha JMP134
MADKAKRKDSDKEKKAVKSASDRIEVRQSGVHGKGVYAIAPIAEGERVIEYKGEHISWKKALDRHPHDPNDPNHTFYFSLDDGSVIDAKFGGNRARWINHACTPNCEAREKKGRVFIHALRDIATGEELFYDYGLVIDARYTKKLKKEFECRCGSPDCRGTMLAPKGKTSSK

SEQ ID NO: 61628 - protein, 455 aa, Frankia sp. CcI3
MSEQVSTLTVTDNRTGKTYEIPVTDGAVRASAFRSIKTSDDDFGLMTYDPAFTNTASCRSAITYIDGDAGILRYRGYPIQELAEKSSFLEVAYLLLAGELPSAEELSTWEDEITHHTLVHESIKKFIDGFHHDAHPMGMLVSTVGALSTFYPDAKTIDDPGLRRLQIVRLIAKITTLAAFSYRHSVGFPYVYPDNDLSYAGNFLNMMWKATELKYEPDPNLEHALDVLFILHADHEQNCSANAMRAVGSSQADPFSAAAAAISALYGPLHGGANEQVLRMLSEIGSVENIPAFIAQVKDGKKKLMGFGHRVYKNYDPRARVIRQVADEVFKVTGTNPFLDLAMELERIALEDEYFVARKLYPNVDFYTGIIYQAMGFPVEMFPVLFAIGRMPGWLAQWEEGLLDPEQKIARPRQLYIGYDQRSYVPIDDRSGVGDSGIDPIAAQAAQAAPERPLR

SEQ ID NO: 61629 - protein, 430 aa, Thermobifida fusca YX
MATHLKSHELFNRARSVIPGGVNSPVRAFKAVGGTPPFMVSGKGPYLTDADGNTYVDLICSWGPLILGHAHPAVVEALAKAAAQGTSYGAPTEAEVELAEEIVSRTPVEKVRLVNSGTEATMSAIRLARGATGRAKVVKFAGNYHGHVDALLAAAGSGVATFALPDSPGVTGASAADTIVLPYNDIAAVEAAFAEAGDEIACVIAEACPANMGVVPPRDGFNAKLREITARHGALLILDEVLTGFRVSPSGWYGLEGVAPDLMTFGKVMGGGLPAAAFGGRADLMDQLSPEGSVYQAGTLSGNPLATAAGLATLRNATPEVYAHIDAAAARVSAAVSEALTAEGVPHRIQHGGNLFTVFFTDTEVVDFDGARAQNTARYAAFFQAMLEQGVYLPPAAFEAWFFSAAHDDAALDRVVSALPAAAKAAAQVA

SEQ ID NO: 61630 - protein, 358 aa, Oryza sativa (japonica cultivar-group)
MSAYCGKYKDELIKNAAYIGTPGKGILAADESTGTIGKRFASINVENVEDNRRAFRELLFCTPGALQYISGVILFDETLYQKTKDGKPFVDVLKEAGALPGIKVDKGTIEVAGTDKETTTQGHDDLGKQCAKYYEAGARFAKWRAVLKIGPNQPSQLAIDLNAQGLACYAIICQENGLVPIVEPEILVDGPHDIDRCAYVSEVVLAACYKALNEHHVLLEGTLLKPNMVTPGSDAKKVAPEVIAEYTVRTLQRTVPPAVPAIVFLSGGQSEEEATLNLNAMNKLSAKKPWSLSFSFGRALQQSTLKAWAGKTENVEKARAAFLVRCKANSEATLGTYKGDAVLGEGAAESLHVKDYKY

SEQ ID NO: 61631 - protein, 152 aa, Oryza sativa
MAGVGGPSVRPFVCLLGCLFSCCWGIGYDEDARYPETKTLTIGQFKLGLCHGHQVVPWGDLDSLAMLQRQLDVDILVTGHTHQFKAYKHEGGVVINPGSATGAYSSITYDVNPSFVLMDIDGLRVVVYVYELIDGEVKVDKIDFKKTATMHA

SEQ ID NO: 61632 - protein, 282 aa, Azoarcus sp. EbN1
MTASIETRTFHDQPALVLRTPGGAQAVVSLLGAQVLSWTPAGGSEWLYLSPQARHDGSTPIRGGIPVCFPQFAALGRLPKHGLVRTRRWTVGEQRSGDDFALVTLTTSEDDASYAAWPQRFSAEITVIIEGERLGVELEVGNTGHAPFAFTAALHTYLRVGEVENARLEGLHGHEYRDAADNDRIKRDSGDALVVEAETDRVYHDVQRPLLLRDGGRSLGINVEGFPDVVVWNPWEQRCAQMPDLPANGFRHMLCVEAAAARHRIELDAGEQWYGRQTLIAL

SEQ ID NO: 61633 - protein, 138 aa, Arabidopsis thaliana
  misc_feature (2)..(3): Xaa can be any naturally occurring amino acid
  misc_feature (12)..(13): Xaa can be any naturally occurring amino acid
  misc_feature (51)..(51): Xaa can be any naturally occurring amino acid
  misc_feature (63)..(63): Xaa can be any naturally occurring amino acid
  misc_feature (67)..(67): Xaa can be any naturally occurring amino acid
  misc_feature (78)..(80): Xaa can be any naturally occurring amino acid
  misc_feature (82)..(83): Xaa can be any naturally occurring amino acid
  misc_feature (85)..(85): Xaa can be any naturally occurring amino acid
  misc_feature (90)..(91): Xaa can be any naturally occurring amino acid
  misc_feature (93)..(94): Xaa can be any naturally occurring amino acid
  misc_feature (100)..(101): Xaa can be any naturally occurring amino acid
  misc_feature (104)..(105): Xaa can be any naturally occurring amino acid
MXXSMVSSAAVXXSPAQATMVAPFTGLKSSAAFPVTRKTNKDITSIASNGXRVSCMKVWPPIXKKKXETLSYLPDLSXXXLXXEXDYLLXXKXXPCVEFXXQHXXALLTPPYCPLMIPFLCPSFVITLPQCISSPPSP

SEQ ID NO: 61634 - protein, 471 aa, Glycine max
  misc_feature (175)..(175): Xaa can be any naturally occurring amino acid
  misc_feature (203)..(203): Xaa can be any naturally occurring amino acid
MKKQVQGPIPNACLSESSRGARWSLNGMTALVTGGTRGIGHAIVNDLAAFGAAVHTCSRNQTELKKCLQEWQTQGFQATGSVNNVGTNFRKPTVEYSAEEYSELMTVNLDSGYHLCQLVYPLLKASVKGSIVFISSVAGVLSKNLACEWANDNIRSNCVVPWATRTPLVEHVICXQNQKFVEDILSRTPLKSIAEAEEVSSLXRSSINRGARWSLNGTTALVTGGTRGIGHAIVSDLAAFGAAVHTCSRTQTELNKCLQEWQSLGFQVTGSVCDVSSPSQREKLIEEVTSILNGKLNIYVNNVGTNFRKPTIEYTAEEYSQLMTVNLDSSFHLCQLAYPLLKASENGSIVFISSVAGVVSLGTGAVYAASKAAINQLTKNLACEWAKDNIRSNCVVPWATRTPLVEHLLRDQKFVDDIMSRTPIKRIAEPEEVSSLVTFLCLPAASYITGQVICVDGGLTVNGFQPSMRIT

SEQ ID NO: 61635 - protein, 320 aa, Oryza sativa (japonica cultivar-group)
MTIYIAREASKVWRKVTTETSVELSLLREKWGLLLAGIVFQLVPRSYMVYAIVEDLGFMALPEFGQDKGYLSESIFASNFASLVLASQVLRIITFYSTQLPGPNYHCREGSKLATLPPPNNVFEVLLINFPRGVLFGCGDLIFSSHMIFTLVFVRTYHKYGSKRFVKLLAWFMAIVQSLLIIASRKHYSVDVVVAWYTVNLVVFFVDNKLPGYIFVTFVALRLYRDLYGKHFVTSFVEIFTEMPDRTNGVPLLPLSTREKDGRLKEEKDSRLKEEFHKLLNGNHGDPTDRRQRAQMNGRHDEDINHAHSTLSDAAVNGGT

SEQ ID NO: 61636 - protein, 425 aa, Coccidioides immitis RS
MAYQRYGTSNIRACDSYFVESYDNDYQPSRVCPKEHAKIIARERQYAMGDEMTKAVREEYQEDIIAHMHLMDSATLPDVDSIDIQTEIQWFMRPYLLDFLIEAHAAFQLLPGTLFLTVNLLDRYCSKRVVYKRHYQLVGCAALLIAAKYSDKKERVPTIKELKSMCCSLYDDDMFVQMEWHVLQTLGWSIGHPTVDGFLQVAVMDTPYDPEVEHLALYILEIALFHREFVSKLSADLSRAALALSRCILNRPQASHNDWASNYDSLTLVNLSQHLFQPSHVLARKYSSAHYSRVSKILEQFLARQSTVTKSYNPPTPPTDRAEDSKPYEGEIGLATPQKSHCPRTMTNGYITPPITPENDAFAPTSNANPSKDASGLLYVCPTSPTPQQAMHYGQTHHYKLQETDPYSQHQRFPQQPSVPYNSVF

SEQ ID NO: 61637 - protein, 1105 aa, Oceanicola granulosus HTCC2516
MIIGAGPIVIGQACEFDYSGAQACKALREEGYRVILVNSNPATIMTDPGLADATYIEPITPDVVAKIIEKERPDALLPTMGGQTGLNTSLALADMGVLEKFGVEMIGARREAIEMAEDRKLFREAMDRIGIENPKATIVTAPRLESGKRDLKEGVRLALEALEEIGLPAIIRPAFTLGGTGGGVAYNRAEYEHYCRSGMDASPVGQILVDESLLGWKEFEMEVVRDKADNAIIVCAIENVDPMGVHTGDSITVAPALTLTDKEYQEMRNGSIAVLREIGVETGGSNVQWAINPEDGRMVVIEMNPRVSRSSALASKATGFPIAKIAAKLAVGYTLDELDNDITGVTPASFEPSIDYVVTKIPRFAFEKFPGAEPELTTAMKSVGEAMAIGRSFHESMQKALASMETGLTGFDEIDIPGAPDKAAITKALAKQTPDRIRVIAQAMRHGLTNDDIHAVTMFDPWFLARIREIVDTEGRVRADGLPVTEEGLRRLKMMGFTDARLGTLTGRDEGQVRRARARLGVTAVFKRIDTCAAEFEAQTPYMYSTYEHPVMGEVEDEARPSERKKVVILGGGPNRIGQGIEFDYCCCHACFALTDAGYETIMVNCNPETVSTDYDTSDRLYFEPLTFEHVMEILRVEQENGTLHGVIVQFGGQTPLKLANALEEEGIPILGTTPDAIDLAEDRERFQALVNDLGLKQPRNGIAHSDAEALAIADEIGFPLVIRPSYVLGGRAMEIVRDMAGLERYIREAVVVSGKSPVLLDSYLAGATEVDVDCLSDGTRVHVAGIMQHIEEAGVHSGDSACCLPPHTLAADVVEELKRQTEALALRLGVVGLMNVQFAVKANEAGENEVFLIEVNPRASRTVPFVAKATDSAIASIAARLMAGEPLDNFPLREPYPPAEDPMTVLPLGNPFTLADPITPWFSVKEAVLPFNRFPGVDTLLGPEMRSTGEVMGWARNFARAFLKAQLGAGTVLPERGAVFISIRDADKAETMREAAAMLAELGFAILATRGTAKWLAGHGLEAEVVSKAYEGGLTILDRIKDGHVDLVINTTEGAAAVEDSRSMRAVTLADKIPYFTTAAGAHAAAQAMRARQDEEVRVRALQG

SEQ ID NO: 61638 - protein, 432 aa, Acidobacteria bacterium Ellin345
MSKNPSRATAFDILLRVERDQAFASELLHSDRLNDLSAPDRGLATELVMGTLRWQSTLDALVATQSSQPLRKLDIEVLIALRLAAYQLQFLDRIPANAAVNESVELVKRARKRSAVPFANAVLRKISKLPREIHGDLAHPAWLVARWRDNYGGDAAESISKYGQTTPETALRLPFDAEKRAKVEAELQENGVELAPGRLLNAARRLVSGDLSGTAAFQRGDVWIQDEASQLVALLTGHGDRILDCCAAPGGKTSVLAERNPSSKIVALELHEQRARLLRERVRASNVDVQTADATNFRAETAFDCVLADVPCSGTGTLARNPEIKWRLKPEDLADLQQRQIAILRAALSQLAPGGRLVYSTCSLEPEEGEAVVEASLTDEFELQPAAPELEQFAPAFAIPDPQTLVRGPYLRTIPGIHPCEGFFAAVITRRQ

SEQ ID NO: 61639 - protein, 314 aa, Cicer arietinum
QMSKSKRTHRKLPAANFDLAPAQANPEFEKPRRNIRKFPTQPSDPAVENPQIELEKVKRNLRKVHNPVVETAVLPEAESDTAKAHLEKDAVASSVAVSEQGVISSKEIINKEATISISSQPDIGITTGDLATKEVYNTPSSYQVNVESKPLTDITSKDKNISDEVNNDPIDLLDTICKDENSHITNGDLNHKEDQSGSENQKPSRKASIVAKQERAENGLHNSPTIPSYMAATESAKAKLRAQGSPRFGQDGSEKNNNARRHSLPSLTNSKITSHSPRTQRPAQSGGKVGHKSDKAVSSSRDGNGKVIQAEWKR

SEQ ID NO: 61640 - protein, 551 aa, Mycobacterium avium 104
MSSGGENTRRAEPVEPRGTAVLDSAHLGDIEGAFGRIRVGETEHARTWKTRLLTLLAIVGPGIIVMVGDNDAGGVATYAQAGQNYGYSLLWVLLLLVPVLIVNQEMVVRLGAVTGVGHARLINERFGRGWGWFSVGDLFLLNFLTIVTEFIGISLAAEYIGVSKYVVVPVSAVALVAIMASGSFRRWERAMFIFIAITLLQIPMLLMSHPQWGRAAKSFVVPSISGGVSSDAVLLIIAIVGTTVAPWQLFFQQSNVVDKRITPRFMGYERADTVLGAFVVVIGAAALVMTGDWAARSTDTVGGFTDAGATAHLLGQHRQVLGSIFAIVLMDASIIGAAAVTLATSYAFGDVFGLKHSLHRGFADAKQFYLSYTAMVVVAAAIVLIPGAPLGLITTAVQALAGLLLPSASVFLLLLCNDREVLGPWVNRAWLNWVAGLIVGTLLLLSGILMATTLFPDLNVVAVAGYLTLALIILAAGAAPVLRWLARRQPARPGPRLPARGVDRSTWRMPPLTLLEPVTWSPGTRLAMIALRGYLVVGALLLVVKAIQLSR

SEQ ID NO: 61641 - protein, 527 aa, Clarkia delicata
VEFDNIFLDYSRQQASPDTISKLYKLADAAHLKQKIDRMYNGDHINTTENRSVLHVALRAPRNSSICSDGKNVVPDVWNVLDKIKDFSDRVRNGSWIGATGKELKDVIAVGIGGSFLGPLFVHTALQTDPEASKNARGRELRFLANVDPIDVARNISGLNPETTLVVVVSKTFTTAETMLNARTLREWISSALGPSAVAKHMVAVSTNLPLVEKFGIDPNNAFAFWDWVGGRYSVCSAVGVLPLSLQYGFAVVEKFLQGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEELKKENVSEHLIPHKTFTGNRPSLSILLPTLDAYRIGQLLAIYEHRVAVQGFVWGINSFDQWGVELGKSLATQVRKQLHASRVKGEPVEEGFNFSTKTLLTRYLQATSDVPADPSTLLPNI

SEQ ID NO: 61642 - protein, 320 aa, Silicibacter sp. TM1040
MWNLIADVGGTNMRLAAVNAEGEILEQARYDSKGTQNLEEACADFAAHRGSAPGRAVIAAAGVVRGGSVQLTNANQSFSERGIAVALQTERVKVLNDFEAAAWSLASVSAGDVTVLQGQAVFPKEPCLIIGPGTGLGVGALIWANGEPCVVPGEGGHVAIGPRTADEVAIFEALREEWPEIGMGPGLAVEAEGILSGTGLPYFYRAVARSMELTAPLTTGAEIFQSAQARLDTAAVRAVSLFAQYLAGVAGDLGLVFAAKGGVFVTGGVAAANPWIFDAAFVEAFNAGGRHTAWREELPLHLYHQPNFGLIGARNYLRAR

SEQ ID NO: 61643 - protein, 400 aa, Triticum aestivum
MSGEVECSVCHAKVAVPPAAVSKAYDSHRSTVSSRQRALNVLLVSGDCVLAGLQPILVYMCKVDGKFKFSPVSVNFLTEITKVIFAIIMLFFQARRVKVGEKPLLTVSTFVQAARNNVLLAVPAFLYAINNYLKFTMQLYFNPATVKMLGNLKVLIIAVLLKVLLRRRFSTIQWEALALLLIGISVNQLKSLPEGSTALGLPVAAGAYLYTLFFITVPALASVYNEKALKSQFDTSIYLQNLFLYGYGAIFNFLGLVITALVQGPRSFHILEGHSKATMFLICNNAAQGILSSFFFKYADTILKKYSSTIATIFTGVASAILFGHTLTINFVLGISIVIISMHQYLANQIKDQVPSSKIEMSDAEDDSRLEESVIVKVDTVASEAKHRHGSDERQPLLPV

SEQ ID NO: 61644 - protein, 526 aa, Clarkia delicata
VEFDNIFLDYSRQQASPDTISKLYKLADAAHLKQKIDCMYNGDHINSTENRSVLHVALRAPRNSAICSDGKNVVPDVWNVLDKIKDFSDRVRNGSWIGATGKELKDVIAVGIGGSFLGPLFVHTALQTDPEASKNARGRELRFLANVDPIDVARNISGLNPETTLVVVVSKTFTTAETMLNARTLREWISSALGPSAVAKHMVAVSTNLPLVEKFGIDPNNAFAFWDWVGGRYSVCSAVGVLPLSLQYGFAVVEKFLQGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVMKSQQPVYLKGEVVNNHDELMSNFFAQPDALAYGKTPEQLKKENVSEHLIPHKTFTGNRPSISILLPTLDAYRIGQLLAIYEHRVAVQGFVWGINSFDQWGVELGKSLATQVRKQLHGSRVKAKPVEGFNFSTKTLLIRYLEATSDVPADPSTLLPNI

SEQ ID NO: 61645 - protein, 150 aa, Triticum aestivum
  misc_feature (90)..(90): Xaa can be any naturally occurring amino acid
MAEQTFIMIKPDGVQRGLIGEVISRFEKKGFYLKGLKLQNVEKSFAEQHYSDLSSKPFFAGLVEYIVSGPVVAMVWEGKSVVATGRKIIXATNPLASEPGTIRGDFAVDIGRNVIHGSDSVESARKEIALWFPEGIAEWRSSQHNWIYEA

SEQ ID NO: 61646 - protein, 137 aa, Triticum aestivum
MARTKQTARKSTGGKAPRKQLATTIAARKSAPTTGGVKKPHRYRPGTVALREIRKYQKSTDLLIRKLPFQRLVREIAQDFKTDLRFQSHAVLALQEAAEAYLVGLFEDTNLCAIHAKRVTIMPKDIQLARRIRGERA

SEQ ID NO: 61647 - protein, 327 aa, Glycine max
  misc_feature (249)..(249): Xaa can be any naturally occurring amino acid
VLTSLYDYIPRMRSSDSEEVSENAENSLSNKRKYNISVSLSGHLFDQFLINEALDIIEAAGGSFHLVNCHVGQSVEAVSFSELEVGADDRAVLDQIIDSLTAIANPTENDRFSNQDSSKISLKLGKVEENGIEKESDPRKKAAVLILGAGRVCQPAAEMLSSFGRPSSSQWYKTLLEDDFECQIDIEIIVGSLYLKDAEQTVEGIPNVTGVQLDVMDHANLCKYIAQVNVVISLLPPSCHIIVANACIXDHMMAMKMINQAHVRKGKIKSFTSYCGGLPSPEAANNPLAYKFSWNPAGAIRAGRNPATYKWGGETVHIDGNDLYDSA

SEQ ID NO: 61648 - protein, 123 aa, Medicago sativa
GKAPRKQLATKAARKSAPATGGVKKPHRFRPGTVALREIRKYQKSTELLIRKLPFQRLVREIAQDFKTDLRFQSSAVSALQEAAEAYLVGLFEDTNLCAIHAKRVTIMPKDIQLARRIRGERA

SEQ ID NO: 61649 - protein, 148 aa, Glycine max
  misc_feature (27)..(27): Xaa can be any naturally occurring amino acid
  misc_feature (42)..(42): Xaa can be any naturally occurring amino acid
SLDIMSDIPGASTYIIGAQNETAFYLXPHDVQQVVNISVDNXKSPNSTSSYHCDIMRHIPIDSIDPSLAIGFYCRDKDDFDDFCSQASKLAEESNGAPLFTVTQSRSFSKQVTSNDVSGDNTGFQEEDFPGMDRGNDTGTNEDDWQLL

SEQ ID NO: 61650 - protein, 480 aa, Oryza sativa (japonica cultivar-group)
MSRIHRNPTLLAPTPSPSSIPPLLEPSRSSPPPPMAATIVSVKARQIFDSRGNPTVEVDVCCSDGTFARAAVPSGASTGVYEALELRDGGSDYLGKGVSKAVDNVNSVIAPALIGKDPTSQAELDNFMVQQLDGTKNEWGWCKQKLGANAILAVSLAICKAGAIIKKIPLYQHIANLAGNKQLVLPVPAFNVINGGSHAGNKLAMQEFMILPTGAASFKEAMKMGVEVYHNLKSVIKKKYGQDATNVGDEGGFAPNIQENKEGLELLKTAIEKAGYTGKVVIGMDVAASEFYNDKDKTYDLNFKEENNDGSQKISGDSLKNVYKSFVSEYPIVSIEDPFDQDDWEHYAKMTAEIGEQVQIVGDDLLVTNPTRVAKAIQEKSCNALLLKVNQIGSVTESIEAVKMSKRAGWGVMTSHRSGETEDTFIADLAVGLATGQIKTGAPCRSERLAKYNQLLRIEEELGAAAVYAGAKFRAPVEPY

SEQ ID NO: 61651 - protein, 506 aa, Oceanicola granulosus HTCC2516
MTAPKPVVLCILDGWGLREEREANAPALAETPNFDRIWRDCPHATLTTHGRDAGLPEGQMGNSEVGHTNIGAGRVVAMDLGQIDLALEEGTYAEQPPLKDFIATLKDSGGRAHLLAVVSDGGVHGHIAHLLETARILDAEGVPVVVHAMTDGRDVAPTSGKGFVERLVEELPGSATVGTVIGRYYAMDRDERWERIETAYRAIAEGKGESEAADPVAAVEAAYDADMTDEFIPATVIEGYDGLREADGLFCLNFRADRAREILRALADPEFDGFARETPALAARLGMVDYSSDHNAWYESVFPKKAIRNTLGAWVAAQGLRQFRLAETEKYPHVTFFLNGGKEEPEAGEDRKMPKSPKVATYDLQPVMSAGEVSDAFVGAIEAGYDLIVVNYANPDMVGHTGDLDAAIKACEAVDAGLGRALEALEAAGGAIVVTADHGNCETMVDPETGGPHTAHTLNPVPVIVVGGPEEATLREGRLADLAPTVLDLMGLDQPPEMTGKSLIQR

SEQ ID NO: 61652 - protein, 457 aa, Oryza sativa (japonica cultivar-group)
MSRIHRNPTLLAPTPSPSSIPPLLEPSRSSPPPPMAATIVSVKARQIFDSRGNPTVEVDVCCSDGTFARAAVPSGASTGVYEALELRDGGSDYLGKGVSKAVDNVNSVIAPALIGKDPTSQAELDNFMVQQLDGTKNEWGWCKQKLGANAILAVSLAICKAGAIIKKIPLYQHIANLAGNKQLVLPVPAFNVINGGSHAGNKLAMQEFMILPTGAASFKEAMKMGVEVYHNLKSVIKKKYGQDATNVGDEGGFAPNIQENKEGLELLKTAIEKAGYTGKVVIGMDVAASEFYNDKDKTYDLNFKEENNDGSQKISGDSLKNVYKSFVSEYPIVSIEDPFDQDDWEHYAKMTAEIGEQVQIVGDDLLVTNPTRVAKAIQEKSCNALLLKVNQIGSVTESIEAVKMSKRAGWGVMTSHRSGETEDTFIADLAVGLATGQIKTGAPCRSERLAKYNQATS

SEQ ID NO: 61653 - protein, 480 aa, Oryza sativa (japonica cultivar-group)
MSRIHRNPTLLAPTPSPSSIPPLLEPSRSSPPPPMAATIVSVKARQIFDSRGNPTVEVDVCCSDGTFARAAVPSGASTGVYEALELRDGGSDYLGKGVSKAVDNVNSVIAPALIGKDPTSQAELDNFMVQQLDGTKNEWGWCKQKLGANAILAVSLAICKAGAIIKKIPLYQHIANLAGNKQLVLPVPAFNVINGGSHAGNKLAMQAFMILPTGAASFKEAMKMGVEVYHNLKSVIKKKYGQDATNVGDEGGFAPNIQENKEGLELLKTAIEKAGYTGKVVIGMDVAASEFYNDKDKTYDLNFKEENNDGSQKISGDSLKNVYKSFVSEYPIVSIEDPFDQDDWEHYAKMTAEIGEQVQIVGDDLLVTNPTRVAKAIQEKSCNALLLKVNQIGSVTESIEAVKMSKRAGWGVMTSHRSGETEDTFIADLAVGLATGQIKTGAPCRSERLAKYNQLLRIEEELGAAAVYAGAKFRAPVEPY

SEQ ID NO: 61654 - protein, 480 aa, Streptomyces avermitilis MA-4680
MPALRIKSPELLVAESGADLEGHGLKRTMGLFQLICFGVGAIVGTGIFVGLSDSVAQAGPAVVVSFVLAAITCVFTAFAFAELGGAIPVSGSSYSFAYAGLGERTAFLVGWCLLLEYGVSVSAVAVGWSQYVNELLDSLTGLELPAALSAGPGDGGVINLPAVVVIALASVLLVRGVRESARATAAMAVLKLAILVVFCAIGFSAFKDGNLTPFSPAGLGGIGAGTTAAFFSYIGFDAITTAGEEARNPRRDIPIAILVCLGLATLLYCAVALAAIGAIGGDQVGGRPAALSYVVNEVTGSTAGGAVIAFGAVVAIASVVLAVMYGQTRILMSMARDGLVPRVFERVSPKTSTPVTGTLLVALVFAVPAAFASLDAVVNLCTIGTLAIMAVVNVTVIALRRREPGLTRSFRVPLYPVIPVLGVGFCLYLMYETGWTTWIQFAAFLAAGCLVYALYGRRNSRLAKSAAATRTDAEAVSQAV

SEQ ID NO: 61655 - protein, 655 aa, Bacillus clausii KSM-K16
MSEKTFYITTPIYYPSGKLHIGHTYTTVAGDAMARYKRLRGYDVRYLTGTDEHGQKIEQKAKEKGISPLEYTNEMVKPIKELWKKLDISHDDFIRTTEKRHTNMVEKIFEQLVEQGDIYLGEYEGWYCVSDETFYGERELVDPIKDESGNIIGGKSPDSGHPVEKVREKSYFFRMSKYADRLLAFYEENPDFIQPASRKNEMINNFIKPGLQDLAVSRTSFTWGVKVPSNPKHVVYVWIDALTNYITALGYGTADDTLYQKYWPADVHLVGKDILRFHTIYWPIMLMALDLPLPKKVFGHGWFLTKDGKMSKSKGNVVDPAPLIDHFGLDAIRYYLLREVPFGADGVFTPEAFVERVNYDLANDLGNLLNRTVAMINKYFNGEIPAYVKSASPFDEDLLDLVQATITKVEDAMEEMEFSIALAAIWQLVSRTNKYIDETQPWMLAKEEDNRELLGSVMYHLAESLRIISVLIRPFMTRTPAKIWAQLGIDESLAGWESIRVFGQLPAGTKVSKGEPVFPRLDVEKEVDYIVELMGGKADPEPEEIEDENEITIDDFSKVELKVAEVTAAEPVEGADRLLKIQLDLGTETRQVVSGIAKYYAPSDLVGKKVICVTNLKPVKLRGELSQGMILAGSKGKKLQLATVDGDLPNGAQVK

SEQ ID NO: 61656 - protein, 403 aa, Oryza sativa
MAGVDLEKCKRIVQYFWDPEPKNDTVPEAPIWCLGQEYTPTPKDVSKSTDVSRGERPGTNSDAAVGSSWPEAFLDDFESRIWMTYRSNFTPIPRNKTPEATSSMTLGVRLRSQLMDSQGFTSDTGWGCMIRSGQSLLANTLSMIQLGRDWRRGSSPEEESKLLAMFADHPDSPFSVHRFVQRGAESCGKYPGEWFGPSATARCIQLLSHECESPKLRVYITNNTSDVYEDEVARLGRDENGQPVPVLVLLGLRLGIEQVTSVYWDGLRAALQYPQSVGIAGGRPSASHYFVGVQDSHLFFLDPHSTRPALPVPQSSKVYSREDLDTCHTRRLRRIHIKDMDPSMLIGFLIRDESDWKDWKQRVQSTPGKPIIHILASGAPTEEGMERMEALDEVEALDDSEAE

SEQ ID NO: 61657 - protein, 421 aa, Caulobacter crescentus CB15
MNHFEYGPQGLACEGVPLAKIAAEVGTPVYVYSRATLERHFVVFRDALAMSGVVDPLIAYAVKANSNVAVLKVLGDLGAGADTVSEGEVRRALAAGIPGERIVFSGVGKARREIAFALQAGVAEINVESEPELNLIAEVAAELGVRAKVAFRVNPDVAAGGHAKIATGKSENKFGVSFAEAARLYANASNNANLQPVGVACHIGSQITDLAPMRAAFTKMRGLVEQLLAEGLSVERLDLGGGLGVPYFNHPEPPSPAEFAAMVGEVTQGLPVTLAFEPGRVIAANAGVLVSEVIHVHERPEGRKFLVIDAAMNDLVRPAMYDAFHDIRPVIQRTGETVYDVVGPVCETGDTFTRDRALPPFAAGDLVAFMSAGAYGAAMASEYNTRPLVPEVLVDGDRYAVIRQRPTYDEMLARDLVPDWV

SEQ ID NO: 61658 - protein, 447 aa, Methanosarcina barkeri str. Fusaro
MVQIKKCITKEDVLEAVKERDVKFIRTQFTDTLGIIKSWAIPVEQLEEAFENGVMFDGSSIQGFTKIEESDMKLVLDPSTFRILPWRPTTGAVARILGDVYLPNGRPFEGDPRYVLKSAIEEAKKMGYSMNVGPELEFFLFKLDANGNPTTELTDHGGYFDFSPLDRAQDVRRDIDYTLERMGFQIEASHHEVAPSQHEIDFRFGDVLSTADNVITFKYVVKSIAYHKGYYATFMPKPLFGVNGSGMHTNQSLFKGDNNVFYDPESADQLSQEAMYYIGGLLNHIIEFAAVTNPVVNSYKRIVPGYEAPVYLTWSAKNRSSLIRIPETRGNGTRVELRCPDPSCNPYLAFALMLRSGLDGIKNKIDPGEPTNTNIFHLTEKEREGKGIRSLPADLKGAIDEMKGSKFVKEVLGEHVFNHYLCAKEMEWDEYKAIVHPWELEKYLHML

SEQ ID NO: 61659 - protein, 314 aa, Rhodopirellula baltica SH 1
MFRTCLMSPRKGSDFAGLSTAIVTPFRDGQVDEKRLAEQIDFQIDSGVTCIVPCGTTGESPTLTHDEHERVISLTIQHVAGRVKVMAGTGSNSTAEALRLTRRAADEGADATLQVAPYYNKPTQEGMYQHFRAVAEAVDIPVCVYNIPGRSAKNIEVDTIVRLAELPNITMVKEATGSLDQCTAVLGATNLTVLSGDDSLTLPMMSVGAEGVISVAANLVPSVLLEMVQTAAAGDYTKAAELHHRLYSLCSKMLGLATNPIPVKAAMQMVGRDTGEMRLPMVPLDDADRAILQETLMKFGMESAIAGQLQASGA

SEQ ID NO: 61660 - protein, 527 aa, Clarkia delicata
VEFDNIFLDYSRQQASPDTINKLYKLADEAHLKQKIDRMYNGDHINITENRSVLHVALRAPRNSAICSDGKNVVPDVWNVLDKIKDFSERVRNGSWVGATGKELKDVIAVGIGGSFLGPLFVHTALQTDPEASKNARGRELRFLANVDPIDAARNISGLNPETTLVVVVSKTFTTAETMLNARTLREWISSALGVSAVAKHMVAVSTNLPLVEKFGIDPNNAFAFWDWVGGRNSVCSAVGVLPLSLQYGFAVVEKFLQGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEQLRKENVSEHLIPHKTFTGNRPSLSILLPTLDAYRIGQLLAIYEHRVAVQGFVWGINSFDQWGVELGKSLATQVRKQLHASRVNGEPVEEGFNFSTKTLLTRYLKATSDVPADPSTLLPKI

SEQ ID NO: 61661 - protein, 356 aa, Frankia sp. CcI3
MSSLFSAVCDHEQVLLCSDRPSGLHAIIAIYSTALGPSLGGTRFHPYADEEVALADALALSRAMAYKAACAGLDLGGGKAVIIGDPAVAKSEPLLRAFGRHVASLGGRYITACDVGTYVADMDVIARETRWVTGRSPAHGGSGDSGVLTAYGVFEGMRAAARHRWGTPSLAGRRVAVSGVGKVGRRLVGHLLDSGASVVAGDVDPVALARLRVEFPAAETVPDPDDLLDLDIDVYAPCALGGALSAETVRRLRAGVVCGGANNQLAQPEVGRQLADAGVLYAPDFVVNAGGLIQVADEIEGYSPERARARAAQIFDTTSEVFRLAEAEEVTPTEAAERLAERRMTDVGRLRGILLP

SEQ ID NO: 61662 - protein, 439 aa, Pseudomonas putida GB-1
MPCSHPDFERTSMSRSEDLFAKAQKHIPGGVNSPVRAFKSVGGTPLFFKHAEGAYVVDEDDKRYVDYVGSWGPMILGHGHPDVLDSVRKQLEHGLSYGAPTAMETDMADLVCSLVPSMEMVRMVSSGTEATMSAIRLARGYTGRDAIIKFEGCYHGHSDSLLVKAGSGLLTQGVPSSAGVPADFAKHTLTLPFNDIAAVEKTLAEVSQTVACIIVEPVAGNMNCVPPAPGFLEGLREQCDKHGVVLIFDEVMTGFRVSLGGAQGHYGIKPDLSTFGKIVGGGMPVGCFGGKREIMGCIAPLGPVYQAGTLSGNPLAMAAGLTTLKLISRPGFHAELTDYTSRMLDGLQQRADAAGVPFVTTQAGAMFGLYFSGADDIVTFEDVMASDAERFKRFFHLMLDGGVYLAPSAFEAGFTSIAHGDKELQITLDAAEKAFAALK

SEQ ID NO: 61663 - protein, 307 aa, Clarkia epilobioides
  misc_feature (77)..(87): Xaa can be any naturally occurring amino acid
AAHLKQKIDRMNNGDHINSTENRSVLHVALRAPRNSVICSDGKNVVPDVWNVLDKIKDFSERVRNGSWVGATGKELXXXXXXXXXXXFLGPLFVHTALQTDPEASKNARGRELRFLANVDPIDAARNISGLNPETTLVVVVSKTFTTAETMLNARTLREWISSALGVSAVAKHMVAVSTNLPLVEKFGIDPNNAFAFWDWVGGRYSVCSAVGVLPLSLQYSFAVVEKFLQGAHSIDQHFSSAPFEKNIPVLLGLLSVWNVSFLGYPARAILPYSQALEKLAPHIQQVSMESNGKGVSIDGLPLPFES

SEQ ID NO: 61664 - protein, 536 aa, Silicibacter sp. TM1040
MSDIWQQLSAHRAATEATPLTDYFAQDADRFARYSASAGEMLLDYSKTALDDTARDLLVQLAESVDLKSRIAAMMSGAKINSTENRAVLHTALRAPKDAVIEVDGENVVPGIQKVLAQMGAFATALREGSYQTKTGTAFTDVVNIGIGGSDLGPVMATLALAPYHDGPACHFVSNVDGAHIHDVLAGLNPETTLVVIASKTFTTIETMTNAETAIQWLKGALGEDVSTHLAAVSTALDKTAAMGIPDARVFGFADWVGGRYSMWGPIGLPIMIAVGPESFGEFLAGAAAMDQHFRDAPLMENLPALLGLIGVWHNNICGYGSRAVLPYDQRLSRLPAYLQQLDMESNGKSVALDGSPLPRASGPVVWGEPGTNGQHAFYQLLHQGTQVIPTEFLIAATGHEPELAHQHNLLKANCLAQSEALMLGRSWDEAREIAIARGFDGVDADRMAGHLSFPGNRPSVTLAYPKLTPFVFGQIVALYEHRVFTEGVIWGINSFDQWGVELGKELATRLLPMVEGADASQKDASTRGLLAKLST

SEQ ID NO: 61665 - protein, 256 aa, Mycobacterium sp. JLS
MADGVPTDLRQALDGAARLPRLLIACDYDGTLAPIVSNPADARPLPASAAAVEELAALPATTVALISGRALGVLKELSGVSGRVHLVGSHGAEFDTGFLSPIDERAEALLVEIKQTLDEIAAEYAGVTTELKPASVALHVRNASTDDGEAAMHRANEAAARWDAQVTDGKAVKEFAVIQTDKGQAVDILRDQHDASAVLFLGDDVTDEKAFRRMRDGDIGVKVGPGDTAAAYRVDEPRDVAEVLEYLLAVRRRAHS

SEQ ID NO: 61666 - protein, 217 aa, Zea mays
MGEEASCDAVSLTEAGTNAKPVGKEVGREPAAAPAAAADPRLQGISDAIRVVPHFPKQGIMFNDITTLLVAPQGVQGRRQTGPSKGYRGMGHQPPSPGIEARGFVFGPAIALAIGAKFIPLRKPRKLPGEVISEKYVLEYGTDCLEMRVGAIERSGERVLVIDDLVATGGTLCAAIRLLERAGADVVECACVIGLPKFKDLYKLNGKPVYVLVESRE

SEQ ID NO: 61667 - protein, 485 aa, Arabidopsis thaliana
MDQGSGKTMISVLLVHHVDKKNVVWIQSGSDFVDLFYSFLTMPLGTIVRLLEHHGRLKEKVSIGCFNNLYKSLVDMSIDNFRNEACKQMLVYPKSVKERQCRMLKINIDDTEETKYFMCPKSLQSPSCREFFSNFNTSRCRCGNLMNKESSSPEGEESVSRLGGSCDDDGVFVHGDGNMAFMLSDDLTIENFSWDLPRKRVKDLGCVNVFDKLGEGEPEVGFREAMTLLRSLFTSETPLTATFFPFHSSPYPSKRAYKASSPCDSVLGQVLSFKVYLSKEDNKKVIYAECGEGFIDLLCMFLVLPLGYICQISSRDGDDDDGLGCIGNLFRSFKGLSGDEITIPWYYNCRKNLLGITVQKPPSLFNCISYLEDNGMAGDCEDSRLKKVRPMDPKAEISGQSRSSSGGFVKSNKKFLVTDDLIITPLNSDLTMRELKKLKISFDEVNIKEITIGKTEATNLLKASFVTSFALTNGLSDLLSKKLEG

SEQ ID NO: 61668 - protein, 1352 aa, Streptomyces avermitilis MA-4680
MTTTPEAERTRTAEQVRTVCSYCGVGCGIVLDVGTGPDGRRTVLKASGDKEHPANRGRLCTKGATTADMLAAPGRLTSALVRDDRGAEPVPAPVDEAVRETARRLRAIVDEHGPDAVAFYVSGQMSLEAQYLANKLAKGFVRTNQIESNSRLCMASAGTGYKLSLGADGPPGSYDDLDKADVFLVIGSNMADCHPILFLRLLERVKAGAKLIVVDPRRTATAAKADLFLQVRPGTDLALLNGLLHLLYENGHTDAEFIARHTEGWEAMPDFLADYPPATVSEITGIPEDDIRAAARLIGEAGEWTSCWTMGLNQSTHGTWNTNALVNLHLATGAICRPGSGPLSLTGQPNAMGGREMGYMGPGLPGQRSVLVDEERAFVEELWELAPGTIRADGVGRGTVEMFRKMADGDIKACWIICTNPVASVANRKTVIEGLEAAEFVVTQDVFADTETNAYADVVLPGALWTESPGVLVNSERVLTLARPVVEPPGEATADWRLIAAVAREMGYTEGFAYESAEQVFEEIKRAWNPKTGWDLRGVTYERLRSTPVQWPAARADGPARNPVRYVADGLVFPTASGRAVFHARPHLPAAELPDDDFPFVLNTGRVQHQWHTLTKTGKVAKLNKLNPGPFVEVHPRDAAALGVVDGDSVEVASRRGRAVLPAVVTDRVQPGCCFAPFHWNDLFGEYLSINAVTSDAVDPLSFQPEFKVCAVALARVASPPSALPVRSLDAAPPAPDGGLTASSAPAGQAEIFGLTPGPPPVLTARERQYLTGFLAGLGSGAPGVPVLPAEAPFSAEHALWVNGVLAGMYSRAATAEAPAKPPGREVVVLWASQTGNAEEFAAATAERLTATGHRATLVGMDDTDVAQLPRTADLLLITSTFGDGDAPDNGSGFWDALSAEAAPRLDGVRYAVLAFGDSSYDDFCGHGRRLDTRLDELGAVRLAPRTDCEPDYEPYAGAWLDQVLGALGTKTDAPKPARPRKPEPAIARLTGNRLLSLPGAGKEVRRFTFDTSGTGLTYEAGDALGVRPVNSPDLVDEWLSVTGLDHSTPVAVEGVGEVPFAQALHRHLDITHITPDLLRFVSEHAHDNRELKKLLRPDNKDGLAQWSWGRQAVDVVAEHPVRATAEEWAEVFKRLQPRLYSISSSPLVDPHLVSLTVSVVRYEDRLGRPRGGVCSPFLADAEHHTPVPVFVQRSPHFRPPADSSTPMVMVGPGTGVAPFMGFLQERRALGHRAPNWLFFGEQHRATDFYYEEELTALLADGTLTRLDTAFSRDQRAKVYVQDRIREHGPELWHWLQNGARFYVCGDASRMAKDVDRALRDIAVTHGGLTEAEATAYVKQLAAEKRYVRDVY

SEQ ID NO: 61669 - protein, 901 aa, Ustilago maydis 521
MKSSFKFSNLCGTVYQGGNVVFSADGDSIYSPVGNRLSIFNLVRNTSTTLPFETRKPIARIALSPANQAIVLVADEDGRALLINTLRRSLLAQMNFKQPLRDAQFSNDGKFLAVTYANQIKVWRTPSHLAREFVPFILHRTYTGHFDDVLSIRWTKNSRFFITTSKDMTARLYSLDQVEGFRPKTFTGHRDAVIGAYFSKDEKTIYTVSRDGACFAWQGKHNDDDSQDTDMHEDDEDIWQPTEGAKGGSSSRQADNAVGLTRWGVASKHYFLQTGAKTVCASFHQQGSLLVVGFSNGIFGLWEMPDFNPIHTLSISQEKITSVAINDSGEWLAFGAHRLGQLLVWEWASESYILKQQGHYYDMNTVGFASDGAVAATGGDDGKIKLWNTASGFCTATFSEHSASVSCIEFAKQGQVLFSASLDGTVRAYDLVRYRNFRTLTSPEPVQFVSLAVDPSGEVVCAGSADTFEIYMWSVQTGKLLDILSGHEGPVSGLCFSPDGSGVLASVSWDKTVRTWEVFRTTQSVETLTLNADGLAVAFRPDGREICASTLDGYLAFFDPLEGKQTGVVECRRDIAGGRKVNDKIARRNTASGACFTTVCYSADGACILAGGNANYVCLYDVKERVLLKRWELTKNLSLDGTQDKLDSRRVTEAGAIDLVDDREDEADLLPTERIDESLPGAQRGDATKRTTRAISRAKCVRFAPTGRSWAAASTSGLLIYSLDEQAAFDPLDLDMDLTPQAVREASARGEHLLAVVGACRLGEKPLMAEVYERTSAADILLVSQQLPLLHLPTVLRLIAERLQPSSGSPHVEFHLRWIAAIFSVRGAEIQSKASTDYAPVLRAVQVALNELRANVKRISDENLYSLLYVWNGVTKAEQSSRGQPTQAVASLGELMEVDAL

SEQ ID NO: 61670 - protein, 123 aa, Bacillus clausii KSM-K16
MKVVHTNEAPAAIGPYSQGMIVGNLFFSSGQIPLTPAGELVTGGVEEQTHQVFANVKAVLEEAGSSLEKVVKATVFIKDMNDFPRINEVYGSYFREHKPARSCVEVARLPKDVLIEVEVIATV

SEQ ID NO: 61671 - protein, 213 aa, Silicibacter sp. TM1040
MTSQTTAPHGPLRVGIGGPVGAGKTTLMAELARALKDHHSIGVITNDIYTQEDAEALMRQQILPQDRVIGVETGGCPHTAIREDASINLAAVAEMQNRHPEVEIVLIESGGDNLSATFSPELADVTLYVIDVAAGEEIPRKGGPAITRSDLLIINKTDLAPHVGASLEVMERDAKRMRNGLPFAFTALRHGEGVDTVLRHLFDIGGIDSGAVT

SEQ ID NO: 61672 - protein, 100 aa, Arabidopsis thaliana
MLVGMVDVIFSDVAQPDQARILALNASFFLKTGGHFVISIKANCIDSTVAAEAVFQSEVKKLQQEQFKPAEQVTLEPFERDHACVVGGYRMPKKQKTPAS

SEQ ID NO: 61673 - protein, 435 aa, Streptomyces avermitilis MA-4680
MRYGEATVTVVDPRSYMTYQPFLPETAAGSISPRHVVVPLRRVLPKAEVLTGRVTTIDQDRKVATIAPLVGEAYELPFDYLVIAMGAVSRTFPIPGLAEQGIGMKGIEEAIGLRNHVLEQLDKADSTTDEEVRRKALTFVFVGGGFAGAETIGEVEDMARDAAKYYNNVSREDMRFILVDAADKILPEVGPKLGQYGKEHLESRGVEIYLSTSMDSCVDGHVVLKNGLEVDSSTIVWTAGVKPNPVLSRFGLPLGPRGHVDTQTTLQVQGTDYIWAAGDNAQVPDMAARKAGVENAWCPPNAQHALRQARVLGDNVVSGMRGFPQKEYAHSNKGAVAGLGLHKGVAMIVMGKMKIKLKGRLAWYMHRGYHGLAMPTWNRKIRVFADWTLQMFLKREVVALGALESPREEFYEAAKPAPAPAAAVAPKTEEKAKAS

SEQ ID NO: 61674 - protein, 252 aa, Coprinopsis cinerea okayama7#130
MPAIHLNGTADQGANSHPQTQKKEGGEEPKGGPKTVLIVVMGVSGTGKSTLGSTLAKELRMEWIEGDDLHPKANVDKMSAGIPLNDADREPWLELIRTTAEQKIVELQSQSAKQEFEGGGKVQGVVVGCSALKVYYRDILRGLRRPASHPSNAQKLKEANGVDIPSDLLKPPLPEILPTFFVFINGPREVLYDRMEKRPGHFMKASMLDSQLNTLEPPTGEEGVITVSLESTTEEQVEVAKQALAEMLGMEL

SEQ ID NO: 61675 - protein, 428 aa, Streptomyces avermitilis MA-4680
MPSIDVVVAREILDSRGNPTVEVEVGLDDGSTGRAAVPSGASTGAFEAIELRDGDPNRYQGKGVEKAVLAVIEQIGPELVGYDATEQRLIDQAMFDLDATDNKGSLGANAILGVSLAVAHAASEASDLPLFRYLGGPNAHLLPVPMMNILNGGSHADSNVDIQEFMIAPIGAESFSEALRWGAEVYHTLKKVLKTKGLSTGLGDEGGFAPNLESNRAALDLIIEAIKQAGYIPGEQIALALDVAASEFYKDGKYEFEGKSRSAAEMTEYYEELVSAYPLVSIEDPLYEDDWAGWKVITDKLGDKVQIVGDDLFVTNPERLARGIEEGSANALLVKVNQIGSLTETLDAVELAQRNGFKCMMSHRSGETEDVTIADLAVAVNCGQIKTGAPARSDRVAKYNQLLRIEEILDDAAEYAGRSAFPRFRSAN

SEQ ID NO: 61676 - protein, 232 aa, Triticum aestivum
  misc_feature (183)..(183): Xaa can be any naturally occurring amino acid
  misc_feature (194)..(194): Xaa can be any naturally occurring amino acid
MAAATTTTSRPLLLSRQQAAASSLQCRLPRRPGSSLFAGQGQASTPNVRCMAVVDTASAPAPAAARKRSSYDMITLTTWLLKQEQEGVIDNEMTIVLSSISTACKQIASLVQRAPISNLTGVQGATNVQGEDQKKLDVISNEVFSKLLRWSGRTGVIASEEEDLPVAVEETYSGNYIGGFDPXLDGSSNFDAAXVSTGSIFRDSQAQSKKCHIGPTTQPLDKSDAIMGIRET

SEQ ID NO: 61677 - protein, 348 aa, Debaryomyces hansenii CBS767
MFSKLRGKDSKTETKKEQKVLGEKLYLPLTKASSKCTIPEAIGLNGEEQEKYDKVLKYFQQEDFKVAVSEANQKDKDSSKYKELSESEKAWLTRECFLRYLRATKWHYEDTISRIELTLAWRREFGIAGCYDSENEVNGKLCSPENETGKEVILGYDNDTRPCLYLKPGRQNTKTSLRQVQHMVYMLERVIDYMPSGQDSLALLIDFKASPLGTEGGKIPPVGTGRQVLHILQTHYPERLGKALLTNIPWLGWTFLKIIHPFIDPLTREKLVFDQPFPEYVPIEQLDKDFGGDLNFEYDHEKYWPEMIKIAESNKQKYMKRFENFGSKIGLSEYDLRGESEELVYPVA

SEQ ID NO: 61678 - protein, 380 aa, Oryza sativa (japonica cultivar-group)
MTSSPAARRRPPGPLALGLESSANKIGIGVVSLSGEILSNPRHTYVTPPGHGFLPRETAHHHLAHLLPLLRAALGEAGVTPADLACVCYTKGPGMGAPLQVAAAAARALSLLWGKPLVGVNHCVAHVEMGRAVTGAVDPVVLYVSGGNTQVIAYSEGRYRIFGETIDIAVGNCLDRFARVLELSNDPSPGYNIEQLAKKGEKFIDLPYVVKGMDVSFSGILSFIEATAIEKLKNNECTPADLCYSLQETLFAMLVEITERAMAHCDSKDVLIVGGVGCNERLQEMMRIMCSERGGRLFATDDRYCIDNGAMIAYTGLLAYAHGMTTPLEESTFTQRFRTDEVHAIWREKEMPVLTNIRAHAMAEVSKDEASVPTPIAVDS

SEQ ID NO: 61679 - protein, 492 aa, Alkalilimnicola ehrlichei MLHE-1
MNTLPEYLYTPAQVQELDRRAIQDHGLPGLSLMERAGRRGWEVLLKHWPHVRRLRVLCGGGNNGGDGYVVARLARRAGLGVRLQALSDPDRLNGDAATVARRFQEEGGQIESWDPTGLADEDVVVDALLGTGLDRPVEGRYREALQALKAAGVPVLAIDVPSGLNAGTGAVMGEAVEAHCTVTFIGLKPGLLTGAGPQCAGTLYFDDLGVPPEIYQDMAPVAGLCRDELLRRCLGPRPAHAHKGQFGHALVIGGDLGMGGAARMAGEAAGRTGAGLVSVATRPAHVAALLAARPELMVHGLDSAEGLAPLLEKATAWALGPGLGQGPWGRALWEAALRTEHPCVLDADALNLLAADPRPCPNALLTPHPGEAARLLGVTPAEVQADRLAAADALVERYRGAVVLKGAGSVIAAPGALPRLVTAGNPGMASGGMGDVLTGVVLGLLAQGLSAVEAAELGALVHARAADRAARAGERGLLAGDVLMALRAEVNP

SEQ ID NO: 61680 - protein, 479 aa, Geobacillus kaustophilus HTA426
MNEGQRTVVIIGGGITGLTAAYYLQKAIREQRLPLACKLVEATHRLGGKVQTVVRDGFVIERGPDSFLARKTSAFRLVKEVGLEHEIVHNATGTSYILVNGKLYPIPGGAVMGIPTRIAPFLTTGLFSPAGKLRAALDFVLPPVKVDGDMPLGRFFRRRLGDEVVDNLIEPLLSGIYAGDIDEMSLMATFPQFFQLEQKYGSLVRGARRTTPKEQKERKGAFQTLKTGLQSLVDEVEKRLEPGSVIKGVRVERIVRTDSAYRLQLSTGEVWGADGIIVTTPHHVVPDMFADYPFFAPFRSVPLTSVATVALAFPEEAIRQDIDGTGFVVSRRSDYTMTACTWTHKKWPHTAPPGKALLRCYVGRPGDEEIVDQPDDEIVRVVLDDLNKVMNIAGQPEFAVISRWKRAMPQYTVGHRERLAHIKRQMGDALPGVFLAGSSYEGLGLPDCIDQGEKAVRDVLLYLQQAPVQQTSDLYSSVR

SEQ ID NO: 61681 - protein, 147 aa, Medicago sativa
MSFTDKQEALVNSSWEAFKQNLPRYSVFFYTVILEKAPAAKGLFSFLKNSAEVQDSPQLQAHAEKVFGLVRDSAVQLRATGGVVLGDATLGAIHVRKGVVDPHFVVVKEALLKTIKEAAGDKWSEELNTAWEVAYDALATAIKKAMS

SEQ ID NO: 61682 - protein, 144 aa, Oceanicola granulosus HTCC2516
MLVHQILRSKANEGVLTLAPGKSVAEAVAFLSDKKVGAVVISEDGRVPLGILSERDIVRELGRRGAECLQDGVHDMMTDKLTTCTPHDSADQVLEMMTTGRFRHLPVMENDEMVGLISIGDVVKARLSELAMEKDALEGMIMGH

SEQ ID NO: 61683 - protein, 497 aa, Lactobacillus sakei
KMAAKIAVGLTLDEIYNPITGTTYAQFEPMLDYVVAKIPRWPFDKFNKGDRQLGTQMKATGEVMAIGRNIEESLLKAVRSLEIGTAHLELDGLTSVSDNDLVQRIIHPQDDRLFYLAEALRRGYLIQELAELTKIDLFFLDKISHIVELEEQLRSEKGDVELLEIVKKNGFSDEKIAKTWQITPIQVRQMRQESGIQPVYKMVDTCAAEFESQTPYYYTTYEQENESLVSAKPSILVIGSGPIRIGQGVEFDYATVHCVQAIQKAGYEAIIMNSNPETVSTDFSISDKLYFEPLTLEDVLNVVELEKPEGVIVQFGGQTAINLAAPLEENGVKILGTSVANLDRAEDRDLFDQLIQELNIPQPVGKTATNAPDALTIATEIGYPVLIRPSFVLGGRAMEIVHTPEDLTHYMQEAVKVSDEHPVLIDRYLMGKECEVDAICDGQEVLIPGIMEHIERAGVHSGDSMAVYPPQNLTEDQKAAIIDYTTKLCLALDCHGL

SEQ ID NO: 61684 - protein, 565 aa, Thermobifida fusca YX
MEPDRGCSPAAGEQTLTGVAASPGKATGPVAVLAAPPTLPPRRPAVTDPDAEIARATAALHQVADQFRRQAATVDGEAREILEAQALMASDPQLAAGIAERVRNGLAAEWALDEAVASYQELLRGAGEYVAGRAADLGDIRNRALAVLLDVPMPRPPVPGHPFVLVADDLAPADVARLDADTVLAIVTRVGGATDHTAILARSLGIPAVVGCAEAHQLCEGTPVTVDGDQGTVVVHSSAQQCTTQRHSRPQAARGLATGPGRTKDGQRVELLLNLGGEDPERAARHDCEGVGLLRTEFLFMDRVAEPTGAEQSAAYARVFRAFGGRVVTVRTLDVGADKPLAFLAQENEPNPALGVRGFRMVRTSPEVLRRQLAAVARAAQETRTRVRVMAPLVATPQEAADFVALAREAGIAEVGVMVEVPSAALLADRVVREVDFVSIGTNDLAQYTLAADRTRPALSDLLDPWQPAVLHLVGRVGAAGREAGRPVGVCGEAAADPLLALVFVGLGVTSLSMAAAALPVVRGALARHTVADCRKLAALAMDAAGPCEARETVRAAVDPAVLDA

SEQ ID NO: 61685 - protein, 591 aa, Oryza sativa (japonica cultivar-group)
MEEAAEDRRLQVREEGGDQEPLLLLPQDANLYTGDGSVDIKGRPALKHATGNWRACFFILGDECCERLAYYGIAKNLVTYLKTNLHQGNLEAARNVTTWQGTCYLTPLIGALLADSYWGKYWTIAAFSAIYFIGLVALTLSASVPALQPPKCSGSICPEASLLQYGVFFSGLYMIALGTGGIKPCVSSFGADQFDDSDPADRVKKGSFFNWFYFCINIGAFVSGTVIVWIQDNSGWGIGFAIPTIFMALAIASFFVASNMYRFQKPGGSPLTRVCQVVVAAFRKWHTEVPHDTSLLYEVDGQTSAIEGSRKLEHTSELEFFDKAAIISSDDAKSDSFTNPWRLCTVTQVEELKILIRMFPIWATTIIFNAVYAHNSSMFIEQGMVLDKRVGSFIVPPASLSTFDVISVIIWIPFYGRVLVPIARKFTGREKGFSELQRIGIGLALSILAMLSAALVELRRLGIARSEGLIHEDVAVPMSILWQIPQYFLVGAAEVFAAIGQVEFFYNEAPDAMRSLCSAFALVTVSLGSYLSSIILTLVSYFTTQGGDPGWIPDNLNEGHLDRFFSLIAGINFVNLLVFTGCAMRYRYKKA

SEQ ID NO: 61686 - protein, 591 aa, Triticum aestivum
  misc_feature (503)..(503): Xaa can be any naturally occurring amino acid
MAGRSRAPAFLLLGLFLGLAGSSPPPEPVECARGTSDCTVTNVYGSFPDRTICRAANATFPRTEKELVAAVAAAAASKRKVKVATRHSHSFTKLACPGGRDGTIISTERLNKTVSVDAAKGLMTVESGMVLKDLIQAAAAAGLALPHSPYWYGLTIGGLLATGAHGSSLWGKGSAVHEYVVGMRIVTPAPASQGFAVVRELSVGDPDLDAVKVSLGVLGVVSQVTLALQPMFKRSVTFEKRDDTDFAAQAAVWGGLHEFGDMAWLPRQGKVIYRKDDRVPVSTKGHGLNDYLGYRSNPTLALITDRATEERLEEDNSDIARCLAARVPSALFELQGYGFTNDGSFFTGWPVIGFQNRIQASGTCISSPEDGLLSSCTWDPRIRSPFFYNSGFSVALSKAPAFIAEMQKLRDLKPRAFCGLDAKLGVLLRYVRASSAYLGKSEDSIDFDVTYYRSYTEGEPRANSDVVDEIEQLALRKYGAVPHWGKNRNFVFDGVIAKYPKAXLVPQVKARYDPDGIFSSEWSDQVLGIKGSPNIVEKGCAIEGLCVCSKDSHCAPEKGYFCRPGTMFSEARVCSTRAAFGDESDDLLDEQ

SEQ ID NO: 61687 - protein, 194 aa, Triticum aestivum
  misc_feature (47)..(47): Xaa can be any naturally occurring amino acid
IRPTWQTPARTRFSPTHWLGGRQPLHGVRAALPAREANERETVIRAXRSGRLFFEPHATPATSSSILDEAKLKVKDSDTTTVTTCCGSGKVDKTAPFEGATALTMDSSNPYRDFRASMEEMVMSHGVKDWCWLEKMLGWYLRANGKSTHGLIVGAFVDLLVALSDTASPSSPTTATTNRSSSFSGTDEIKEEEG

SEQ ID NO: 61688 - protein, 585 aa, Oryza sativa (japonica cultivar-group)
MGSSLEAEQQSLIVRTTEPEDVDDYTGDGSVGFSGQPILKHETGNWRACSLILGTEVCERLAYYGISKSLVTYLSTRLHEGNVSAARNFTTWQGTCYLTPLIGATLADSYWGKYKTIAVFSTIYFLGMAALTFSALVPSLQPPQCFGSFCPQPTVPQYLIYFVGLYMIALGSGGIKPCVSSFGADQFDDTDPVERTKKGAFFNWFYFAINIGSLISGTVLIWVQQNCGYGIGFGIPTIFIALAIGSFFIGSQRYRYQIPGGSPLIRVCQVVIAAIHKRNVDLPVDSSVLYELHGKTSAIEGSRKLEHSSEFSFLDKAAVILSNERGGSHDPWRLCTITQVEELKILMRMFPIWATGIVFFTVCAQNSSMFIEQGMALNNQIESFKIPPATLSSLDVISIVVWVPIYETFVVPIASRLTGKERGFSELQRMGIGLFVATTAVATAALVEIKRLEIARSEDLIHSKVPVPMSILWQAPQYLLVGIGEVFTAIGQAEFFYNQSPDSMRSLCSAFALVTVSLGSYLSSFILTLVSYFTTRDDNPGWIPDNLNEGHLDRFFWLIAGLSFLNLLLFVYYAQQYKCKKAAAI

SEQ ID NO: 61689 - protein, 471 aa, Frankia sp. CcI3
MRVVIVGGGIAGLSAARALAGHAEVTVLDAADRVGGKLRTTPIEGLDVEEGAESFLARVPDGLRLARQIGLGHEIVHPATTSASLWIRGRLHPIPPNTLLGVPTDVLGLLRSRVLSPWGLVRAAADLVLPRTRFADDPTVGRYVGTRVGREVVDLLVDPLLGGVYAGRADALSLRATVPQLVPIFAEDRSLLLGAHRVRARTGPATTTSTAPLFATLRGGLGSFAARVAAQSGATVRTGVLVRSIAKTAGGWQVNCDRVGGADALGPFQADAVILAVPAGVARALLAPLAPHASAPLAGVPYASVGLVTLVYRDAAPPPGSGFLVPARAGTAVKAATFLSAKWPHLGSDRLTVVRASIGRAGAEQDLQRGDVELAGVAAAEIAQITGLSGRPVATRVSRWGGALPQYLPGHLNRIAAVRRGLPAGIALAGAGYDGVGIPACIRSGETAAHAVLRATRTAQGSPADPVGPGI

SEQ ID NO: 61690 - protein, 168 aa, Oryza sativa (japonica cultivar-group)
MAAVMVARQGRELQRYSDNTGGRMVVGCIPYRVRGDGGGVEVLVISSQKKGAAAGDVVMFPKGGWELDESVDEAARREALEEAGVLGEIGASLGRWCYRSRRYDATYEGFVFPLRVTDELDRWPEMAARRRSWVSPQQAMDRCPHWWMREALQRFADLFPQPTPLSLL

SEQ ID NO: 61691 - protein, 389 aa, Oryza sativa
EAMLPAVKLSPGPVAFAGTNLRSRSASVSSVSSLKPSKFVVSPLRPLYLAPLDGPRAAGQKAQRQPLEFRCAASAADDKESKTEVVPVRSEAAQKLKISIYFATWWALNVIFNIYNKKVLNAFPYPWLTSTLSLACGSAMMLVSWATRLVEAPKTDLDFWKVLFPVAVAHTIGHVAATVSMSKVAVSFTHIIKSAEPAFSVLVSRFLLGETFPVPVYLSLLPIIGGCGLAAVTELNFNMVGFMGAMISNLAFVFRNIFSKRGMKGKSVSGMNYYACLSIMSLVILTPFAIAMEGPQMWAAGWQKALAEVGPNVVWWVAAQSVFYHLYNQVSYMSLDEISPLTFSIGNTMKRISVIVSSIIIFHTPVRPVNALGAAIAILGTFLYSQAKQ

SEQ ID NO: 61692 - protein, 431 aa, Euglena gracilis
MPVIKTVKARQILDSRGNPTVEVDVILDNGLLGRGAVPSGASTGEYEAVELRDGDKAVYLGKGVLKSVEAVNTIVAPKLVGLDPTEQLKIDNLMRELDGTPNKGKIGANGILGVSMAVCRAAALVKGVPLYRHIGDLHGNKTFQMPVPMCNIINGGKHADNKIDFQEFMVMPVGAANFSEGLRWCAEIFHHLKSILKKAGHVTSVGDEGGFAPNLDNDEALDFVIAAIKAAGFEPGKQIAIALDCASSELFDEGDRKGYKYWKSNPDRLFSAAEMIEKYAGWVAKYPIVSIEDPLDQNDWDGYVNMTKQLGGKIQIVGDDFFVTNPTRFKKGIELAACNSILIKVNQIGTVSETLECIKMAQAAGYTAVASHRSGETEDAFIADLAVGTAAGQIKTGSLSRTDRMAKYNQLIRIEEELGGEAKWTTAMLRK

SEQ ID NO: 61693 - protein, 485 aa, Euglena gracilis
FFSILPIMANNTADIQYLRQHNIPELVNDLIQQLVTTKPAQPVAFLRDVLSKRKAVIKVVKARQILDSRGNPTVEVDVILDNGVVGRGAVPSGASTGEYEAVELRDGDKKVYLGKGVLKSVNAVNTLVAPKLIGLDPANQREIDELMKQIDGTPNKGKIGANGILGVSMACCRAAALTQGIPLWKHIANLHGNKDNFQLPVPMCNIINGGKHADNKIDFQEFMIMPIGAKSFSEGLRWVTEIFHTLKALLKKAGHVTSVGDEGGFAPDLSNDEALEFVMKAIKAAGYTPGTQIGVALDCASSELFDEGGRKGYKFWKSNPSKLFSAQEMIDIFCRWCDEYPIVSIEDPLDQNDWDGYVNMTKKMGRRTQIVGDDFFVTNPARFSKGIGMNACNAILIKVNQIGTVSETLECIKMAQAHGYGSIASHRSGETEDAFIADLAVGTGCGQIKTGSLSRTDRMAKYNQLIRIEEELGAQAKWTTKHLVR

SEQ ID NO: 61694 - protein, 335 aa, Oryza sativa (indica cultivar-group)
MPMFPGDVGPVMLAPPPPLPFFPIAAVQSGLGFMHMSAPPEIVTARSKLNSDAPSFSPRSPAASAAADEVEVRDVWAANLEEELRSIGALLPTYPVVSMDTEFPGTVHDVATPRHLRTPRESYAVVKRNVDELHLLQLGLALSGPAGRCPVAWQFNFAGFDARRDPHSGSSVAMLAAHGVDFTALRRHGIDHGDFARAFGRSKLACGRLTWAAFSGSYDFAYLVKVLTGGRPLPSTLEGFMAKVSKIFGPAVLDVKHLAKFCGGGGGIRGGLEHVAAALGVHRAAGRAHNAGSDSLLTSDVLHAMVDRFFPNSGVLNHAGAIDGLVKCSNLYYKY

SEQ ID NO: 61695 - protein, 145 aa, Nicotiana sylvestris
MASLATLTVVQPTTTIKGLAGSSIAGTKLHVKSSRLNLKPSKSRAGAVVAKYGDKSVYFDLEDLGNTTGQWDLYGSDAPSPYNSLQSKFFETFAAPFTKRGLLLKFLILGGGSTLAYFSSTASGDILPIKKGPQLPPKLGPRGKI

SEQ ID NO: 61696 - protein, 964 aa, Silicibacter sp. TM1040
MLRKKTNGVARRPQRTSILSKVGESAVDRRAFLRGSGLAIGGLAAISATGGTVTQANAAASATGAMETIKSVCTHCSVGCTVVAEVQNGVWVGQEPGWDSPFNLGAHCAKGASVREHAHGERRLKYPMKKEGGEWKRISWEQAIDEIGDGMMQIREESGPDSVYWLGSAKHNNEQAYLFRKFAAYWGTNNVDHQARICHSTTVAGVANTWGYGAMTNSYNDIHKSKAIFIIGGNPAEAHPVSLLHVLKAKEENNAPLIVCDPRFTRTAAHADEYVRFRPGTDVALVWGILWHIFENGWEDTEFIRTRVWGMDQIRTEVAKWTPEEVERVTGTPGSQLKRVARTLVNNRPGTVIWCMGGTQHTNGNNNTRAYCILQLALGNMGVSGGGTNIFRGHDNVQGATDLGVLSHTLPGYYGLSAGAWGHWGRVWGEDMDWLKGQFETVKGADGKDKNLMNLTGIPVSRWIDGILEDKENMDQPNNVRAMVLWGHAPNSQTRMTEMKTAMEKLDMLVVVDPYPTVSAVLHDRTDGVYLLPACTQFETRGSVTASNRSLQWRDQVVEPLFESLPDHVIMAKFANKFGWADRLFRNIEMEDAETPNIESITREFNAGMWTVGYTGQSPERIKLHMANQHTFDRTTLQAVGGPADGDYYGMPWPCWGTPEMKHPGTPNLYDMSKPVAEGGLCFRARFGVERDGENLLAEGVSNPGAEIQDGYPEFTMQMLMDLGWDGDLTAEERAAIDAVAGPKTNWKTDLSGGIQRVAIKHGCAPFGNAKARAVVWTFPDPVPLHREPLYTNRRDLVADYPTYEDRKFYRLPTMYASIQKNDVSKEYPIILTSGRLVEYEGGGDETRSNPWLAELQQDMFVEINPRDANDIGIRDGSQVWVEGPEGGKVKVMAMVTERVGAGVAFMPFHFGGHFQGKDLRDKYPDGADPYVLGESTNTAQTYGYDSVTQMQETKATLCKISAA

SEQ ID NO: 61697 - protein, 354 aa, Glycine max
  misc_feature (111)..(111): Xaa can be any naturally occurring amino acid
  misc_feature (144)..(144): Xaa can be any naturally occurring amino acid
PEVTHSEDGMETLRRFLFDVCGVGAGWKMEDVMEEEIKVIKETVGPDEHVICALSGGVDSTVAATLVHKAIGDRLHCVFVDNGLLRYKERERVMETFEKDLHLPVVCVDAXVSFLTKLKGVVDPETKRKIIGKEFICIFDAFAXELEGKLGKKPSYLVQGTLYPDVIESCPPPGTGRTHSHTIKSHHNVGGLPKDMKLKLIEPLKLLFKDEVRQLGRILDVPVAFLRRHPFPGPGLAVRVLGDVTEGNALDILRQVDEIFIQSIKDAGLYDSIWQAFAVFLPVRSVGVQGDQRTHSHVVALRAVTSQDGMTADWYYFEHKFLDDVSRKICNGVRGVNRVVQDITSKPPSTIEWE

SEQ ID NO: 61698 - protein, 145 aa, Nicotiana sylvestris
MASLATLAAVQPTTAVNGLAGSSIIGTKLHVKSSRLNLKSTKSRAGSVVAKYGDKSVYFDLEDLGNTTGQWDLYGSDAPSPYNSLQSKFFETFAAPFTKRGLLLKFLILGGGSTLAYFSSTASGDILPIKKGPQLPPKLGPRGKI

SEQ ID NO: 61699 - protein, 117 aa, Brassica napus
  misc_feature (30)..(30): Xaa can be any naturally occurring amino acid
  misc_feature (32)..(33): Xaa can be any naturally occurring amino acid
  misc_feature (40)..(41): Xaa can be any naturally occurring amino acid
  misc_feature (48)..(49): Xaa can be any naturally occurring amino acid
  misc_feature (58)..(58): Xaa can be any naturally occurring amino acid
  misc_feature (61)..(61): Xaa can be any naturally occurring amino acid
  misc_feature (75)..(75): Xaa can be any naturally occurring amino acid
  misc_feature (80)..(80): Xaa can be any naturally occurring amino acid
  misc_feature (96)..(96): Xaa can be any naturally occurring amino acid
  misc_feature (99)..(102): Xaa can be any naturally occurring amino acid
  misc_feature (105)..(105): Xaa can be any naturally occurring amino acid
  misc_feature (108)..(108): Xaa can be any naturally occurring amino acid
  misc_feature (112)..(112): Xaa can be any naturally occurring amino acid
  misc_feature (114)..(114): Xaa can be any naturally occurring amino acid
HDFRWDHGATGVISVVSNLVPGLVRKLMFXGXXSALNAKXXPLVDWVXXEPNPIGVNXALXQLGVARPVFRLPYXPLPVXKRVEFVKLVEEIGREXFVXXXXVQXLDXDDFXLXGRY

SEQ ID NO: 61700 - protein, 114 aa, Bacillus subtilis
IINTASITAYKGNKTLIDYSATKGRIVTFTRSLSQSLVQQGIRVNAVAPGPIWTPLIPASFAAKDVEVFGSDVPMERPGQPVEVAPSYLYLASDDSTYVTGQTIHVNGGTIVNG

SEQ ID NO: 61701 - protein, 205 aa, Escherichia coli O157:H7 EDL933
MNIIKQPLRVGVGGPVGSGKTALLEALCKSMRDTWQLAVVTNDIYTREDQRILTEAGALEAERIVGVETGGCPHTAIREDASMNLAAVEALSEKFGNLELIFVESGGDNLSATFSPELADLTIYVIDVAEGEKIPRKGGPGITKSDFLVINKTDLAPYVGASLEVMERDTLRMRGERPWGFTNLKSGEGLQNIIAFIEEQGMLGK

SEQ ID NO: 61702 - protein, 317 aa, Photorhabdus luminescens subsp. laumondii TTO1
MTDKLTSLRKLTTVVADTGDIAAMKLYQPQDATTNPSLILNAAQIPEYRKLIDEAIAWAREQSDSREQQIVDASDKLAVNIGLEILKLIPGRISTEVDARLSYDSERSVAKAKRLIKLYNEAGISNDRILIKLASTWQGIRAAEQLEKEGINCNLTLLFSFAQARACAEAGVYLISPFVGRILDWYKANSDQKEFAPHEDPGVISVTEIYQYYKQHGYDTVVMGASFRNSGEILELAGCDRLTIAPALLKELSEAQGEVERKLGYAGEIKARPEPLNEAQFYWEHHQDAMATEKLADGIRKFAIDQGKLEKMISDLL

SEQ ID NO: 61703 - protein, 289 aa, Xanthomonas axonopodis pv. citri str. 306
MAAARLRTLTAAALRAMPLPSPGGDKEQRGRVLVVGGSMRVPGAALLAGEAALRAGAGKLQIATAASVAPAMALAVPEALVLGLGQNGQGEITRGHRALDAALAACDAAVIGPGMASTTTATALVKLAAAKAVCPLVLDAGALSRSLRAPPGRPFVLTPHAGEMATLAGDDKAAVEAAPGEYALAFAQKMRSVVIVKGADSFIAGPDGALWVHRGGVPGLGTSGSGDTLAGLIAGFAARGSDALTAALWGVFVHAVAGKQLSRRIGTVGFLAREIPQEVPGILDRLSRK

SEQ ID NO: 61704 - protein, 140 aa, Bacillus subtilis
EVNVFSLYWVVKAALPYLPEGASIITTTSVEGYNPSPMLLDYSATKNAIIGFTVGLGKQLASKGIRVNSVAPGPIWTPLQISGGQPTENIPKFGQGTPPAPLNRAGQPVELADVYVFLASENSSYVTSQVYGITGGIPTA

SEQ ID NO: 61705 - protein, 369 aa, Arabidopsis thaliana
MSPIPERAKLHIAMVVFQTGYAGNHVIMRYALNLGVSKLVFPLYRTIVAFSVLAPSAYFLEKKERPAMKISFLIQFFLLGLVGITLNQGFYIFGLDNTSPTFASATENVVPAVSFLMAALLGIEKVEWKRKDGIAKVVGTIVSVAGSLVITLYKGPTIYQPSLNIVNQTIKPEEAEEENKNWTLGCLCLMGHCLCWSSWIVLQSPLLKKYPARFSFVSYSCFFAVIQFFGISAYFERDLERWKIISGGELYALLYTGLVGSAMVFAIQIYVVERGGPLFVSAYLPLQTLIAAVLATLALGEHFYLGGLIGAILIMSGLYLVVMGKSWENQALCQQQQHMISSAASDFGDEEDYHNNKPRSPISQPLISS

SEQ ID NO: 61706 - protein, 404 aa, Azoarcus sp. EbN1
MIAGKSVLAFVMAGGEGSRLHPLTAERSKPSVPFNGRHRIVDFVLSNLVNSEIYSIYLLVQYKSQSLIEHTRRAWVMSPLLPHHFVTVVPPQMQHGPEWFQGTADSVYQNLHLVELVKPDLVVVFGADHVYRMDLRQMIEFHIATQADATVAALPVPLEHTSSFGIIRTDSAGRIRDFREKPESAEPMPGRPGHALASMGNYVFSADLLVDALRRAHSRGGHDFGKNLLPAMAERNRVMAYDFTTNRMRGIRDYEEPAYWRDVGTIDAYYDANFDTLGEFPKFCMSNPHWPIYANPDQTEAAQVHDGHIRTASLGAGVVIRRAVIERSLLRREVVVEEGAEVVDSIIMDRSVIGKGARVRRAIIDQYNFVPPGMKIGYDPEADRQRFHISESGVVVVGKGQLKP

SEQ ID NO: 61707 - protein, 433 aa, Nicotiana tabacum
MAGQTVIVSGLNPAAILQSTIGGGASPTAAAAAENGTRKVIPLSRDALQDFMLSIITQKLQDEKQPFYVLDLGEVVSLMDQWKSALPNIRPFYAVKCNPEPSFLSILSAMGSNFDCASRAEIEYVLSLGISPDRIVFANPCKPESDIIFAAKVGVNLTTYDSEDEVNKIRKHHPKSELLLRIKPMLDGNARCPMGPKYGALPEEVDPLLRAAQAARLTVSGVSFHIGSGDADSNAYLGAIAAAKEVFETAAKLGMSKMTVLDVGGGFTSGHQFTTAAVAVKSALKQHFDDEPELTIIAEPGRFFAETAFALATTIIGKRVRGELREYWINDGLYGSMNCVLYDHATVNATPLAVLSNRSNVTCGGSKKFPTTVFGPTCDAFDTVLRDYQLPELQVNDWLVFPNMGAYTKAAESNFNGFNNSAIVTHLAYFYPS

SEQ ID NO: 61708 - protein, 767 aa, Azoarcus sp. EbN1
MMGGLMHGFLASMKEGLPYPLGATWDGEGVNFALFSAHATRVELCLFDDSGRIEVTRVDLPEFTDEIWHGYLPGAGPGLVYGYRVHGPYVPEQGHRFNPHKLLLDPYAREVVGRLRWGSALFAYELRGKKPGHGFDKRDSAPFMLKARVVAPAPELPLPGRPRVPWERTVFYEAHVRGLTRLHPAVLARLRGSFAGLGSPVIIEHLKSLGVTSVELLPIHLFVDDTHLTEKGLRNYWGYNSLGFFTPDPRYLAGRAVVEFRDMVARLHDADLEVILDVVYNHTAEGNELGPTFSFKGLDNVSYYRLNPDEPCYYINDTGTGNTLDVNHPRVLQMVLDSLRYWVLQMGVDGFRFDLATILGREAHGFDPGSGFFDACRQDPVLNRIKLIGEPWDCGPGGYQLGAFPPGWGEWNDSFRDAVRSFWKGDEGRAPELATRLSASADRFNRRGRRPWASINFITAHDGFTLHDLVSYNDKHNEANGEDNNDGHDDNRSWNCGAEGPTDDPDIIELRERQKRNLLATLLFAHGTPMLLAGDEFGRTQRGNNNAYCQDNDISWANWEEIDARGERLLAFARHLLVLRDALPVLRPGRFSTGEMHPVHEVRDVAWLTPAGAELEEKEWADPQMRCFGMLADGRAQHTVVPHPGSDVIVLLVVNAGHEAVEWTLPHVRGAGHWTRLVNTESPDDPAFPAFVAGHRVPLGARSLLLFAAAADKPSAIFIDGLLVGLTARGTRSRLQVDETDGDGAGDGQGGGQGGGQGQGGGDAQPD

SEQ ID NO: 61709 - protein, 472 aa, Oryza sativa
MVRDFATDESHGERGMSVLKLRLDGVRSAYDAAAAELETAKRAREDAEQELGGNQVQVAIAVVSIHGLEATISHLQEEISQVRSDLDALKGKGDIERDEFISQMDQLNTKIRKFQQMVSVELNGKKCSELSSGEGQQVTDWSEVIELEGSFEELNGNVSNADSERFVIVNGHVILAQHLLLFLLFICYQHILLYRFVGLSHFPYYHLFRRYVGACLHRPGSPSRLSMAKSGFSSGDAERGLRGRGGGRERTSARVRGTGGDSAAVADGDGNRHRGVAGKGGGSLYEGRKGLERLRECESLPSTTRRDVFRCSAAAALTGGDARLDGVNCPDARGPCALTTAAGATPPEWAERRPAVSVDYDRGQREARAEVEGVGAVAFPARHRLRVEGSRWQRDWKVLEAAARVLAIPRAEAGAVDAVLNCWAGRFARGNFPLLIRPTPLSAAAAATAVSLPTAPEAAPAPPSPHTHVYPR

SEQ ID NO: 61710 - protein, 321 aa, Mycoplasma penetrans HF-2
MYNQNTFKVIKELKNMYILSIETSCDDTSVAILEDNKVLSCIIKNDSKQLNPFGGIVPEIVARYHEENIIKALDLALQESNISLNQIDKVAYTNQPGLPGSLFVGEIFAKTMAYALDVECVPINHIHGHILSPFINSVPKYPFMSLIASGKTTSIFLVKSANEIIELTKTRDDAIGEIFDKVGKALGYDYPAGPKLDKYFDISKATITPSFPPVKNDFSFSGIKNKFLSIINSSKMKNEEIDTITIGSSFLKYSIDLIIKKLKYYKDEYSVDCVCIGGGVANNNYFKQEIKKLFSDSFVPESKYSTDNAAMIGFAYYEKNK

SEQ ID NO: 61711 - protein, 776 aa, Frankia sp. CcI3
MKRPRPANTVRPVGFGRMSQVWPGSPYPLGATYDGSGTNFAIFSEVADRVQLCLFDDAGNEERIDLRERDAFVWHAYLPTVGPGQRYGYRVHGSYDPARGLRCNSTKLLLDPYAKAVDGEVAWDQAVFPYTFGDPDSVNDADSGPHMMKSVVISPFFDWNGDRPPRRPYNESVIYEAHVRGLTKNHPGLPEEYRGTYAGVAHPVMIDHYRKLGVTAIELLPVHQFVHDEHLVSRGLRNYWGYNSIAFLAPHSGYSASGGHGRQVQEFKGMVKNLHEAGIEVILDVVYNHTAEGNHMGPMLCFRGIDNSAYYRLVDNRPQYYMDYTGTGNSLRVRHPHVLQLIMDSLRYWVTDMHVDGFRFDLAATLAREFYDVDRLSSFFDLVQQDPVVSQVKLIAEPWDLGEGGYQVGNFPPLWTEWNGKYRDTVRGFWRGQDHGIAEFASRLTGSSDLYENSGRRPWASINFITAHDGFTLHDLVSYNEKHNEANGEDNRDGSDDNRSWNCGVEGPTDDPTVLSLRAAQTRNLLTTLLLSQGVPMLVAGDEMGRTQQGNNNAYCQDNPISWLDWSDAERNADLIEFTGMLSRLRHDHPIFRRRRFFQGKSLRGQGGTTHGAAEAVTGGQAGGQDADGSGGRSGDDPAVKDDPAVKDIAWLRPDGTEMSDSDWESGTARSLGVYLNGEGIPDPDALGQAIIDDSFLLFFNAHHEPVGFQAPATSFGSSWEIVVDTRASTAEVDARLSDTALLHSALDPASMGRAVKAGDPIELDARSTVVLRRVS

SEQ ID NO: 61712 - protein, 567 aa, Oryza sativa (japonica cultivar-group)
MASSALICDTEQWKGLQAHVGAIQKTHLRDLMDDAERCKAMTAEYEGIFLDYSRQRATGETMEKLFKLAEAAKLKEKIEKMFSGDKINSTENRSVLHVALRAPRDEVIKSDGVNVVPEVWGVKDKIKQFSETFRSGSWVGATGKALTNVVSVGIGGSFLGPLFVHAALQTDPEAAESAKGRQLRFLANVDPVDVARSIKDLDPETTLVVVVSKTFTTAETMLNARTLKEWIVSSLGPDAVAKHMIAVSTNLELVEKFGIDPKNAFAFWDWVGGRYSVCSAVGVLPLSLQYGFPIVQKFLEGAASIDKHFRSSSFEKNIPVLLGLLSVWNVSFLGYPARAILPYSQALEKFAPHIQQLSMESNGKGVSIDGVQLSFETGEIDFGEPGTNGQHSFYQLIHQGRVIPCDFIGVVKSQQPVYLKGEIVSNHDELMSNFFAQPDALAYGKTPEQLHSEKVPEHLISHKTFQGNRPSLSLLLPSLSAYEIGQLLSIYEHRIAVQGFLWGINSFDQWGVELGKSLASQVRKSLHASRMEGKPVQGFNSSTASLLTRYLAVEPSTPYNTTTMPKV

SEQ ID NO: 61713 - protein, 356 aa, Bartonella henselae str. Houston-1
MLWIKFIYVHYNTLGVKILRAAIKSDQIKNNPISLQSLVNLTKDDMEHVNQCIFSMAKSDVEIIPEISNHLISSGGKRLRPMLTLASARMFGYQNDGHIKLATAVEFMHTATLLHDDVIDESNLRRGKSTARMIWGNQASILVGDFLLGQAFKMMVDVGSIEALSVLANAAAIIAEGEVMQLSATKNIETSISDYLKIINAKTAALFSAAAEVGPIIAGYGHEERLALREYGTFLGLAFQLIDDALDYGGTAKYLGKNIGDDFREGKITMPVILAYARSNAVEKTFWKQALENGNSNDETFAHAQHLIEKYDSLTDTIEQARSYGKNATHALAAISESPIHNALIETVDFCIARVN

SEQ ID NO: 61714 - protein, 475 aa, Gibberella zeae PH-1
MATATAAGKNASPFPDGTKDYVPLRAGAAKKDTNKPHISDTPMTWSNWPQHINWLNTTLVVFVPLMGFISAYWVPLQLKTALWAVFYYVHTGLGITAGYHRMWSHSAYKGTTPLKIYLAAVGAGAVQGSIRWWSYGHRVHHRYTDTDKDPYSVRKGLMYSHMGWMVLKQNPKRQGRTDITDLNEDAVVVWQHKNYIKCVLFMALAFPAIVAGLGWGDWWGGLVYAGILRVCFVQQATFCVNSLAHWLGDQPFDDRNSPRDHVITALVTLGEGYHNFHHEFPSDYRNAIEWWQYDPTKWSIWLWKQLGLAYELKEFRANEIEKGRVQQLQKKLDQKRATLDWGIPLEQLPVVDWDDFVAQSKAGKGLVAIAGVIHDVTDFIKDHPGGKALINSAIGKDATAIFNGGVYLHSNAAHNLLSTMRVGVLRGGCEVEIWKRAQFENKDITYMNDSAGQRIIRAGSQATKIVQPAASADAA

SEQ ID NO: 61715 - protein, 290 aa, Oceanicola granulosus HTCC2516
MLLGTAAQADLTATANVRLGGDALVDADVDVDKNNHNIAEADANVLNRNGTTNARARLGGSSDNGGSGGGSGGSGGGSGGGSGGSGGGSGGSGGSGGGSGGSGGSGGSGSGGSGGGSGGSGGGGSSSGGGSGSGGGSGSGGGGGGSSAGSGGGNDSAGNNGNRNRNRNNGNRNRSAVRSESDRGSDRHDAQRRAQTRAFLESGGQAATGADQGVNLQAILGQRVYSADSYFVGEVARIDGSRGDTVALRVHLNGALGVNRSQAVVEVWPSQIRPDGVWLHMSADALRSYF

SEQ ID NO: 61716 - protein, 300 aa, Xanthomonas axonopodis pv. citri str. 306
MSSTKNQYEMQNPLTQFPQPQFPEQTQQAPGTIHALQPKADHGEQSYKGFGRLQGRKALVTGADSGIGRATAIAFAREGADIVLNYLPEEEQDAAEVVQLIQAEGRKAISVPGDLKNEAFCTELVDRAVKELGGLDVLVNIAGKQTAVKDIADITTEQFDATYKTNVYAMFWLCKAAIPHLPPGASIINTGSIQSYQPSPTLLDYASTKAAIVNFTKGLAQQVAEKGIRVNAVAPGPVWTPLQPSGGQPPEKIPDFGSETPLKRAGQPVEMAPLYVILASQESSYVTGEVFGATGGLLLS

SEQ ID NO: 61717 - protein, 322 aa, Gossypium hirsutum
SINGWCLTSSSSSTTTSSFSARRRPTLRPSVVASLNSSPSPPTLIQDRPVFAAPVPLLTPREEMGNKSYDEAIEALKKLLSEKGELKAEAAARVDQITAELNTTSADGKPSDSSVERLKEGFVYFKKEKYEKNPALYGELAKGQSPKYMIVACSDSRVCPSHVLDMQPGEAFVVRNVANMVPPYDQIKYAGIGSAIEYAVLHLKVQEIVVIGHSACGGIKGLMSFPLDGNNSTDFIEDWVKIGIPAKAKVLAEHGGEPLGVQCTHCEKEAVNVSLGNLLSYPFVRDGLVKKTLGIKGGYYDFVKGSFELWSLQFQLSSSLSV

SEQ ID NO: 61718 - protein, 122 aa, Oceanicola granulosus HTCC2516
MTTATAEDQIRDTVTSNDVVLFMKGTKTMPQCGFSSRVAGVLNYMGIDYADVNVLADDAIRQGIKDYSDWPTIPQLYVKGEFIGGCDIITEMTLSGELDQLFEAKGVAFDKDAADKIREANG

SEQ ID NO: 61719 - protein, 102 aa, Mycoplasma mycoides subsp. mycoides SC str. PG1
MADIIKITSKEQFDKEIKEGKVLVDFNATWCGPCKMLAPILHDFAKKVDGVKFLDVDVDLNRQVAEKFRIMSIPTLITFENGNQVNKHIGFATPDQLKKLID

SEQ ID NO: 61720 - protein, 319 aa, Gossypium hirsutum
GWCLTSSSSTTTTSSFSARRRPTLRPSVVASLNSSPSPPTLIQDRPVFAAPIPLLTPREEMGNKSYDEAIEALKKLLSEKGELKAEAAARVDQITAELNTASADGKPSDSSVERLKEGFVYFKKEKYEKNPALYGELAKGQSPKYMIVACSDSRVCPSHVLDMQPGEAFVVRNVANMVPPYDQIKYAGIGSAIEYAVLHLKVQEIVVIGHSACGGIKGLMSFPFDGNNSTDFIEDWVKIGIPAKTKVLAEHGGEPLGVQCTHCEKEAVNVSLGNLLSYPFVRDGLVKKTLGIKGGYYDFVKGSFELWSLQFQLSSSLSV

SEQ ID NO: 61721 - protein, 372 aa, Photorhabdus luminescens subsp. laumondii TTO1
MAKRDYYEVLGVSKTASEKEIKKAYKRLAMKYHPDRNQGDKEAESQFKEVKEAYEILTDDQKRAAYDQYGHAAFEQGGMGGGGADFSDIFGDVFGDIFGGGRRQQRPSRGADLRYSMELTLEEAVRGVTKEIRIPTLETCDICHGSGAKAGTSPVTCSTCQGAGQVHMRQGFFTVQQPCPHCHGRGQIIKDSCHKCHGHGRVERYKTLSVKIPAGVDTGDRVRLSGEGEAGAKGAPAGDLYVQVQVKSHHIFERQESNLYCEVPVNFAMAALGGEIEVPTLDGRVKLKIPAETQTGKMFRMKGKGVKSVRGGVQGDLLCRVVVETPVKLNERQKELLRELGESFGGAGEETNSPRSKSFFDGVKKFFDDLTK

SEQ ID NO: 61722 - protein, 334 aa, Silicibacter sp. TM1040
MTLKIAINGFGRIGRNVLRALLENDTTDVEVVAINDLAPPATQVHLLKFDSVHGRLDAEVTVEGDTMKVGRHEIRLTAIRNPEELPWSDVDIAYECTGLFTTRDKAAAHLKNGSKRVLISAPGTEVDRTVVFGVNDRDLTAEDIVVSNASCTTNCLAPVAKVLDDAFGIKTGYMTTIHAYTGDQPTHDTTHKDLYRARAAALSMIPTSTGAARAISLVLPHLKGRLEGSAIRVPTPNVSVVDLTFQPERVASVEEINAAIAAAAKEGPLQGILGYEEAPLVSIDFNHDKRSSIFAAPQTAVTSEGLVRVVSWYDNEWGFSNRMIDTGRAMGKFL

SEQ ID NO: 61723 - protein, 432 aa, Synechocystis sp. PCC 6803 [sequence omitted]

SEQ ID NO: 61724 - protein, 109 aa, Alkalilimnicola ehrlichei MLHE-1
MDQVQETIAKQVKENPILLYMKGSPQQPQCGFSMRAAQALAGCGKEFAYVDVLQDEAIRQGIKEFGNWPTIPQLYLNGELVGGCDIIMEMYESGDLQKMVDQAAESASN

SEQ ID NO: 61725 - protein, 464 aa, Zea mays
MPPSADAMPAPGDAACAGDVRLISSKELREHASAADLWISISGDVYDVTPWLPHHPGGDLPLITLAGQDATDAFAAYHPPSARPLLRRFFVGRLSDYTVSPASADYRRLLAQLSSAGLFERVGPTPRVQLALMAVLFYAALYLVLACASASAHMLAGGLIGFVWIQSGWMGHDSGHHRITGHPLLDRVVQVLSGNCLTGLSIAWWKCNHNTHHIACNSLDHDPDLQHMPLFAVSPKLFGNIWSYFYQRTLAFDAASKFLISYQHWTFYPVMCIARINLLAQSAVFVLTEKRVPQRLLEIAGVAAFWAWYPLLVACLPNWWERVAFVLLSFTICGIQHVQFCLNHFSSDVYVGPPKGNDWFEKQTAGTLDILCPPWMDWFHGGLQFQIEHHLFPRLPRCHLRKVAPAVRDLCKKHGLTYSAASFWDANVLTWKTLRAAALQARSATGGGGGAPKNLVWEALNTHG

SEQ ID NO: 61726 - protein, 56 aa, Glycine max
MPATAGRVRMPANNRVHSSAALQTHGIWQSAIGYDPYAPNKEDKRDSSQNLPNAEP

SEQ ID NO: 61727 - protein, 530 aa, Mycoplasma penetrans HF-2
MTNNIFKYFNIKELEKFGKFYKVKKEYEIPKKLESKLILVTSINPTPEGEGKTTTLIGINDCLNYFGKESIACLRQPSMGPYFGIKGGATGSGKCEIQNPEKVNCGFTNDFYAIEAANNLIMSVIENEIYFNTDLEIDPQKIIWKRCIDINDRSLRDINYQVSKNTKINSSFSITAASNLMALFCLAKSKSDFKKRIENTLVAFSKSNKAIYVKDLNIIDSIMLILDDALKPNLVFSQDNNPIIMHGGPFANIAHGCNSVIALSCGLNKAEYVLTEAGFGSELGAEKFINILCRETNLVPNLVVLTITLKAIKYHGVNNSNNTSPLTDEKEKIDIGFNNVIHHFNLLKNLNLNVCIVINKFSDDNKNELDYLFNKSSELTKTVISTMWQDGASKNKSLFETIIESVQEPKPINWTYDLKDNAVNKINDLSTKVYNGATITYSDLATAKLKDNENWIQDYYVCGAKTPYSPSIKNEYMDTNKHDIHVEDIEINHAVKFIIPIFSKTFLMPGLPKVPNAKKIKINFDKFKYE

SEQ ID NO: 61728 - protein, 473 aa, Azoarcus sp. EbN1
MQTSTVGTAALAYFLGTPGQDFLPEDDERRDKPTSNPAWPGACTDTTSHRIVIVGGGAGGLELAARLGDGVGRRGEAEVVLIDPMPAHLWKPLLHEIAAGTRSPHEQALDYLQQARQHHFRFHPGRIEGLVRHRREIWLAPLIDEEGVEMAARRQLRYDTLVIAIGATDDDFNTPGVRRHAISLNSAADAEHFRSRLLSLCAGAGQDAARPVQLVIVGGGTTGVEFADELTGAVEEIASCGYLLRQVGEPVKIRMIEASDRLLAPLPAEAAERIHRELVRRGIDVRLNRRVAEVRHDSVLLGNGEILAADLVVWTAGIRGPEVLASLGALDTNERQQLLVRTTLQTFRDDNIFAIGDCANCVSSEGDTLAPPLARAAQQQAKLLAHSLERRLAGKSLIPFRYREHGALSPGRNEGPAGDTSRDRNGVGGLFARLSYWMLYRRHLAVLLGGMRTLLMTVGEWLPRRARPRLKLH

SEQ ID NO: 61729 - protein, 147 aa, Zea mays
MATSSSSLTTLHSRFFSPTPSSPYMAALPRRRRAGARYPRIRAIDLDQNTIVAISVGVVSIAVGIGVPVFYETQIDNAAKRDNTQPCFPCSGSGAQVCRFCSGKGIVTVVLGAGETEESQCVNCEGIGSLTCTTCQGTGNPQPPAIF

SEQ ID NO: 61730 - protein, 117 aa, Brassica napus
EEGLSLTCSIQLLGFCVFEACVGIFWPSIMKMRSQYIPEEARSTIMNFFRVPLNIFVCIVLYNVDAFPITIMFGMCSIFLFVASILQRRLMVISEKPKGEEWSPMKDRNSEVDPLTL

SEQ ID NO: 61731 - protein, 116 aa, Glycine max
MDQGDVAVAVPPAAPSSSCGGAGCKKGKRFEIKKWNAVALWAWDIVVDNCAICRNHIMDLCIECQANQASATSEECTVAWGVCNHAFHFHCISRWLKTRQVCPLDNSEWEFQKYGH

SEQ ID NO: 61732 - protein, 720 aa, Xanthomonas oryzae pv. oryzae KACC10331
MATRKFTQRSRIREGRPNSLGATWDGLGVNFALYSRNATRVELCLFDDRGREQERIALPEYTDEVWHGYLPDARPGQLYGYRVHGPYAPDAGHRFNHNKLLLDPYAKQIVGELKWAPHLFGYIIGHRDKDLSFDRRDSAAFMPKSAVIDPAFTWGQDRPPQTPWNRTVIYEAHVRGLSMLHPAVPPEERGTFSALKTDELIDHISSLGVTAVELLPVHAFVDDQYLLENGLRNYWGYNTLGFFAPQARYMSTRTVAEFKQMVARLHHAGLEVLLDVVYNHTAEGNELGPTLSFKGIDNASYYRLADDRRFYINDTGTGNTFDLTNVGALRMVMDSLRYWVQEMHVDGFRFDLASILGRERYGFDPSGSFLDAVRQDPVLSQTKLIAEPWDIGPGGYQVGNFPPGWVEWNDKFRDNVRAFWRGDGGQLAELATRLTGSADLFNHSGRRPTASVNFVTAHDGFTLRDLVSYEGKHNLANGEDGRDGSDHNISCNYGVEGETNDPTIKQLRRQQMRNLLATLLLSQGTPMLLAGDEFGHSQNGNNNAYCQDNELTWIDWTAATKAAAADQAAFVRRLIRIRQRYPLLHRARFFDGKFDEALGLKDLTWLAPDGHEMDEAGWHDPEARALMLRLDGRSPATGLREIAANVTLLMLINAASTSVSFTLPAMHDEHWRVLVDTARHGGRVVAGGSEWKASAHSLTLLAVERDRIISSARIVSEGAR

SEQ ID NO: 61733 - protein, 393 aa, Triticum aestivum
MSLPLTRKDLMIVNMGPQHPSMHGVLRLIVTLDGEDVIDCEPILGYLHRGMEKIAENRTIIQYLPYVTRWDYLATMFTEAITVNAPEFLENIQIPQRASYIRVIMLELSRIASHLLWLGPFMADLGAQTPFFYIFRERELIYDLFEAATGMRMMHNYFRIGGVAADLPYGWIEKCLDFCDYFLRGVVEYQQLITQNPIFLERVEGVGFISGEEAVNWGLSGPMLRASGIQWDLRKVDPYESYNQFDWKVQWQKEGDSLARYLVRVGEMRESIKIIQQAVEKIPGGPYENLEVRRFKKEKNSEWNDFEYKFLGKKPSPNFELSRQELYVRVEAPKGELGIYLVGDDSLFPWRWKIRPPGFINLQILPQLVKKMKLADIMTILGSIDIIMGEVDR

SEQ ID NO: 61734 - protein, 173 aa, Flavobacteria bacterium BBFL7
MNNEFIESHIHDIPDFPKEGIVFKDISPLLASAKARSITTELLVRDFRGQTIDVVVGIESRGFLFGMLLADALNAKFVMLRKPGKLPGAIISQKYELEYGTDTLELQENAISPGDCVLIHDDVLATGGTAIAAAQIIQKAGGKVEGFNFVIELDFINGREKIKDYKIASVLHY

SEQ ID NO: 61735 - protein, 116 aa, Synechococcus sp. PCC 7002
MDLKSLIRDIPDFPKPGILFRDITTLLNHPEGMRYTMDALVQLCLEANLKPDHVVGMESRGFIFGPTLAYNLNAGFVPVRKPGKLPAAVHTVEYELEYGTDTLEIHQDAVGSGDKI

SEQ ID NO: 61736 - protein, 368 aa, Zea mays
MKRKENSAHSAPPLNRPRGKRKALAELPKSNGLNMNHDSAPRPSKPRTRSAARAEAEAEAAMKRRKAGDAARWPMDTRQPDAEAAVAPYVGDIDRYLRSLEVEPLRRPSHSYFQDIQKNICPKMRAILVDWLVEVAEEFKLHAETLHLAVSYVDRFLTMNVVARNKLQLLGVTALLVAAKYEEIESSKMKVKRYTDITDNTYTKQQVVKMETDLLKSLSFQIGGPTVTTFLRQFIASCRGGNSASRGKLEFVCSYLAELSLLDYDCISYLPSVVAAACLFVARFIIHPKTRPWNLSLEQSTGYRVFDLQKSIYVIHELQLTIRCPNQVAIREKYKDPKFGCVSTMVSPREIPTSFLEGAISEVRTWTW

SEQ ID NO: 61737 - protein, 288 aa, Triticum aestivum
  misc_feature (243)..(243): Xaa can be any naturally occurring amino acid
  misc_feature (248)..(248): Xaa can be any naturally occurring amino acid
  misc_feature (266)..(266): Xaa can be any naturally occurring amino acid
REREREREREREREREREREREDVAIKLLEKPENDLERAQLMEQQFVQEVMMLSTLRHPNIVRFIGACKKSIVWCIITEYAKGGSVRQFLAREQTKSVPLRLAVKQALDVARGMAYVHALRFIHRDLKSDNLLISADKSIKIAHFGVARIEVKTEGMTPETGTYRWMAPEMIQHRPYDHKVDVYSFGIVLWELMTGMLPFTNMTAVQAAFAVVNKNARPAIPQDCLPALSHIMTRCWGCKPEXPVINXVVTMLEAAETDVVNNVRXSTVRCCISEPMTPTEMPSDYKK

SEQ ID NO: 61738 - protein, 590 aa, Trichodesmium erythraeum IMS101
MHITDDLYRLLEIVPDKIRRPLQEHQERNHLIEIVMDLGRLPEARFPSHVEYLAEIPVSRKDLSYSMERIGTFSSDNRAGIEQTLHRISAMRNRTGEVIGLTCRVGRAVFGTIAMIRELVETGRSILMLGRPGVGKTTALREIARVLADELEKRVVIIDTSNEIAGDGDVPHSAIGRARRMQVASPEQQHRVMIEAVENHTPEVIVIDEIGTELEALAARTIAERGVQLVGTAHGNQIENLVKNPTLSDLIGGIQAVTLGDDEARRRSSQKTVLERKAPPTFEIAVEMLERHRWVVHEQVADTVDALLRGKKPNPEVRTMDDNGEVKIKREFNSSPGFGSGVNRNAGRLLEQSGEMLISGGSFRDSGYMMPLSNTGKISQPLEFSEAKSFEQLLDESLSGNGMFSHDTGDRWDNKDAGPNGEDLPLHIYPYAIPRHQMEQVITTLGLPVVLTKDIDSADVVLALRSHTRKQSKLRHAAKTRHVPIHVIKNSGLPQIAKALRRLLDMEDPATPEFADLNLFAASASEDEMEALEETRLAVEQIVIPNGQPVELLPRSPKVRKMQHELVEHYRLKSASFGDEPNRRLRIYPA

SEQ ID NO: 61739 - protein, 310 aa, Frankia sp. CcI3
MSEGQTAPAAGPATDSARHAGTARVKRGMAEMLKGGVIMDVVTAEQARIAEDAGAVAVMALERVPADIRAQGGVARMSDPDMISEIIEAVSIPVMAKARIGHFVEAQVLQALGVDYVDESEVLTPADPHHHIDKWRFTVPFVCGATNLGEALRRIAEGAAMIRSKGEAGTGEVSNAVVHMRTIRAEIARLSGLPAEELYAAAKELRAPVELVAEVARLGRLPVVLFTAGGIATPADAALMMQLGADGVFVGSGIFKSGDPARRARAIVEATTMFKDPDVLVKVSRGLGEAMVGINVTELPPEARYADRGW

SEQ ID NO: 61740 - protein, 454 aa, Vibrio vulnificus YJ016
MQRLCCRPLNLTFIFEREETLMSKIVKVLGREIIDSRGNPTVEAEVHLEGGFVGMAAAPSGASTGSREALELRDGDKARFLGKGVLKAIEAVNGAIADALVGKDAKDQAAIDAIMIELDGTENKSKFGANAILAVSLANAKAAAASKGMPLYEHIAELNGTAGQFSMPLPMMNIINGGEHADNNVDIQEFMIQPVGAKTLKEAVRMGAEVFHNLAKVLKSKGYNTAVGDEGGFAPNLKSNAEALEVIAEAVAAAGYVLGKDVTLAMDCAASEFFDKEAGIYNMKGEGKTFTSEEFNHYLAGLVEQFPIVSIEDGLDESDWAGFAHQTQLLGDKIQLVGDDLFVTNTKILAEGIEKGIANSILIKFNQIGSLTETLAAIKMAKDAGYTAVISHRSGETEDATIADLAVGTAAGQIKTGSMSRSDRVAKYNQLIRIEEALGERAPFNGLKEVKGQA

SEQ ID NO: 61741 - protein, 480 aa, Fagus sylvatica
MGEEGNSWIRRTKFSHTVCHRLDASRLASFPIIIRPERNSGLKSRPGATSSSEKFGTIYNKQRSLSPLPESRLSDVFKEARSETKRFMTPLPRRREQAKGVMGKFVHKDFHEVKASDSKSLANSSALRHLSSMKVNDKSKYRKESSWAKYFDHGGGRVNAVETSDEWTVDLSKLFLGLKFAHGAHSRLYHGIYNDEPVAVKIIRVPEDDENGALGARLEKQFNREVTLLSRLHFHNIIKFVAACRKPPVYCVVTEYLSEGSLRAYLHKLERKSLPLQKLIAFALDIARGMEYIHSQGVIHRDLKPENVLIDQEFHLKIADFGIACEEAYCDSLADDPGTYRWMAPEMIKHKSYGRKVDVYSFGLILWEMVAGTIPYEDMNPVQAAFAVVNKNLRPVIPRYCPPAMRALIEQCWSLQSEKRPEFWQVVKVLEQFESSLARDGTLNLVQSLTCQDHKKGLLHWIHKLGPVHPNGSMPKPKLT

SEQ ID NO: 61742 - protein, 332 aa, Zea mays
MSTANRYQHIKSTKPVVGKARKLKDLMIKSDNRICADCGAPDPKWASANIGVFLCLKCGDVHRALGPDISKVLSVTLDDWSDSDIDSMVEVGGNSYANSIYEAFLPKDHPKPKPDSTMEYRTKFIRAKYETQDFLKPSLRISSRSSFKSTTSVKSVDSNFSSTSRKDVFEDTREFVGELNITLVKGTNLAVRDMLTSDPYVVLTLGGQKVQSTVKKSDLNPVWNEVLKISVPRNYGPLKLEVYDHDMFSADDIMGEAEIDLQPMITAAMAFGDTSRLGDMQIGRWFMTKDNALMKDSTVNVVAGKVKQEVHLKLQNVESGELELELEWVPIL

SEQ ID NO: 61743 - protein, 379 aa, Oryza sativa
MATAGKVIKCKAAVAWEAGKPLSIEEVEVAPPQAMEVRVKIIYTALCHTDVYFWEAKGQTPVFPRILGHEAGGIVESVGEGVTELAPGDHVLPVFTGECKECDHCKSEESNMCDLLRINVDRGVMIGDGKSRFTIKGKPIFHFVGTSTFSEYTVIHVGCLAKINPEAPLDKVCILSCGFSTGFGATVNVAKPKKGQTVAIFGLGAVGLAAMEGARLSGASRIIGVDLNPAKFEQAKKFGCTDFVNPKDHSKPVHEVLIEMTNGGLDRAVECTGNINAMISCFECVHDGWGVAVLVGVPTKDDVFKTHPMNFLNEKTLKGTFFGNYKPRTDLPNVVELYMKKELELEKFITHSVPFSEINTAFDLMLKGESLRCVMRMDE

SEQ ID NO: 61744 - protein, 762 aa, Vibrio vulnificus YJ016
MSFRIKTIIGIACIEIIMLMLLVFSAMNFMRQSNQEQFIQKANATSQMFARASKDALLSLDLATLDDLTQEILSLPDILYVDIRNNDQQLAFAGALPKVSADWQADDHVSLGDLVFDVSEKITVDGLTYGEIRMGFNTTAIQTALDEASKAIVLIAVLEIILVALFSYFLGSYLSQNLYQLTRAAERVANDGPGFQLQLKAKDEIGKVAAAFDSMSHNLATSYQELEQARTQAELANESKSRFLASMSHEIRTPMNGVLGLLGILGETKLDNHQQNLVHTAKESGELLLSIINDILDFSRMEANTLILYPRPFELKSCVEEIVNSFEPLAKTKGLYLSLTFNDECDYVVVGDSNRYRQVLLNLLGNAVKFTQKGSVSLHVTTQNEGDKLYIRCEINDTGIGIAPDAMAILFEEFTMVDQGYSRTREGSGLGLAICKRLAQLMEGEINVESEVGKGSCFVFSVEMPLAEHDTVTQQAQPDNDSVCTLLQGKRILVAEDNTANQMVIKAMFERLGVAIDLANDGYEAVSMASNHHYDIIFMDISMPGKDGMQACKEIRQLPDAKQAATPIIALTAHALYGDKEKFLRSGMNGYLSKPLRSRHLIEELNKILSASNHHDTATKPLETEKTNHMQITLTSEKNTTAPLVDELIIQQMIRDTSAEVMPMLIEHYIEESERRLVKIDQAIAHSDFQQLEFELHTLGSSSLALGNRRLSNLARKLERLCVAKEYDAVMEDASGIAQLAHDSLSALNERKQLGFVEPNSI

SEQ ID NO: 61745 - protein, 287 aa, Triticum aestivum
  misc_feature (179)..(179): Xaa can be any naturally occurring amino acid
  misc_feature (187)..(187): Xaa can be any naturally occurring amino acid
  misc_feature (222)..(222): Xaa can be any naturally occurring amino acid
  misc_feature (245)..(245): Xaa can be any naturally occurring amino acid
  misc_feature (257)..(257): Xaa can be any naturally occurring amino acid
  misc_feature (269)..(270): Xaa can be any naturally occurring amino acid
  misc_feature (279)..(279): Xaa can be any naturally occurring amino acid
VNYRTSLYKKAGWYRSGIPGISSTHASAQGAGVTILCEMGLDPGIDHMLSMKMIDEAHAQNGKIKAFTSFCGGLPSPAAANNPLAYKFSWSPAGAIRAGRNPAVYKFLGETINVDGSKLYESAKRLRLPELPAFALEHLPNRNSLMYGDLYGISKEASTVYRSTLRYEGFSEIMAILAXIGFFDAEXHPLLQETNRPTYRIFLNELLNVNNVSTSNTKVNGXEETGGHDDELISRLMMLGHCKEXELAVKILKTIKXLGLHEETQIPKXXSSAFSGICXRMEQRMAY

SEQ ID NO: 61746 - protein, 301 aa, Triticum aestivum
  misc_feature (223)..(223): Xaa can be any naturally occurring amino acid
  misc_feature (249)..(249): Xaa can be any naturally occurring amino acid
  misc_feature (252)..(252): Xaa can be any naturally occurring amino acid
  misc_feature (254)..(254): Xaa can be any naturally occurring amino acid
  misc_feature (289)..(289): Xaa can be any naturally occurring amino acid
  misc_feature (298)..(298): Xaa can be any naturally occurring amino acid
MSMPMSMTPPTSAGSAPPAPPPLGELERVRRVGSGAGGTVWLVRHAPTGRAYALKVLYGHHDEAVRRQITREIAILRTAEHPSIVRCHGMYEQAGELQILLEYMDGGSLDGRRIASEAFLADVARQVLSGIAYLHRRHIVHRDIKPSNLLIDSGRRVKIADFGVGRILNQTMDPCNSSVGTIAYMSPERINTDLNDGNYHGYPGDIWSFGLSILEFYLGPLPXLGENLGEAGPTGRRLMCAICYSQSPXAPXTXSPELRSFISCCLQKEPAKAPSAAQLLQHRFIASPXQQQPQVLAXPPC

SEQ ID NO: 61747 - protein, 188 aa, Frankia sp. CcI3
MTSIDDAPQRSAAHDAVAEVLRGHIRDIPDWPQPGVVFKDITPLLATPTAFGVVIGALADAARALGATTIAGIEARGFLLAAPVADRLGTGLVPIRKQGKLPGPTRSASYDLEYGAATIEIHADAVHDGDRVLLVDDVLATGGTAAAAHSLLAAGGGEVVGLAVLMELSFLPGRDRVAPLDVVSLLTI

SEQ ID NO: 61748 - protein, 344 aa, Oryza sativa (indica cultivar-group)
MESLPVPSVQSMVAADGGAHVPPRYIRPRDEAVATDGETEIPVIDFQRLQLGHDEEMARLDKACQDWGFFQLINHSVPEDVVDGMKANARGFFELPAETKKQFAQERGQLDGYGQLFVVSEDQKLDWADILFLNTLPVQNRNFRFWPNQLAKFRSALDKYSAAVKSIVDFLLVTVANNLGVDPEVIANKCGTDGIQAVRMNYYPPCVQADKVIGFSPHSDSDLLTLVLQVNEVDGLQIKRNETWFPVRPLEGAFIVNVGDILQIFTNGRYKSAEHRAVVDMKKERLSIAAFHSPSVHAVIGPLKEMVAHEHEAVYRSIGHDEFMKLFFSSKLEGKSFLDRMKKL

SEQ ID NO: 61749 - protein, 162 aa, Triticum aestivum
  misc_feature (58)..(58): Xaa can be any naturally occurring amino acid
  misc_feature (73)..(73): Xaa can be any naturally occurring amino acid
  misc_feature (78)..(78): Xaa can be any naturally occurring amino acid
  misc_feature (105)..(105): Xaa can be any naturally occurring amino acid
  misc_feature (126)..(126): Xaa can be any naturally occurring amino acid
  misc_feature (129)..(129): Xaa can be any naturally occurring amino acid
MAPSVMASSATTVAPFQGLKSTAGMPVARRSGNSSFGNVSNGGRIRCMQVWPIEGIKXFETLSYLPPLTVEDXLKAVXVPAPSNWVPCPDSSKGPVCPTVENHRXPGYYQRKYWTIWNCQGSVDRXTQXLKDPRRQKGSPILTVKLKLFNPKTPGSGEKPQK

SEQ ID NO: 61750 - protein, 418 aa, Brassica napus
MEDKRGVVLYSIFPLVLLIIFLKFLKPNKQNLPPSPPGWLPVIGHLRLLKPPIHRTLRFLTESLHGGGGGVMSLRLGSRLVYVVSSHRIAAEECFGKNDVVLANRPQVIIGKHVGYNNTNIIAAPYGDHWRNLRRLCTIEIFSTHRLNCFLYVRTDEVRRLISRLFRRAGSEKTVVEMKPMLTALTFNNIMRMMTGKRYYGEETTDEEEAKRVRQLVADVGANTSSGNAVDYVPILRLFSSYEKRVKELGKKTDKFLQGLIDEKREQQETGNTMIDHLLVLQKSDTEYYTDQIIKGIILVMVIAGTNTSAVTLEWALSNLLNHPDVIRKARTEIDKQVGLDRLIEESDLSELPYLKNIVLETLRLHPATPLLVPHMASEDCKVGSYDMPRNTTLLVNAWAIHRDPNLWYDPDCFKPER

SEQ ID NO: 61751 - protein, 313 aa, Gibberella zeae PH-1
MVDRPNKPSALASTPAAPPQAVADITHDNSRVKAVLPSGESVEVLLHGATVISWKDASGTEKLWVSETAALDGSAPVRGGIPIVFPVFGTAPDHEPVAKLPQHGFARNSRWEFLGKSTSEGSSSSVKLDFGLSSESISDDFKALWPYKFALIYSVSLDSESLNTSIVITNDGDAAFDFQTLLHTYFKISDIASTEVTGLEDSVYLSKVSGSEATQSGAITFSGETDSVYTPANGPKHPVVISESGSPRYRIVRDNLDQVVVWNPWVDKSAGIKDFSPKDGWKNMLCVEPGSVKGWQKLEKGDAFEAAQTITLA

SEQ ID NO: 61752 - protein, 487 aa, Glycine max
MSFRSENVNPNPSPTPPLKKRWSDIWTKSKPLNQMVMAMKLHSLSSSPRISTTDKTNPILSPFPITDRTLLLSDALLLKIIALVSDSSTQRNSNSLVCKRWLNLQGRLVRSLRISDWNFLLSGRLIHRFPNLNHVDLLSAALISPKNSGILLSNRVISMHLDSNSSPNWCFFEDNMLPVEVIDNGLTSLASGCPNLRRLHVIGTTEIGLLTVAEECSTLQELELQRCSDNVLRGIAACGNLQILKLVGHVDGFYDSVVSDIGLTILAQGCKRLVKLELSGCEGSFDGIKAIGKCCQMLEELTFSDHRMDDGWLAAISYCENLKTLRFQSCKKIDPNPGMEEYLGCCPALERLHLQKCQLRDRKSVVALFSVCRAVREIVIQDCWGLDNSMFSLAMICWRVKLLYLEGCSLLTTEGLESVIHSWKDLQSLRVVSCKNIKDNEISPALATLFTTLKELRWSPDTKSLLPSSVKGITMGKKGGKFFKRAR

SEQ ID NO: 61753 - protein, 233 aa, Bartonella henselae str. Houston-1
MPKIDLIIFDCDGVLVDSEYLAAQIGSQLLKKIGYEISPEELSARYAGLIFPDILKKVEQETGKPTSAHLIDQMSDLFRAQIKTELRAIDGIKEAIEAIQSHYPYCICSNARSTEIKEMLTIVDLYDFFDNKDKIFSAPEVGTKKTKPAPDVFLFAAQQLRVKPKNTIVIEDSIHGVHAATAAGMRVIGFTGGSHSYLGHSNALVEAGAETAIAKHAHLLEVLEAMAVWQDLP

SEQ ID NO: 61754 - protein, 351 aa, Gibberella zeae PH-1
MASRHSMQLFRALRTSQSTIRQPVNRISVCRFYSTSTEDAPAPLLSKLKADLKTAMRAKDTPRLTVIRSIMSANLNASKTSTPIKTDVQLVALIRKIQKGAQDAAAEAKAANRDDLVQKEEEQIKVLNEYITNSGVESLTEAQLKAMVQDAVEASKAAGIQAKSIMGDVMKRLSGALEVRISLVLFNILGFCFIVRLYRVTPLSRGDIWNSNISSGSAFEEQIGYSRAVVTGDWVFVSGTTGYDYATGKISANVTEQADQTMINIATALESAGASLSDVVRVKYILPDRDDFPKTWPVLKKWFGEVGPAATMVQSALMKDEMKIEIEVTARIGCGKQGKWATVETSRGVSN

SEQ ID NO: 61755 - protein, 472 aa, Oryza sativa (indica cultivar-group)
MEFHESKTFETRDPRTGDVIARVAEGDKEDVDLAVKAAREAFDHGEWPRMSGSERERVMAKYAEVVERHADELAALESLDAGKPLAAARAVDVGECVGILRYFAGAADKIHGETLKMSRQLQGYTLREPLGVAGLIVPWNFPAIMFFSKVSPALAAGCTVVVKPAEQTPLSALFLAHLSKQAGVPDGVINVVTGFGPTAGAAISSHMDVDVVAFTGSTEVGRLIMEASAKSNLKPVALELGGKSPFIVFDDADLDKAVELAIGGNFFNKGEACVAGSRVFVQEGIYDRFEQKLADTMKSWVVGDPFDPRVNQGPQVDKAQYERVLGYIEQGKAEGATVLTGGKPCGKKGYYIEPTIFTNVKDDMVIAREEIFGPVMCLMKFKTVEEAIERANGTRYGLAAGLVTRDIDVANRMARSIRAGVVWVNCYFAMDRSCPFGGRKMSGFGKDDSMHALDKFLAVKSVVTPVHGSPWF

SEQ ID NO: 61756 - protein, 455 aa, Geobacillus stearothermophilus
AIETETLVVGAGPGGYVAAIRAAQLGQKVTIVEKGNLGGVCLNVGCIPSKALISASHRYEQAKHSEEMGIKAENVTIDFAKVQEWKASVVKKLTGGVEGLLKGNKVEIVKGEAYFVDANTVRVVNGDSAQTYTFKNAIIATGSRPIELPNFKFSNRILDSTGALNLGEVPKSLVVIGGGYIGIELGTAYANFGTKVTILEGAGEILSGFEKQMAAIIKKRLKKKGVEVVTNALAKGAEEREDGVTVTYEANGETKTIDADYVLVTVGRRPNTDELGLEQIGIKMTNRGLIEVDQQCRTSVPNIFAIGDIVPGPALAHKASYEGKVAAEAIAGHPSAVDYVAIPAVVFSDPECASVGYFEQQAKDEGIDVIAAKFPFAANGRALALNDTDGFLKLVVRKEDGVIIGAQIIGPNASDMIAELGLAIEAGMTAEDIALTIHAHPTLGEIAMEAAEVAL

SEQ ID NO: 61757 - protein, 327 aa, Vibrio angustum S14
MADITLIEAVNLALHYEMQHDPNVVILGEDIGENGGVFRATLGLKHAFGCKRVIDTPLAESLIAGVTVGMASQGLRPIAEFQFQGFIFPAMEHLVCHAARLRNRTRGRLTCPAVFRAPFGGGIHAPEHHSESIEAMFAHIPGLKVVIPSSPQRAYGLLLAAIRSNDPILFFEPKRIYRTVKSHVENNGLALPLEQCFTLRKGTDITLVTWGACVVESLQAADTLSHHGIKLEVIDLASIKPIDMATITASIEKTGRLLVVHEAAKTCGVGAEIITRVAESAMCLLKAPPKRLTGFDTIMPYYRNEDYFMIQHDDIVNAARELMEGWQ

SEQ ID NO: 61758 - protein, 214 aa, Methanosarcina barkeri str. Fusaro
MLKAIIFDVDGVLIDSMNFQAEAWVKTFKEIGINITRKDIYELEGSNNKRLIKSIFEKSGKELEPWYFEKLPEKKREVLEFDRIKPYEGIQDCIKALKRHFKLALVSGSHTDTVNKVVNKYFSKCFDVIITGSDLEHGKPDPDPYLKALEKLDLTKNECMVIENAPLGITAAKRAGLYCVAVTGMLEPEKIEHADLVLENHAALFKYLKNLIPK

SEQ ID NO: 61759 - protein, 521 aa, Lactococcus lactis
MKERQELGLIGLLPPTVQTIEEQAEQTYEQYLTKPSDLEKRHFLMEIFNTNRTLFYYLFNKHIVEFNPVVYDPTIADTIENYSHLFVDPQYAAYLDINHPENITETLKNAAGDREIRLIVVTDAEGILGIGDWGTQGVDISVGKLMIYTAAAGIDPASVLPVVIDAGTNRKELLEDHLYLGNHQERIYGDQYYSFVDQFVETAESIFPKLYLHWEDFGRSNAATILNNYKTKIPTFNDDIQGTGIVVLGGIFGSLDITGEKLTDQVYLCYGGGSAGAGIAGRVHAEMVSEGLSEEEAYKHFFMIDQQGLLFDDMEDLTPAQKPFAKKRADYKDAGDMTDLLNVVKTVKPTILVGTSTNPGAFTKEVVEAMCANTERPVIFPISNPTKKMETTAEQVIEWSDGKAFVATGVPSGTISYKGVDYQIGQANNSLIYPGLGLGMLASEAKLLTDEMIGAAAHSLSGLVDPGKPGAPVLPPFEFVADVSIKVAEAVAKKAQEQGLTESKETDMAKAVRDLKWYPEY

SEQ ID NO: 61760 - protein, 474 aa, Alkalilimnicola ehrlichei MLHE-1
MGAVRPDNPLFRYRDVVDDWPAFETAVASPLPATIWAHPARITREALRSLLAEAGIDARPVAWQPSALRLPAGLRPGAHWGQAAGLYHAQEEASMVPVTLLDPQPGHRVLDLCAAPGNKTAQAALALGNRGTVVANDVAKGRLAAIRHLIKRLGLMNVSVTCRPAQDYSPHAGGFDRVIADVPCSCEGTVRKSSQPSAQALCETRERLVARQTAILDKAVRLCRPGGRIVYSTCTFAPEENEQVVDALLRRYPDELRLLPVSLPGLYLAPGLTGWRGRTFLPELAQAVRLWPHHNNTGGFFIALLERVGGECREGARAAERPTDGHWLEGIVQRYAIPGSALAGLRLVHRGRKYAQLIAADHEPPARPERVFFGLPTVGVQMKPPKLTTAGVMALGAYARRNVVELDESQAQAYTRRQVVTLQPGQGIGLGESGSVVVRRRGYGLGLGVVSPAAEDGSRHLASLYPRSWAAEVP

SEQ ID NO: 61761 - protein, 481 aa, Pasteurella multocida subsp. multocida str. Pm70
MIGPFKPAPHIAELPADKIDARYRFLRWQVFAGIFFGYAAYYFVRANFDLAQKGLIEAGMYNKAELGIIGTGAGLAYGLSKFFMASISDRSNPKVFLPFGLLLSGLCMTMMGLMPWATSGIAVMFIMIFLNGWFQGMGWPPCGRTMVHWWSKSERGSIVSIWNTAHNLGGMVPGAMVLLASAVYFSTHGVEATAKDVWQQALYYPGIAAMIAAIPIYFMMKDTPQSCGLPPIEKWRNDYPDDYNEKTYEHDLSTKDIFVTYVLKNRLLWYIAIANVFVYLIRYGVLKWSPVYLGEVKHFNIKGTAWAYTIYELAAVPGTLLCGWVSDKVFKGKRGLTGFIFMILTTAAVVALWLNPATPEAELAKYAGHAWYENPYQLMDFILMTTIGFLIYGPVMLIGLHALELAPKKAAGTSAGFTGLFGYLGGTVSASAVVGWAAEYYGWDGGFYVMIAGGVLAILLMFITMIEESKHKARLEDHYGK

SEQ ID NO: 61762 - protein, 331 aa, Methylobacillus flagellatus KT
MLKLSEFLVQQERQHAVADNVLTLIQDIAATCQAVAREIRYGALRGNMGSAGRENVQGEEQKALDVISNDIFTAMASKQPHVAAVASEEMAQAQVFAGKQGKYLLVFDPLDGSSNVNLNLSVGSIFSILPAPEGSVDEASFLQAGSRQLAAGYALYGTSTMLVLTMGHGVHGFTLDPDQGEFYLTHPGLTIAASTEEFAINMSNQRFWQPPVQRYIAECIAGSSGPRGKDFNMRWVATMVAEVHRLLVRGGVFLYPLDSRAVGRGGRLRLLYEANPMSLLVEQAGGLATTGHRRILDVEPAGLHQRVAVMMGAREEVERLQDYHSFTDPTA

SEQ ID NO: 61763 - protein, 247 aa, Methylobacillus flagellatus KT
MSSTPSGTAKVIVLTGASSGIGEATARHLARLGHHLFIGARRLDRLTALQDELRAEGCHVEVMQLDVTRLEDLQGIASQTHATHGRIDVLINNAGVMPLSPLAALKIDEWNRMLDVNVRGVLHGIAAALPIMQAQGHGHIINIASIGAYQVWPSSAVYCASKFAVRAISDGLRQETDAIRVTLVSPGVVESELADHITDETARAAMREFRRIALPPQAVAQAIAYAIAQPDGVDVNELIVRPTASPY

SEQ ID NO: 61764 - protein, 388 aa, Mycoplasma penetrans HF-2
MSSKRDYYEVLGVSKDATDDQIKSAFRKKAMQYHPDRNKEPDAEEKFKEVNQAYEVLSDPDKRANYDRFGHEGVDGQFGGGAGFDPFDIFNQFFGGGRGGGAHFEQSFGGSGFEDIFSNFFGGGRRGASSQQREANLVVSIVLTFVESVVGVKKTIEYKIEKDCESCHGSGADNSEGSISTCSNCNGSGVEITQKRTIMGIIQSQNICSRCNGEGKEIHKKCNSCKGRKVHEERVEIDVEIPGGVSNDEHLKVSGKGSVVGGKTGDLYINIQIKPSKIFSRKGNDIYVILKVDPILAIVGGEANIPTPFGIKSIKMKPGTRNGEIITVPSHGVKSTKRFGSNGDLFAVVEYTSAKRFSSAELKSLSKFAQETNDEIEKYLKEARKEIN

SEQ ID NO: 61765 - protein, 377 aa, Wolinella succinogenes DSM 1740
MAGSSNTPKRKLPKESYKIMKKYEIAIIKGDGIGPEIVDEAKKVLDAISYSHGFELSYHDYLMGGIAVDRAGVPLPDETIEGCLRADAVLFGAIGGEKWDSLPRELRPESGLLKLRKSLEIFANLRPTVVYDELIEASTLKESVIKGVDILVVRELIGGIYFGEPKGREGDKAFNTMVYSVPEIERIAHVAFKAAMRRQKRVCSVDKANVLDVSQLWRETVTRIAKEYPEVELSHMYIDNAAMQLIRNPKQFDVILTGNLFGDILSDEASMLSGSIGLLPSASIGGKAALYEPIHGSAPDIAGQGIANPIATIASASMMLRHSLGEVEAADAIDKAIVKTLKEGYRTKDIAAFGAKEICTTDEMGSIIANYAAKKGE

SEQ ID NO: 61766 - protein, 539 aa, Oryza sativa (indica cultivar-group)
MASLPVPSVQAMVAAIGIDHVPPRYLRPTDADEPVASDGGEAEIPVVDFWRLQLGDGDELARLHIACQDWGFFQLVNHNVPEDVVEGMKASIKGFFELPAETKKQVVQEPGQLEGYGQLFVVSEDQKLDWADILYVKTQPLQDRNLRFWPDQPAGFRMALDRYCAAVKITADGLLAAMATNLGVESEVIAERWVGGVQSAMVAAIGIDHVPPRYLRPTDADEPVASDGGEAEIPVVDFWRLQLGDGDELARLHIACQDWGFFQLVNHNVPEDVVEGMKASIKGFFELPAETKKQVVQEPGQLEGYGQLFVVSEDQKLDWADILYVKTQPLQDRNLRFWPDQPAGFRMALDRYCAAVKITADGLLAAMATNLGVEPEVIAERCVGGVQSVRVQYYPPCGQADKVVGISPHSDADLVTILLQANEVDGLQIRRGGAWLPVRPLEGALIVNVGDILQVFTNGRYKSVEHRVVVDGKKERLSMATFHSPSKNAIVGPLSEMVEHEDDAAYTSMNHDELLKLFFAKKLEGKNFLNPIKKLKNSG

SEQ ID NO: 61767 - protein, 430 aa, Agrobacterium tumefaciens str. C58
MSPSPVWHPFTQHGLEPPMKRVVSADGAFLVDEDGNRLFDAISSWWVITHGHRHPAIMAAIRAATETLDQVIFAEFSHEPAETLARGLIELAPAGLSHVFYSDSGSTAVEVALKMALGYFHNCGEKRDRIVVMEHGYHGDTIGTMSTGERGVFNAAYEPLLFGVDRLAFPEVGSEQCTLDMFEAYCRSGRVAALLVEPLVLGAGGMKVYAANVLAGLKQIAESHGCLVIADEVMTGWGRTGTVFACEQAAISPDILCTSKGLTGGSLPLAATLCSAQIFDAHFSTDRRKTFFHSSSYTANPIACAAAVANLQVWRDEPILQRIGQVQQTLGDHIRRFADDGRFANIRQAGTIAALDLVVPAGGYLSEAGPRMRQLFRRRGFLIRPLGNVLYLMPPYCSTADDLTRAFDVIDEVAGIVTDVASAKSYGVGK

SEQ ID NO: 61768 - protein, 534 aa, Nicotiana plumbaginifolia
MGNCCSRGQPDDNEHTSNNDQKSNTKNDQSISNNSQQQQNNGSITPSKSPDPSSKPSKNSPIGPVLGRPMEDVRKTYSIGKELGRGQFGITHLCTHKQSGEQFACKTIAKRKLVNKEDIEDVKREVQIMHHLTGQQNIVELKGAYEDKHSVHLVMELCAGGELFDRIIAKGHYTERAAATLLRTIVQIVHTCHSMGVIHRDLKPENFLLLNKDEDSPLKATDFGLSVFYKQGDVFKDIVGSAYYIAPEVLKRRYGPEVDIWSVGVMLYILLSGVPPFWAETEHGIFNAILRGHVDFSSDPWPAISHGAKDIVKKMLTIDPKQRLTAIQVLNHPWIKEDGEAPDTPLDNAVLSRLKQFRAMNNFKKVALRVIAGCLSEEEIMGLKQMFKSMDTDNSGAITLEELKQGLAKQGTKLSDHEIEQLMEAADADGNGTIDYEEFITATMHMNRMDKEEHLYTAFQYFDKDNSGFITIEELEQALREFGMTDGKDIKEIVAEVDSNNDGRINYEEFVAMMRKGTPETAANLKKRRESFVA

SEQ ID NO: 61769 - protein, 334 aa, Geobacillus stearothermophilus
AVKVGINGFGRIGRNVFRAALKNPDIEVVAVNGLTDANTLAHLLKYDSVHGRLDAEVSVNGNNLVVNGKEIIVKAERDPENLAWGEIGVDIVVESTGRFTKREDAAKHLEAGAKKVIISAPAKNEDITIVMGVNQDKYDPKAHHVISNASCTTNCLAPFAKVLHEQFGIVRGMMTTVHSYTNDQRILDASHKDLRRARAAAESIIPTTTGAAKAVALVLPELKGKLNGMAMRVPTPNVSVVDLVAELEKEVTVEEVNAALKAAAEGELKGILAYSEEPLVSRDYNGSTVSSTIDALSTMVIDGKMVKVVSWYDNETGYSHRVVDLAAYIASKGL

SEQ ID NO: 61770 - protein, 140 aa, Hyphomonas neptunium ATCC 15444
MAVQRTFSIIKPDATERNLTGAINAVIEKAGLRIVGQRRIQMTRAQAERFYSVHSARPFFGELVDFMISGPVVVQVLEAEDAITKYREVMGATNPADAADGTIRKLFAKSIGENSVHGSDSAENAALEIAQFFSEADLTN

SEQ ID NO: 61771 - protein, 891 aa, Bartonella henselae str. Houston-1
MTKWVYSFGDGSAEGSASERNLLGGKGANLAEMSNLGLPVPPGFTLTTEVCNFYYAYGKSYPKELREAVEQALKHIGEKTGREFCNEKRPLLLSVRSGARASMPGMMDTVLNLGMNDETVKAIALQTKNERFAYDSYRRFIQMYSNVVLGLEHSYFEEILDDSKMRKGYTIDTEMTAVDWQDVIVSYKAYIEEKLGKPFPQDPEQQLWGAIGAVFSSWMTARAVTYRRLHNIPESWGTAVNVQAMVFGNMGEDSATGVAFTRNPSTGEKELYGEFLVNAQGEDVVAGIRTPQNITENARIVAGSNKPSLEKIMPEAFGKLYHIGQKLEKHYRDMQDLEFTIEKGKLWMLQTRSGKRTARAALKMAIEMVEEGLISREEAVMRIDAKSLDQLLHPTLDPKAGRFVVARGLPASPGAATGEIVFTSEEAETASVEGRKVILVRIETSPEDIHGMHAAEGILTTRGGMTSHAAVVARGMGKPCISGAGSVRIDYSTNTMFASGQSFKKGDVITIDGGSGEIFKGKVAMLQPELCGDFAKLMEWADGMRRIKVRANAETPSDARMGHSFGAEGIGLCRTEHMFFSGERIVAMREMILSDDENGRRKALDKLLPMQRSDFVQLFEIMCGLPVTIRLLDPPLHEFLPKTDAEILDIATVMGVSKEALAERAQQLHEFNPMLGLRGCRLAITYPEIVEMQARAIFEAAAEAAQKSGSPVMLEIMVPLVALKSELDFVKTHIDQVACEVMKEKKSTIQYMVGTMIELPRAALRADEIAETAEFFSFGTNDLTQTTFGISRDDAAPFLATYFQKGLLEQDPFVSIDRDGVGELIAIAAKRGRSQRAKIKLGICGEHGGDPASIALCEENDLDYVSCSPFRVPIARLAAAQSAIAKKRERF

SEQ ID NO: 61772 - protein, 151 aa, Vicia faba
MKLFSIFLIFTIFIIASALVAAKSAADVTELQIGVKYKPASCEVQAHKGDKVKVHYRGKLTDGTVFDSSFERNSPIDFELGGGQVIKGWDQGLLGMCLGEKRKLKIPAKLGYGEQGSPPTIPGGATLIFDTELVGVNDKSLSEEKSTSSEL

SEQ ID NO: 61773 - protein, 512 aa, Arabidopsis thaliana
MDIISGQPLFLLFCFILSCLLFFTAARSRRSPSQVLSKSPPGPPRLPIIGNIHLVGKNPHHSFTDLSKTYGPVMSLKLGCLNSVVIASRDAAREVLKAHDQILSGRYITQATKSNNHHEFSVGWIHPSSPRFRNVEEMTFTQLFSPQRIEATKALRMKKVQELVNFLSESSERGEAVDISRASFVTALNIISNILFSVNLGSYDSKNSSAFQEMVIGYMESIGNPDVSNFFPFMRLLDLQGNSKKMKEYSGKLLQVFREFYDARILENSSRIDEKDVSSRDFLDALIDLQQGDESEINIDEIEHLLLDMFLAGTDTNSSTVEWAMTELLGNPKTMTKVQDEINRVIRQNGDVQESHISKLPYLQAVIKETFRLHPAAPFLLPRKAERDVDILGFHVPKDSHVLVNVWAIGRDPNVWENPTQFEPERFLGKDIDVKGTNYELTPFGAGRRICPGLPLALKTVHLMLASLLYTFEWKLPNGVGSEDLDMGETFGLTVHKTNPLLAVPLKKRAIN

SEQ ID NO: 61774 - protein, 580 aa, Candida albicans SC5314
MSFVLAAKPRFVYLTNKQLQTIGKRLLTQSAKSSFKSSQCLLSEPNTMIKTASPKKNQQQYRKSVALVSGVIIVGSYIVFNQSNYFNLDTLPSNLPPPQQSKKLLQDNQKKYFSTSTSSLHQKDSISHQQHKEGIFLLNEEQVSTKLRQFEESYTVNRGKGVTRYDICQLPSNSPIEDDRAEEIVQVPILQDNNIKTSTDWMFFGVFDGHGGWTTSSKLRDQLIGYVINELGTIYKPVQGEENLRYVPNSATIDQAMKNGFLKLDHELVNKNIEKLLTDGNKAKAAELLMPALSGSCALLSFYDTNSQMLKVAVTGDSRAILGSFKDNHWTVRQLSIDQTGANPSEVARIISEHPNEPKVIRNGRVLGSLEPTRAFGDCRYKLPAVIQERIYKQFFGRPLPNQLKSPPYVTAEPIITTTKINPNEHDFLVMASDGLYEMLTNEEIVGLVVKWMEKADMIKPRKSWFGFGSADSKLPEVKDVTNDKASKKPLNNKLGNSFLLEDNNVSTHLIRNALSNGGSREQTSMLISIPNPVSRRYRDDLTVTVVFFGKDTKGEDENGTLEVNWNATAGGLNSAKPKL

SEQ ID NO: 61775 - protein, 376 aa, Flavobacteria bacterium BBFL7
MTDFYDILGISKGATAAEIKKAYRKKAIEFHPDKNPGDATAEENFKKAAEAYETLSDPQKKARYDQLGHQAYTSGGAGGFGGGGFGGMDMDDIFSQFGDIFGGGGFSGFGGGGGFGGGGRRRVKGKDLRIRVSLTLEEAAVGVEKKVKVKRKKQAPGVTYKTCTTCGGSGQVTRIQNTILGRMQTSAPCNVCGGAGQTMDKKPAGADAQGLIIDEETVSIKIPAGVETDMRLKVSGKGNEAPGNGVSGDLLVDIEVKEHAELQREGNNLHYDLYVSVPEAVLGTTKEIQTVTGKVRIPIEAGIQSGKILRLRGKGMPSVNGYATGDLLVHVNVWTPRNLSRDQKEFFESMMADSHFEPAPEKGDKSFFEKVKDMFS

SEQ ID NO: 61776 - protein, 143 aa, Zygosaccharomyces rouxii
ATQATSAQTIDIHTGIGFLDHMIHALAKHSGWSLIVECIGDLHIDDHHTTEDCGIALGDAFKQALGQVRGVKRFGFGFAPLDEALSRAVVDLSNRPCSVIELGLKREKIGDLSCEMIPHFLESFTEAARLTVHVDCLRGFNDH

SEQ ID NO: 61777 - protein, 1423 aa, Oryza sativa (indica cultivar-group)
MEIPKQGQPPRVAGTPPTLPGAITHTTQVGYPAVFYNGNWGAQVPASSYLIVPMSEPPAQVGVPRPNAPGLSGSGARPLSRVSLRPPQQVLSVQTALPGMAAMMPSPSMIAGKKMAASPKVQMLKSVPFRSAGSKRPAQELLPKAQPQLFESVRSKFRETLAAALNMDSDQQCAPQSVETVSHVGSASENKQADGAGIDSVTETSALKSGQHNMLSSNSASNMSIKVSDDMQQQSIHVPLENKVLDNNSCTLDELLQGHGLCWSSDVVGASETISQSDPDRVRKSDIDEGVDVSLIEHESKRIKTDDAAAEEKKSVTQKAQILAFEIEGELFTLLGGVNKKYKEKGRSLLFNLKDKSNPVLRGRVLSGDITPKRLCSMTTEELASKELSDWRLAKAEELAKMVVLPSKEVDVRRLVRKTHKGEFQVEVEETDGISVEVGIGGDLLSHVPSRPTEGQTKTDDKSVHTEEKESDNSEQDGVIVTGGNNMPSNLEHTENEKTDLMQELMVDDLKDTENLPPIMSLDEFMETLDSEPPFEDDSTQTVKDDPNSIEKTDISLKSEDSSKNVDSASASDSQLDPQTLSPQDKFESKLQSPKKGAGSILFPVEQIKEDLLVKSSPEKANAENIDTGSQSIPESITDCKSAPDALLTHDSVWEGTIQLSLSSLTNVVVIFKSGEKTSTNEWRHFLDIKGRVRLSAFQEFLEQLPKSRSRAIMLTELRWKEGSLESGRQHLLQTIDSYIADERVGLVKPADGVELYLCPSQGKAAQILAEHLPKEHSSSLTVTGTSAIGVVVWRRPHVSPRIPARNDGSRNQSISRKQHAVIASAVPLSSKPTNERQHHGQDVVTDDVPPGFGPGVVREDDDLPEYDFVTVPNAAANVVPSRQAHRSQQQHSQAASRRPVDHVREMVRKYGSRSAAAAQPWEEDDDDDDIPEWDPNQSNLNLQQTRHAIPQPPLPPPGPVHQQMHAYHQQHQQQQQHYQSIQQYHATQESQNTLSQAYYVQSHSQQHSVPVQQLTHLQPGWPTTAQWLAAGAAGAAHSGLPANNVVQQYCTSATPDGCHHLTELRWKEGSLESGRQHLLQTIDSYIADERVGLVKPADGVELYLCPSQGKAAQILAEHLPKEHSSSLTVTGTSAIGVVVWRRPHVSPRIPARNDGSRNQSISRKQHAVIASAVPLSSKPTNERQHHGQDVVTDDVPPGFGPGVVREDDDLPEYDFVTVPNAAANVVPSRQAHRSQQQHSQAASRRPVDHVREMVRKYGSRSAAAAQPWEEDDDDDDIPEWDPNQSNLNLQQTRHAIPQPPLPPPGPVHQQMHAYHQQHQQQQQHYQSIQQYHATQESQNTLSQAYYVQSHSQQHSVPVQQLTHLQPGWPTTAQWLAAGAAGAAHSGLPANNVVQQYCTSATPDGSGQGYATGNQGSMPWNLQ

SEQ ID NO: 61778 - protein, 610 aa, Coprinopsis cinerea okayama7#130
MPLFYLQGMPIGGVSLMLACVASIGGFIFGYDTGQISDILVMDDFRQRFGNCTNPSDPSTCEFTNVRAGLIVSLLSIGTLSGALAGAVIADFLGRRWAMISECLLFCVGLIIQMTTFTVWQQVAVGRFVAGLAIGALSAAVPMYQAETAPTQLRGTLTATYQLFITAGILAAYSIGIGTRDLTGAAQWKTLIGIGFAWPALLIFGMLFMPESPRWLAAKGRSKEAARAIARTYGIPQKEADSNRFVQAEVDEIINQLEAERRLKAGWIDCFRTNNMTLYRTILGMSLQSLQQLTGANYFFYYGATIFRGVGIADSFVSQIILGAVNFGCTFGGLYVMERFGRRLPLIWGGLWQALWLFVFAAAGTARDPLYNESVGKLMITSACLFILGYATTWGPGIWILIGETFPTRTRAKQGALATASNWTWNFLISFFTPFITSSIGFRYGFVFAACNLTGAVVVYFFLYESSNLSLESVDNMYNDPDCKAWNSRHWVPAGYSSRFDLVEQTKAAQARKPFAKPQGDEQRMEKAGDINSEASSAASAERGEVVIRPISTMRARSRSQAFDEDDDVDREHPFVDGHGPGSPGYPVRLTQSGPRGGGGIHHEDGHGNY

SEQ ID NO: 61779 - protein, 326 aa, Candidatus Blochmannia floridanus
MINDKLLLQYAKETLAIEIDEAQHMLERLDDSIVLACRILLECKGKVIVSGMGKSGHIGKKIAASLASTGTSAFFVHPAEALHGDLGMIGEQDVVIFISYSGYAYEIMTLMPLLSDSGIPVIALTGDLQSPLAVGAECVLNIKRKREACPMELVPTSSSVNALMMGDALTISLMRYKGFSTEQFARSHPGGRLGSKLLNCVHHIMRVGEHISKVFCTGTVMDAMFELSRTGLGLTAVCDINDHVIGVFTDGDLRRWIVQGKSLTDSVNLAMTCPGCVIDRDWKVDVALKMLHKLNITAAPVVNKLGIIVGSINVHDLHRRCNGIIK

SEQ ID NO: 61780 - protein, 357 aa, Candidatus Blochmannia floridanus
MNDKILFIDRDGTLIHEPKDNFQIDSLDKLLLEPYVIPTLIALKNIKFKFIIVTNQNGLGTDLFPKTKFNKPHQFMIQIFKSQGIKFDQILICPHLPEDQCNCRKPKTGLISCWLKNKSLDMPNSYVIGDRDTDIQFAHNIGIQGIKYHQIHFNWKKIHKYLMQNSHRVAHIQRITNETNVDVKIWLNQCDQNKINTGIHFFDHMLEQIAIHAKIRMHIITKGDLHIDDHHTIEDTALSLGEALNQALGDKRGIGRFGFTLPMDESIAQCILDLSGRTYFDYQAEYSLQKIGNFSTHMIEHFFRSLSSKMHCTLHLKVIGNNDHHKAESLFKSFGKSLNQAIYIQHNQIPSSKGILL

SEQ ID NO: 61781 - protein, 504 aa, Coprinopsis cinerea okayama7#130
MMKDFKTSYVLDVYLQLFKEYQCTTLNLRILWRDCIISMDQDHTKYVLATGFGRFWRGHAQKERLETFLGSGIFNRDDDDWKEHRAIARPFFARDRIEDFDNFETHTARTLSILTSLASTQEAFDAQDLYSRFTLDSASEFLFGKNLDTLSQSRPIPGQTVMGPKGSAVEGDWGSFAKAFETAQINATTRARIGHWWPLLELFKDKNAEHADVIHRWLDPLVQRALNERTQRIGRKRADSKASLGTSFLKHIAECVDDPVTIRDQLLNMLLASRDTTATVLTFLTYLLATHPDVTDRLRAEILEHVGPTSHPFPDTLKQLKYLRAVLNETMRLYPPVPLNIRETRSASCTLPPSDPTYASSDTRPFYMPAKTIIMYFPLLTQRNPALWGEDAEEFVPERWIDPDRASKIVNNPAMYAPFSAGPRICLGQNYAYNQMSYFVVRLLQQFDRFTLAPEFQPPGSLPPKEWKHRQGRQKDEKIWPAAALTLFVKGGLWVKCHLAKTHS

SEQ ID NO: 61782 - protein, 307 aa, Escherichia coli
MNAKVWVLGDAVVDLLPESEGRLLQCPGGAPANVAVGVARLGGNSGFIGRVGGDPFGRYMRHTLQQEQVDVSHMYLDDQHRTSTVVVDLDDQGERTFTFMVRPSADLFLVEEDLPQFAAGQWLHVCSIALSAEPSRSTTFAAMESIRSAGGRVSFDPNIRPDLWQDQALLLACLDRALHMANVVKLSEEELVFISSSNDLAYGIASVTERYQPELLLVTRGKAGVLAAFQQKFTHFNARPVASVDTTGAGDAFVAGLLASLAANGMPTDMTALEPTLTLAQTCGALATTAKGAMTALPYQRDLNRQF

SEQ ID NO: 61783 - protein, 238 aa, Zea mays
MVVVAAANRQSSTSEGGSAASPSKKRIRSDSLDTAPHHQNTRKPSPSPPPPFAAHDQMECTSAAAAAAFHHEPGSRVREECKSKVSRRYVHADPSDLSLAVKDGYQWRKYGQKVTKDNPCPRAYFRCSFAPSCPVKKKLVEHFFQSVVNTSGMTLHIRQRVCMTPSLSPDLDPYCLLKLAGKNSHHIIEASFKAFARALRQATEYDLRRQGTVPSFCQQINGRAEKIRALQLSGKRDG

SEQ ID NO: 61784 - protein, 459 aa, Botryotinia fuckeliana
MSSPSGSSQASGAGKANGALNKAFPHIDLDGHNLPPSPAPSSPHNGRRYALATELVYTETKDQYGASSMPIYQSATFKQNLAGGGSEYDYTRSGNPTRTHLERHLAKIMNANRALVVGSGMGALDVITRVLRPGDEVITGDDLYGGTNRLLTYLAANTGIIVHHVDTTTPDKVKAVLGPKTAMVLLETPTNPLIKIVDIATIARTAHELNEKALVVVDNTMLSPMLCNPLDLGADIVYESGTKYLSGHHDIMAGVLAFNDPAIGDKMYFTINSTGCGLSPNDSFLLMRGIKTLAIRMERQQTNAQAIAEFLETHGFRVRYPGLKSHPQYDLHWSMARGAGAVLSFETGDVALSERIVEAAKLWGISVSFGCVNSLISMPCQMSHASIDAKTRKERQMPEDIIRLCVGIEDVNDLIDDLSRALVQAGAVKVTLDGFHAIDAAQAIAEVPIAESDAAAAPL

SEQ ID NO: 61785 - protein, 273 aa, Hyphomonas neptunium ATCC 15444
MSNPAARNAIAQHVEDWISTAITVAPAGHIPLLFLSGAQGSGKSTALRQAAASLTAPVAIASLDDFYLTRTARAHLANTISPLLATRGPPGTHDLPLLRATLASLRAASDRSATSIPVFDKLADDRAASSAWRVFQGRPAAIVIEGWLMGALPDATAPSSAPLNEVEAQDPAGTWRRFQEEALAGGYARLWDEADGFFHILAPGFDTVLGWRLEQEASLWQARGTPMPEDRRAWAARFIQYYERITRRMLEGGRRPGTDLLIDGNRCGLPPPP

SEQ ID NO: 61786 - protein, 626 aa, Cytophaga hutchinsonii ATCC 33406
MSTIRIGGAAVNQTPIDWENNVKNILDAIEEAKNANVEILCLPELCITGYGCEDLFLTDWVAETAIEYCFEIAASCTDITVSLGLPMRIAGITYNCVCLVENGIVKGFSAKQFLANEGVHYETRWFTAWPRNHTTTFLYNDVKYPFGDVLYNVKDARIGFEICEDAWRTDRVGIRHYEKGATLVLNPSASHFAFGKSAIRYDLVIGGSERFDCTYVYANLLGNEAGRMIYDGEVLIAHKGKLIQRNDRLSFKNVNLIYADIATDSAETPETVLTQDDLEKEFEFWEATSLGLFDYMRKSRSKGFVLSLSGGADSSACAIMVAEMIRKGLKELGLTAFLQKSNMETLFDLPALQHLPFEEQAKKITAVFLTTAYQSTRNSGDETYTSAKTLAESIGATFYNWSVDEEIEQYKATIENVIERPLTWEKDDITLQNIQARGRAPIIWMLTNVKQALLITTSNRSEGDVGYATMDGDTAGGIAPIAGVDKDFIRSWLRWAEKNRNQHGLHIVNKLAPTAELRPSEYTQTDERDLMPYDVLARIERKAIKERLSPVQVYTALLTEGPYTKNEFKYWVKKFFRLWSINQWKRERLAPSFHMDDFNIDPRSWYRFPILSSGFAKELNDLDQLQ

SEQ ID NO: 61787 - protein, 112 aa, Urtica dioica
MMMRFLSAVVIMSSAMAVGLVSAQRCGSQGGGGTCPALWCCSIWGWCGDSEPYCGRTCENKCWSGERSDHRCGAAVGNPPCGQDRCCSVHGWCGGGNDYCSGSKCQYRCSSS

SEQ ID NO: 61788 - protein, 484 aa, Rhodopseudomonas palustris CGA009
MDAPRKFAGSRRSRRGVKLIPCRAFHPPAAQCMRSAMLDKIKPTSAVNAPNDLNAFWMPFTANRAFKRAPKMVVGAEGMHYITADGRKIIDAASGMWCTNAGHGRKEIAEAIKAQADELDFSPPFQFGQPKAFELASRIADLAPEGLDHVFFCNSGSEAGDTALKIAVAYQQIKGQGSRTRLIGRERGYHGVGFGGTAVGGIGNNRKMFGPLLNGVDHLPATYDRDKQAFTIGEPEYGAHFAEALEGLVNLHGANTIAAVIVEPMAGSTGVLPAPKGYLKKLREITKKHGILLIFDEVITGYGRLGYAFASERYGVTPDMITFAKGVTNGAVPMGGVITSAEIHDAFMTGPEHAVELAHGYTYSAHPLACAAGIATLDIYRDEKLFERAKALEPKFAEAVMSLKSAPNVVDIRTVGLTAGIDLASIADAVGKRGFEAMNAGFHDHELMLRIAGDTLALTPPLILSEDHIGEIVDKVGKVIRAVA

SEQ ID NO: 61789 - protein, 895 aa, Glycine max
  misc_feature (214)..(214): Xaa can be any naturally occurring amino acid
MRLLSIITTSLTLFFLLLFLSIHLQAYTPEDNFTISCGTTGIVFDGQRTWTGDEDTKYLSGGQGSTVLTQAATQDPSVNQVPYTTARLSPSQFNYSFPVSAGPKFVRLFFYPADYPSFPRTDASFSVQSNGFTFLKGFNASLNADAEATKTIFREYVVNVNDGENLILSFTPSQPNSYAFINGIEVLSMPSDLYYTSATDSTGFKFLGSTTLYXVETRFALQAEYRIKMGGQEISPLNDTGLFRKWAGDEEDYLIKQNPQNNDLSSNTDGKMNITVNPDYVAPKELYRTARNMGTNATLNKISNLTWEFPVDSGFTYVLRLHFCELDPNINKDGDRVFFIYIASQLAENHADVMQWSHNQKGLAVQRNYAVLIPKDNTQKKVNLSLRMDPYATNDKTKYSDAFLNGLEIFKISEAGSNNLAGPNPDPVQTPHNNIPAPKGNRKSGTTSIIGIVAGVVSGVVLISLIILFLIVFFRRKTITTPKDYNKSKSSATSKWGPLSFTTTKSTTTTKSSLPSDLCRHFSLPEIKSATNNFDDVFIVGVGGFGHVYKGYIDNGSTPVAIKRLKPGSQQGAHEFMNEIEMLSQLRHLHLVSLIGYCNENNEMILVYDFMARGTLRDHLYNTDNPPLTWKQRLQICIGAARGLHYLHTGAKHTIIHRDVKTTNILLDDKWVAKVSDFGLSRIGPTGNAKAHVSTVVKGSIGYLDPEYYKRQRLTEKSDVYSFGVVLFELLCARPPLIRTAEKKQVSLADWARHCCQNGTIGQIVDPTLKGRMAPECLRKFCEVAVSCLLDDGTLRPSMNDVVWMLEFALQLQESAEQRENTNIVDNEINERREEEASDDLFSTGTSVGQVSDFNKSSGVVSVSTDSEELSSSYKESDKLMSGTVFSEIVDPKPR

SEQ ID NO: 61790 - protein, 273 aa, Brassica napus
  misc_feature (260)..(260): Xaa can be any naturally occurring amino acid
SPPPNESDEELKGVSYQEYRRLRRIKMRNTPRDPNVDERDDDNLPKAKVESDSGKSQSETDRSRKRRGRRSYDSDSESVESDSDEEDRRRQRSRRKIKSKSSRRSEESDSDEEDRKLGRKRKKSTSIRKKRRYSDSESEISASSSGDEQQHTKSKIKRLKKLSGDEEEDRGRRTSNKKKGSRKKRGHRSASGEEHSRSKSKRRKKLSGDGSDTDLKAKLEEKVKDTELELKKFREEEEAEVGPKAEGHMSGYGPALRPGXEGDAIAQYVQQGN

SEQ ID NO: 61791 - protein, 220 aa, Vibrio vulnificus YJ016
MSMTQDEMKKAAGWAALKYVEKGSIVGVGTGSTVNHFIDALGTMSEEIKGAVSSSVASTEKLEALGIKIFDCNEVASLDIYVDGADEINADREMIKGGGAALTREKIVAAIADKFICIVDGTKAVDVLGTFPLPVEVIPMARSYVARQLVKLGGDPCYREGVITDNGNVILDVYGMKITNPKQLEDQINAIPGVVTVGLFAHRGADVVITGTPEGAKIEE

SEQ ID NO: 61792 - protein, 311 aa, Bradyrhizobium japonicum USDA 110
MLIASGDALIDFVPTRNADGREAVMPAVGGSCLNVAIGMARLGAPTGFVGGISTDLFGQMIADHATASHVELGLATRSDHQTTLAFVRIVAGESHYAFYDAETATRNWTYRRGSVAFDTVEVLHVGSTTLVNDEGAAETKALIADARMSSTISFDPNCRPNLVRDKPAYLARMAEFAQSADLIKMSDVDFAYLFGDEPYQQRASTLLGQGTSLVVVTRGNNGAIAWHAGAGRIEVQAPRVEVADTIGAGDSFQAALLFALHKQGRLARQQLKVINADELRRALSFAANCAGLTCTRPGADPPWSHEITWSP

SEQ ID NO: 61793 - protein, 393 aa, Aspergillus nidulans FGSC A4
MSVILCTAGYDHTIRFWEALSGICSRTIQHPDSQVNRLCITPDKRYLAAAGHNNVKLYDIKSTNPNPVMTFEGHTNNITGVAFHCEGKWMVTSSEDGTVKVWDTRTGSLQRNYAHKAPVNDVVIHPNQGELISGDRAGIVRVWDLGESVCTHQLIPEDDVAVHSVSVASDGSLLCAGNKKGNVYIWRMIQEAEVTRIVPICTFQAHKDYLTRVLLSPDVKHLATCSADHTAKVWNLDLDFPPAKTAIAAAARSKVKSPSAAEVKPASPSSAGSESQSNSMQLERGKADSIPFHLLNGTQPANNVEPPPSFPVQPDGPPMDPNTGTLFLETTLANHQRWVWDCAFSADSAYLVTVSSDHYARLWELASGQIIRQYSGHHRGAVCVALNDYSEPR

SEQ ID NO: 61794 - protein, 213 aa, Candidatus Blochmannia floridanus
MLTTEKYQGLNWSKNHGLIPAIIQHSISGEVLMLGYMNQESMAITEKTGYVTFFSRSKNRLWIKGESSGNVLKLINWYPDCDFDSLLILVLPQGFTCHKNTNSCFHPALTDFSFLFQLENIISIKKNHTSSHGNQQSSYTSDLYTSGIERIAQKVGEEGLETALAAVSRNSKSLIDEASDLIYHLLVLLQHESLNFHDVIQELRVRSKLKKKH

SEQ ID NO: 61795 - protein, 586 aa, Oryza sativa
MASHIILPKEEEAALGVAVEEDHDSPAAPGYQHQQGPPVAKALPFSATCVRISRDSYPNLRALRNASAMSLPDDDAAYAKLEEGDYGYLLDDVPHFTDYLSDLPVSADTPPLPTHPCLALVVPLPDSTPATFPNPLQDHPAYSTVKQYFVNADDTVPEKVVVQKDSPRGVHFRRAGPRQRVYFESEDVKACIVTCGGLCPGLNTVIRELVCGLSHMYNVNDIFGIQNGYKGFYSSNYLPMTPKSVNDIHKRGGTVLGTSRGGHDTKKIVDNIQDRGINQVYIIGGDGTQKGAYEIYKEIRRRGLKVAVAGVPKTIDNDIAVIDKSFGFDSAVEEAQRAIDAAHVEASSAENGIGLVKLMGRYSGFIAMYATLASRDVDCCLIPESPFYLEGEGGLFEYIEKRLKENNHMVIVVAEGAGQDLIAKSIAAADQIDASGNKLLLDVGLWLTHKIKDYCKNKKMEMTIKYIDPTYMIRAIPSNASDNVYCTLLAHSAIHGAMAGYSFTVGMVNGRHAYIPFHRVTSTRNKVKITDRMWARLLSSTNQPSFLSQKDIDAAREADKLASKSPVPVNTKEHGENVKKPANGEK

SEQ ID NO: 61796 - protein, 161 aa, Oryza sativa (indica cultivar-group)
MEVMVHSSTFLLPKLHQPANSPAKKAAKLRICADGGANRIFDEMFQMTNDPDYESTRKRYIPEIIEGDMDSIRPEVKQFYSSQLCVLVTGALGGRFDHEAANINILYLFSDMRIVLLSDDCLIRLLPKTHKHEIYIESSVEGPHCGLFPVEHHLEALQPLA

SEQ ID NO: 61797 - protein, 391 aa, Vibrio vulnificus YJ016
MRGHIMSVIKMTDLDLAGKRVFIRADLNVPVKDGKVTSDARIIASLPTIKLCLEAGAKVMVTSHLGRPTEGEYAEEFSLQPVVNYLNDALDCEVKLAKDYLDGLELNAGELVVLENVRFNKGEKKNDEELSKKYAALCDVFVMDAFGTAHRAQASTHGVGMFAEVACAGPLLAAELEALGKAMSNPERPLVAIVGGSKVSTKLTVLESLSKIADQLVVGGGIANTFIAAEGHNVGKSLYEADLVETAQKLMKECAIPVATDVACAKAFDENAEAEIKHVSEVQDDDMIFDLGPDSTAALAEIIANAKTILWNGPVGVFEFKNFEAGTKGISEAIAQSPAFSVAGGGDTLAAIDKFGIKADVSYISTGGGAFLEFVEGKVLPAVEMLEARAK

SEQ ID NO: 61798 - protein, 428 aa, Gibberella zeae PH-1
MSSRPHNEEPLPLLSAEERDRDMKGELDVEGDAGRAEPPKNNNLEHEYSIPSTVKFAWLGTYFFFSLLLTLYNKLVLGMFHFPWLLTFLHASFASMGTYAMMQMGYFKLSRLGRRENLALVAFSALFTANIAVSNLSLAMVSVPFYQTMRMLCPIFTILIYRVYYGRTYSYMTYLSLLPLIIGAAMTTLGEMSFTDAGFLLTILGVILAALKTVVTNRFMTGSLSLPPIEFLLRMSPLAALQALACATATGEVSGFHQLITSGKVPLPPAFASLFGNGFLALLLNISSFNTNKLAGALTMTVCGNLKQCLTVALGIFLFDVTVDLLNGAGMAVTMLGAAIYSKAELDNKNRKSQQAAAAYKPVDQQSRRSTVLLNEVRKGEDWRTRDVITIMIMGYGVFENMQAQGLHFQIWFSLDEWLRALVDRCPV

SEQ ID NO: 61799 - protein, 3154 aa, Burkholderia pseudomallei K96243
MPRPPMNTDNPRRAEPIAIVGMGCVFPGAAGPAAFLELLRAGRVAVRDVPPERWDAAALHDPDPDAPGRILTRRAATIDGAHGFDPEFFGLSRRDAREMDPRQRLMLKTAWWALEDAGMPGWGLAGRSVGVFLGASNGEFGGAHARLSAIGASTAAGHATSVLANRVSYLLGLTGPSLVVDTACSSSLVAVHLACAALRARECELAIAGGVSLMLRPDASVAFSRARMLAADGRSKPFSASADGYGRGEGAGAVVLKRLSDARRDGDRIVAIVLGSAVNHNGQSNGITAPSAPAQEALIRQAIEAAGVAPEQIDLVEAHGTGTLLGDPLEAKALGRVLGAIDGRAGALPIGSVKGNIGHLEAAAGIAGLIKLALALRHREILASAGFDAPNPHIDFRALNLTVPTARTPLPERARPAIGALSSFGFGGANAHLIAAAPPADQPDRHDRHDQHDSPVRHAGAQTGAPWPALLVLSAASDSALNRLAAATAACARGDRPGAWRLARASHVARSPLRRRLAVVAPDADTLAAALDRAASGGRDGVVARGAAPRRRPALAFLYAGQGAQFPGMAAGLLDGDTELRRTLEHASAITGLPIVDWLAAGGAALDRTDVTQPLMVALQVGLTRQWAAWGVAPDIVIGHSLGDYAAAVAAGALSFDAAMRVAALRGRLAATSARPGGMVAVAAGRDAVAPHLARGAAIAVDNGPAQLSVAGDAAALAETVRRLEAAGIAARPLPVSAAFHSPAMEPMLDAFRAALADVAMQPLRVPMVCNRTGAVLPAGTMLDAEFWVRHLREPVRFADGVRALAREGVALGLEIGPSAMLSRLAPLSAPTLSVVPSLARGTRDRDALLAAVGALWVAGVTPDWRAIDGPDRVHAELPLYPFDDAPFPLLADGTVAAGAIASSGAFGAREAGPAPSPPQASPSLPATPAVAAASASNAAARERALDIGAKLRDAIAEALETSPDRVDPTVPFIEMGADSLVLMAAARKIEAAFGVRIPMRAFFDELSTMEALATYLAAESPRPAAASDRAPAAPSSPGFVAQVVREQLALMRRQLDLLEGRRAAGEPEMPDDAARALRAEIARAERMGDRGEDGRREEGGSEEGRGEWHGGGKDGHGGGDGSGKGGDGSDTGRAVPAVRATRRANTVRDALSPRRQAHLDKLIGDYTRRTAGSRALAARYRDVMADSRASAGFRPSIKEMLYPIVCRSAAGATFEDVDGNRYLDLSMGFGVHLFGHAPDFVTAALRESLSRGLRLGPQADRAGEAAAVIARLSGQDRVAFVNSGSEAVMVALRLARTVTGRERVVIFRGAYHGHFDGVLADAADPADPAAGGAPLVPGVARGAVADTLVFDYGDPASVDTLAAQLGHVAAVLVEPVQSRRPDLQPAAFLRRLRALAEQAGALLIFDELITGFRIAAGGAQAHFGVKADLVAYGKILGGGLPIGALAGRADVMAAVDGGAWRYGDDSAPTAETTLFAGTFNKNPLSIDACVAVLTEIERRGDALYAQLNERSARLHARLEQALAGTPIGIARFGSVFRFVFGRNLDLFFYHLLLRGIYVWEGRTCFLSAAHTDADCDRLVVAVADAVAALRDGGMLDEGEGDHEGEVEGEGEGGPTADPAARDYAAPHADTDTHTDTLPMIRAQRQLAALAEMDPAGAVAYALPLLLALDGPLDAARLRDAVERAAARHDGLWVAMDPLSGTLRMMPPGRLTLGVQALDAAALDAQVRRQMAAPFDLKAPPLLRATLFAFADGTHALLLVGHHAALDGFSLQVLAADIAACYRGAPLPRAASLRRVLAAHRDAERDGRWAAARDGWRARLRDAPAGFDLDVAAPRPPMRALRGAREVRRIEAASARALRARAAAERTSLLAVMLAGFAWLLARHGAADVVIGVPYAGRALAGDGAQRVVGYCAHLLPIRLRAGAVDSVAALLAHTRAALIEALDHADYPFAHIVDDLALKRDPARPLLVPATFNVDRVPPALDFGEGVAARLRSPAVGAGRFDLACNVIDDGDALTVEFDHDEALYGGGRAQRLADEYLQLLEALAQGGERPLHDGAGHVARWATVVAAGRAEPLAVRWRRHLERAPQQVAVAVDGDARLSRAALDRWSDAVADAIEGAISGVRAGVIEGVIDGAVEDKIEGAAEAARASATAGPVALLLPRTEALPVAMLACWKAARAWLPIDPATPAERIAEMIRRAGCALVVRDAATAAAADGAIAPRCATLDLPPRAAAGRRAARRPWPAPNPEDVAYVLFTSGSTGRPKPVAVPHRALEWYVQGLLARLGLPSGLSCGLVSTFAADLGLTATLPALFDGGCLCIQSDAAARDPLLLAAVHRKRPVDLLKIVPSHLEALLAGAPDPLLLPRRVLVLGGERAGPGLLRRLAECAPPALRVMNHYGPTETTVGVAMGEWTRGADALRLDAPLAGAALVLLDDAGRRAPAGVRAQLYVGGPQVALGYPGCPDETAARFGARPASGVAGPLYATGDLGRLDADGTLTIVGRTDDQAKIRGYRVEPGEVAAALEGLPGVASAAVVAAEHPARGTVLVAYVAGDGAQADPASLALALHARLPDYMMPARIIPCRSLPLTANGKLDRGALPAPDWATHAPGEPASATVSSEAERVQATLVAVWRELFGRPDIGVHDEFFALGGDSILGIRMVARLHRDGLRLLASDLYRHPTIAALAPLIRPVDAQAEQGVLSGPVPLLPAQRRWLEIGAGLRPHANLSLLLELDAEVTPARVADAFARLLHQHDGLRMRARTDGGELVQTYGPPAPVPLHRVAAGHATPAALTRLQALADPAASPLVLGWLDGAPSRLLIVMHHWITDAVSCAILLDDLARLLRDPDAPLGPKTPSLRQWAQTLTERAASPDALAQLEYWTLSTSLPPPALPARSGGARGDAADGEWPGAPGAVGLTLSADETRDVTAGPAAQAGAETEDLLLAALALALGGRTGEPLLYVELEGHGRTPPDGLPEPARTIGWFTARHPAWFDLTGVPEAAAVAAVRAQRLSIPNRGADYGALRHLGPDHARDALAAGRRPAVSLNWLGQLAGIEHAPFRLVSWRPGCPLRGAERAADLPQPHALAVETMLIDGCLRIEFIYDAARFDAATIDTLAADYAAALLRLARERAAPPAPPPDSPGELDADDLAALAASR

SEQ ID NO: 61800 - protein, 676 aa, Vibrio vulnificus YJ016
MLSIRLMHSGADMPSRKHLANAIRALSMDGVQKANSGHPGAPMGMADIAEVLWRGHLNHNPSNPEWADRDRFVLSNGHGSMLIYSLLHLSGYELSIDDLKNFRQLHSKTPGHPEYGYAPGIETTTGPLGQGITNAVGMAMAEKALAAQFNKEGHDIVDHFTYVFMGDGCLMEGISHEACSLAGTLGLGKLIAFWDDNGISIDGHVEGWFSDDTPKRFEAYGWHVIPAVDGHNAEAINAAIEAAKADPRPTLICTKTIIGFGSPNKSGSHDCHGAPLGAEEIAAAREFLGWEHPAFEIPADVYAEWDAKAAGAAKEAAWNAKFDAYAAAYPAEAAEFKRRVNGELPAQWEEKANQIIADLQANPANIASRKASQNALEAFGKMLPEFMGGSADLAPSNLTMWSGSKSLEASDFSGNYIHYGVREFGMTAIMNGIALHGGFVPYGATFLMFMEYARNAMRMAALMKVQNIQVYTHDSIGLGEDGPTHQPVEQIASLRLTPNMSTWRPCDQVESAVAWKLAIERKDGPSALIFSRQNLAQQPRSAEQVADIAKGGYILKDSDGKPELILIATGSEVELAVKAAEQLTAEGKKVRVVSMPATDAFDKQDAAYRESVLPSDVTARIAIEAGIADFWYKYVGFDGRIIGMTTFGESAPADQLFEMFGFTVENVVNTAKELLA

SEQ ID NO: 61801 - protein, 225 aa, Triticum aestivum
  misc_feature (191)..(191): Xaa can be any naturally occurring amino acid
MDSEHWISRLAAAKRFYAAQLGHADRAGMDELDMDGDENAGRPDFACPYCYEDHDVASLVAHLEEDHPFEPHAAPCPICSEKVSKDMLNHITMQHGYLFKNRRRLRRFAVPGSQSLSLLSRDLREAHLQVLLGGGGHRSSNNNATNISADPLLSSFGLSFPTLDAEETSKLSTPAQSDVPVLKETAARPWXSSIDSSLTREEREQASVRAMFVQDLLLSTLFRDQ

SEQ ID NO: 61802 - protein, 129 aa, Pasteurella multocida subsp. multocida str. Pm70
MTKVIHTDNAPAAIGPYVQAVDLGNMLLTSGQIPVNPKTGEVPADIVAQARQSLENVKAIVEQAGLQVANIVKTTVFVKDLNDFAAVNAEYERFFKENNHPSFPARSCVEVARLPKDVGIEIEAIAVKA

SEQ ID NO: 61803 - protein, 139 aa, Cytophaga hutchinsonii ATCC 33406
MGGNRTFSMIKPDAVKDGHSGSILKMIEGAGFRIVAIKLTYLSAERAGEFYAVHTGKPFYDSLKSIMSESPIIALILEKENAVEDFRKLIGATNPANADAGTIRKLFAKSLERNAVHGSDSDENAQIEGSFFFSALEKF

SEQ ID NO: 61804 - protein, 110 aa, Zea mays
  misc_feature (29)..(29): Xaa can be any naturally occurring amino acid
DLGYVLRGSRPPRMNSFRIRKRNRVLSSXDKRALALFYFREKSKREPKVLASFQRLGQKTLGHYVGPSHDPFASTEGWVMIFCSTSPLYQVGFPRLCFPPPLVISVFELA

SEQ ID NO: 61805 - protein, 347 aa, Zea mays
MSTRAAGSALLRHLGPRVFGPVFSPAVAPPRPLLALAGGGERGGALVWVRVRLLSTSAAEAKEEVAASKGNSGSTAAAKAEAVEAAKEGDGKRDKVVSSYWGVAPSKLMNKDGAEWRWSCFRPWEAYKPDTTIDLNRHHEPKVLLDKIAYWTVKLLRVPTDIFFQRRYGCRAMMLETVAAVPGMVGGMLLHLRSLRRFEHSGGWIRALLEEAENERMHLMTFMEVAKPKWYERALVLAVQGVFFNAYFLGYLISPKFAHRVVGYLEEEAIHSYTEYLKDLEAGKIENVPAPAIAIDYWQLPADATLKDVVVVVRSDEAHHRDVNHFASDIHFQGMQLKETPAPIEYH

SEQ ID NO: 61806 - protein, 337 aa, Zea mays
MASESRISQVATTIPVRNVQDLAAYDAGELTADALERYIRPDIDKDAVLYEHSGELPVVDLGRLNPQHWEEEAAAKLRYACEEWGFFQVLSHGVPEEVMVNIKRDIQEFFELPLDVKNAYAQTPGDLQGYGQAYVVSNDQKLDWADMFCIISQPPPARDMKHWPTQPLTFRKSLEDYSVELEKVAHSIVTAIGKILNIDPELMSDKYAVQVLRMNYYPPCTSMPEKVLGFSPHSDASFLTILSQVNSVEGLQIRRHGAWVPVKPHPEALLVNVGDLLEIMTNGKFKSIEHRVMINARKERLSVSAFHNPKFDGVVSPATGDSDRKAFVQDCESGRLY

SEQ ID NO: 61807 - protein, 377 aa, Magnaporthe grisea
MLVHQVNTKLCSAKQFTHLAKVVTPALSYQASSVYSANLPRLAASPRLFSTTSSAQLRDFFPVKETEHIRQTPPTWPHHGLTEKEMVDVVPGHRKPRTLGDKFAWSLVRISRWGMDKVSGLSSEQQQINKGSPTTSIVAAKPLTEAQWLSRFIFLESIAAVPGMVAGMLRHLHSLRRLKRDNGWIETLLEEAYNERMHLLTFLKMCEPGWLMKILIIGAQGVYFNAMFVAYLISPKICHRFVGYLEEEAVHTYTRSIEELERGDLPKWSDPKFQVPEIAVSYWGMPEGHRTMRDLLLYIRADEANHRGVHHTLGNLNQVEDPNPFVSDYKGDKPRPVAASRPEGFEREEVIGKEVIGKEVIEKDVIGKEVLGKQVSV

SEQ ID NO: 61808 - protein, 118 aa, Oryza sativa (japonica cultivar-group)
MNSRSTRTSLFDGIEEGRIRATSYSSHEIDENENDQAIDGLQDRVSILKRLSGDIHEEVETHNRMLDRMGNDMDSSRGFLSGTVDKFKMVFETKSSRRMGTLVASFVALFLLVYYLTR

SEQ ID NO: 61809 - protein, 346 aa, Triticum aestivum
  misc_feature (78)..(78): Xaa can be any naturally occurring amino acid
MPHRGAVLVFLLALAAAPLAVAWRPWPPRDASGALAGLGASKKFEGSSDFVKLEYHMGPVLAADITVHPIWYGAWPAXEQKRTIRAFLRSLSPQASGEKEGAVPSPSVADWWRTVRLYTDQTTANVSAVVALGQEKCDARMSRGASLTRMDIQTVVKDAVTARTRPLPVDAGGVYLVLTSPEVHVENFCGQVCGFHYFTFPSVVGYTLPYAWVGNSAGRCPEVCAYPFAIPAYVPGRRPEAPPNGDAGVDGMVSVIAHELAEMASNPLANAWYAGGDPSFPTEIADLCEGIYGTGGGGAYTGQLLTDGRSGAAYNLNGVGGRRFLVQWVWDPYRSYCSGPNALDHQ

SEQ ID NO: 61810 - protein, 200 aa, Aspergillus nidulans FGSC A4
MTSRLVLVIGDLFIPDRAPDLPAKFRKLLTPGKIGQILCLGNLTDRSTFEFLRQVAPDLQLVKGDFDVDSPNLPLSKVVTHGSLRIGFTHGHTIIPQGDADALLIAARQMDVDILLWGGTHRFEAFELEGRFFVNPGSATGALSTGYWPEGEEPTPSFCLMDIQGDVLVLYVYQLKTDSNGVETVAVEKVSYRKNSVLSS

SEQ ID NO: 61811 - protein, 181 aa, Candidatus Blochmannia floridanus
MMKLKEFFINIISIFRSVYMVGMQAFSKRETYMYPDVACKLSSRYRGRIVLTRDSAGHERCVACNLCAVSCPVGCISLKKSENSEGRWYPEFFRINFSRCIFCGMCEEACPTAAIQLISDFEMSDYKRSDLVYEKSDLLISGPGKYKNYDFYQISGVKYSNKYKKESSFEEKPISVKTILP

SEQ ID NO: 61812 - protein, 433 aa, Pisum sativum
MVHSFKYIIIGGGVSAGYAAREFVKQGVHPGELAIISKEAVAPYERPALSKAYLFPESPARLPGFHTCVGSGGERLLPEWYSEKGIQLYLSTEIVSADLAAKFLKSANGEHFDYQTLVIATGSAVIRLTDFGVIGANAKNIFYLREVDDADKLYEAIKRKKNAKRVVVGGGYIGLELSAVLKLNDLDVTMVYPEPWCMPRLFTSEIAAFYEGYYANKGINIIKGTVAVGFTANSDGEVKEVKLKDGRVLEADIVIVGVGGRPQISLFKGQVEEQHGGIKTDSFFKTSVPDVYAVGDVATFPLKLYNDVRRVEHVDHARKSAEQAAKAIFAADVGKSVEEYDYLPYFYSRSFDLSWQFYGDNVGETVLFGDNDPASSKPKFGTYWIKEGKVVGAFLEGGTPDENKAIAKVARAKPAVEDVNQLAEEGLSFASKI

SEQ ID NO: 61813 - protein, 260 aa, Oryza sativa
MSPAEASREENVYMAKLAEQAERYEEMVEFMEKVAKTTDVGELTVEERNLLSVAYKNVIGARRASWRIISSIEQKEESRGNEAYVASIKEYRSRIETELSKICDGILKLLDSHLVPSATAAESNVFYLKMKGDYHRYLAEFKSGAERKEAAENTLVAYKSAQDIALADLPTTHPIRLGLALNLSVFYYEILNSPDRACNLAKQAFDDAIAELDTLGEESYKDSTLIMQLLRDNLTLWTSDNAEDGGDEIKEAAKPEGEGH

SEQ ID NO: 61814 - protein, 396 aa, Oryza sativa (indica cultivar-group)
MASRAAIPNESPHTDGRFMMRLKLPNGVTTSEQTRYLASVIETYGKEGCADVTTRQNWQIRGVTLPDVPAILDGLNAVGLTSLQSGMDNVRNPVGNPLAGIDPDEIVDTRSYTNLLSSYITSNFQGNPTITNLPRKWNVCVIGSHDLYEHPHINDLAYMPAVKGGKFGFNLLVGGFISPKRWEEALPLDAWVPGDDIIPVCKAVLEAYRDLGTRGNRQKTRMMWLIDELASATKSRVVTSATWMEFIHKKPSRSMPQEHNSVSHLQSNYRNLNQKSCDAMEGSNLKSAALLEQLHVHLASGAGKELVQMIGFVYHLNISPKKLGFDEEVFVVVDLKKGVVSKGPYEGKPDATFSFTDDDFLAISSGKLNPQMVFIMGKLKIKGSISAAQKSKPSKL

SEQ ID NO: 61815 - protein, 1087 aa, Mycoplasma penetrans HF-2
MDKNRKYMNFNSVIINVNTSKKNKFILNGFNLNGLFSINEKTIMDNNIELFSEANLNVYIVIEKQYSNILKKHLVNIEKVQILLKEDFFNQKNFIKSDEKTLIVDDNFYFNQEILNNLLTNEKYSNLSTLIKLNYNTHFDYIGIFDSTSINYIDFKNNSISDDIKVLSNLVELKEKQYLPIKIYDYKTLSKMDSKYECDKGFLYFTPGPVQIREWVKEVLGEYVNHHRSLSIKEIYKEAAENIKWAFNSKKGYPIAMANTGLGAIESTFVNLLEQGDEILILSNGFFGENLIDIAKRHQLNQSLLQIKQGESFDLKEVENLIKNKKAVFMVYMDTSCGILNPVKKVGELCKDYGCLFIVDAISGILNEEFNFDEYGVTAAVSTSGKGFEVSPGLAFVCVSEQGMQISANIKKRKPKFLDWQTFKVRSLYDGLTPSTYPVNIFASLNKVCEEIKDNGGLTRLIDKKFNLNLYLSESLITLGFRHIIENENSRSNWVLVMETPNIIKANELRAYLYAMKNILIECGIADSSNRIVRLAISAAHDIEDVTQLIEAIKEYIDLKITSKGEVMKKFYITTPIYYPSGNPHIGHAFTTLIADVLTRYKKKLGYETFFITGMDEHGQKIEEKAKELNLKPQELVDKYAKVFDNLWKLLGIEYSHFIRTTAEYHKNVVQETFSELLKKDFIYLGVWKGLYCVSCEENYTKNIAVRKENDDKLYCAQLHPLIQKEEESYFLKIKQFKKYISSFLKDPNLVYPITRINELFNSFLNNDDFDDLSISRSNFSWGIQIKENPKHVVYVWLDALLNYLSGLGYRQKDDSNFQKFWNSQDAEIVQLMSKEITRFHCIYWPIMLEMLGLRKPTKYISHGWIITEQGKMSKSLGNVLDPIYFINTYGRDAFRYYLLKELSLKEDSVFSEKLLINTFNKDLANNVGNLFNRSIGMINKYRDGIIPKYSKPKLSFNIEFEKQLKQFDDEITTIIEKLNIQKILSRVIDLINECNFFIEQVKPWDLKKENNEKDLDCFLSLILNAVKRVIYYLEPVLIDGSKEALKQFNIDSSKFDIKFVTDFSSLDNQKINTPEPIYLRIESEDK

SEQ ID NO: 61816 - protein, 610 aa, Bartonella henselae str. Houston-1
MQKNIPSISCSPFPASRKIYQQSPLFSDVQVPLREISLTDGSAEKSLNIYDTSGPYTDNDIIIDITNGLPAISLPWLSKRADTEPYPARPVKPEDNGLLYDKTPPPAFKQKRPILRAKNGKAITQMAYARAGIITAEMEYVAIRENEGLTVKDQPKAQPDKICNGSIPEIYTAEFVRNEIACGRAIIPHNINHPECEPMIIGRNFRVKINANIGNSAVTSSMAEEVDKMVWAIRWGADTVMDLSTGRNIHNIREWIIRNSPVPIGTVPLYQALEKVQGIAENLTWDIFRDTLIEQAEQGVDYFTIHAGLRLPFIPLTIDRITGIVSRGGSIMAKWCLHHHKESFLYEHFDEICDIARTYDISLSLGDGLRPGSIADANDEAQFAELKTLGELTKVAWAKDVQVMIEGPGHVPMHKIKENMEQQLDLCHEAPFYTLGPLTTDIAPGYDHITSAIGAAMIGWFGTAMLCYVTPKEHLGLPDKNDVKTGVITYKIAAHAADLAKGLPRAQLRDNALSRARFDFRWYDQFNLSLDPETACAFHDETMPKEAHKLVHFCSMCGPKFCSMRISHDIRDTVHRKIKDEGMVAMAEKYQKNGDLYIDVSPPQKKIVNH

SEQ ID NO: 61817 - protein, 206 aa, Schizosaccharomyces pombe
MNANINRYDYLFKLLLIGDSGVGKSCLLLRFADDTYTESYISTIGVDFKIRTFELEGKTVKLQIWDTAGQERFRTITSSYYRGAHGIIIVYDVTDQDSFNNVKQWLQEIDRYAVEGVNRLLVGNKSDMVDKKVVEYSVAKEFADSLNIPFLETSAKDSTNVEQAFLTMSRQIKERMGNNTFASSNAKSSVKVGQGTNVSQSSSNCC

SEQ ID NO: 61818 - protein, 998 aa, Colwellia psychrerythraea 34H
MKTPSFFHSISSLNRAVYIALSASLLVSACGETSKSTQSSQLDNQGVDIAAKSKTITASAFKVSDLDNLPSDSSAHWLSTNILVLPKSVNKFQYQLLSKNSVGFSSIDLMPVNFPEKLATKFPHLADFQAFELQLTPDQSKRWLKQQVMVVAIDATIDTTVEPALKTSKQAKEVAYVQIGGVIDALYTQGKNDADEVTDLGATIISNQEVEGVSTAVSFKLWAPTAQAVSIQLFDDNLQALSDGKLEMVEDSSTGVWQVLSDSQASYAYYKYQVNVYHPASKKIESLSVTDPYSLSLSVNSEYSQVVDLNDAVTQPKDWLTQQIPTVKNVEDNVFYETHIRDFSANEQQLSDSGFKGKYKAFSEKNSDGIQHLKALQIAGLNNIHLLPTFDIATVNEDDSKHLDIDDSLGKVCAITKNISLCQQPYDEKQSIKSLLQSYEVAGEQTQQLVSELREVDNYNWGYDPFHYTVPEGSYAVDAKGVSRLVEFREMVQSLHAMGFRVIMDVVYNHTHQAGLEPNSVLDKIVPTYYHRLDPLTGDIEQSTCCDNTATERVMMAKLMTDSLVVWARDYKIDGFRFDLMGHQPKDAMLTAREAVRLVDNDTYFYGEGWNFGEVASNSQFIQASQLELGGSEIGTFSDRLRDAVRGGGNNTRDSQGVGNGLLTFPNNKQPNESQDQTMIQADYALRMDQLRIGLAGNLINFPLRTLKGESNGEKVLGKDIPYGDQPTGYALDPADTINYVSKHDNQTLWDNSQYRLPFDVSTEDRVRMHLQSLSFALFAQGIPFIHMGSEFMRSKSFLRDSYDYGDWFNRVDFSKQDNFYNVGLPPAEKDKDNWPLIKEVLAGHQGRDQVNAEQIQRSSNAFIDMLAIRMSSPLFRLTTEQSIIDKVSFLNAGALKQGGSISAQQTGLLVMKIDDTQGEAVDSKYQSLLVIFNISDKTQTFNYNFKEDFDSTSTHGYQLHPIQKRGSDEVVKQSKVTVKGFIVPPLSSVVFVKPDSK

SEQ ID NO: 61819 - protein, 1097 aa, Cytophaga hutchinsonii ATCC 33406
MQVYIPDKPYEIFSLTYCFETIYNMKQRTFVLLFFILTLSSYAQTLKLETVIQKGHSASVKAVAVSPDGKILATGSRDKSVKLWDQQSGMEIRSLIGHDHTVNGLAFSPDGKLLATSSADGTARVWDILTGKEIFTSPKNSKYITDVAFNPDGKSFAYAGYPDSASIYAIPSGKLIKRLEVNADQGSGYGISLKYSNDGKWLAIGEDNKTANVYRTSDWHLAYTFKPAEGWCGGCGTYVEFSRDNKSLFKIAHNDKLSQYDLQTGSLIKTFGEPVDYLRGITLTKDGQHVIAASDSMLYNYTITSKTVVAYKLYLSETVNDIALSLDEKEILVASDNMTAWALEAASGKVIRTYQGALQEQDKGGLNYNADNYWEYNIARYLRLKNELLLTKDDNNFITGKTGVNAIQWNISTGAPNKLYEGHTKAVISMDQSADGSILATADGAGEVFLWNTKTGALINRIKPHTEPIFDVSLSRDGKYVATGSWDASIEVYDVQTGEVSSDMYLKENSCYSISFTPNGLYLLCGRLDKSLELREPDSKKVVLSFIGHTDVVSSIAFGADPNKALTASWDGTARIWDVTTGMMLQKFKGARGMLHSAIYSTDSKKIITGGDDRIIRIWDIQSGQVLKTLNGHQSEITSLSLSKDGKMLVSYSTDGVVKFWNLESGLEFYEHVHISSREWMARTPQGYFSATEQARADIHFVKGMDVYAPDQFFEYYRPDLIQQIFLNRGSSPTGMQNVENSLQLSPPPLIKLACIPNADGLQATLNIKVMDEGGGLSEIRLAHNGKNMAVALDPKKVVEGKGNSYIYSVPVSLVRGTNQFSGIAVSKGKIESAASLVSVVSDKAPSAAVCHVFAIGIDTYKNPAYTLNYAREDAEAFAESVKRNGANLYQKVIVHGLYDAAATRQNVLDTLKSLEAHIALNDVFIFYYAGHGSMVDQNFYFIPTECTSMYQATANNALSAETIQAGFKNIKALKQIIIMDACQSGGSVEVLAMRGANEEKAFAQLSRGAGIHVMASAGSEQNAKEILELKHGLFTYVLLEALNGKADGAPKDGKITIYELKSYLDDQVPELNSKYSGKIQFPYTFSRGSDFPIVLE

SEQ ID NO: 61820 - protein, 129 aa, Magnetococcus sp. MC-1
MEKLPDLATLKYNEQGLIPAIAQQYDTGEVLMMAWMNQTSLAETLSTGVACYWSRSRNRFWRKGESSGQVQTVKAVRLDCDKDTLLLLVDQQGVACHTGRHNCFYLEAQDGSWKTITDPEIDPEELYGK

SEQ ID NO: 61821 - protein, 252 aa, Magnetococcus sp. MC-1
MNNLSPPSTVDILEQVYQVIQQRKSAPDPEASYVAKLFHKGDDAILKKVGEEATELVLAIKGRAARNEVAHEAADLIFHTLVGLAIMNIPPTEVMNVLSSRFGKTGLTRNQTPSVELEPSRRQFERRLHSKTIHLIFSSGITIDGLTRDISLDGMQLHVDYADKVRLLGEKGYFELSVQNKATFNANNLLVGLEIPTTMDNNPLMAAVHSARTYRFEFEIVRVTEDAIGLRIIGDKGMFSFALANEVFNDLM

SEQ ID NO: 61822 - protein, 117 aa, Magnetococcus sp. MC-1
MSNDCLFCKIVAGTIPCNKVYEDELVLAFRDIHPQAPEHVLVIPKQHIATLDDVQVQARAVMGHLMERTAHVARLIGVAEKGYRTLINTRGDGGQEVYHIHVHILGGKAIGPMVCNK

SEQ ID NO: 61823 - protein, 364 aa, Arabidopsis thaliana
SNSSRPHLHRFHSNTLRHSAYPSADAGGGLVVYPTYGRHRCSAIAIDAPSSLTGVTPIRWGYTSVQGFQYEMEDDIVIRSDAVDSFSYAAVFDGHAGSSSVKFLREELYKECVGALQAGSLLNGGDFAAIKEALIKAFESVDRNLLKWLEANGDEEDESGSTATVMIIRNDVSFIAHIGDSCAVLSRSGQIEELTDYHRPYGSSRAAIQEVKRVKEAGGWIVNGRICGDIAVSRAFGDIRFKTKKNDMLKKGVDEGRWSEKFVSRIEFKGNMVVATPDIFQVPLTSDVEFIILASDGLWDYMKSSDVVSYVRDQLRKHGNVQLACESLAQVALDRRSQDNISIIIADLGRTECKNLPAQTKRSG

SEQ ID NO: 61824 - protein, 306 aa, Oryza sativa (japonica cultivar-group)
MRPPRGRGFGRGGRGDGGGRSGGGGRGFGRGGDSGGRGGRGRGGGRTPRGRGGGRGGGRGGMKGGSKVVVVPHKHNGVFIAKAKEDALCTKNMVPGESVYGEKRISVQNEDGTKVEYRVWNPFRSKLAAAVLGGVDNIWIAPGTRVLYLGAASGTTVSHVSDIVGPTGLVYAVEFSHRSGRDLVNMAKKRTNVIPIIEDARHPARYRMLVGMVDVIFSDVAQPDQARILALNASYFLKNGGHFVISIKANCIDSTMPAEAVFASEVEKLKADQFKPSEQVTLEPFERDHACVVGGYRMPKKQKGTS

SEQ ID NO: 61825 - protein, 312 aa, Prochlorococcus marinus str. AS9601
MNSVIFQETAKLKKPVPAEKVIELSEKLLEPSSHSKRYPPRLHKTWGTIVFMVAIHILSLIALQPKFWSLPAVTSLLFFYWVTACLGVTLGYHRLLSHRSFIVPRWLERFFATCGAISCQHGPIDWVGLHRHHHSFSDTEVDHHNSKKGFWWSHMGWMFKDVEALKAVPKLSADLIKDPYYRFLNKYFLFLQIPIGLSLYVIGQKLGVGGWALVLWGIPLRLVVVYHVTWLVNSATHCWGKAPFESGDSSKNNAWVAALTFGEGWHNNHHAFPNSAKQGLFKGQIDITWEHIKILAKFGFAKKVKLPSRSYY

SEQ ID NO: 61826 - protein, 442 aa, Oryza sativa (indica cultivar-group)
MSQNDLQPWKIRGIILCSRGEYPSGYVTDPLHINEEAKKFSFQTGLRVVVAYGGTPMYNQLRDLERGADILVATPGRLVDMVERSKVSLEAIKYLVMDEADRMLDMGFEPQIRKIVERMNMPRKSVRQTMLFSATFPPEIQRLASDFLSNYIFITVGRVGSSTDLIMQKVELLSDGEKRGYLLDLLQRQSVGVANSKLQQPLTLVFVETKREADSLRYWLYSKGFPATAIHGDRTQQERESALRSFKTGLTPIMVATDVASRGLDVPNVAHVINYDLPKSVEDYVHRIGRTGRAGKAGSATAFFTESDHSLAKGLLELMTEAKQDVPDWLIQYAERPYYGGSSYGGRNRRSGGGGNRFAGRDFRQGSDYDYSGGGGGGGYSGGGGGYSGGGRGGGYSSGGRGGYSGGGGGGGGDPYRASAPPPRYYPSYPMGTADINASGWD

SEQ ID NO: 61827 - protein, 382 aa, Medicago truncatula
MADLLVKYGGVAPKMAEEAHSQVIDQVVQDALDKAYMTEKDLTAVAVTIGPGLSLCLRERKRKREREREREREREREREMGVQKARRIAGGFNLPIIGVHHMEAHALVARLIEKDLQFPFMALLISGGHNLLILARDLGQYIQLGTTIDDAIGEAYDKSAKWLGLDIRRSGGPAIEELAREGNDKSVSFSVPMRQHKDCNFSYAGLKTQVRLAIESKKIDATIPISSASYEDRLSRADIAASFQRVAVLHLEERCERAIQWALKMEPSIRHLVVSGGVASNQYVRARLDTVVKKNGLQLVCPPPRLCTDNGVMVAWTGIEHFRVGRYDPPPPAEEPEDFLYDVRPRWPLGEEYAEGSNFSRSLRTARIHPSLTSLIQASMQQ

SEQ ID NO: 61828 - protein, 236 aa, Brassica napus
  misc_feature (131)..(131): Xaa can be any naturally occurring amino acid
  misc_feature (137)..(137): Xaa can be any naturally occurring amino acid
  misc_feature (144)..(144): Xaa can be any naturally occurring amino acid
  misc_feature (175)..(175): Xaa can be any naturally occurring amino acid
  misc_feature (204)..(204): Xaa can be any naturally occurring amino acid
  misc_feature (229)..(229): Xaa can be any naturally occurring amino acid
MTSPEKTGSSSVSKKVSEIWERMNEGVPNKRFNFVSKTSTSSPPAKKTANSNWKSYLGIDAKKRDKAVQKEDSVLDSSCSEEAKRIAAAALAAVRNATATAAAASSRGKIEITEVKDFAGQEIEVKRLVEXGSKEAXRPPSVAXRGATAGVDAGSVRQIKKKQKLSVLDKTKKDXWGEYKEENKGVEDELDKYKKSSDKYLDKXVSFLERADYRQFEKERDARLALQSXKRRLDDV

SEQ ID NO: 61829 - protein, 362 aa, Gelasinospora sp. S23
MNTPKVNILYSPGQAAQLSRTLISTCHTRPFLLGGLRVATSLHPTQTNLSSSPPRGFTTTSVVRLKDFFPAKETAYIRQTPPAWPHHGWTEEEMISVVPEHRKPETVGDWLAWKLVRICRWGTDIATGIRPEQQVDKNHPTTATSADKPLTEAQWLVRFIFLESIAGVPGMVAGMLRHLHSLRRLKRDNGWIETLLEESYNERMHLLTFMKMCEPGLLMKTLILGAQGVFFNAMFLSYLVSPKITHRFVGYLEEEAVHTYTRCIREIEEGHLPKWSDERFEIPEMAVRYWRMPEGKRTMKDLIYYIRADEAVHRGVNHTLSNLDQKEDPNPFVNDYKEGEGGRRPVNPALKPTGFERAEVIR

SEQ ID NO: 61830 - protein, 661 aa, Zea mays
MASLWKTKVLPGLNKIFDKDGKKAAAAGFFKSFNKEEIGKEIEEKKAELEPKVAEAYEASPPEVKALFKDKKPVKISKKNSTAVTKFLDELAKIDFPGAKVVSEAVAKSGASPLSPAITFILDKVAPYIPKEEPKAEDAVAEATSREVAVEVEDAEPAIADAAAETPSEAKKGEEEKPAAEEAAPPAAAATEEKTDNSIKNHWNSSLKKKLEAYSNSSVLSAPKLFVHDDFKDKMKPVATDSHLDLNQMPSVGSKDVPGRAYCTILSPPSQAYNLDSSGLFSFSIPTTQPLTSYAMSSLVDGSAVTLAAQGLQSDSVRDKGLEIDSVHEKGVEVGSTPDPAGVELESAPAKRGAELSSKIELHSILGPLCYQIPNMEDVVPISTPLRSEHNSAQKTSQHCMSPNGYTSPSATIGNVSSQLTVDSILRIAADTFPCTPSILRKRKRDKATPASGNELKTGGVCILNIINCAFLTLSIINLFFHTFQGINGNLMKPDRTLWNPFRTNQPHANVVVQAKSKSITFSGDKELPAMEMTYGTQANSLPCHLMEYENSGQIGVEFIRTEAQLGDVLTKPCIRSCRSVSSAGLRIVLQSIQFGQCSLVRVAGLRKDRENGPCQSVFFVRAFGSPFSSSVLLVKKKDGSWRFYVDYNHLNAITVKGKYP

SEQ ID NO: 61831 - protein, 361 aa, Botryotinia fuckeliana
MTTMYVSRVSTRPLSAQSAAQLSKAVAFFAQSYRLSSNACTAPTPSRRAFTSASKIQVKGRDLFPEPEHGQIKRTEPAWPHPPYTAEQMRSKVYFAHRKPRDFSDRVALGMVRFLRWCTDFATGYKHNVEAPKKASDSNALTATKPYQMSERKWLIRYVFLESVAGVPGMVAGMLRHLRSLRGLKRDNGWIETLLEEAYNERMHLLTFLKMYEPGIFMRTMILGAQGVFFNSFFLCYLFSPRTCHRFVGYLEEEAVLTYTLSIQDLENGHLPKWADPDFKAPDLAVEYWGMPEGNRSMRDLLYYIRADEAKHREVNHTLGNLKQDEDPNPFVSEYGKERGEKPGKGIESLKPVGWERDEVI

SEQ ID NO: 61832 - protein, 193 aa, Solanum peruvianum
FVFAGVGSAIAYGKLTTNAALDPAGLVAIAVCHGFALFVAVSISANISGGHVNPAVTCGLTFGGHITFITGSFYMLAQLTGAAVACFLLKFVTGGCAIPTHGVGAGVSILEGLVMEIIITFGLVYTVFATAADPKKGSLGTIAPIAIGLIVGANILAAGPFSGGSMNPARSFGPAMVSGNFEGFWIYWIGPLV

SEQ ID NO: 61833 - protein, 87 aa, Triticum aestivum
MALGDDSPASYIRMVHHLIEKCMTFGMSMEECMEALSKRADVQPVVTSTVWKELEKENKEFFDRYNKQLRSEKGGRSSCSSSSDSSS

SEQ ID NO: 61834 - protein, 401 aa, Cryptococcus neoformans var. grubii
MSAIMLRSGNVARSTILAGGPLIGGPMTFRSAVSSTRTFSLFTKARIQSDDMKRASLSLQPSVREAEKSQGPVVGSEGREVEGPHYQDQVSHNVLSDASTTGAWTMLNPIYTEKELNTVQVVGRAPVTFGDKAAHRTVKFLRKCFDLLTGYTPYEVPASVLAQKPIPIAELRSKGKLLSDQKWLFRIILLESIAGVPGMVGGTLRHLRSMRLLKRDGGWIHSLLEEAENERMHLLTFMTIAQPGIFTRALVLAAQGVFYNAFFLTYLISPRIAHRFVGALEEEAVRTYTHCISDMEAGLIPEWKDMPAPAIAIDYWRLPASSSLLDVIRAVRADEATHRFVNHSLANLDQKRDFNPFALSEASPEERGSKWGYTREESAKFALEQQRKLMAASEKSSGLVE

SEQ ID NO: 61835 - protein, 596 aa, Candidatus Blochmannia floridanus
MMNDNKYIHIDSCVIEKHKIWDSLITKFGSHDLILQSAYIDSLIIWIPKERIIPIMEFLKQILAPHVMLYDLHGIDERLRMYRKELPEADFTVFYHIMSMSRNYDVILKVPLLENAMNVTTITSVFMNANWYERETWEMFGIHFDYHPNLTRIIMPKCWKGFPLRKEYPARATEFYPAFTLTRKKEDLAMDDLLFKPEEWGMHRNNKHEDFMFLNLGPNHPSVHGVFRIILQLSGEEIIDCVPDIGYHHRGAEKMGERQSWHSYIPYTDRVEYLGGCINEMPYVLAVEKLAGIVVPDRAKIIRIMLSELFRINSHLLYVSTYLQDVGVMTPVFLAFTDRQKIYDVIESITGARMHPAWFRIGGVADDLPLNWSDLLKQCLDWLPKRIAFYIDIALKNSIFKKRTCGIGSYGAKEALSWGVTGSGLRATGIEFDLRKSRPYSGYENFDFDIPIGNGLSDCYNRLVLKIEEMYQSIRILNQCLKNMPTGPVKSDHPLTTPPMKKYALKHIETLITHFLQVSWGPVIPPNESLQMVEATKGINSYYLISDGNTMSYRTRIRTPSFPHLQQIPSVIRGSLIPDLIAYLGSIDFVMSDVDR

SEQ ID NO: 61836 - protein, 358 aa, Blumeria graminis
MYLSRLPPRSIPCRSINQISRVVARSSKSRLEFVGSYQNSLTTNQTRCLRPFSSTSRSQLRDYFPEADHEHIKKTEAAWPHPNYPKEQMLTNISYAHRTPKDFSDRIALYLVRFLRFSTDLATGYKHDPVTITENGEKVLKKPYRMSERKWLIRMVFLESVAGVPGMVAGMLRHLHSLRRLKRDNGWIETLLEEAYNERMHLLTFLKMAKPGWFMKFMIIGAQGVFFNSMFLSYLISPRTCHRFVAYLEEEAVLTYSTAIQDIEAGLLPKWTSPEFRIPDLAVQYWKIPEGNRTMRDLLLYIRADEAKHREVNHTLGNLDQNEDPNPFVSEYRDKAAPHPSKGIEHIRPTGWERNEII

SEQ ID NO: 61837 - protein, 194 aa, Lactobacillus acidophilus NCFM
MTKVAVVFADGCEEVEGLSIVDVLRRLNVECDMVGLTSKKVDGDHHIEITCDKVVNDGLLDYDLVAFPGGMNGSANLRDNEKLRDLMVKRHEAGKWDAAMCAAPRALAHYGVLDDADFTCYPGIQDECLEDQPNAHFSERITVTDDKHKIITSRGPATAWAFAYAIAEALGVDTKALKKGMLYDYLAENIQDSL

SEQ ID NO: 61838 - protein, 634 aa, Physcomitrella patens
MCSIPFGRKKSKKGDLAQDLLGDVFSTYSENGKLDAEGLLKFLQTEQGDSKSSLDDAKHLVELIRNERHKSKFPGFIVSSDLSKGDFKNYVLSPDLNGVLESTVHQDMTQPLSHYFIFTGHNSYLTGNQLSSDSSDVPIAAALQRGVRVVELDLWPDDKGGIKVTHGNTLTSPVAFEKCIKAIKANAFVSSKYPVVITLEDHLSSPLQALAAETLTNILGEDLYYPPSSDGFKELPSPESLKGKILISTKPPKEYLEAAVAQKSALKDEKILNELKKADKLQEQSTAPVKSPVEKKIAVPPSEKTKSISEEKDLSEKVGNLRVDSEGESADPAPASSPDGKKATLTADSESDDDDNKKNPEYARLITIHQSKPSKGTTVEDRLKVEGTVVRISLSETKLEKVTEEFPELVVKFTQRNILRVYPAGNRVNSSNYDPTAAWIHGAQMVAQNMQGYGKELWQAHGKFRGNGGCGYILKPKYLLEDLPNGKPFNPSAPGDTKMILKVKVMTTMGWDKAFPKYHFDLFSPPDFFTRLLVTGVPADVAKWKTSVIDDVWEPHWNEDHEFYLKCPELALLRIEVRDHDEGSQDEFEGQACLPMHEIKDGYRCVQMYDKKGSVLKGVKMLFHFQKRSFSPVQ

SEQ ID NO: 61839 - protein, 609 aa, Oryza sativa
MAHAFAGGTSAICRCPHDPGRAALVSRPRHRLRVLASSLPTPAIEGQGVELSVTTRRGRVLPVLKDCSLRVPPGQLWMLLGPNGCGKSTLLKVVMPTVESDVAFGLGKLNLSLDEKQRVAIAGALAEASKVLLLDELTTFLDEYDQMGVIKAVRKSVGAGGEVSALWVTHRLEELRYADGAIYMEDGQTIIQDGSVGIYRPHPVQSGLHRFIRMEGHEGGEEEGLGDQFERLPDEVLLDVFGRIGDVKALGRCALVSRRFHALVPLVDSVFVRVDCVISDDPPPSSAGSAQAAAAAEGGPPAARGRGALAHLARLVLGGIVRPIQALGQILSPAAATVSRRSAAPPAAPAPAAADVSHHSPSEVLRSFKELRRLHIELPTGELGIEDGVLLKWKADFGSTLGSCVILGASSVTSKPPPPPAAPPPTAADSSAASPDSSREPDELGNIPESLYTNGGLKLRVVWTISSLIAASARHYLLQPIIADHSTLESLDLTDADGQGVLTMDKRQLQELRVRPVSASGNSHRTLMPALSMRLWYAPHIELPGGQLLKGATLVAIRPSEDVLREGGGIEVAGPTGASWILDAFEEPYRTAAQVLLKRRTYSLEMNSF

SEQ ID NO: 61840 - protein, 146 aa, Lactobacillus acidophilus NCFM
MTKTWRLNERHYGALRGLNKDVSRKVFGVEQVLLWRRGFNSIPPAQGSPVIDRRYKLCDQHLMPRAESLHQTQNRLMPYYYDHIAPKLLNGEDQLIVAHGSSLRALIKKLENINDHDIVNLEVPNAEPIVYTMDDQLNIINKKILR

SEQ ID NO: 61841 - protein, 506 aa, Rhodopseudomonas palustris CGA009
MNLITTMHPDASTVFKARYGNFIGGRWVAPVDGRYFDNTTPITGAKLTEIPRSQKEDVELALDAAHTASVTWSKTTTTERSLILNRIADRMEANLDLLAIAETLDNGKPIRETRAADLPLAIDHFRYFAGALRAQEGSISEIDHDTIAYHFHEPLGVVGQIIPWNFPLLMAAWKLAPALAAGNCVVLKPAEQTPASILVWAELVGDLLPPGVVNVVNGFGVEAGKPLASSPRIAKIAFTGETSTGRLIMQYASENLVPVSLELGGKSPNIFFGDVTAEDDPFFDKAIEGFVMFALNQGEVCTCPSRALVQESIYDRFMERALARVAAIRQGDPRDPATMIGAQASQEQLDKILSYIDIGRHEGAELLAGGGRAQLPGGLAGGYYVHPTVFRGHNQMRIFQEEIFGPVVSVTTFKDEAEAIAIANDTQYGLGAGVWTRDGTRAYRFGRAIAAGRVWTNCYHAYPAHAAFGGYKQSGIGRETHKMMLDHYQHTKNLLVSYGTGPLGFF

SEQ ID NO: 61842 - protein, 132 aa, Glycine max
MAVNCTSSIRIPIQKYGSFLKYPNKKLMSKRSYVPMKKASVLRITASIKNKVYEDHSQGIICYQDEFGEIVCEGYDEGPCFQRIPETTNRPRDAQITKNLLLRQSWIQIVKGENSNDGLQKDLNCNGFNSFC

SEQ ID NO: 61843 - protein, 386 aa, Hyphomonas neptunium ATCC 15444
MSKRDYYEVLGVERGVDEKALKSAYRKLAMKYHPDQNAGDTAAEDKFKEVGEAYAILSDPQKRAAYDRYGHGAFENGGMGGGSPFGGQGGNPEDIFQDLFSQVFGAGGFAGGRRRSGPQRGADLRYDLEITLEEAFYGKDETIHVPQAVACRPCEGTGAAPGTKPETCETCGGHGRVRAQQGFFTMERTCHICQGRGQIIRKPCKTCGGHGQVKEERKLQVKIPAGVESGMRIRLSGEGEPGTSGGPKGDLYIFVEVVEHDIFERDGPNLYCRAPVPMTTAALGGEIDIPTIDGGRARVAIPEGAQTGRKLRLRSKGMPSVRANGQTGDLYVEMFVETPQNLTARQKDLLRQFCDCSGADCHPESEGFLGKIKRFWGGEGDEKRPV

SEQ ID NO: 61844 - protein, 311 aa, Vibrio vulnificus YJ016
MVKSVMKPTKELLNEILHEVRPLIGRGKVANYIPALARVPAHKLAIAVYTNQGEVIKAGDADEAFSIQSISKALSLTLAMGLYQPDEIWRRVGKEPSGQAFNSLIQLEMEQGIPRNPFINAGAIVVADLLASRLSAPRQRLLEFVRQLSGETHICYDKVVAASEMMHSDRNAAIAYLMRSFGNFENEVIPVLNNYFHACALKMSCVDLAKTFSYLANKGVSVHTDQRVISPVQTKQLNALLATCGLYDGAGEFAYRVGMPGKSGVGGGIIAIVPGEMTIAVWSPELDPSGNSLAGTKALELLSERIGRSIF

SEQ ID NO: 61845 - protein, 294 aa, Bartonella henselae str. Houston-1
MLKGAVTALITPFDDNGAIDEKAFCNFVEWQITQGINGVSPVGTTGESPTLTHEEHKRIIELCVEQVAKRVPVVAGAGSNSTSEAVELAKHAEKAGADAVLVVTPYYNRPNQRGLYTHFSSIAKAISIPIIIYNIPSRSVIDMAVETMRDLCRDFKNIIGVKDATGKIERASEQREKCGKDFVQLSGDDCTALGFNAHGGVGCISVSSNVAPKLCAQLHAACLCSDYKTALKLNDLLMPLNRAVFIEPSPAGIKYAAAKLGLCGTIVRSPIVPLSDTTKKIIDEALYHAGLLKE

SEQ ID NO: 61846 - protein, 680 aa, Zea mays
MAPPPQPELPAAALALLVLLLAAAVPARAQQEYEANKQNACYATNASSVLGYTCNATAASTPACESYLIFRSSPSYYNTPVSISYLLNSSPATVAAANAVPTVSPLAASSLVLVPVPCACTPGGYYQHNSSYTIQFQSETYFIIANITYQGLTTCQALIAQNPLHDSRGLVAGNNLTVPLRCACPSPAQAAKGFRYLLSYLVMWGDGVPSIAARFRVDPQAVLDANSLTADDIIFPFTTLLIPLKAAPTPDMLASPAPPPSPTPPQPTPAPSGGSGSGKWVGVGVGLGCGALALAAILGLLFLRTRRRRGQRFADGESVRQGSKVVIDVSSSAEYGALASGKQTSNTTTSTTSSATRSLVASDVRGAVESLTVYKYSELEKATAGFAEERQVPGTSVFRAVINGDAAAVKLVAGDVRDEVSILMRVNHSCLVRLSGLCVHRGDTYLVFEFAENGALSDWIHGGGGSTLRWRQRVQVAFDVADGLNYLHHYTNPPCVHKNLKSSNVLLDADLRAKVSSFGLARTVAASDGGAQLTRHVAGTQGYLAPEYLEDGLITPKLDVFAFGVVLLELLSGKEAAFADAGTGEETLLWEAAEEALVADGGEDVDRAKVRAFMDPRLHGDFPIDLALAMAALALRCVATEPRARPAMDEVFVSLTAVHNSTLDWDPSDYGTSGSSMVGR

SEQ ID NO: 61847 - protein, 439 aa, Synechocystis sp. PCC 6803; identical to SEQ ID NO: 1180

SEQ ID NO: 61848 - protein, 424 aa, Thermus thermophilus HB27
MKSEPLSYLGKDGGPWEIFTEQVDRVVPYLGRLAPLAESLKRPKRVLIVDVPVRLDDGSVAYFEGYRVHHNTARGPAKGGVRYHPEVTLSEVMALAGWMTIKNAAVGLPYGGGKGGIRVDPRKLSPGELERLTRRYTSEIGILLGPDRDIPAPDVNTGEREMAWMMDTYSMNVGRTVPGVVTGKPIALGGSLGRRDATGRGVFITAAAAAEKIGLQVEGARVAIQGFGNVGNAAARAFHDHGARVVAVQDHTGTVYNEAGIDPYDLLRHVQEFGGVRGYPKAEPLPAADFWGLPVEFLVPAALEKQITEQNAWRIRARIVAEGANGPTTPAADDILLEKGVLVVPDVIANAGGVTVSYFEWVQDFNSYFWTEEEINARLERVLRNAFEAVWQVAQEKKIPLRTAAYVVAATRVLEARALRGLYP

SEQ ID NO: 61849 - protein, 358 aa, Monilinia fructicola
  misc_feature (65)..(65): Xaa can be any naturally occurring amino acid
MYVARLSTRPLSNPSTAQLSKAAAFFAQSYALPSTKCTAHVPSRRPFTSGAKIQVKGRDLFPEPXHGQIKRTEPAWPHPPYSVEQMRSKVYFAHRKPRDFSDRVALGMVRFLRWCTDFATGYKHNVEAPKTASDSNAVTATKPYQMSERKWLIRYVFLESVAGVPGMVAGMLRHLRSLRGLKRDNGWIETLLEEAYNERMHLLTFLKMYEPGLFMRTMILGAQGVFFNSFFLCYLFSPKTCHRFVGYLEEEAVLTYTLSIQDLENGHLPKWADPNFKAPDLAIEYWGMPEGHRSMRDLLYYIRADEAKHREVNHTLGNLKQDEDPNPFVSVYGKEVADKPGKGIESLRPLGWEREEVI

SEQ ID NO: 61850 - protein, 529 aa, Magnetococcus sp. MC-1
MQNNLEHAPHGDAARSLDLATLVYAVFTAGLCSIIYELLIATTVVYFLGDSVRYFSLTIGLYMASMGAGAYLSKYMQGVLLHKLIVAEIILGLVGGFCVPLLYLAFTYEALFLPLYVVLTLTVGFLIGLEVPLLTRILEGYDSLRVSIAHVLSLDYLGALVATVAFPLLLLPLFGIFRSGLFFGLVNMSIAVLLLWRFGSRLGSHRIKSYRLAAWSITLAIGAGLLFAQVLLQAWNQSVYRDRILHTEHTAYQEVVLTKRRDDLRLYLNGALQFSTSDEFRYHEALVHLPMAYVQAAKARGPLSVLVLGGGDGMAVRELLRYNRIERITLVDLDERVLKLATENPYLRQANAASLSRDERVKIRVGDAMRFLQERAALFDLIVADLPDPSSTETARLYSRAFYRLARSNLAPAGVFVTQATSPFHAREAFWTTHATVADVFAQARPYHLLVPSFGDWGFVMAGGAVLQTPLEQVVKDFPPGLRHLRPAMATGMFMFGKDVEDPGQLGISTLDQPQVLERYRAGWRHWGG

SEQ ID NO: 61851 - protein, 330 aa, Medicago truncatula
MRGCCVLPFSFPHIAIGVSHSHSFTIHTPTSKSILSSIHNHPFSPTSLHAQQQQQPHHHQEEDEESFQILTSVKTDYNHIMIVDTPKSTMLLLDSSHNVHSILYKDKKWTNSYWDEFSSLPAIVPKGPIAILGLGGGTAAHLMLELWPALQLEGWEIDDILIDKARDYFGLSDLEKTNEDGGILNVHIGDAFIPSDDLHRRYAGIVVDLFSDGKVLPQLQEVSTWLELHDRLMANGRFMVNCGGIDGVDGSTDPKKLSNDEAWLLNAAIKALLKAFPGQLSWKRMPKETGQNFMALTGPLPDLKSWSANVPSPLSTGVMDWKPCEIVSGI

SEQ ID NO: 61852 - protein, 419 aa, Thermus thermophilus HB27
MPLKAYRPPEDPGLWDTYLEWLERALKVAGVHPTTLEYLAHPKRLVTLSLPVVMDDGKVRIFQGYRVVHDIARGPAKGGVRLDPGVTLGQTAGLAAWMTLKAAVYDLPFGGAAGGIAVDPKGLSPQELERLVRRYTAELVGLIGPDSDILGPDLGADQQVMAWIMDTYSMTVGSTVPGVVTGKPHALGGSEGRDDAAGLGALLVLEALAKRRGLDLRGARVVVQGLGQVGAAVALHAERLGMRVVAVATSMGGMYAPEGLDVAEVLSAYEATGSLPRLDLAPEEVFGLEAEVLVLAAREGALDGDRARQVQAQAVVEVANFGLNPEAEAYLLGKGALVVPDLLSGGGGLLASYLEWVQDLNMFFWSPEEVRERFETRVARVVDAVCRRAERGGLDLRMGALALALERLDEATRLRGVYP

SEQ ID NO: 61853 - protein, 363 aa, Podospora anserina
MISSKTSNRICLCSPQQTARITGIVVSSRPAYLTGLGYPVSLRLSSAVSQSSSQHTRSFSSTRAAHLKDFFPVKETAYIRKTPPAWPHHGYTEEEMLAVVPQHRKPGSLSDWLAWKLVRLCRWGTDIATGIKPEQQVDKSNPTTAVAAQKPLTEAQWLVRFIFLESIAGVPGMVAGMLRHLESLRRLKRDNGWIETLLEESYNERMHLLTFMKMCEPGWFMKTMILGAQGVFFNAMFLSYLISPRITHRFVGYLEEEAVHTYTRCIREIEQGDLPKWSDPNFQIPDLAVTYWKMPEGKRTMRDLILYIRADEAVHRGVNHTLSNLNHKEDPNPFVSDYKCDADHQRPNPALKPTGFERSEVIG

SEQ ID NO: 61854 - protein, 381 aa, Bacteroides thetaiotaomicron
MDDKGNIQTNMGYRVQHNNAIGPYKGGIRFHASVNLSILKFLAFEQTFKNSLTTLPMGGGKGGSDFSPRGKSNAEVMRFVQAFMLELWRHIGPETDVPAGDIGVGGREVGFMFGMYKKLAHEFTGTFTGKGREFGGSLIRPEATGYGNIYFLMEMLKTKGTDLKGKVCLVSGSGNVAQYTIEKVIELGGKVVTCSDSDGYIYDPDGIDREKLDYIMELKNLYRGRIREYAEKYGCKYVEGAKPWGEKCDIALPSATQNELNGDHARQLVANGCIAVSEGANMPSTPEAVRVFQDAKILYAPGKAANAGGVSVSGLEMTQNSIKLSWSAEEVDEKLKSIMKNIHEACVQYGTEADGYVNYVKGANVAGFMKVAKAMMAQGIV

SEQ ID NO: 61855 - protein, 70 aa, Oryza sativa
  misc_feature (58)..(58): Xaa can be any naturally occurring amino acid
MVVGLINANPVVYEKKERRARQAPETTDENAAEAIDQLEIFDHIRDIKDPERPYSLEXLNVVTEDSIEIN

SEQ ID NO: 61856 - protein, 516 aa, Thermus thermophilus HB27
MTVEPFRNEPIETFQTEEARRAMREALRRVREEFGRHYPLYIGGEWVDTKERMVSLNPSAPSEVVGTTAKAGKAEAEAALEAAWKAFKTWKDWPQEDRSRLLLKAAALMRRRKRELEATLVYEVGKNWVEASADVAEAIDFIEYYARAALRYRYPAVEVVPYPGEDNESFYVPLGAGVVIAPWNFPVAIFTGMIMGPVAVGNTVIAKPAEDAVVVGAKVFEIFHEAGFPPGVVNFLPGVGEEVGAYLVEHPRTRFINFTGSLEVGLKIYEAAGRLAPGQTWFKRAYVETGGKDAIIVDETADFDLAAEGVVVSAYGFQGQKCSAASRLILTQGAYEPVLERVLKRAERLSVGPAEENPDLGPVVSAEQERKVLSYIEIGKNEGQLVLGGKRLEGEGYFIAPTVFTEVPPKARIAQEEIFGPVLSVIRVKDFAEALEVANDTPYGLTGGVYSRKREHLEWARREFHVGNLYFNRKITGALVGVQPFGGFKLSGTNAKTGALDYLRLFLEMKAVAERF

SEQ ID NO: 61857 - protein, 143 aa, Glycine max
VAFTEKQDALVSSSFEAFKANIPQYSVVFYTSILEKAPAAKDLFSFLANGVDPTNPKLTGHAEKLFALVRDSAGQLKASGTVVADAALGSVHAQKAVTDPQFVVVKEALLKTIKAAVGDKWSDELSRAWEVAYDELAAAIKKA

SEQ ID NO: 61858 - protein, 361 aa, Venturia inaequalis
MTLMFTSRTAVYCSNLTTQRSAVTILRTLSGTASNGIKSRSALTAYQQNPSLRTRNFHSTSVVQAKDFFPEPDTPHIKKTKTAWPHPIYTVEQMNQVAVAHRDTRNWSDKVALIAVKLLRWGLDTVSGYKHGKAQALHAQDPQEAQKRYGMTGKQYLVRNVFLESVAGVPGMVAGMLRHLHSMRRMKRDHGWIETLLEESYNERMHLLIFLKLYEPGWFMRLAVLGAQGVFFNAMFLSYLISPRTCHRFVGYLEEEAVVTYTRELADLEAGKLPEWETLAAPDIAVDYYNLPEGHRTMKDLLLHVRADEAKHREVNHTLGNLDQNSDPNPYASKYDNPNVPHPRKDIKYLKPSGWEREEVM

SEQ ID NO: 61859 - protein, 354 aa, Emericella nidulans
MNSMSTTGPIRVAAIPKHYLQFTVRTYTRSMASAGLRYSNPPLVKKCYDQPTGKRFISSTPQSQIKDYFPPPDAPKIVEVKTAWAHPVYSEEEMRAVTVGHREAKNWSDWVALGSVRLLRWGMDLVTGYKHPAPGQEDIKKFQMTEKEWLRRFVFLESVAGVPGMVGGMLRHLRSLRRMKRDNGWIETLLEEAYNERMHLLTFLKMAEPGWFMRLMVLGAQGVFFNGFFLSYLISPRTCHRFVGYLEEEAVLTYTRAIKDLESGRLPHWEKLEAPEIAVKYWKMPEGNRTMKDLLLYVRADEAKHREVNHTLGNLKQAVDVNPFAVEWKDPSKPHPGKGIKHLKTTGWEREEVV

SEQ ID NO: 61860 - protein, 412 aa, Rhodococcus opacus
MTSDIVVIGGGVAGVSAVQSLRSEGYDGRLFLIGKERELPYDRTSLSKAVLAGDLADPPPLSPADWYDELQVETVLDRTVLQVDVTRKEVLLDGGRSLEVDRVLLATGASARVPSFSGADLPGVTTLRTVDDAQRLRQDWEPGQRLVVVGGGLIGCEVATTARKLGLEVSILEASDELLQRVLGRRIGGWCRARLEELGISVMVNTGVAEFDGVDRITAVIGTDGRRFPADSAIVCVGAEPETAIAEQAGLACSRGIIVNDSGGTALEGVFAAGDAASWPLRTGGRRSLETYINSQKEATAVASAMLGKAVHAPQLPLSWTEIAGHRIQMIGDIEGSGEYVMRGAPDDGPALLFRLTDGKLTAALSVDAPREFAMATRLVESGAQVGRDVLADTSVELRELNRAARERTTAA

SEQ ID NO: 61861 - protein, 356 aa, Ajellomyces capsulatus
MYPTSGCARVLMACPAPAMLRGPLLRPSTTAIRGLRGSPLLYHYAATSNSNMRYFSSTSRRWIKEFFAPPKETDHIVESVTTWKHPVFTEKQMKEIAIAHREAKNWSDWVALGTVRFLRWATDLATGYRHAAPGKQGVEVPEQFQMTERKWVIRFIFLETVAGVPGMVGGMLRHLRSLRRMKRDNGWIETLLEEAYNERMHLLSFLKLAQPGWFMRLMVLGAQGVFFNGFFISYLISPRTCHRFVGYLEEEAVMTYTHAIKDLESGKLPNWANQPAPDIAVAYWQMPEGKRTILDLLYYIRADEAKHREVNHTLANLKQGVDPNPYAAKYDNPEAPHPTKSAEIVKPTGWERDEVI

SEQ ID NO: 61862 - protein, 379 aa, Candida albicans
MIGLSTYRNLPTLLTTTTVISTALRSKQLLRFTTTTSTKSRSSTSTAATTVGNSNPKSPIDEDNLEKPGTIPTKHKPFNIQTEVYNKAGIEANDDDKFLTKPTYRHEDFTEAGVYRVHVTHRPPRTIGDKISCYGTLFFRKCFDLVTGYAVPDPDKPDQYKGTRWEMTEEKWMTRCIFLESIAGVPGSVAGFVRHLHSLRMLTRDKAWIETLHDEAYNERMHLLTFIKIGKPSWFTRSIIYIGQGVFTNIFFLVYLMNPRYCHRFVGYLEEEAVRTYTHLIDELDDPNKLPDFQKLPIPNIAVQYWPELTPESSFKDLILRIRADEAKHREINHTFANLEQWQDRNPFALKIKDSDKPQPNYNLDVTRPQGWERKDLYL

SEQ ID NO: 61863 - protein, 283 aa, Prochlorococcus marinus str. AS9601
MTDITTWIDEYHKGSRFGLNGKILFKKTSKYQEIIVIENEYYGKALMLDGCWMTSLKDEKYYHECLVHPALSSIDEKSNVLIIGGGDGGTVRECVKYSKISKIDLVEIDEEVIKISKKFLKEIAGEAWNDKRLEIHIDDGVKWVEKTKDNFYDVIFIDCSDPSEFSNLLFSHSFYKECERILAPSGILATQSESPESFKNIHINILKSLKNIFKVSETMYSFVPIYPSGIWSWTFASSEDLSLSKQNYDEVVKIEKGCEIWNLNFQNAAFKMMPNKIVKELDS

SEQ ID NO: 61864 - protein, 412 aa, Candidatus Blochmannia floridanus
MLEKQSDVIGNCTNRKVKFALLGPAFIAAIGYIDPGNFATNIQAGATFGYQLLWVVVWANIMAMLIQLLSAKLGIATGKNLAEHIRDQFPKSLVWIYWVQAEIIAMATDLAEFIGAAIGFQILLGISLLNGALLTGVATFLILTLQNYGRKPLELVVGGLLLFVAIAYVIELFYSKPQLIELGMSMLCPILPNKEAVFLSAGVLGATIMPHVIYLHSSLTQDSSVIATKSERYSSTKLDVAIAMTIAGFVNLSMMATAASVFHFRGHTGVASLDEAYLTLSPLLSHTAAVIFGLSLTAAGLSSTVVGTLAGQVVMQGFVRFYIPIVLRRIVTMFPSFIIIALKIDPTHILIMSQVLLSFGIALALVPLLLFTGNVNLMHELVNSFWMNFLGWIITMIVIALNIYLLIGIFSE

SEQ ID NO: 61865 - protein, 960 aa, Medicago truncatula
MKETGHEYACGDMLEPRESDIPVLFLVLVVLPLVAYILLGKWSETAKKRNRINLLAQLAAEEAFKAEAKMAVADVIPPQPQVFYTPKNYSPKNELHHECARCSAPAKTRCSRCKLVRYCSGNCQIIHWRLFHKQECLPLETHNSSSFPMAFPVEEFGHGSAFYENSNNPYFGCNLNQTLRASEPLDNLVHPPTGTTAASATVDFSPFNGSQPSALESRPSHKSNRETRRRDSGSIYESSDCKATTSQETFMRQKSRKSNDSVSEEETSKINSNGFGVYTHEQDGSRNTMDEDDNYQNQYENAFAPRNKNGSYNVSSAANSDEGVDEFETNVVTKGGHHHSDEAAQHKCSSETTVKGSAKAKKPSHTSKAKLSKSPKSTSKTSIDFCDPEIEKKGKIPDEPKVAGSRSTLPLHGINGVTSTGLMKMMGLRKSTKHTALASSESNGVRSKKAKNIKMLFPYEDFVKIFQSEIFGIFPRGLLNCGNSCYANAVLQCLTSTKPLVVYLLYGSHSESCCAKDWCLMCELEQHMMILREIGAPLSPSRILWHMRSINCNMGDGSQEDAHEFLRLLVASMQSICLEGLGGERKVDPRLQETTFIQHTFGGRLQSKVKCLNCSHESERYENIMDLTLEILGWVESLEDALTQFTSPEDLDGENMYRCGRCTAYVRARKQLSIHEAPNILTIVLKRFQEGRYGKINKCITFPEMLDMIPFMTGTGDIPPLYVLYAVVVHLDTLNASFSGHYVSYVKDLQGNWFRIDDTEVQPVLVNQVMSEGAYILFYTRSSPRPPAEFTGKAAQQSVSDSSKLYSLETQKLSKPGHSRHVSQSFVSEPSPNTRPEIATHLMDTSNGFVKRSTNRNVHPVIQTYAENVRHEFSDATTSSDWSIFTSSDEASFTTESTRDSFSTVDYADPFSNMDPISSLFNYTPENNNYMKISHSRPLTRFFPKKGHIERVQKTTIWES

SEQ ID NO: 61866 - protein, 266 aa, Pseudomonas syringae pv. tomato str. DC3000
MFAGKLPKLIMFDLDGTLVDSVPDLAVAVDTMLAELGRPTAGLESVRAWVGNGAPVLVRRALANNLDHSGVDEALAERGLDIFMRAYAEKHEFTVVYPGVRETLKWLQKMGVEMALITNKPERFVAPLLDEMKLGRFFRWIIGGDTMPQKKPDPAALFFVMKMAGVPASQSLFVGDSRSDVQAAKAAGVACVALSYGYNHGRPIAEENPAMVIDDLRRLIPGCLDLDAEILLPDIKRPSSRESIVVVTRKLWMKVIKALARWRWRA

SEQ ID NO: 61867 - protein, 1533 aa, Aspergillus nidulans FGSC A4
MDGQRQQPYVPAPPPSASQPSQAHIMPLPPPPPRYPPAQPQNVMPPPPPGPPPGSAYGTSKLTNPQLQSQSTLGWSNWGGRGIPQYLPPPPPPPMTHANQSSFARPSAVQNNNATSATYVPQPGTFGPGVGIPPFDVPSHSYDAPNTMVASERPRPPPNAPYGHGTSNASAYQLDGTIPSTPLTHTAPFSHETSHDVPSSAVPTGSPFKSVPQSASQANDLTKSSSHRHNNSNTTVGGMSASEAAVQWPLDRVLLWLAKNGFSHEWQETFKTLEIEGADFLELGHGQNGRPNLGKMHTVVYPQLAKECEANGTAFDLTRERDEGKRMRKLIRLIHDDAGPDNGGTFNKQHDFDDGHGSVPDEGPEFSPNINNVAQAPGSPSLNATNVSNSPNLKAPKYSHKPRSFTTPGSISHDSTTAELAMTEGSSTMLPRSDFSRNVLGTIGIDHQRKSPSMSSDNGVFAIPPHRPHEGSPKSGSPAAQHATLYAAPVSSATDLNAKYDARFGHNRVNSGERRYYETLKHDGSRPSPQTTQTAGDNASSYPKDHRMGFLNFFKKKSARNSDPNNPSPDDNTPDSPIYSKYHFNSSDVSVNERPLSASLSDYERMMMVRTKPAHRGKRFIFATMDGWNYRLIDTTDIDSVEKLRASICQNLGIYDWPDAQIFLTEPGQLEHDEPLNDTFLTLCQRSKSDSIGSLKLFVKTPHNVAGLGVSMPDRSAVSPTSAIPRKPLDGEAASRLSPLKPSSPQQLKPPASRLPLRDIQNSAAGTSPVDGEPDGSLQDQERKPQKSYRPTPAPLPRPDAYSETGYRRKEVINFDKPRISPYEDKKSEVLVPFRKPPSAPQESNTLSKVNSLRKKDGDRPRPHRSNQPPGIKEMMADMGMMSSLIGKPSSPNSGNTTATEDAHSSIDSAVDKSSQSTPPLTNTSYSPTTTATTTTTTTTASSSLSRSASQKRKSVGPEFDFEETQVSFQRSPALEEDSDDDSDDGLFAIPLANTKNSVKPGSPDTQARPRKPSLTVDTEAKPRTGLSVSFKSPSATRETFASSGGDASNSTAPYFIASNSPEEEKTPIRRNSLRNSFATGDVWASRPPVEGVIDQLDDFFPDIDLDAPYLDEQGTSPPSSPASKVAIDNELNRKDKQENSHHGMQPPPAPEDNTLGSSEPTMTSHGQGIVARRNVSRSGGGLTRMKSIREVAKGANQATRQRSVAASSGNKRSGDVHRRKSTKMFGAKIMQISPRRGSQLSQLDPIPQNSISSSSKPQRQPTFRIIRGQLIGKGTYGRVYLGMNADNGEVLAVKQVEINPRLAGQDTDKIKEMVAALDQEIDTMQHLEHPNIVQYLGCERGELSISIYLEYISGGSIGSCLRKHGKFEESVVKSLTRQTLEGLSYLHNQGILHRDLKADNILLDLDGTCKISDFGISKKSNDIYGNDSSNSMQGSVFWMAPEVIQSQGQGYSAKVDIWSLGCVVLEMFAGRRPWSKEEAIGAIFKLGSLSQAPPIPDDVSMNVTPAALAFMWDCFTVSNPSYSSFLRARSEV

SEQ ID NO: 61868 - protein, 125 aa, Klebsiella pneumoniae
REVMTTLWPFLEENPRYRQLALLERLVEPERVIQFRVVWVDDRNQVQVNRAWRVQFNSAIGPYKGGMRFHPSVNLSILKFLGFEQTFKNALTTLPMGGGKGGSDFDPKGKSDGEVMRFCQALMTE

SEQ ID NO: 61869 - protein, 574 aa, Candidatus Blochmannia floridanus
MISGISVSPGIALGKALLLKEKKIVINTKKITIKSIDKEIKKFLSGRSKTVEQLKEIKKKVRKKLDSKQESIFEGHIILLEDEELEQDIITLIKDELFTADAAVYSVIENQANALEKLKDEYLKERSIDVRDIGNRLLKNILNIPIINLNDITEEVIIITVDLSPSETAQLNPKKILGFITDLGGKTSHTSIMARSLELPAIVGTNTITTTVMDGDFIILDSLNNKIYINPDLNIIHTLKLLKKKYLSEKKQLTKLKNLPSITLDNHKVHICANISTVHDIVKAQENGAEGIGLYRTEFLFMNRNALPTEEEQFQAYKNAAESMYNQSIIIRIMDIGGDKNLPYMNLPHEDNPFLGWRAIRILMDRKDMLHTQLRAILRASFFGKLRIMYPMIISVEEIQQLNTELNFLKTQLHNSGEKFDENIKVGVMIETPSAAIIAHHLIKEVDFFSIGTNDLTQYTLAVDRGNKLISHLYNPMSPSILILIKKIIESSHIAGKWTAMCGEMAGDERAVPLLLGMGLDEFSMSAISIPKVKKIIRNTYYHDAQLLAQKALKCSTTEELMKLLSSHLPIQET

SEQ ID NO: 61870 - protein, 213 aa, Oryza sativa
AWITVQGRRTATWSMASLTIVVATIFLLSLTSASVAVHGRSSRRRFVRSYDEPCMEMRLYLHDILYDYSNSTSNSTAAAATKPTALANAVPSTGGTFFGEVVVFNDPVTEGRALPPSLEETAVRAQGLYLYNSKEAFNAWLAFSIVFNSTGRRGTLNLMGADIIAEKTRDISVVGGTGDFFMSRGVATLRTDAFEGFTYFRLQMDIKLYECYV

SEQ ID NO: 61871 - protein, 916 aa, Oryza sativa (indica cultivar-group)
MADLEAGMVAAATDQGNSTRSQDDAATLIPNSGNLGSSNRSTKTARFKDDDELVEITLDVQRDSVAIQEVRGVDEGGSGHGTGFDGLPLVSPSSKSGKLTSKLRQVTNGLKMKSSSRKAPSPQAQQSAKRVRKRLDRTKSSAAVALKGLQFVTAKVGNDGWAAVEKRFNQLQVDGVLLRSRFGKCIGMDGSDEFAVQMFDSLARKRGIVKQVLTKDELKDFYEQLTDQGFDNRLRTFFDMVDKNADGRLTAEEVKEIIALSASANKLSKIKERADEYTALIMEELDPTNLGYIEMEDLEALLLQSPSEAAARSTTTHSSKLSKALSMKLASNKEMSPVRHYWQQFMYFLEENWKRSWVMTLWISICIALFIWKFIQYRNRAVFGIMGYCVTTAKGAAETLKFNMALVLLPVCRNTITWIRSKTQVGAVVPFNDNINFHKVIAAGVAVGVALHAGAHLTCDFPRLLHASDAQYELMKPFFGEKRPPNYWWFVKGTEGWTGVVMVVLMAIAFTLAQPWFRRNKLKDSNPLKKMTGFNAFWFTHHLFVIVYTLLFVHGTCLYLSRKWYKKTTWMYLAVPVVLYVSERILRLFRSHDAVGIQKVAVYPGNVLALYMSKPPGFRYRSGQYIFIKCTAVSPYEWCWSYTFYGKKMHPFSITSAPGDDYLSVHIRTRGDWTSRLRTVFSEACRPPTEGESGLLRADLSKGITDEKARFPKLLVDGPYGAPAQDYREYDVLLLIGLGIGATPLISIVKDVLNHIQGEGSVGTTEPESSSKAKKKPFMTKRAYFYWVTREEGSFEWFRGVMNEVSEKDKDGVIELHNHCSSVYQEGDARSALIVMLQELQHAKKGVDILSGTSVKTHFARPNWRSVFKKVAVSHENQRVGVFYCGEPVLVPQLRQLSADFTHKTNTRFDFHKENF

SEQ ID NO: 61872 - protein, 88 aa, Triticum aestivum
  misc_feature (14)..(14): Xaa can be any naturally occurring amino acid
  misc_feature (34)..(34): Xaa can be any naturally occurring amino acid
  misc_feature (42)..(42): Xaa can be any naturally occurring amino acid
  misc_feature (44)..(44): Xaa can be any naturally occurring amino acid
  misc_feature (46)..(46): Xaa can be any naturally occurring amino acid
  misc_feature (50)..(50): Xaa can be any naturally occurring amino acid
  misc_feature (60)..(60): Xaa can be any naturally occurring amino acid
  misc_feature (62)..(62): Xaa can be any naturally occurring amino acid
  misc_feature (72)..(72): Xaa can be any naturally occurring amino acid
MMSGEAWLYLLSVXINAVNLFLQVFFTIMYSDLXECDYINPXIXLXNRLXTYIIPEAAVXGXLTALFLINGXRDTHSSTPLVNNQLNS

SEQ ID NO: 61873 - protein, 493 aa, Delftia acidovorans
MSQKFIDRHGLWSDAQKAAAVEVLKKIEQDGIQMIRLSWPDQYGLLRGKMLSVAALRSAFGSGSEITMAPFFFDTASAIVFNPFSSDGGLGNPELAGSPNVVMVPDPTTFRVLPWADRTGWMLADLYMRSGRPFPLSPRALLKKALGQLADLGYDFHGGLEVEWYLTRIVDPCLEPETLGGPGTPAAPPKVMPVAKGYSYLLENHLDEVEPIMAEVRQHLLTLGMPLRSIEDEWGPSQMETTFDVMSGLDMADTMVLFRNAVKQICRRRGYLASFMCKPKIEGFCASGWHLHQSLAARDSGVNAFVPQTGEPLSALGRAYVGGLLKHACAASSFTTPTVNGYRRRRPFSLAPDRVTWAEDNRAAMARVIAAPEDSASRVENRVGEPAANPYLYLASQLFSGIDGIRRQLDPGPLQETPYAADVPILPRNLAEALDVLEGSSFFREAFGEEFIHYWLHLRRSEWARFVAAEGADVDMAGDPVTDWEHREYFELF

SEQ ID NO: 61874 - protein, 149 aa, Triticum aestivum
MEFQGQHDNPANRVDEYGNPFPLGGVGGAHAAPGTGGQFQARREEHKTGGILHRSGSSSSSSSSEDDGMGGRKKKGMKEKIKEKLPGGHKDNQQHMATGTGTGGAYGPGTGTGAAYGQQGHTGMAGAGTGTGEKKGIMDKIKEKLSGQH

SEQ ID NO: 61875 - protein, 480 aa, Colwellia psychrerythraea 34H
MSESIFCNYINGTWVEGESSLANISPADISDVIGHYAQANQEQAEAALDAAIKGQLEWQESGLEQRYSVLMAIGDELIARKDELGKLLAREEGKTLPEGAGEIYRSGQFFHYYAAEVLRQMGETADSVRPGIEIETRREPVGVVGIITPWNFPVATAAWKIAPALAFGNSVVLKPANQVPASAWALTEIISRQGLPAGTFNLVMGPGAEVGDLLINSKKINALTFTGSLETGRKVAIATATNLVKCQLEMGSKNALIVLDDADLDNAVECAVGGAFFGTGQKCTASSRLIVTEGIHDRFVDAVVARMKQLVVGHPLREGVHIGAVADARQMKQNLNYLEIAKKEGGKLVSGGDVITEETEGYYLTPALFTETTNAMTINRDEAFAPIACVIKVKDYDEALATLNDTNYGLVGGICTQSLKYATHFKRNAQTGCAMVNLPTAGTDYHVPFGGRKDSSFGSREMGSYAKEFYTIVKTTYIRS

SEQ ID NO: 61876 - protein, 344 aa, Burkholderia pseudomallei K96243
MKALVLEKARELALRDIDLPLEVGPADVKIRVHTVGVCGSDVHYYMHGGIGPFRVDAPMVLGHEASGTVVEVGRDVTYLRVGERVCMEPGVPRFDSKATLHGLYNLDPSVRFWATPPVHGCLAPYVVHPAAFTYRLPPNVSFAEGAIVEPLAIGLQAAKKAAMKPGDIAVVVGAGTIGAMTALAALAGGAARVILADVVKEKLALFAANRAVTTVDASTQSLADAVAHATDGWGADVVFEASGNASAYAGIVDLLCPNGCLVLVGMPLAPVPLDVVSLQAKEARIESVFRYANVFPRALALIASGAIDVKPFISRTFPFSDGLRAFEAAASGQPHDVKIQIEMD

SEQ ID NO: 61877 - protein, 412 aa, Cupriavidus necator
MMSLSHASVPHTNPTAPHTLAALLAAGGLAGKRVFIRADLNVPQDAAGDITDDTRIRASVPAIAACLQAGAAVMVTSHLGRPQEGAPDPRHSLAPVGRRLSELLGRQVPLLSGWTEGGFQVPPGQVVLLENCRMNTGEKKNSDELAQKMAALCDVYVNDAFGTAHRAEATTHGIARYAPVACAGPLLAAEIDALGKALGQPARPLWAIVAGSKVSTKLTILKSLADKVDNLVVGGGIANTFMLAAGLKIGKSLAEPDLLADARAIIDIMAARGASVPIPVDVVCAKEFSATAAAAVKDVRDVADDDMILDIGPKTAAMLADQLKAAGTIVWNGPVGVFEFDQFGNGTRVLAQAIAESKAFSIAGGGDTLAAIAKYGIADRVGYISTGGGAFLEFLEGKKLPALDVLEQRAAS

SEQ ID NO: 61878 - protein, 387 aa, Pseudomonas syringae pv. syringae B728a
MTVLKMTDLDLQGKRVLIREDLNVPVKDGVVSSDARILASLPTIRLALEKGAAVMVCSHLGRPTEGEFSAENSLKPVADYLSKALGRDVPLVADYLDGVDVKAGEVVLFENVRFNKGEKKNADELAQQYAALCDVFVMDAFGTAHRAEGSTHGVAKFAKVAAAGPLLAAELEALGKALGAPAQPMTAIVAGSKVSTKLDVLNSLSGICNQLIVGGGIANTFLAAAGHKVGKSLYEPDLLDTARAIAAKVSVPLPTDVVVAKEFAESAAATVKLIADVADDDMILDIGPQTAAHFAELLKSSGTILWNGPVGVFEFDQFGEGTKTLAKAIAESQAFSIAGGGDTLAAIDKYGVAQQISYISTGGGAFLEFVEGKVLPAVEVLEQRAKA

SEQ ID NO: 61879 - protein, 257 aa, Glycine max
MGSAASPPRALDAATQEDLKRVSAHRAVDMVESGMTLGLGTGSTAAHALDRLGALLRTGALRAVAGVPTSLKTEAHAARVGIPMLALADAAEIHLSIDGADEVDPDLNLVKGRGGSLLREKMIEGAGARFVVIVDESKLVPRLGCTGSSVPVEVVPFGSAYTLGLIRMVFDKLPGFHARLRTVKSKAGDGQEELFLTDNGNHIVEMFFEDGIHGNLRDISDSLLRITGVVEHGMFLGMATKVIVAKKDGTVAVLSKK

SEQ ID NO: 61880 - protein, 665 aa, Pseudomonas syringae pv. syringae B728a
MPSRRERANAIRALSMDAVQKANSGHPGAPMGMADIAEVLWRDYLKHNPANPSFADRDRFIMSNGHGSMLVYSLLHLTGYDLSIDDLKNFRQLHSRTPGHPEYGYTPGIETTTGPLGQGFANAVGFAAAEKTLAAQFNRPGHSIVDHHTYVFMGDGCMMEGISHEAASLAGTLQLNKLIAFYDDNGISIDGEVEGWFTDDTPKRFESYGWLVIRNVDGHDPEEIKTAIETARKSDQPTLICCKTTIGFGSPNKQGKEESHGAPLGADEIALTRAALKWNYGPFEIPADIYAEWNGKEKGLAAEAEWDQRFADYSAAFPELANDFIRRMSGQLPADFAEKSAAYVAEVNAKGETIASRKASQNALGALGPLLPEILGGSADLAGSNLTIWKGCKSITGEDPNGNYLHYGVREFGMGAMMNGIALHGGFVPYGATFLIFMEYARNAVRMASLMKKRVIYVFTHDSIGLGEDGPTHQPIEQLTSLRTTPNLDTWRPADAVESAVAWKHAIERDDGPSALIFSRQNLTHQARDEKQLSYIARGGYVLRDCAAEPELILIATGSEVGLAVQAYDKLTEQGRNVRVVSMPCTSIFEAQDAAYKQAVLPLQVSARIAIEAAHADYWYKYVGLEGRVIGMTTFGESAPAPALFEEFGFTLENVLSTAEELLED

SEQ ID NO: 61881 - protein, 489 aa, Zea mays
IPCVGDFLEKNNDMVNGTDDSMLYTLPQEELFELFLTLSGQLSLLWNAFLKFHRVNKTKILEYLHDAWAIDRKAEWSIWTVHSKIEIPHRYLRSMNDESSHRHSLLRVSGSRKFHDDPAQNSASRAELHRKSIAQMKINTQSVQDMHIYADPSHVPVVLIEQHVMVVPQHSSSKDLASNASEQKDTIVLPKLQGEPLVPKSSAGKKSGRILRAVIFVHGFQGHHLDLRLVRNQWLLLDPGADCLMSEANEDKTSGDFKEMGSRLAGEVIAFLKKKMDKLSRYGGCKELKLSFVGHSIGNIIIRSALAEPALQPYLKNLYTYMSISGPHLGYWYSSNSLFNSGLWLLKKLKNAQCIHQLTFSDDQDPHNTYFYKLCKLKTLENFKNIILLSSPQDGYVPYHSARMELCPAASSDTSKKGQVFTEMLNNCLDQIRAPSSDTRTFMRCDVNFDQSNHGRSLNTMIGRAAHIEFLETDIYAKFIMWSFPDLFR

SEQ ID NO: 61882 - protein, 798 aa, Oryza sativa
  misc_feature (149)..(149): Xaa can be any naturally occurring amino acid
  misc_feature (192)..(192): Xaa can be any naturally occurring amino acid
MPRKVVSGPDYDDEYNDDYDEYDEDYDDYGGTGHSDDIQHPTKEKESSKKSSSMVPVLWRCSMCMFDNHESMVYCEMCGVFRESFMKSAKDGSIKVHGIPSDFGTPSMPKSDSTKMPVNTRTTDFGGDPEIKNASISHEKVGSTQYASXGSSSGAGKKVKHIALPEDVPVERTAQLISDHFQLKEDQSSRAXSSAQNEDVAQKLSSDIQKLGLEKNEVDTAKPYLPEEYKPEKWMFANEESGVLSQLNLAIVGHVDSGKSTLSGRLLHLLGRISKKDMHKNEKEAKEKGKGSFAYAWAMDESSEERERGVTMTVAVAYLETNKYRVVLLDSPGHKDFVPNMISGATQADAAILVVDACTGSFEAGMDGEGGKSVGQTKEHAQLIRSFGVEQLIVAVNKMDAIGYSKERFEFIKVQLGSFLRACNFKDSSVTWIPLSAVENQNLIKIPSDVRLTSWYQGFCLLDAIDSLQLPSRDVSKPLILPICDVIKSQSTGQLAAFGKLETGAIRIGSKVLISPCGEVATVKSIERDSNSCDIARAGDNVAVSLQGIDGSKLIAGGILCNPGFPVPVSNFLELRVLVLDVTIPILIGYQVEFHIHHVKEAARVTKIVALLDKAGKPSKTAPRFLKSKQNAVVQVTLDAPVCVEEFSKCRALGRAFLRSGGSTIAVGVVTRPCFGAHIVADSKRDIKDPEHPYSLEELNVVTEDSVEINDELSHVRVTFTPTVERCSMATVIGLCLRVKLMRSLPPRYKVDIRVAPGSHATETAVNKQLNDKERVAAALENPNLLDIVEECLSPTFA

SEQ ID NO: 61883 - protein, 323 aa, Candidatus Blochmannia floridanus
MNQLDNLKKFSKISADTGDVDLIRTYQIQHATTNPSLILKSPLFTTYLKLFNDAIDYAQKIGGNQNTKITNASDRLIVNIGSEILANISGYISTEIDAQLSFNTDLTIKKAHKLITMYQKKNIDTSRVLIKIAATWEGIQAAEELEKSGIKCNLTLVFSFAQARACAERNIYLISPFIGRIYDWYNQRNLIKTSYINDDPGIQSIKKIYHYYKTYGYNTIIMGASFRRLEQILALSGCDYLTISPHFLKQLYQNTNSVTRQLFPPKTIISHHIPVLDQSEFFQEHNKNQMAVEKLNEGIQQFSIDQQKLHKLLLNNLNVQLQK

SEQ ID NO: 61884 - protein, 664 aa, Candidatus Blochmannia floridanus
MLHEQMLANAIRILSIDCIQHANSGHPGAPMGMADIAEVLWREYMNHNPKNPNWINRDRFILSNGHASMLLYSILHLTGYKISIEDLKNFRQLHSKTPGHPEYKHTDGVEVTTGPLGQGLANAVGFAIAERTLANQFNRPLFNIIDHYTYVFVGDGCMMEGISHESCSLAGTMKLNKLIVLYDKNGISIDGSVEEWFSDNTAARFESYGWHVIPDVDGHNRKSINIAINQAKSILNKPSLIIFKTIIAFGSPNKSGQSCTHGSPLGTSEILATRNKLCWNEQTPFLIPQKIYKLWDATIIGQQKENIWNQMFLQYQKTYPDLAQELTRRVQCKLPIYWNTKIQKLIKQLSTNPQNIATRQSSQIVIEYISKYLPELLGGSADLTSSNLTTYSQSSSIIQNPSGNYIHYGVREFGMTAIANGISVHGGFLPYTATFLTFSDYSKNAIRMAALMNNRHIMIYTHDSIGLGEDGPTHQPIEQLSSLRMIPNLQIWRPCDQIETVIAWKTAIENTGPTVLILTRQTLKQQKNTIINMTNISKGGYILQDCYNTPELIIIATGSEIELAVNIYHQLTNEGYKIRIVSMPCTNIFDQQNATYREQVLPQTVTKRLAIEAGHSDLWYKYVGLHGKVIGINTFGKSAPAHDLFNFFGFTKNHILQEINILLQ

SEQ ID NO: 61885 - protein, 292 aa, Candidatus Blochmannia floridanus
MFTGSIVALITPMDSKGSIDRMGLKKLVDYHVDNGTSAIVSVGTTGEMSGLTHSEHVDVVMWTIEFSDGRLPVIAGTGSNSTSEAILLTNQFNDSAVSACLSVTPYYNRPSQEGLFQHFRAIAESTNLPQILYNVPIRTGCDLLPITVGRLSTIKNIVGIKEATGNLNRVNQLKRLVNEDFILLSGDDISAVDFMRLGGHGVISVTANVAPKDMSTLCSFVQKNDFKSAYDINNRLIPVHQSLFFDSNPIPVKWACKELGLISYDTLRLPMTSISKEHSVLIRKALEDADLL

SEQ ID NO: 61886 - protein, 951 aa, Vibrio vulnificus YJ016
MKLIKRSDSVTKEQKQLGISRRVFMRNSSLAAGGAIAGASMFAPGMIRKAEAKSVDASAPIEVKRTICSHCSVGCGIYAEVQNGVWTGQEPAFDHPFNAGGHCAKGAALREHGHGERRLKYPMKLENGKWKKLSWDQAIEEIGNKVLEIREQSGPDSVYWLGSAKHNNEQAYTFRKMASMWGTNNVDHQARICHSTTVAGVANTWGYGAMTNSFNDMHNCKSMLFIGSNPAEAHPVAMQHILIAKEKNSCKIVVADPRRTRTAAKADHYVSLRPGTDVAFIWGVLWHVFNNKWEDKEFIRQRVFGMDEIRAEVAKWNPKEVERVTGVSEEDVYQTAKLLSDHRPGCIVWCMGGTQHTTGNNNTRAYCVLELALGNLGKSGGGANIFRGHDNVQGATDLGVLSHTLPGYYGLAEGSWKHWAKVWGIDFDWLKNRFDQNKYNGKQPMFNMGIPVSRWIDGVLENKDSIEQNDNIRAMFYWGHAVNSQTRGVEMKKAMEKLDMMVIVDPYPTVAAVMNDRTDGVYLLPATTQFETHGSVTASNRSIQWRDQVIEPLFESKPDHEIMYLLTKKLGFADQLFKNVRVVNNQPVIEDITREFNKGMWTIGYTGQSPERLKAHQQNWHTFHKTTLAAEGGPANGETYGLPWPCWGTPEMKHPGTHILYDTSKPVAQGGGTFRTRFGVEFEGKSLLADGSYSKDSDIQDGYPEFSDKLLKQLGWWDDLTAEEKALAEGKNWKTDLSGGIQRVAIKHGCIPFGNGKARTIVWEFPDRVPLHREPLYTPRRDLIADYPTWDDAASIYRLPTLYKSIQDQDKSQEYPIILTSGRLVEYEGGGEETRSNPWLAELQQEMFVEVNPKDANDLGFKDGDMVWVEGAEKGRIHVKAMVTRRVRPGMAFIPFHFGGKFQGEDLRNKYPEGTDPYVIGESANIATTYGYDPVTQMQETKVTLCNIRKA

SEQ ID NO: 61887 - protein, 238 aa, Glycine max
MSAAVSATKDVPFNAHLEEDIKNKEINKVVNVGEADQIPYNDDAEGTDSEAEEDPKLGLDLGPQCSLKEQLEKDKEDESLRKWKEQLLGGIDVSAVGENKEPEVKIVSLTIICPGRPDLILPIPFTSDAKKSIFTLKEGSQYQLKFSFTVSNNIVSGLKYTNVVWKTGLRVDNTKKMLGTYSPSQELYTYELEEETTPSGLFARGTYSARTKFVDDDRKCYLDTSYHFEIQKNWPTPI

SEQ ID NO: 61888 - protein, 209 aa, Candidatus Blochmannia floridanus
MSNDKAKHPMKVGIGGPVGSGKTALIEVLCKKMKTDYQLAVVTNDIYTKEDQQILINAHALESDRIIGVETGGCPHTAIREDVSMNLLAIEELIDKFNNLDIIFIESGGDNLSATFSPELSDWNLYVIDVAAGDKIPRKGGPGITKSDFLIINKIDLAQYVGASLDVMKFDTHTMRNNRPWTFTNLKTGYGIESVINFLREKKLINNKM

SEQ ID NO: 61889 - protein, 275 aa, Zea mays
MSEDPAGSRRWRCDLGGDERWLSGAAGDDQFDRLPDALLLVIFNRISDVKALGRCSLVSRRFHELVPLVDSVLVRVDCVIPDEPPSSSSSSSTPSSPTASVRARGVFSQIARIVLGGIVKPIQALGQILSPANSASGFPASAASSLSSSSSSSSPLPAGDVSHHSPSEVLRSFKELRHLRIELPAGELGMDDGVMLKWKADFGSTLGSCVILGASSASPSPSPSSAGSDSPSAAPSDDSGHTEPDECDDSGSIPESFYTNGGFKLRVVWSISSLI

SEQ ID NO: 61890 - protein, 601 aa, Arabidopsis thaliana
FTSSPSYGSQNAAFWRTIFVVHCISTLVFTTISTPPEDPVKCVSGNTNCTVTNSYGAFPDRSTCRAANVAYPTTEAELISVVAAATKAGRKMRVTTRYSHSITKLACTDGTDGLLISTKFLNHTVRTDATAMTLTVESGVTLRQLIAEAAKVGLALPYAPYWWGLTVGGMMGTGAHGSSLWGKGSAVHDYVTEIRIVSPGSVNDGFAKVRVLRETTTPKEFNAAKVSLGVLGVISQVTLKLQPMFKRSLRYVMRNDLDFGDQAVTFGMKHEFADFIWLPSQGKVVYRMDDRVAVNTSGNGLLDFMPFRSQLSAALAIIRSSEETQERFRDANGKCAGATLITSTLFATSYGLTNNGMIFTGYPVIGSQNRMMSSGSCLDSLHDGLITACPWDSRIKSEFFHQTTFSIPLTQVKSFINDIKSLVKIESKSLCVLELYDGILMRYVTSSPAYLGKETEALDFDLTYYRAKDPLSPRLYEDFIEEIEQIALFKYNALPHWGKNRNLAFDGVIKKYKNVPAFLKVKESYDPMGLFSSEWTDQILGIKGNVTIIKDGCALEGLCVCSEDAHCAPTKGYFCRPGKVYKEARVCTRADDISVIQSLSY

SEQ ID NO: 61891 - protein, 141 aa, Cytophaga hutchinsonii ATCC 33406
MGTVTDNKINTSQSLILFDGVCHFCNNSVNFVIDRDPEKKFVFAPLQSDYAKERLTQLGAYNASVYTVILIRNNKLYKRSRAALEIARRLNGLWPLCYMFILIPGFIRDVVYNFIAKNRYKWFGKMEACRIPTPEMRERFL

SEQ ID NO: 61892 - protein, 375 aa, Methanosarcina mazei Go1
MTQYKVPVLPGDGIGPEIIAEGRKVIDAAGERFGFDVEWIEYPHGADHYLETGELISEETLKELSGYPAIYLGSIGDPRIAPGVLEKGILLTARFYFDQYINLRPIKLLEGVWTPIKDKTSKDIDFVVVRENTEDFYIGIGGRAKKGASKDLLEVKRTLYSAKFGLDIETDSEEIGYQIGLISKEGTKRVIEYAFDLAENRKKHVSSVDKANVLSDIYGFWREEFNAVAEKHPGFTTDFNFVDAITMWFVKNPEWFDVVVTPNMFGDIITDLGAMIQGGLGLAPGGNINPNGTSMFEPIHGSAPKYKGQNKVNPIATIWAGAMLIEQLGEKEAADTIVNAIQKNILDGKVKTYDMGGKNTTSDVGDDIARIIKGE

SEQ ID NO: 61893 - protein, 1418 aa, Burkholderia pseudomallei K96243
MTSASVKTVCPYCGVGCGMVLHVEDGEVVKVSGDAEHPTNLGRLCTKGSSAHVALRNAGRLERAFVRDARELDPAPVPIADAIAETARRLRATLDAHGPDALAFYVSGQMSLEAQYLVNKLAKGYVRTPHIESNSRLCMASAGSGYKLSLGADGPPGSYQDFERADLFFVIGSNMADCHPILFLRMMERVKAGAKLVVVDPRRTATAQKADLFLKIRPGTDLALLNGLLHLLHANGRTDADFIAAHTEGWDAMPGFLADYTPQRVAALTGLAEADIRLAAQWIGDAREWTSCWTMGLNQSTHGTWNTNAICNLHLATGKICRPGSGPFSLTGQPNAMGGREMGYMGPGLPGQRSALDGDDRRFVEEIWGLPAGTIRPDAGGGTVDLFARMAAGDVKACWIICTNPVATVANRKNVIAGLQAADVVIVQDAFLDTETNRYADILLPGALWAEAEGVMINSERNLTLMRQALEPPGDAWPDWRIVAAVARGMGYGDAFDYGSAAEVFDEIRRFANPNTGYDLRGASHAALRATPLQWPCPPEDGRDRHPIRYLNDGASRPRVTLPDGCVPPLAFPTPSGKARFFARPHVAPAEMPTPEFPIVLNTGRLQHQWHTMTKTGKVAMLNKLDARPFVEIHPDDAAALSIAANDAVEIRSARGRAVLPAVVTDRVQPGACFAPMHWNDVYGDDLCVNAVTNDAVDPVSLQPELKFCAVALARVDAPDSADAGAHAGAHAAPLHETGSREAQAQAAPRAHEAACADAAPEEHDMSDIDTFAALLGVPAATSAPQLTDAQRVYVSGFVSGLRSAEGRRAGGVPMLPASAPFDAKARLWLDGLLAGLFSRAPLGAAARVDARAAAAAAVPAPSGAADAVSAPSGVRIVRTRPKVVLLWASQTGNVESLTERYATQLMDSGFEIRVACMSDYPAASLAKAQYALLMTSTFGDGDAPDNGQAFWTALAAAGAPRADGLRYAVLAFGDRNYDPFCGHGRRLDARLAELGATRLVERVDCDAEFQPAADAWLERAIARIKEEDAALHAVPADGMIPSGAIPTKTRPAASRLVANLRLNEPGAAKDTRCVSLSTDGAAIEYETGDALGVWPTNCPELVDELLALTRLKPDAPVTVAGMGELRLADALAKHLDITRPHPDALAFVASRSRAGDALARLLGDDRKTDLKHWLWGQQLADVLHEFPLELSAAELVGMLKRLQPRLYSIASSPSAHRGEIHLTVSAVRYGNGRRQRKGVASTFLADRAADAPVPVFVQKSAHFRPPASGDAPIVMVGPGTGIAPFRGFLHERRARGAKGRNWLFFGEQHADTDFYYRDELAQMRADGFLTRLDVAFSRDQTEKVYVQDRMLEQGAALWAWLEEGAHFYVCGDASRMAKDVDAALKTIVARHGGMTDEQAADYVARLAKDKRYARDVY

SEQ ID NO: 61894 - protein, 513 aa, Zea mays
MDKAYVAVLSVAFLFLVHYLVGRAAAGGGKGRKRLPPSPLAIPFLGHLHLVKTPFHSALGRLAERHGPVFSLRMGCRRAVVVSSPECARACFTEHDMSFANRPRFESMRLVSFDGAMLSVSSYGPYWRTLRRVAAVQLLSAHRVACMSPVICAEVRAMVRRMARLAAGGAARVQLRRRLFELSLGVLMETIARTKTSRSEACAADTDVSPEASELTRISEEIMPYLGTANLWDYLPFLRWFDVFGVRNKLMAAVRWRDAFLRRLIDAERRRMDGDGDGEKKSMIAVLLSLQKSEPELYTDTMIMALCGDLFGAGTETTSVTTEWAMSLLLSHPEALKKAQAEIDAVVGNSRRLITADDVPRLGYLHCVINETLRMYPAAPLLLPHESAADCKVGGYDVPRGTLLIVNAYAIHRDPAVWEDPGSFLPERFEDGKAEGRLLMPFGMGRRKCPGETLALRTVGLVLATLLQCFDWDTVDGAEVDMTESGGLTMPRAVPLEAMCKPRAAMCDVLREL

SEQ ID NO: 61895 - protein, 861 aa, Burkholderia pseudomallei K96243
MSTGKQRASIMKIVVIGHGMVGHKLLECIAAGAPGALAAPRVAVVCEEPRPAYDRVHLSEFFAGKSADDLSLVEPGFFERHPNFRLLLNTKAVAIDRAARTVALSTGETLAYDKLVLATGSTPFVPNVPGRERAGCFVYRTIEDLEAMRACGARANSGVVVGGGLLGLECAKALRDMGLAAHVVEFAPRLMAVQVDEGGGRMLREKIEALGVQVHTGKNTLEIVDGETGAHRMAFADGTHLDADMIVFSAGIRPRDEIARACGLEIGPRGGVAIDERCRTSDEDIYAIGECAAWNGQTFGLVAPGYDMARVVARQLAGGEGAFAGADLSTKLKLMGVDVASIGDAHGRTPGSRAYQFADERRGVYKKLVVSECGKALLGAVMVGDAADYGTLLQMMLNRIELPRSPEFLILPQADGAAKPALGVDALPDAAQICSCNNVTKAQLREAVAGGATSLGALKGCTGAGTSCGGCVPLVTQVLKAEMKKQGLAVNNHLCEHFPYSRQELYHMVRVERFKTFGALLKKHGRGLGCDVCKPAVAGILASCWNEFVLKKEHAALQDSNDYYLANIQRDGTYSVVPRMPGGEVTPEGLIAVGEVARKYGLYTKITGGQRVDLFGARVEQLPLIWEELIAAGFESGHAYGKSVRTVKSCVGSTWCRYGVGDSVGLAIELENRYKGLRAPHKLKFGVSGCTRECAEAQGKDIGVIATEKGWNLYVCGNGGMKPRHAELLAADLDRATLVRYVDRFLMFYIRTADRLQRTSVWRDNLEGGLDYLIDVVVHDKLGLAAELEAEMQHVVDTYECEWKRAVTDPATRRRFRHFVNSDAPDSTIAFVEARGQIRPVTPDERDAEGQADRQPETETA

SEQ ID NO: 61896 - protein, 499 aa, Glycine max
MCSSETINIAASTQKLDVDNRIALRFYYRIADNILKQADIFRAETNIVDLYIMLLRFSSLVSETIPRHRDYRSSSQGKKEALRKKLLHSVNELEKLKPKVQQKINEFNSRRAYQHNGWEKYHSNDFMDFSPAKKAVIPTTGEFVYQGSRGQQFSSARPVEENMRRLSLSLPCPKEETLSRHSVLGPNGLKGQWRPPASDKGVRYPTIIDLSPVETPSLQHSLEDGSLNKKDNSISEQHKSDLESILTQSDDCKAKHADEAPSLISFEATEVHAQIEVTRQPSPPPVLAEVKDLVPAVLSHVNEEGCKTEILTSDSIVRAESPLQLHISTSMMESFMKLAKSNTDKNLETCGILAGLLKNRKFYITALIIPKQEATSSSCQATNEEEIFEVQDKQSLFSLGWIHTHPTQSCFMSSIDVHTHYSYQIMLPEAVAIVMAPTDSSRSHGIFRLTTPGGMSVIRQCQQRGFHPHNQPPDGGPIYDTCTDVYMNPDLKFDVIDLR

SEQ ID NO: 61897 - protein, 1068 aa, Pasteurella multocida subsp. multocida str. Pm70
MPKRTDINTILIIGAGPIVIGQACEFDYSGAQACKALREEGYKVVLVNSNPATIMTDPDMADVTYIEPIEWRTVEKIIEKERPDAILPTMGGQTALNCALDLSKNGVLKKYNVELIGAKEDAIDKAEDRGRFKEAMEKIGLSTPKSFVCHTLEEAWAAQSEVGFPTLIRPSFTMGGSGGGIAYNKDEFYAICERGFDASPTHELLIEQSVLGWKEYEMEVVRDKADNCIIVCSIENFDPMGVHTGDSITVAPAQTLTDKEYQIMRNASIAVLREIGVDTGGSNVQFAINPENGEMIVIEMNPRVSRSSALASKATGFPIAKVAAKLAVGYTLNELRNDITGGLIPASFEPSIDYVVTKVPRFAFEKFPQADDRLTTQMKSVGEVMAMGRTFQESLQKALRGLETGICGFNLMSEEPEKIRQELGNPGPIRILYVADAFGAGFTLDEVHHYSKIDPWFLIQIQDLVLEELALEKRTLDDLDYAELRRLKRKGFSDKRIAQLTKSAESAVRNKRVSLNLHPVYKRVDTCAGEFTSDTAYLYSTYEEECESRPSDKKKIMILGGGPNRIGQGIEFDYCCVHASLALREAGFETIMVNCNPETVSTDFDTSDRLYFEPLTLEDVLEIIHVEKPHGVIVHYGGQTPLKLANDLHANGVNIIGTSADSIDAAEDRERFQQILHKLHLKQPTNRTARNAEEAVKLAEEVGYPLVVRPSYVLGGRAMQIVYNVDELQRYMREAVSVSNDSPILLDHFLNNAIEVDVDCICDGAEVVIGGIMQHIEQAGIHSGDSACSLPPYSLSQEVQDEIRRQTAEMAFALGVKGLMNVQFAVQDGVIYVLEVNPRASRTVPFVSKATGRPLAKIAARVMAGESLKAQGIQGEVIPPFYSVKEAVFPFIKFPGVDTVLGPEMRSTGEVMGVGTTFAEAFLKAQLGANERIPKTGKVFLSVNDADKPRLLPIARQLQESGYGLCATLGTAKFLREHGVAVQIINKVREGRPNIVDAIKNGEIAMVINTVSGLAETVTDGHAIRRSALQQKVFLQTTLAGAEALAGSVEYLADSEVYSLQDLHQRLL

SEQ ID NO: 61898 - protein, 227 aa, Pasteurella multocida subsp. multocida str. Pm70
MELVFIRHGFSEWNAKNLFTGWRDVNLTERGIEEAKSAGKKLLEAGFEFDIAFTSVLTRAIKTCNIVLEESNQLWIPQVKNWRLNERHYGALQGLDKKATAEQYGDEQVHIWRRSYDISPPDLDPQDPHSAHNDRRYAHLPSDVVPDAENLKITLERVLPFWEDQIAPALLAGKRVLVTAHGNSLRALAKHIEGISDADIMDLEIPTGQPLVYKLDDNLKVVEKYYL

SEQ ID NO: 61899 - protein, 954 aa, Oceanospirillum sp. MED92
MNLTKKSDKPAAPSAAAGLGLSRRRFLKNSGIAAGGVATASMMAPGMMQQAEAATTAAGAPTDVKRTICSHCSVGCGVYAEVQNGVWTGQEPAFDHPFNAGGHCAKGAALREHGHGERRLKYPMKLVDGKWKKISWDDAINEVGDKMLQVRKESGPDSVYWLGSAKFSNEQAYLFRKYAAFWGTNNVDHQARICHSTTVAGVANTWGYGAMTNSFNDIHFAKSIILIGSNPAEAHPVSLQHIFRAKERNKAHIICVDPRFTRTAAHANEYIRIRPGSDVAFIWGLLWHIFENGWEDKEFIRQRVYGMDEVREEVKKWTPEEVENVTGVKGSQMRRAAKELAENRPGTVIWCMGGTQHTTGNNNTRAYCILMLALGNMGTSGGGTNIFRGHDNVQGATDLGVLSHTLPGYYGLSDGAWKHWSKVWDVDFEWMQSRFDQEVYRKLKPMNNKGIPVSRWIDGILEDKKLMDQKDNLRVMVAWGHAVNSQTRGPEMKKAIEKLDTLVIVDPYPTHAAVMSDRKNGVYLIPACTQFETYGSVTASNRSIQWRDQVIEPLFESKPDHEIMYLFAKKFGFEKQLFKNIEIKNNQPVVEDITREFNKGMWTIGYTGQSPERLKTHQKNWHTFNFDTLKGEGGPANGDYYGMPWPCWGTAEHAHPGTPILYDTSKPVAEGGLTFRARFGVERDGVSLLAEGSFSKGSDIKDGYPEFSDKLLKKLGWWDDLTAEEKKLAEGKNWKTDLSGGIQRVAIAHGCSPFGNAKARAVVWTFPDKVPLHREPLYTARRDLVSKYPTWNDSESMYRLPTMYKSIQDKDLSKEYPIILTSGRLVEYEGGGEETRSNPWLAELQQEMFVEVHPADANTLGFKDGDDVWVEGAEGGKVLVKALVTRRVDQGVVFMPFHFGGKFQGKDLTDKYPDGAAPYVVGEAANTATTYGYDPVTQMQETKVTLCRVQKATA

SEQ ID NO: 61900 - protein, 301 aa, Oryza sativa (japonica cultivar-group)
MLPYATAAEAEAALGRAMTAAESLWFRYSAGIPDYVLFWHNILFLFVVFTLAPLPVALLELRAPAAVGPFKLQPKVRLSREEFFRCYRDVMRLFFLVIGPLQLVSYPTVKMVGIHTGLPLPSLGEMAAQLLVYFLVEDYLNYWIHRLLHGEWGYEKIHRVHHEFTAPIGFAAPYAHWAEVLILGIPSFVGPALAPGHMITFWLWIVLRQMEAIETHSGFDFPFNLTKYIPFYGGAEYHDYHHYVGRQSQSNFASVFTYCDYLYGTDKGYRYHKAYQAKMKALGQTEGEKADSNGLSYAKLD

SEQ ID NO: 61901 - protein, 205 aa, Pasteurella multocida subsp. multocida str. Pm70
MSDIKLNYHKTHFLTSAPDIRALPEDSGIEIAFAGRSNAGKSTALNALTNQKSLARTSKTPGRTQLINLFEVEPQCRLVDLPGYGYAAVPEQMKIQWQKALGEYLQKRQCLAGVVILMDIRHPLKDLDQQMIEWAVASELPVLLLLTKADKLSQSARSKQVKMVREAILPFQGDVQVEAFSALNKTGIDRLAAKLDSWFAPVLSE

SEQ ID NO: 61902 - protein, 757 aa, Gibberella zeae PH-1
MAAAHRHRKSVAADHPVRSSQNVEFLTDKEISDFLDDLDHDNDGHINYEEVERKLDQEHANLVPKPSAHHVISTDHSDDDRTRHAFLRRMMGDSGVDQIPRDEFAKMVKEWKIPSLKQAKKEEEEDKSYIKRLPGWRRIRSYWAVHGPEIVFLGVVISMQLAFGIWQLVKYQTTPGYRAAFGWGVVMAKTCAGALYPTFFFLILSMSRYFSTWLRRSYHISRFFNWDLSQEFHIRISCVAILLATLHAIGHLTGSFVHGSDPANEDAVAEALGPDKVPRPYIDYVRSLPGFTGITALGLFWILCLLSIPQVRRWNYEVFQLGHLLMFPIIGLMMAHGTAALLQWPMFGYFLAFPTLLVLVERTVRVGLGFHRIKATMKVLDKETVEVTAIIPSERLWKYKAGQYIFLQVPKISFFQWHPFTVSFCRGNKMMLHIKTDGNWTAKLRELGGDSGESEIEVGINGPFGAPAQRFYDFNHSIIIGAGIGVTPFSGILADLQYNDDLDHGGPNHEVDHHRHDSEATAIPQAARRSDSSSSDEATTSDNVPETPTRQGSVGPDLINKEKQPQADKAGSFAEDYRRVDFHWMVRERNYLLWLSDLLNDVSMSQDWHREHEDKPHLDIRINTHVTAKQKKISTHVYRWLLEMHRTDEHPASPLTGLLNPTHFGRPDFDLILDEHYEEMLKFRASKRTSTRNKEDENYEEDEELKVGVFYCGAPVVGEILADKCRELTLRGWQDGIHELGRIEWLVNYDGYDDHIN

SEQ ID NO: 61903 - protein, 341 aa, Oryza sativa (indica cultivar-group)
MAPPQLAGKMTAKAAAAVKPATRAYVTFLAGDGDYWKGVVGLAKGLRKVGSAYPLVVAVLPDVPESHRRILISQGCIVREIEPVYPPENQTQFAMAYYVINYSKLRIWEFVEYERMVYLDADIQVFDNIDELFELPKGPFYAVMDCFCEKTWSHTPQYQIGYCQQCPDKVAWPTAELGPPPALYFNAGMFVHEPSMATAKSLLDTLRVTTPTPFAEQDFLNMFFREQYKPIPLIYNLVLAMLWRHPENVQLEKVKVVHYCAAGSKPWRYTGKEANMDREDIKMLVKKWWDVYNDGSLDFKGLPPIAAADDADEVEAAAKKPLRAALAEARTVKYVTAPSAA

SEQ ID NO: 61904 - protein, 615 aa, Cytophaga hutchinsonii ATCC 33406
MCGINIIIDKKGVLTSREIQSMNQAILYRGPDHSDFVSFQFKQQQIFIGNNRLKIIDRNTLSNQPYNSIDKRYSLTFNGAIYNYKELKQQLPAMEWQTESDTEVLLNWMIVHGLSGLPELNGMFAFAFYDRQQHALIIARDPSGIKPLYYYNDDDYFIASSEIKGILASGLVKKEFNSNQVSHYLQFKYVPKPFTFYKNIFELNEATFIKIDEYDFKIKRFESPSVIKPNTLTNQQLIETCDQLIENAVKHHLVADVPVGLYLSGGIDSTLLLSKIRKLGHLNFPTFTIANSSREQAFGTRDFEFARLASKLYNSDHHEVSVHAEMLQDLPAFVSMIDQPIGDSALFLTHILSKEAGQHVRVALNGAGADELFAGYNRHSAYKSYLNNLLHKNLAITLIKSTYNILPDGGNHSLKKVFRLWNKFTGMMDVDPIKTCHNFSSSEYFIEKNTSIEVDDKSYEDLSYYLYYCLRNDRTKYLISDILALTDKMTMRSSIEARVPYLDQELRRFVESLDPSVLLKNGRKWILKEVLLRNGGETFLNRPKEGFGMPFGYWLKLPVNKNFVEKLTNKNHPIYEWVPYQTIKNLVDWHLGSKRDCSSELWSVLLLMHWYEKEF

SEQ ID NO: 61905 - protein, 408 aa, Nocardia farcinica IFM 10152
MTPVPKGDTPMSTSDLQQRWSAALMNNYGTPKVALVRGAGVVVYDADGKRYLDFLGGIAVNSLGHGHPAILAAVTQQLGTLGHVSNLYVSEPVIELAERLLAHFGDGAGKAFFCNSGTEANEAAFKIARLTGRRKIVACEEGFHGRTMGALALTGQPSKRAPFEPMPPGVVHVPYGDAAALAAAVDADTAAVFLEPIMGESGVVVPPMDYLVKAREITARHGALLVLDEVQTGIGRTGKFYAHQAAGIVPDVITLAKGLGGGLPIGAVLAQGRAADLLTPGMHGTTFGGNPVCAAAALAVLRTIDQEDLLAHVESVGKRLSDGIALLEHPLIDHVRGAGLLLGIVLTDNVSGEVEARAREAGYLVNAPKPNIVRLAPPLVLTETQADNFVVDLPAILDGAAADAKGAR

SEQ ID NO: 61906 - protein, 134 aa, Zea mays
  misc_feature (18)..(18): Xaa can be any naturally occurring amino acid
  misc_feature (77)..(77): Xaa can be any naturally occurring amino acid
  misc_feature (94)..(94): Xaa can be any naturally occurring amino acid
MSGRCKGAKGLGKGGTKXHRKVLRDNIHRITTPAIRRMGRRSGVKRISGIIYKETRGVINIFLQNVIRQAVTHTEHXARRKTETALDALYALKXQGRSLYGFRGYDRRLFIIADWLCDIVLCDAFCGIIACIYL

SEQ ID NO: 61907 - protein, 750 aa, Coprinopsis cinerea okayama7#130
MAPLSHPTIVDGWFREISPQWQGQAMTLKVNKILHVEKSLYQDVLVFESETYGNVLVLDGVIQATERDEFSYQEMIAHLPLAAHPNPKKVLVIGGGDGGVVREVLKHETVEQVVLCDIDEAVIRVAKIFLPHMSKLLESPRVTVHIGDGFKFLAEHEGTYDVIITDSSDPVGPAEALFEKPYFQLLHDALTPGGHISTQGECMWLHLQLIKDMLKFTKEIFTNVEYAYTMIPTYPSGQIGHILAAKSPGRDLKTPVRDVPNCRYYNKGIHASAFVLPEFVDALLYQDRDIRPVFGRELKALDNKPAKKVLLLGSGFVARPCAEYIVRQPENKLTIACRTLSSAQALAENLPDTTPISLDVTNTAALEAAVAEHDLVISLIPYTYHADVIKAAIKGKTHVVTTSYVSPAMRALDEEAKAAGIVVLNEIGLDPGIDHLYAVKTIDEVHEKGGKIKQFLSYCGGLPAPECSDNPLGYKFSWSSRGVLLALLNSASYISGGQRLDITGTELMAHAKPYYITPAYAFVCYPNRDSVPFKEYYNIPEAETVVRGTLRYQGFPEFIKTLVDIGFLDATPKEWLNDNLTWAEVTQKAVSANDAEEATLVERIKAIAKFPNDSEANRIISGLRWIGLFSKDKVTPRAGNLLDTLCAQLEKLMKYEENERDLVMLQHKFFVEWADGSEQILTSTLEAYGAPGGHSAMALTVGLPCGIAVQLVLDGVITKTGVYAPYTKEICDPIREVLEKEGLGMIERVL

SEQ ID NO: 61908 - protein, 286 aa, Prochlorococcus marinus str. AS9601
MISSKTSFIALIGNPVSHSLSPIMQNAALQYLGLDLIYIAVPCKDEDLELVLNSFKKINCKGLNITIPHKEKVLTLCSEISPIANKLKAINTLKLNSEKKWSATNTDVEGFIYPLKNLNLAKKKSIVLGSGGAARSVIQGLINLNLSTISVISRNKSSLDELIKNFGNEIQLQGLLNSDDQAQVLIREADLIVNTTPAGMKTTKYKNNVMPYGETFWRSLNSQTIVYDLIYNPAPTTLLKFSARKGCKTIDGLEMLVAQGIKSLSFWTDGLEVPFHVMNDALKKYL

SEQ ID NO: 61909 - protein, 431 aa, Wolinella succinogenes DSM 1740
MERINSINDFNEAKQVIPGGVNSPVRAFRAVGGTPPFIKEAKGSYLVDEDGNRYIDFVQSWGPLLFGHADLDIQKAVEEAIKRGLSFGAPTTSETLLAKEIIALYEGIEKIRFTSSGTEATMSAIRLARGYTGRDDIIKFEGCYHGHSDALLVQAGSGLATFGNPSSPGVPQSFTKHTLLARYNDLESVRECFKKSSGVACVILEPIAGNMGLVPATQEFIQGLRKLCDEQGSVLIFDEVMSGFRASFGGAQALYGVIPDMATFGKVIGGGMPVGAFGGRSDIMACLSPEGAVYQAGTLSGNPVAMAAGIASIRKIKQGGEALFSRLESLALRLMEGFKKCAQKHQIPLQTTVRGSMFGFFFNHAPVSNFEEALQSDTALFAKFHQAMLERGVYLACSQFETGFICASMDESLVDEVIAKIDEALEEIGRG

SEQ ID NO: 61910 - protein, 193 aa, Solanum chilense
FVFAGVGSAIAYGKLTTNAALDPAGLVAIAVCHGFALFVAVSISANISGGHVNPAVTCGLTFGGHITFITGSFYMLAQLTGAAVACFLLKFVTGGCAIPTHGVGAGVSILKGLVMEIIITFGLVYTVFATAADPKKGSLGTIAPIAIGLIVGANILAAGPFSGGSMNPARSFGPAMVSGNFEGFWIYWIGPLV

SEQ ID NO: 61911 - protein, 526 aa, Candidatus Blochmannia floridanus
MKQCTRQCILIIDFGSQYTQLLLRRIRELGIYAKVCDWNISQDLLVSLNPNGIIFSGGPDSVTNKHSSSISKVVFKIGVPILGICYGMQILVSQCGGNIRSVSNKGEFGYAQVEILSQKNTLIGNLYDYINDQGHCVLEVWMSHKDIVETMPQGFTVIGITENQQIAIIINEKCRWYGIQFHPEVTHTKKGKDILKRFAVDICRCEVTWKPVYIVKNIIKTIKKVVGQDRVVLAFSGGIDSLVTALLLKYAINHEQFVCVFVNNGLLCCNEINRISNFCKKYQDLNIIHLSEEKRFLSALTGVIDPEEKRKIIGKIFVEIFQAQISQLKNIKWLAQGTIYSDVIESGMSCASANIIKSHHNVGGFPSSVNIQLLEPIKDLFKDEVRNIGLYLGLPLNVVNQYPCPGPGMAIRILGEVREEYCNILRRVDYIFMEELNKSDLYNTVDQAFAVFLPVQSVGVQGDQRKYKWVIVLRAIETEDFMTAQWVRLPYTFLNKVSNRIVNEVEEVSRVVYDISCKPPATIEWE

SEQ ID NO: 61912 - protein, 345 aa, Burkholderia sp. 383
MSEKDFGYQPSHNTLVHQVERPHGEPRREHFRFVRQPLAPLAPGEVLVRNVHFSVDPYMRECMDGDWALHAPLEGRTIGQVLRTTDPMLRPGDWVFHRQGWRTYAQVPAQALRVIRPVEGVPLTAWLSILGGTGLTAWVALTRIVRLQPGESLYVSAAAGGVGTAAGQFAKLLGANRIVGSTSHERKARQLTSGLGYTDAFVYQPGQVGAQLRERIPEGFDVYLDNVGGEQLEAAIAVLKDHGRAALIGAVAQYSALQPPAAPRNLFDVVGKSLTLQGFLVKDYANLQQELEAFAIPHLQRGDIVAPETITKGFDTIVDAFLAMLAGGNLGKAIVSVDTDDAGAL

SEQ ID NO: 61913 - protein, 660 aa, Zea mays
WTPAVRSGIFERRRVRTNVAGPVSNSKQLAHIGPSAGLLDPNGPSKKRKKPKAWSKEEDADLAAGVQKYGEGNWEDILHKCNFDNTRTPDQLSQRWALKRPGGSTKPASTKHASVGLEERSAALKALSLAVGPMRGSSALRSGAYPQSIQHKSTVFAPKMPELRSAVTPSPAPAVPVPVAMPLRVAAQVQAPPHQGHQAPAHAAPPKLLNASNKTRKKQAAQPNPTISPSSIQAAAIAAGGRLATASTAANFLKVAQSKNAVHIRSLGATSLKPSASFKASIVVEHGTQPGGSQHLEPLNASAVHDVSGVAAVNQSGPLAGACSETKKALSTALAPVPCDSEEKEDDSEFCVITIDDLFPEDAKQPETVDTKAKQPQTTGLKANQPENADPKVMQQETMDPKSKQSDTVEVEIVDPKDKDMLEFDQYVASQGGHLNTDDLNKSKCTNSVSQAQGLVGSQQKLIPADGKGSPVTVVGKGKPVTAGVAATGRKTKFPVSHLAAGTPRGIVDTVNANAPNKTLVRRAAIPAPVPAGCQVRKDAMNSKGNQMTPGNAGSGVPASSQTSVAAQAASKANLPSSSSQAKPNNMVVNGGNRLVVNPPSSSQASAAVNDANRAATPQSSNPVNGANNREVNPPPSSQASTAVNGAANKGNVPAAARPP

SEQ ID NO: 61914 - protein, 249 aa, Hyphomonas neptunium ATCC 15444
MTETDADDLAHLIRNAHRVVVFTGAGISTESGIPDFRSPGGVWSKMKPIMFQDFVASRDARREAWTRVFNRTAGWTGASPNAGHYAVAQLVEAGKVTSVITQNVDNLHQDSGVPDSKVIEVHGNASYAKCLTCGKRYELEALRHHWEADEDITCMFCTGLIKTATISFGQAMPEDEMARATEEALLADLFLVLGSSLVVYPAASLPLVAKKAGSNLAIINREATEQDPYADLVLNTDIGPLMSAVMGRL

SEQ ID NO: 61915 - protein, 410 aa, Bordetella bronchiseptica RB50
MEQQHTIVIIGAGQAGGWAARTLRAEGYAGRVLLCGDETAPPYERPPLSKEQLAAQAPALPSLMDAAQLAELHIDWLGGAAATRIDRAGRRVLLGDGQALRYDALILCTGGRPRLPPLPGADLPCVHTLRTIDDAARLRAAFDGAPRVAVLGGGWIGLEVAAAARQRGCAVVLLEAADRLCARSGPGLLSETLARLHAGQGVDLRLNARVQRIDAHGRGCRLALADGQGIEADIVVAGVGLVRNDELARQAGLACDHGVIVDGACRTSDPDIYAAGDVAVMARPDGKLAGLESWQNAQDQGIAAARAALGQAVRYAPLPFFWSQQYDTLVQMAGASEPGAALVLRQGGPAQLLCVEMRADGRAAAVLGVNAAREFRQLRKYIAEGARLDARRLADPRSPLAGAVLGEAAA

SEQ ID NO: 61916 - protein, 85 aa, Zea mays
  misc_feature (14)..(14): Xaa can be any naturally occurring amino acid
PLLVGQKHGWKAFXGPPGQKGQAPFGKCIRVKNRATGGSLVARVVDQCNNGGLDLEYKTVFKKIAPHGGGYQMGPPNVDYQFVAC

SEQ ID NO: 61917 - protein, 163 aa, Dunaliella tertiolecta
ASAQQPLNQQAPPPPTSFASQLQHTLGQQQFCDPTLIDRGLQHADKRRRDWIDVDALNEDDTQACSAYAVPIFEHLREAELVRRPNALYPEAFQTDVNAKMRAILVDWLVEVAEEYKLCADTLYLSVNYIDRFLSIHPVQRSNLQLVGIACMWIASKYEEIYP

SEQ ID NO: 61918 - protein, 426 aa, Azoarcus sp. BH72
MHFDIVIVGGGAGGLELAAKLGRKLGPRLGRERVLLVDRAVFHIWKPTLHEVAAGTLDAHQEGLSYTVLARRNHFSFALGELSALDTERRLITLGETRDERGEVLVPTRTVSFTRLVLAMGSGSNSFGTPGADNAYVLEHASDAQRFHAKLLAAFARASFSAEKTLAVAIVGGGATGVELSAELIEAHNELLEGLGSEQRFRLDIALVEAGDRILAGLPPQISAQARLALERKNVRVLTGTRVTEVQRDRLVTTAGEIPASIIVWAAGIKAADANRGFGLETNRINQFVVNDRLETSVSGIYALGDCAACKWEGDKLVPARAQAAHQQADYLTAVLLAALNEGRVDAPFVYRDFGSLVSLGENKGIGNLMGGLSGRNFFVEGLIAKWMYMSLHLMHHRAILGIGKTAVLALARLLQQRVSGRLKLH

SEQ ID NO: 61919 - protein, 81 aa, Salmonella typhimurium
LQVSWGPVMPAQESFQMVEATKGINSYYLTSDGSTMSYRTRVRTPSFAHLQQIPSAIRGSLVSDLIVYLGSIDFVMSDVDR

SEQ ID NO: 61920 - protein, 136 aa, Candidatus Blochmannia floridanus
MIQKERTLSIIKPDAVSKGIIGAIISRFESSGLLIVSAKMLQLTTDQVLEFYNEHKNKFFFKDLMEFMISGPIFVQILEGNYAIRRNREIMGNTDPMKALAGTIRFDYGESCTKNVIHGSDSESSAKYEIAYFFDI

SEQ ID NO: 61921 - protein, 55 aa, Glycine max
YVGPPPKGQKLADAALRRIGATKVVDRVLKAAEVLIKGATVSEKVHGPWYKALIV

SEQ ID NO: 61922 - protein, 193 aa, Solanum habrochaites
FVFAGVGSAIAYGKLTTNAALDPAGLVAIAVCHGFALFVAVSISANISGGHVNPAVTCGLTFGGHITFITGSFYMLAQLTGAAVACFLLKFVTGGCAIPTHGVGAGVSILEGLVMEIIITFGLVYTVFATAADPKKGSLGTIAPIAIGFIVGANILAAGPFSGGSMNPARSFGPAMVSGNFEGFWIYWIGPLV

SEQ ID NO: 61923 - protein, 148 aa, Oryza sativa
  misc_feature (9)..(9): Xaa can be any naturally occurring amino acid
MDHEADAYXTDLMTITRYVLNEQSRNPEARGDLTILLSHIVLGCKFVASAVNKAGLAKLIGLAGETNVQGEEQKKLDVLSNEVFVKALVSSGRTCVLVSEEDEEATFVDPALRGKYCVCFDPLDGSSNIDCGVSIGTVRTHETTKPKR

SEQ ID NO: 61924 - protein, 664 aa, Piromyces sp. E2
MKTLSIFTTLLAVSAAKKCVVRNPTDSAKTNDVKAPVTDDIPSDNETPVNVDENTPLDKEEDSGIENSDIENSEDKPKGKLPADFKWGAATAAYQVEGAWNEGGRGESVWDHFTHLYPKNVESGDRSNPNSTNGNVACDSYHKLGEDIKMMKIMKGNHYRFSMSWSRLFPDGQAKKVKGKWNVNKEGVEYYDMVIDTLLENNITPMATLYHWDFHTLSMKSMVVGRLPFTRRFAKYAEFCFEHFGDRVKNWITTNEPWVNCVSGYRLGPGKAPYRCTGEAPRKLANDTAGLDLLGGCSYEIGPSQYTKNHEALTANRPPQRLEDVWCSHNILIAHAKAVNVYRKKFQKKQKGLIGITIDGEAQIPWQDDKTTPEELENNKKYANLAAEFRIGWYSDPPMIGDYPESVKQRMSKDMPVFTDEEKALLKGSSSDFLGWNTYTAHWAEQVKNEDGTYVQPPTDEEANFENSKRDMWDDNCRGRGEGWTCIPPTLGSQAGSSWNTKYGPTIRVGLNWFADRHKGLIKIGIVITENGCAQPNYKVSRANDEVTKKYFESIGQPEYADVYDESIIEDEKNIEGSILHDEYRIDWYKQYLENLRLAYVEDKVDVRGYMAWSLVDNFEWENGYETRFGMTYIDFYNDKNLTRVPKDSLTFLGQWYLENVEQA

SEQ ID NO: 61925 - protein, 215 aa, Hordeum vulgare subsp. vulgare
MSYAYLFKYIIIGDTGVGKSCLLLQFTDKRFQPVHDLTIGVEFGARMITIDNKPIKLQIWDTAGQESFRSITRSYYRGAAGALLVYDITRRETFNHLASWLEDARQHANANMTVMLIGNKCDLSHRRAVSYEEVEQFAKEHGLVFMEASAKTAQNVEEAFIKTAGTIYKKIQDGVFDVSNESYGIKVGYAVPNASGGGAGLVLSNQGRLLAIKQV

SEQ ID NO: 61926 - protein, 332 aa, Hyphomonas neptunium ATCC 15444
MTAAKFDVVGLGNAIVDVLARADDAFLARLGIHKDAMQLIEEPRAEELTALAKDAVITSGGSGANTIAGLSSFGAKAAYIGKISNDELGHQFMREMMKAGVPFHTRPLEEGPATARSIIFVTEDGHRSMNTFLGASVLFSKEDVDADLVRSGQILYLEGYLFDRDEAKEAFVHAAEIAKAAGRKVAVTLSDSFCVDRHRASFRNLVKGFADIVFANEAELLSLYETEDFDAALAALHADCAIAAVTRSAKGSVVIGDGAPITVPAEPVASVVDTTGAGDQYAAGFLFGVARGLPLATCARLGHIAAAEVISHIGPRPVVSYKELAETAGIRA

SEQ ID NO: 61927 - protein, 375 aa, Zymomonas mobilis subsp. mobilis ZM4
MSELDYYSLLEVERTADDKTIKTSYRRLAMRYHPDRNPGDSDAEERFKAISEAYDCLKDPQKRAAYDRYGKDAFQGGGGFGGFGGGAQDFGGFSDIFESVFGEFMGGRGQARSSVQRGADLRYDLKISLEEAFKGKTVDIEIDVASVCDACHGSGAKAGSGRKTCDTCHGSGRIRVQQGFFVVEQSCPVCQGKGEVISDPCPECHGEGRCEKHKTLSVNIPAGVDDGTRIRLSGEGEAGVHGGPAGDLYIFIHVTPHQVFQRESYNLFAHVPISFTKAALGGSIHVPSLDGEQYEISIPAGIQSGKQLKRRGAGMPVLNGRGRGDLIIQIDVETPTRLTAKQRELLEQFRETETGEECPKSSGFFSKLKTILTGE

SEQ ID NO: 61928 - protein, 176 aa, Triticum aestivum
  misc_feature (155)..(155): Xaa can be any naturally occurring amino acid
MAPAVMASSATTVAPFQGLKSTAGLPVSRRSGSAGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNMRXQVQCVSFIAFRPPGCEESGKA

SEQ ID NO: 61929 - protein, 428 aa, Triticum aestivum
MSKAAAAAAAAASLPPPPPEVAHLVEQLQRHHLAPDASLLSSSAHSDLLQAREEVAAERARYLEALAVYAEAMAMVEEYQHATAAGSAGAAKKLNCSPEVYESLEHHLAVAEAAQRLRLPLLSQDGEVHEEEIEKLSTLSRVSFDSTVTSATPSSTSISTGYNNYGSTGSALTAAAVAGSGGSELVEPGAGGVPDRFLGITSDYLYQVQQQQPAMTVDMVEYQRSVAREIEARLEAKCDALADLFAMDERDSSSINQISSARLPERVKLIIEGIEKEESLLLEDLASMDRKFAEHYNVLEQILAVLIQFVKDKKLEHQHQYDDVKKTWLIKRCRTMNAKLSYLEHHLLRDTYTKETVPALHRIRKYLVEATKEASNSYNEAVSRLREYQGVDPHFDVIARQYHEIVKKLEGMQWTIHQVEMDLKPASS

SEQ ID NO: 61930 - protein, 494 aa, Colwellia psychrerythraea 34H
MTEVTCNLEAAGIKDSQLIKPFSYINGSWHSSETQFPVINPSTGEVVAQVSNADVAETELAVSAAKGALKMWSAKSANERATLLRNWFNLVMENQDDLGRILTLEQGKPLAEAKGEIAYGAAFLEWFAEEGKRVYGDTIPALSSDKKIVVIKQPVGVVASITPWNFPNAMIARKAAAALAAGCTFVVRPSESTPLSALAMAELAERAGIPAGVFNVVVGSNSRGMGQVLTQHPDVAKFTFTGSTGVGKLLLTQCATTVKKVSMELGGNAPFIVFNDADIDAAVQGAIISKYRNAGQTCVCTNRILVQQGVLEEFTEKFKNAVAELHIGDGLVEGVNLGPMISDKAVCDVEKLVADSIAAGAKVAFGGQRSEAGELFYQPTILTGVTNDMPIAANEIFGPVSPIIAFETEEEAIELANDTEYGLAAYFYSRDIGTVWRVAEGLEFGMVGINEGIISNAAAPFGGVKQSGNGREGSKYGLDDYLEIKYLCMGGLDK

SEQ ID NO: 61931 - protein, 468 aa, Pseudomonas syringae pv. syringae B728a
MSKSVQLIKDHDVKWIDLRFTDTKGKQQHVTMPARDALEDDFFEVGKMFDGSSIAGWKGIEASDMILLPDDETALLDPFTEEPTLVLVCDVIEPSTMQGYDRDPRAIAHRAEEYLKSTGIGDTVFVGPEPEFFIFDEVKFKSDISGSMFKIFSEQASWMTDGDVDGGNKGHRPGVKGGYFPLPPVDHDHEIRTAMCNALEEMGQTVEVHHHEVATAGQNEIGVKFNTLVKKADEVQTLKYCVHNVADAYGRTATFMPKPLYGDNGSGMHVHMSISKDGKNTFAGEGYAGLSDTALYFIGGIIKHGKALNGFTNPSTNSYKRLVPGFEAPVMLAYSARNRSASIRIPYVNSPRGRRIEARFPDPAANPYLAFAALLMAGLDGIQNKIHPGDAADKNLYDLPPEEAKEIPQVCGSLKEALEELDKGRAFLTKGGVFSDDFIDAYIELKSEEEIKVRTFVHPLEYELYYSC

SEQ ID NO: 61932 - protein, 361 aa, Brassica napus
PRVRGRVGGHESSTTAAPKAKPGRSDNKAEEFGSGVQEAEKNKLVFFEGSSYNFDLEDLLRASAEVLGKGSYGTTYKAILEEGTTVVVKRLKEVAAGKREFEQQMEAVGRISPHGNVAPLRAYYFSKDEKLLVYDYYQGGNFSMLLHGNNEGGRGALDWEQRLKICLGAAKGIARIHSSSGAKLLHGNIKSPNVLLTQDLNACVSDYGIAPLMSHHTLLPSRSLGYRAPEAIETRKHTQKSDVYSFGVLLLEMLTGKAAGKTTGHEEVVDLPKWVQSVVREEWTGEVFDVELIKQQHNVEEEMVQMLQVAMACVSKHPDSRPSMEEVVNMMEEVRPSNGSGAGSGNRASSPEMIRSSDSPG

SEQ ID NO: 61933 - protein, 227 aa, Sordaria macrospora
IAAAETPVMDELSKSATGFTELDASSLAVGLPEGLMGNSEVGHLNIGAGRVVWQDVVRIDQTIKKGELGQNDVIKSTFERARNGNGRLHLCGLISHGGVHAKQTHLYALLRAAKEAGVPKIYIHFFGDGRDTDPKSGAGYMQELLDTIKEIGIGELATVVGRYYAMDRDKRWERVEVALKGLYLGEGEESTDPVKTIKERYEKGENDEFLKPIIIGGDERRIKEDDT

SEQ ID NO: 61934 - protein, 328 aa, Colwellia psychrerythraea 34H
MLPTESQRIWMYRNMLISRYMEERIESIYMEGKKPVFNMANGPIPGEMHLSNGQEPCAVGVCAHLKAEDVVTATHRPHHIAVAKGVDLNKMMAEIFGKKTGLSGGRGGHMHLFDNDVNFACSGIIAQGMGPAVGAALSRKLQKKSGIAISYIGEGAANQGAFHETLNLASVWKLPVIFIIEDNDWGISVAKSTSTAVEKNSIRAASYDMPGIHIEDNCPDKIFSATKEAIERARRGEGPSLIEIKTSRLAGHFMGDAEDYRPKGEKDKLVKEDPIPTYRQKLIDAKVITLDDDLVLVEETQQIVEQAITFARDSEYPQPEEAMLHVFA

SEQ ID NO: 61935 - protein, 486 aa, Pasteurella multocida subsp. multocida str. Pm70
MIKHWINGKEVASEETFDNFNPATGEVICQVASGGEKEINAAVQAAKDAFPKWSKTPAKERARLMRKLGELIDQNVAKLAELETLDTGLPIHQTKNVLIPRASHNFDFFAEVCTRMNGHSYPVDDKMLNYTLYQPVGVCGLVSPWNVPFMTATWKTAPCLALGNTAVLKMSELSPLTANELGRLALEAGIPEGVFNVVQGLGSTAGHALVTHDDVRAISFTGGTATGKHILKHAGLKKYSMELGGKSPVLIFDDADLDRALDAALFTIFSLNGERCTAGSRIFIQETVYDEFVKQFAARAKRLIVGDPQDFNTQVGSMITRQHYDKVTGYIRIGLEEGATLLAGGLERPQNLPAHLQKGHFIQPTVFADVDNRMRIAQEEIFGPVVCLMKFKDEAEALRLANDVEYGLASYIWTKDIAKALRLSNGIEAGMVFVNSQNVRDLRQPFGGIKASGIGREGGEYSFEVFAELKNVCISMHDHPIPRWGL

SEQ ID NO: 61936 - protein, 107 aa, Thermus thermophilus HB27
MECVFCRIIAGELPSKKVYEDEGFVAFHDIRPKAPVHVLVVPKEHVEKLSDYPDTEEGERKLGALFRTANRVARVLGLEGYRVQVNVGEKGGQEVFHVHVHVMGGWG

SEQ ID NO: 61937 - protein, 347 aa, Burkholderia sp. 383
MNLSIPMRRDVRLKAKLKGLPTPDDFEIVTAAAPAAGSGDVLVRNRYFLVSASLRAMISEGAEDVPGVPFPCLSAGDALMGEALGEVVSAPAGSGLSSGDIVTHFHGWRDYAVVPAWGCQRVGEALPEPAGYLGYLGHGWTAYAALTRGVPIRPGDTVFVTSAAGAIGAMAGQIARRLGAGRVIGSTSSHDKARRLVSELGYDAAVIRGGSTPFAEQLLEAAQGGIDVLIDSVGGEQLQAAVTAAREGARFLILGALSGQLAATGTGRTAPAEIDTVQFLLKRITMRGYSADDNPEAKGEWFERFAQWLRAGEIVFPHTVIDGLDNAPSALCDTSSGRYLGTVLVKL

SEQ ID NO: 61938 - protein, 334 aa, Oryza sativa
  misc_feature (326)..(326): Xaa can be any naturally occurring amino acid
MAASLQAAATQMQPAKLGGRASTAALPSRPSSHVARAYGVDTGAAGRITCSLQSDIREVANKCADAAKLAGFALATSALLVSGASAEGVPRRLTFDEIQSKTYMEVKGTGTANQCPTVEGGVDSFAFKAGKYNMKKFCLEPTSFTVKAEGVAKNAPPEFQKTKLMTRLTYTLDEIEGPLEVSSDGTIKFEEKDGIDYAAVTVQLPGGERVPFLFTIKNLVATGKPESFGGPFLVPSYRGSSFLDPKGRGGSTGYDNAVALPAGGRGDEEELAKENVKNASSSTGNITLSVTKSKPETGEVIGVLRERAARRTQSLGAKVPKDVKIXGVWYAQLE

SEQ ID NO: 61939 - protein, 242 aa, Pericallis cruenta
PWLDLLDLQGIVKRMKKVHSQFDSFLDTIIEEHTVGTGRHVDMLSTMISLRDNADGEGGKLSFIEIKALLLNLFSAGTDTSSSTVEWGIAELIRHPQLMKQAQEEMDIVVGKNRLVTEMDISQLTFLQAIVKETFRLHPATPLSLPRIASESCEVKGYHVPKGSILFVNVWAIARQSELWTDPLEFRPARFLIPGEKPNVEVKPNDFEIVPFGGGRRICAGMSLGLRMVNLLIATLVQAFDW

SEQ ID NO: 61940 - protein, 687 aa, Oryza sativa (japonica cultivar-group)
MATRVLLSSKVILALVLASLFSLPRHGRALELMNWSCNNGSAYAANTTYDTNVHSILATLTARTPNTTTGFATATTGRGTDTEAWGLALCRGDTDRVGCASCLAAVPAVAFNECRGDMDVTVFYDRCLARFSYVDFTARPDNTEVLIGSPSADRITADAGHFDALVADLAGALADWAAYNSTLRYAAGVMTSGDGFMSTTEDMVHNIYGVVQCTPDQAAAACRACLEALRVDMPKVFAGKMGGRFNAVWCNLRYETFVFFDGDPSVKLVAPPVVPEDGKRRSSPENAAAVVGAVLGALVILLSLFIIYLWKKLQAKQYAADKNVDSGSLLFDLAIIRKATANFAEHNKLGHGGFGAVYKGFLPDVGEIAVKRLDRTSGQGLEQLRNELLLVAKLWHNNLAKLLGVCIKGDEKLLVYEFLPNRSLDTILFDPQKREQLSWETRYQIIHGTARGLLYLHEDSQIKIIHRDLKASNVLLDSNMNPKISDFGLARLCSGTKTTSITSQVVGTLGYMAPEYAVLGHLSVKVDVYSFGILVLEIVTGRRNTDVFDADEESSNLLSYVRPIDQLFYDFLKAMAFFMLKVWDHWQKGIPLEITDTLLLLSGSRGLQDMELLKCVHIGLLCVQENPADRPTMLSVLVMLQDVDTTNFAAPSKPAFTFANVRNTTSSSPSAAALSANEVSISEFHPR

SEQ ID NO: 61941 - protein, 721 aa, Mycobacterium sp. KMS
MADTSREGVDEHFTTSISQLTAISSRASGPGDRELLSLFDVALASRHLDLAARWLRAQGRGYYTIGSSGHEGNAAVAAALRPTDPALLHYRSGGFFLARAQQVDGGLARGIRDVLLGLVAATDEPISGGRHKVFGRADLNIIPQTSTIASHLPRAVGVAFSTARAGKLGVPCRWPADAVTVCSFGDASVNHSTAVGALNTAMHTAYQGMPMPLLFVCEDNGIGISTRTPRGWVARTYSQREGLQYFAADGSDLAATLETTRAAAEFVRTHRRPAFLHLSTVRLMGHAGSDYEPGYRRPDEIVADFDRDPVLCAAKASVAQGILSPVEVLERYEATRRQVLDMAAEVRDAPQLDSAAAVERPLRETLAEAVAASSAPPPGGSLAPPVTVAQAVNRALADALAHHPEALVFGEDVARKGGVYGVTRGLQQKAGPARVFDTLLDEQAILGLALGAGVSGLLPIPEIQYLAYFHNAADQIRGEAATLQFFADRQYRNPMVVRVAGYGYQKGFGGHFHNDNSIAAMRDIPGVVIASPARPDDAAAMMHACVAAAKTAGAVCLYLEPIALYHTKDLYADGDGQWLAPLTGTPAPIGRARIHGDGAALTILTFGNGLWMSLRVARRLERLHIGARIVDLRWLAPLPVEDMLREAQATGRVLIVDETRETGGVGEGILAALLAHGYTGPVERVAGRDSFIPLGDAALAVLLSEDTIEAAAIKLARTAGS

SEQ ID NO: 61942 - protein, 430 aa, Triticum aestivum
  misc_feature (222)..(222): Xaa can be any naturally occurring amino acid
MDATTAKQLRRLRTLGRGASGAVVWLASDDASGQLLAVKSAGAGAADTLRREGSVMAGLCSPHIVPCLGSRAAPGGEYQLFLEFAPRGSLADEAARSGGSLAERAIQGYAADVARGLAYLHGNSLVHGDVKARNVMVGADGRAKLADFGCARAADSDRTIGGTPAFMAPEVARGEEQGLAADVWALGCTVIEMATGHAPWSDMDDVFAAVHRIGYTDAVPEXPASLSPQAKDFLRKCLARNPRHRSTAAQLLEHPFLASAFHDVDAEPAKQDWIMSPKSTLNADFWESDEESETEDMLTSAAERIGSLASPCSALPDWESDDGWIVVHGGRPEASETTTPTAIAGTDFGPWSEEGLEAEVDVHFAGADAGRWYDLVRNVDGAHYFGWYERDLGVSVVTDRPLCLIVSHGRKIVKFGCHCDRERTMHFGFA

SEQ ID NO: 61943 - protein, 732 aa, Prosthecochloris aestuarii DSM 271
MLAQIEKDQYEKLHEVLRLARANLKNFDESLVQRAFFMCYRAHEGEKRASGEPFFYHPVEVAKIMLTELPLDGVSVAAALLHDVIEDSEYTYEDLVAELGSEVADIVEGLTKISGIMINREITQAEGFRKMLLSMVKDIRVILLKFCDRLHNMRTLGALPEHRRLKIALETRDIYAPLAHRFGLGKMKVELENLAFKYIDPEMFEMIQQKVRLSRGERIAYLDKMIVPIKDDLQKQGFNLEVQGRAKHLFSIYNKMRLKNKRFEDIHDLYGIRIVIDTERISDCFAAYGFITQKYPPLPQHFKDYISIPKHNGYQSLHSAILGPRGHVVEVQIRTRRMHEFAEFGVAAHWRYKEKVSRDDASVNTFLRWARELINDADSAASFMEGFKLNLYHDEIYLFTPKGDMKTLPAGATPIDFAYSIHTEIGNGCIGAKVNGKIVRLNSELRSGDRVEVITSRNQKPKADWLKFVVTHRAKLKIRSAINEERRLQIEKGRGMWEKMLSGTRKLLNDNDIIRQVRKYGIKTPADFFSALANHQIDPEKVIKSFAEEHRRAALDEGADAGSQFDTFAEQARKVPEDEPAGKGRDEVTIEGLPNIAYSYAKCCKPVPGDDIIGFVTKEGVVKIHRKNCVNVSNESLLKSERVVSVSWNRKVETEFLAGIKVIGEDRIGITNQITAVISKSDTNIRSISLHARDGMFIGTVMVYVRNISRLTALMDKIRKITGVFSVERLSN

SEQ ID NO: 61944 - protein, 452 aa, Cytophaga hutchinsonii ATCC 33406
MTEKEIVDYIKNNDIQKIKFAFADIDGVLRGKLIHTDKFLDGLKEGLGFCDVVFGWDSADAGYDNVSATGWHTGYPDKLAQIDLSTFRLIPWENNTPFFLADYKNNDQTALPICPRTLLKRIAQECSAMGYHAAFAQEFEWFNFRETQQSLVEKNFHDLTPLTNGMFGYSILRPSLEDAYYNDLFDLLGAFDIPLEGLHTETGPGVYECAYFHDEVVRAADKATLLKTAVKEIANKHGIIATFMAKISDKLPGCSGHIHQSLWNTGKTENLFYDPNQEHNMSDLFKHYVAGQLYCLPHIVPMLAPTVNSYKRLVEGAWAPTTLTWGFDNRTTALRVLNHSKKTARLEQRVSGSDTNPYLAIAASLASGLYGIKHKLSLDVPPTTGNGYANKSNGSIASNLMDATQLMKNSSIAKELFGEAFVQHFTATREWEWRQFSKHVSDWEMKRYMEII

SEQ ID NO: 61945 - protein, 486 aa, Azoarcus sp. BH72
MRQIENFIAGEYVAAASGRRFEKRSPVDNRVIASISEAGRPEVDAAVQAARAALHGEWGGLTADQRVELLYGVANEITRRFEDFVEAETADTGQPSHVMRHVFIPRGAANFKVFADVVKNVPTEAFQMATPDGAGALNYAIRVPKGVIGVICPWNAPFLLMTWKLGPALACGNTVVVKPSEETPNTAALLGEVMNAVGVPKGVYNVVNGFGPDSAGAFLTQHPGVDAITFTGETRTGAAIMKAASEGMRDVSFELGGKNAGIVFADADFDAAVDGIFRSAFLNTGQVCLGTERVYVERPIFERFVQALKLKAEAVKYGRPEDHTANYGPLISQEHKRKVLSYYAKAVEEGATVVTGGGVPDMPGELAEGAWVQPTIWTGLPETAAVVREEIFGPCCHIRPFDSEQEVVALANATDYGLSTTIWTTNLARAHRVAARVEVGITWINSWFLRDLRTAFGGSKQSGIGREGGVHSLEFYTETRNVCVKL

SEQ ID NO: 61946 - protein, 347 aa, Cytophaga hutchinsonii ATCC 33406
MASVKEKAKDNTKTKVESAGAFTKETYLFWYEKMQLVRKFEEKTGQLYGQQKIKGFCHLYIGQEACAAGAVSALKKGDHYITTYRDHGQPLVLGTDPKAIMAEMYGKATGISKGKGGSMHIFDKAVNFAGGHGIVGGQIPLGAGLAFAEMYKGTDNLCVCYMGDGAVRQGALHETFNLAMLWNIPVIFVIENNGYAMGTSVQRTSNVTELYQIGESYDMPSEAVDAMSVEEVHLSVARAAERARSGGGPTLLEFRTYRYKGHSMSDPAKYRTKEELESYKAQDPIEKVRAVILEKKHATEADLEAIDAKIKATVEEAVKFAEESPYPDASEAYKDVYTQEDYPFIIE

SEQ ID NO: 61947 - protein, 456 aa, Bordetella parapertussis 12822
MTTLSSAQQQDIQYQLHSYTNAVKHRDVGPRIITHGEGVYVFDDQGNRYLEGMAGLWSVAVGFGEQRLVEAAARQFQELPYYHTFTHKSHPSVIALAERLIGYTDGRMAQAFFTNSGSEANDTVVKLVWYYNNALGRRDKKKIIARQRGYHGVTVASTSLTGLPGNHKDFDLPLPQIRHTACPHYYRYGLPGETEEDFATRMAGELEAMILREGPDTVAAFIGEPVMGAGGVIVPPRTYWQKIQAVCRKYDILVIADEVITGFGRLGQRFGSQVFDIEPDIMVLSKQITSSYQPLGAVLLNARVADVVAEHSGRLGTFGHGYTASGHPVATAVALENLRLIDERGLIEHAAEMGALLHLELQALSSHPLVGEVRGVGLIAGVELVADKATRQPFDPLGKAGGYAYERAHDHGLIVRGIQDTVAFCPPLIITAEQVRDMVARFARTLDDVAAHVAQG

SEQ ID NO: 61948 - protein, 185 aa, Zea mays
  misc_feature (71)..(71): Xaa can be any naturally occurring amino acid
ERRPGQVRGVARGMAYVHGLGFIHRDLKSDNLLISGDKSIKIADFGVARIEVKTEGMTPETGTYRWMAPNXLDEMIQHRPYNQKVDVYSFAIVLWELVTGNVPFANMTAVQAAFAVVNKGVRPAIPHDCLPALGEIMTRCWDANPEVRPPFTEIVRMLEQVEMEVLTTVRKARFRCCIAQPMTLD

SEQ ID NO: 61949 - protein, 208 aa, Cicer arietinum
MGYWKSKVLPKIKKVFVSESSTKKAAAAEVSKSFDESKEVYNKEFEEKKTELQPKVLVVYEALSTQIKSLVKERDEAGLKKNTTEVNKFIEELVKIDFPGSKAVSEASSKFGPALISGPIFYVFEKVSTFIVTEEKVEETTPTTETKTEEETSGVKEKEIVIEEGKKEEKIESVEEKVVADPVSDDKQEEKVVETVVTAVEKEEPIKP

SEQ ID NO: 61950 - protein, 497 aa, Bordetella parapertussis 12822
MSTLPPLSHWESLAAGLTLRNQAFIDGRWHDGRAGPLAAINPATGQLLAEVTACSQADIDQAVAAARRAFESGVWSRMPRRERKQCMLRLAALIREHAEELALIETLDMGKPIGDTMAFDIPETAHTYAWYAETIDKQYDEIAPTDADALATITREPLGVVAAVVPWNYPLLMASWKVAPALAAGNSVILKPAEQSSLSALRLAELALQAGIPAGVLNVVPGAGPVAGRALGLHMDVDCLAFTGSTATGKRFMEYSGQSNLKQIWLECGGKSPHIIFDDCPDLDRAALAAAIGIFNNQGEVCIAGSRLYVQAGIYDTFVSKVEACARAMQPGNPLDPASPMGAMVDERQMARVLEYVESGRREGARLRMGGERVRADSGGYYIEPTIFECARPDLTIVREEIFGPVLAVTRFDGEDEVVAQANASAYGLGSGLWTADLSRAHRVSRRLRAGLVWVNCYFDGDVTVPFGGVKQSGFGRDKSLHALDKYTSLKTTWIRL

SEQ ID NO: 61951 - protein, 505 aa, Zea mays
MASPAMVPLRQLFVDGEWRPPAQGRRLPVVNPTTEAHIGEIPAGTAEDVDAAVAAARAALKRNRGRDWARAPGAVRAKYLRAIAAKVIERKPELAKLEALDCGKPYDEAAWDMDDVAGCFEYFADQAEALDKRQNSPVSLPMETFKCHLRREPIGVVGLITPWNYPLLMATWKIAPALAAGCTAVLKPSELASVTCLELADICKEVGLPSGVLNIVTGLGPDAGAPLSAHPDVDKVAFTGSFETGKKIMASAAPMVKPVTLELGGKSPIVVFDDVDIDKAVEWTLFGCFWTNGQICSATSRLLIHTKIAKKFNERMVAWAKNIKVSDPLEEGCRLGPVVSEGQYEKIKKFISNAKSQGATILTGGVRPAHLEKGFFIEPTIITDITTSMEIWREEVFGPVLCVKEFSTEDEAIELANDTQYGLAGAVISGDRERCQRLSEEIDAGCIWVNCSQPCFCQAPWGGNKRSGFGRELGEGGIDNYLSVKQVTEYISDEPWGWYQSPSKL

SEQ ID NO: 61952 - protein, 232 aa, Glycine max
MPSVHSSPGYSMENPALASLLRHTTGENKRSNKLSSGGGLLKMLKLFPMLSSGCKMVALLGRPRKMLKDSATTGTIFGYRKGRVSLAIQEDTRQMPVFLIELPMLASALNKEMASDIVRIALESETKSNKKKLLEEYVWAVYCNGRKVGYSIRRKQMSDDELHVMQHLRGVSMGAGVLPTSSDHKDCDGEMTYMRARFERVVGSKDSEAFYMINPDSTAQGPELSIFFVRPH

SEQ ID NO: 61953 - protein, 101 aa, Cicer arietinum
PEKKEEAKETKEEEKKTEENEKDQKKSGEGEEKKEAVEGDGEKSGGDGGGAEETKVVEMKKNEYYYKYGTEVFAYPDPAYPLQAYPPQIFSDENPNACSVM

SEQ ID NO: 61954 - protein, 224 aa, Methanothermobacter thermautotrophicus str. Delta H
MYAVKEVKGMDGVFIMNNSLLTINPNPGVKVYGERIIDWGGREYRVWDPRRSKLAAAILNGLRGFSLNSDSRVLYLGASAGTTASHISDIVTDGRVYCIEFSPRMMRELLGVCESRKNMAPLLEDASRPLSYLRMVEAADLVYCDVAQPDQTRLFIENMDCFLKRDGYGLIMIKARSIDVTRSPRKIFREEVGKLESSGFRIIDQVGLNPYEKDHMAVLVKRDV

SEQ ID NO: 61955 - protein, 402 aa, Zymomonas mobilis subsp. mobilis ZM4
MKRHTGLDRNITRKWRPATQAIRGGLVRSEFGETSEALFLTSGYSYERAEDAAERFAGEQEGMIYSRMQSPTVMMLEEKLALIEGAETSRTMSTGMAAMTSVLLSALSAGDHFVIGRVAFGSCRWLSDSLLPRFGITATVVDGADVQQWKDAIQPNTKLFFFETPTNPTLELVDIEAVCNIAKEAGILTVVDNAFCTPVIQKPMDFGVDVVAYSATKMMDGQGRVLAGSVAGSNKFVNETLLPFIRNTGPNLSPFNAWVVMKGLETLELRSIRQSENAQILAEFLEKRIPRVSYPGLKSHPQHALAKKQMKTGGTVLALFLGKDRQQALSLLNNLELIDISNNLGDTRSLMTHPCSTTHSGVAEKERLAMGITEDMLRFSVGLEDVEDLKEDLDQALRKIGL

SEQ ID NO: 61956 - protein, 349 aa, Zymomonas mobilis subsp. mobilis ZM4
MRIALLAGDGIGPEITAEAVKILKAVVGQEIEFDEALIGGAAWKVTGSPLPEETLKLCKNSDAILFGSVGDPECDHLERALRPEQAILGLRKELDLFANLRPARLFPELQAESPLKENIVTGTDLMIVRELTGDVYFGTPRGQRKDDQNRREGFDTMRYNEDEVKRIARIGFETARSRSGNLCSIDKSNVLETSQLWRTVVLEIAQEYPDVELSHMYVDNAAMQLVRAPDQFDVIVTGNLFGDILSDLASACVGSIGLLPSASLNSEGKGLYEPIHGSAPDIAGLGKANPLATILSGAMMLRYSLKREADADRIEKAVSTALEKGARTADLGGKMTTSEMGNAVLAALN

SEQ ID NO: 61957 - protein, 447 aa, Streptococcus thermophilus CNRZ1066
MFMRTLKKVSLAEVNQSIDTPNHNRFWQNLKAFLGPGALVAVGYMDPGNWITSVVGGATYKYSLLFVILISSLIAMQLQQMAGKLGIVTQMDLAQATAFHSPKWLRYTLWVVLELALMATDLAEVLGSAIALNLLFGIPIMVAILVTILDVFLLLLIMKLGFKKIEAIVSTLILTILVIFVYLVALSEPSITGILEGYLPTPTLFGHYAAGHTNHQLTLALGIVGATVMPHNLYLHSSLSQTRKVDHSNDDDVTKAVRFMSWDSNIQLTLAFVVNSLLLILGASLFFGHASDISAFSQMYNALQDSKIAGAVASSTLSTLFALALLASGQNSTITGTLTGQIVMEGFLHMRLPQWVIRLFTRLFALLPVIIVAILYGDQEKTLDQLLVYSQVFLSLALPFSIFPLIYYTSKKSLMGKHVNAKWNTYLGYAIAIVLTILNLKLIFDTF

SEQ ID NO: 61958 - protein, 234 aa, Triticum aestivum
LARAWEKDVQVMNEGPGHIPMHKIPENMEKQLEWCNEAPFYTLGPLTTDIAPGYDHITSAIGAANIGALGTALLCYVTPKEHLGLPNRDDVKTGVISYKIAAHAADLAKRHPYAQAWDDALSKARFEFRWLDQFALSLDPVTAMSFHDETLPSDGAKVAHFCSMCGPKFCSMKITEDIRKYADEHGYGTVEEAVRQGMSEMSAEFLAARKTISGEQHGEAGGEIYVPESYVVQK

SEQ ID NO: 61959 - protein, 383 aa, Rickettsia sp. R300
DISRVSAEADCFTYDPGFMSTASCQSTITYIDGDKGILRHRGYDIKDLAEKSDFLEVAYLLIYGELPSGEQYNNFTKQVAHHSLVNERLHYLFQTFCSSSHPMAIMLAAVGSLSAFYPDLLNFKEADYELTAIRMIAKIPTIAAMSYKYSIGQPFIYPDNSLDFTENFLHMMFATPCTKYKVNPIIKNALNKIFILHADHEQNASTSTVRIAGSSGANPFACISTGIASLWGPAHGGANEVVINMLKEIGSSEYIPKYIAKAKDKNDPFRLMGFGHRIYKNYDPRAAVLKETCKEVLKELGQLDNNPLLRIAIELEAIALKDEYFIERKLYPNVDFYSGIIYKAMGIPSQMFTVLFAIARTVGWMAQWKEMHEDPEQKISRPR

SEQ ID NO: 61960 - protein, 146 aa, Pseudomonas syringae pv. phaseolicola 1448A
MKTVAQLLKLKDLQNQQVHTIGPDQMVLDALRLMAEKNIGALPVVEGNVVVGVVSERDYARKVILKGRSSVGTPVREIMSNKVITVDSQQSVEACMGIMTDSHLRHLPVVEDGRLLGLLSIGDLVKEAIAEQASLIQQLEQYIRGE

SEQ ID NO: 61961 - protein, 1041 aa, Moorella thermoacetica ATCC 39073
MATFDSITTELIAALEEEINAIKESGGAEQIRVHDGRYGGTAAGRFLYIFLLDTELNIPSDTPAQLCIDKDSHETIILSVQGFEMTLGIQDDLGPFIPKAVLSLSAYYLLEQLQRRLDEIRTGVLPAERDMCMRLFAFQANVSFPNVKPATSLGDLNREQMEAVNRSLGQRVTFIWGPPGTGKTRTIGALVRELVQRGDRVLVTSHTNVAVDTALIPVIKALDDNEIQGGAVVRVGALAREDPELQQVTMEAVLERKSKDLRQQQQALGVERKRVQGVRDQLAATIRVIETVEKSEQLVATAKIALAGAEQKVQEEGNAISQARKTLGDLHSKLQQAEAAGFIRRVFFGFNPEVIRRQIVNQETVITKLEAAYQVAQQERRAASVALSEAEHRQAKDRQALESLGPLPPLPELRQQLGEVEKNLKQLDEQLAAIEARLREMAATVIRDARIVGATLSRLVLLEELYRGTFDTVIIDEASMVPLPNLWFAGSRAQKRVVVTGDFRQLPPIATARDAEKYPLAARWLQTDIFVKAGIVEGRARLDDPRLCALKVQYRMHEAIGEVANMLVYEHDGNPLEHRADPKKYAHATAALPESGEPLVLCTTSGANPWCGRLDPGFSRYNIYSAIVCIRLAARALASGAQNVGLVAPYRAQTRLLQHLVEQYRLPGERVETATVHRFQGNEKDVIIFDLVDSPPFQIGKLLSGGWGSEAMRLFNVACTRAKGKLVIVAHHDYLSQKAPAGDSLATLLQYLEQHGKIMDARMVVQDYADPAVKIALGAVMPARRQLGNPEGATHFNEGNFYPAFLEDLRDAAGEVVIFSPFIAERRLADVITPLRRLVDRGVLVLVVTRERHESNQVTEELIRQLSTIGIKVLRRRGLHEKLAFVDRKIAWFGSLNILSHSRSSEVMIRFSQPELVVRLMELSGTVYLLKQEERRSVQKHRLTELADALKKRMAFPSCPLCGGTTGLRTGKHGPFFGCASFRNGGCKGLINIPRRVLELAVQDLELTCPHCGGKVVLKSGRNGAFLGCSRYPDCRWTDSF

SEQ ID NO: 61962 - protein, 213 aa, Brassica napus
MECPKEPLESQCSLSEMDDFDLTRALDKPRLKIERKRSFDERSMSELSTGYSRHDLDMAHSPGSRSFVDTPLSYVRNSFEPHPMVAEAWEALRRSMVFFRGQPVGTIAAYDHASEEVLNYDQVFVRDFVPSALAFLMNGEPDIVKNFLLKTLQLQGWEKRVDRFKLGEGVMPASFQVLHDPVRKTDTIVADFGGSAIGRVAPVDSGVWVDHTS

SEQ ID NO: 61963 - protein, 430 aa, Glycine max
GSHSKSCANKKWCFTCEFERLILKSKDTKSAVSPMGIISHLQNIGSQLANGREEDAHEFLRHVIDTMQSVCLMEAGVNALGSLEEDTTLMGQTFGGYLLSKIKCMRCGGKSERQERMMDLTVEIEGEITTLVEALRRFTSTETLDGENKYHCVRCKSYEKAKKKLTVSEAPNVLTVALKRFQSGKFGKLNKPIQFPEILNLAPFMSGTSDKSPIYRLYGVVVHLDVMNASFSGHYVCYVKNIQNKWFKVDDSVVTAVELDRVLTKGAYMLFYARCSPRAPRLIRNRILSPDSKRKVSGKTLTTKARSISTNSGVAEHVNSSISSDDSPALASFYSKFHHLKRILEEDSSSDNSSLISSNSDEGSCSTDSTRDSTNTDDFSEYLFGDSGNGWSSVWRNSDSDTSSSSSYSPLNLRHSPLSHSPSPGERKKP

SEQ ID NO: 61964 - protein, 891 aa, Oryza sativa (japonica cultivar-group)
MASSQGLKKNYRCDRSLQQFYTGGPFAVGSSPGGGEGEVEGGEAEAEAFLACACGGEVRLVSAADASAIGEPIEGENEAVTALALSPDSRLLFTAGHSRLIRVWDLASRTCTRSWKGHDGPIRAMACHASGGLLATAGADKKVCVWDVDGGFCTHFFRGHAGVVTTVMFHKDPKRLLLFSGSEDATVRVWNLESKKCVAVLKEHFSAVTSLALSEDGQTLLSAGRDKIVNVWDVRKYNSKKTIPAFEMIEDVSFIGPGSNLLSCLGEPANIKRKTDGYFLTVGERGVVRIWCLESAQCIYEQQSSDVTVNTENEESRRGFTSAVMLSDDQGLLCATADQQFLFYCPTRTDGGDFQLNLYKRLVGYNDEILDLKFVGEDEQYLAVATNLEQVRVYDVASMSCSYVLSGHTEIVVCIDTCISSSGKTLVVTGSKDSTVRLWDMERRSCIGIGKGHLGAIGSVAFSKKSKNFFVSGSSDRTIKIWSWDDTLDDVGSEVPLKAKAVVAAHDKDINSLSVSPNDGLVCSGSEDRTACIWKLPNLVPSVVLKGHKRGIWSVEFSPVEQCVITSSGDRTVKIWAVADGSCLKTFEGHTSSVLRASFLSHGTQFVSCGSDGLVKLWTIKTNECIATFDKHDGKVWALAVGKKTEMLATGGTDAVLNLWHDCTMEDKQEDFRKKEEELLRGQELENAVSDYDYAKAIQLAFELRRPHRLLELFTQLCRESDLEDPIEKALIGLPKEGLRVLLEYIREWNTKPKLCHVAQFVLFRVLRSLPPTDILEIKGISELLEGLIPYSQRHFSRVDRLVRSTFLLDYTLTRMSVVDPDIDEGTTRDDANGSSVENCEIAQAKPDALVAEENLQKSVKKRKSSKSSKKGGKKVKIASTGGSKDVPIEA

SEQ ID NO: 61965 - protein, 424 aa, Bordetella parapertussis 12822
MDNAELTRRKEAATPRGVGVMCNFYADRAENAELWDTEGRRYIDFAGGIAVLNTGHRHPQLMQALQAQMSRFTHTAYQIVPYASYIQLAERINQLAPGDFAKKTALFTTGAEAVENAVKIARAATGRPAVVAFGAAFHGRTLLGMALTGKVVPYKVGFGPFPADIYHVPYPNALHGVSTDDALAALGTLFKTDVDPRRVAAIIIEPVQGEGGFNICPPAFMQALRALCDDHGILLIADEVQTGFGRTGKLFAMEHYGVAADLTAMAKSLAGGMPLSAVCGRAEVMDAPPPGGLGGTYAGNPLAVAAALEVIRIIEAEDLLARGTRLGHQLRDHLEAQRHDVPEIAEVRALGAMVAVEFRQPGSDAPSPEFARQVQARALEQGLLLLTCGSDGNVIRFLFPLTIPEAVMREALDILARTLRGQNA

SEQ ID NO: 61966 - protein, 506 aa, Cytophaga hutchinsonii ATCC 33406
MNKKVILMILDGWGLGTNPKVSAIAAAKTPFVDSLFVNYPHSKLEASGLAVGLPVGQMGNSEVGHMNIGAGRIVYQDLVKINLAVENNTLADEPAIKDAFNYAKTNNKKVHFIGLVSDGGVHSHVNHVKGLCNIANQYGLKDVYVHAFTDGRDCDPKSGLGFVKELQESMAKSTGKIASLVGRYYAMDRDNRWERVKLAYDVMVNGEGTHAADALKAIEESYAAGVTDEFIKPVVLVDANDKPIAKIEPGDVVICFNFRTDRGREITVALTQKDFHEQNMFKLDLYYVTMTNYDDTFNNVKVIFDKDNLSNTLGEVLQGASKKQIRIAETEKYPHVTFFFSGGREEPFKGEKRLMAASPKVATYDLAPEMSANEIKEKIVVELKSKDPDFVVLNFANPDMVGHTGVFEAAVKACEVVDSCTEAVVTTALENGYTAIVIADHGNADYMINEDGTPNTAHTTNLVPCILIDNEYKKPLKDGKLGDLAPTILALMGIEKPKEMTGESLL

SEQ ID NO: 61967 - protein, 355 aa, Bordetella parapertussis 12822
MAAKHRIAVIAGDGIGKEVMPEGLRVLEAAATRFGIDFQWDHFDWSCDYYARHGKMMPDDWAAQIGGHEAIFFGAIGWPDAVPDHEALWGSLFRFRRDFDQYINLRPVRLMPGVPTPLANRKPGDIDFFIVRENTEGEYSNSGGRLFAGTEREVVIQESVFTRVGADRVLKFAFELARKRGKHLTAATKSNGISISMPWWDERVAEMAASYPDVRWDKYHIDILCAHFVQHPDWFDVVVASNLFGDILSDLGPACTGTIGIAPSANLNPERKFPSLFEPVHGSAPDIYGKGIANPIGQIWSGALMLDFLGYPQAAAAVVAAIEQVLVDGPRTPDMQGKATTAEVGSAIAALVAAG

SEQ ID NO: 61968 - protein, 627 aa, Pseudomonas aeruginosa
MCGIAGFWNITGTLLGDNARVARQMAAAIHHRGPDESGIWYEAPRAPILVHARLAVLELSPAGSQPMHSDCGRYVLIYNGEIYNHLALRARLSEAGVTHSWRGGSDTETLLACFAQWGVESTLKLTVGMFALALWDRQEKTITLARDRMGEKPLYWGWQNGVLFFASELKALKEHPLFRGDIDRDALALFLRYGYVPAPYSIYKGIGKLRAGSYLVLSERSLNETCEPAAYWSANAAIEEALSNPFQGTDAEAVDLLESQLRTSISDQMVSDVPLGAFLSGGVDSSTVVALMQQQSSRPIRTFSIGFDEPGYDEAVYAKAVAEHIGTDHTELYVNSKDALDVIPSLPKIYCEPFGDSSQIPTLIVSGLARQQVTVALSGDGGDELFGGYNPYQFTPRVWRMLERFPHSMRRFASAFAQDLPLPEKLGKLRDVFASRTAEELFYRLNSHWRNHEYPVIGAQGHTALLDTPERWPRVDSFQHWMMAMDVQGYMPDDILVKVDRAAMANSLETRVPLIDHRVFELAWRMPLHMKIRNGKGKWLLREVLYRHVSRELIERPKKGFSVPVSDWLRGPLKEWAESLLDERRLQQEGYLDSRLIRRIWNDHLAGRRDHSRRLWSVLMFQAWLES

SEQ ID NO: 61969 - protein, 350 aa, Arabidopsis thaliana
MGSSGGYRKGVTEAKLKVAINGFGRIGRNFLRCWHGRKDSPLDIIAINDTGGVKQASHLLKYDSTLGIFDADVKPSGETAISVDGKIIQVVSNRNPSLLPWKELGIDIVIEGTGVFVDREGAGKHMEAGAKKVIITAPGKGDIPTYVVGVNADAYSHDEPIISNASCTTNCLAPFVKVLDQKFGIIKGTMTTTHSYTGDQRLLDASHRDLRRARAAALNIVPTSTGAAKAVALVLPNLKGKLNGIALRVPTPNVSVVDLVVQVSKKTFAEEVNAAFRDSAEKELKGILDVCDEPLVSVDFRCSDFSTTIDSSLTMVMGDDMVKVIAWYDNEWGYSQRVVDLADIVANNWK

SEQ ID NO: 61970 - protein, 341 aa, Xanthomonas campestris pv. vesicatoria str. 85-10
MKTPLALIATTLLAASVGTAVAAAPSDQPAPLRPVADFLKALNSGGGTPIEQLSPAQARQVLTNAQANTPLPAADVSRKTIQANGKLLNLVIVRPPHSTGQVLPAFMFFHGGGWVLGDFPTHERLIRDLVNASGAAAVYVDYTPSPEAHYPVAIHQAYAATRWVAEHGMEIGVDGQRLALAGNSVGGNMVAAVALQAKAAGTPALRYNLMLWPVTDAAFDNDSYQRYQSGYFLSRNMMTWFWDNYTTDPKARAEITASPLRATAAQLEGLPPTQIQTAELDVLRDEGEAFGRTLDQAGVEVTVTRYNGLIHDYGLLNALRDVPAVRDAIRQAGDGLREHLK

SEQ ID NO: 61971 - protein, 203 aa, Aspergillus niger
RKASSVESESVQSELPANFGEVVKGIYRSSFPYPWNLTALKKLGLKTIITLVDEPYPPSHVMFVKENGIAHHRILVQANKDPAVKIPDSVMCRILELLLDKSNHPILVHCNKGKHRTGCVVACFRKLQAWDSCDVIEEYLRYAFPKPRLLDENYIDGFDPSKLHQLAQSSGVKTWQPSGLFKMPSGEQDRDKELTNCHVPPSL

SEQ ID NO: 61972 - protein, 396 aa, Arabidopsis thaliana
MASVTFSVPKGFTEFSGLRSSSASLPFGKKLSSDEFVSIVSFQTSAMGSSGGYRKGVTEAKLKVAINGFGRIGRNFLRCWHGRKDSPLDIIAINDTGGVKQASHLLKYDSTLGIFDADVKPSGETAISVDGKIIQVVSNRNPSLLPWKELGIDIVIEGTGVFVDREGAGKHMEAGAKKVIITAPGKGDIPTYVVGVNADAYSHDEPIISNASCTTNCLAPFVKVLDQKFGIIKGTMTTTHSYTGDQRLLDASHRDLRRARAAALNIVPTSTGAAKAVALVLPNLKGKLNGIALRVPTPNVSVVDLVVQVSKKTFAEEVNAAFRDSAEKELKGILDVCDEPLVSVDFRCSDFSTTIDSSLTMVMGDDMVKVIAWYDNEWGYSQRVVDLADIVANNWK

SEQ ID NO: 61973 - protein, 302 aa, Gibberella fujikuroi
MPYVSAARYGKDNVRVCKVDRDASTGIQTVTEMTVCCLLEGEIETSYTKADNSVVVATDSIKNTIYITAKQNPVNPPELYASILGSHFIEKYSHIHVANINVKTVRWQRLEVDGKPHPHSFFKDGEETRNVEVRVSRQEGIQIKSSLVGLTVLKSTGSAFHGFVRDEYTTLPETWDRIFSTDVDATWKWKKFDSLNAVKAFAPKFDSAREAARNTTLKIFAEDDSASVQATMYKMSTQILGLVPEIATVTYALPNKHYFEIDLSWHKGLKNTGKDAEVYAPQSGPNGLIKCEVSRDNLQSKL

SEQ ID NO: 61974 - protein, 499 aa, Saccharomyces cerevisiae
MLRIRSLLNNKRAFSSTVRTLTINKSHDVVIIGGGPAGYVAAIKAAQLGFNTACVEKRGKLGGTCLNVGCIPSKALLNNSHLFHQMHTEAQKRGIDVNGDIKINVANFQKAKDDAVKQLTGGIELLFKKNKVTYYKGNGSFEDETKIRVTPVDGLEGTVKEDHILDVKNIIVATGSEVTPFPGIEIDEEKIVSSTGALSLKEIPKRLTIIGGGIIGLEMGSVYSRLGSKVTVVEFQPQIGASMDGEVAKATQKFLKKQGLDFKLSTKVISAKRNDDKNVVEIVVEDTKTNKQENLEAEVLLVAVGRRPYIAGLGAEKIGLEVDKRGRLVIDDQFNSKFPHIKVVGDVTFGPMLAHKAEEEGIAAVEMLKTGHGHVNYNNIPSVMYSHPEVAWVGKTEEQLKEAGIDYKIGKFPFAANSRAKTNQDTEGFVKILIDSKTERILGAHIIGPNAGEMIAEAGLALEYGASAEDVARVCHAHPTLSEAFKEANMAAYDKAIHC

SEQ ID NO: 61975 - protein, 338 aa, Arabidopsis thaliana
MADKKIRIGINGFGRIGRLVARVVLQRDDVELVAVNDPFITTEYMTYMFKYDSVHGQWKHNELKIKDEKTLLFGEKPVTVFGIRNPEDIPWAEAGADYVVESTGVFTDKDKAAAHLKGGAKKVVISEPSKDAPMFVVGVNEHEYKSDLDIVSNASCTTNCLAPLAKVINDRFGIVEGLMTTVHSITATQKTVDGPSMKDWRGGRAASFNIIPSSTGAAKAVGKVLPALNGKLTGMSFRVPTVDVSVVDLTVRLEKAATYEEIKKAIKEESEGKLKGILGYTEDDVVSTDFVGDNRSSIFDAKAGIALSDKFVKLVSWYDNEWGYSSRVVDLIVHMSKA

SEQ ID NO: 61976 - protein, 384 aa, Legionella pneumophila subsp. pneumophila str. Philadelphia 1
MMFGFLNMTLWGYLLAGFVLTHITTTAVTIYLHRYQTHRALTLHPLVSHFFRFWLWLTTGMTTAEWVAIHRKHHANTDMEGDPHSPQVFTLKKVFWQVPELYREASKDKDMIKKYSSGTPNDWIERKLYSPHANKGIFLMLTLNLFLFGIPGLTLWAIQMMWIPLVAGVVNGIGHYWGYRNHESSDSSTNVFPWGLLIAGEELHNNHHTFASSAKFSIKWWEFDLGWFYIRCLSFLKLAKVKKLPPKLIIDKNKSHIDVDSVKAILGNRFQVISDYYKLVIFPTLRDMQYRIKNRDLKNARHLFKKPNEQLSHADQLRLKTLLKQHDNLQAVHNYRELLQQIWLKTSLSNKDLLNLIQKWCSQAEESGLHVLRQFASQLKSYSL

SEQ ID NO: 61977 - protein, 511 aa, Saccharomyces cerevisiae
MAFQQGVLSRCSGVFRHHVGHSRHINNILYRHAIAFASIAPRIPKSSFHTSAIRNNEAFKDPYDTLGLKKSATGAEIKKAYYKLAKKYHPDINKEPDAEKKFHDLQNAYEILSDETKRQQYDQFGPAAFGGGGAAGGAGGGSGSPFGSQFHDFSGFTSAGGSPFGGINFEDLFGAAFGGGGRGSGGASRSSSMFRQYRGDPIEIVHKVSFKDAVFGSKNVQLRFSALDPCSTCSGTGMKPNTHKVSCSTCHGTGTTVHIRGGFQMMSTCPTCNGEGTMKRPQDNCTKCHGEGVQVNRAKTITVDLPHGLQDGDVVRIPGQGSYPDIAVEADLKDSVKLSRGDILVRIRVDKDPNFSIKNKYDIWYDKEIPITTAALGGTVTIPTVEGQKIRIKVAPGTQYNQVISIPNMGVPKTSTIRGDMKVQYKIVVKKPQSLAEKCLWEALADVTNDDMAKKTMQPGTAAGTAINEEILKKQKQEEEKHAKKDDDNTLKRLENFITNTFRKIKGDKKN

SEQ ID NO: 61978 - protein, 230 aa, Arabidopsis thaliana
  misc_feature (108)..(108): Xaa can be any naturally occurring amino acid
  misc_feature (115)..(115): Xaa can be any naturally occurring amino acid
  misc_feature (122)..(122): Xaa can be any naturally occurring amino acid
  misc_feature (162)..(162): Xaa can be any naturally occurring amino acid
  misc_feature (172)..(172): Xaa can be any naturally occurring amino acid
  misc_feature (177)..(177): Xaa can be any naturally occurring amino acid
  misc_feature (185)..(185): Xaa can be any naturally occurring amino acid
MASSMLSSATMVASPAQATMVAPFNGLKSSAAFPATRKANNDITSITSNGGRVNCMQVWPPIGKKKFETLSYLPDLTDSELAKEVDYLIRNKWIPCVEFELEHGFVYXREHGNSXPGYYDGXRYWTNVGSFPLFGLHPTSGQSVEREVGRGSKKGYPNAFIXIIGFHNTRQXVQCIXFNWLKPPXLHRLISLWLWPQNFYSPFFGFYPLVFWFFPLSWVLISLNGWFSGL

SEQ ID NO: 61979 - protein, 92 aa, Legionella pneumophila subsp. pneumophila str. Philadelphia 1
MMKQKKIYVGNLPFGTTEEALSIQFSQYGKIEEMFLIKDRLTGQMKGFGFITFSAQQEAESALEMNGQPFDGRSLKVCMAQKKTNSVSRSRW

SEQ ID NO: 61980 - protein, 959 aa, Rhizobium leguminosarum bv. viciae 3841
MSLIHEIDYGTPASKSEAMVTLTIDGQQISVPEGTSIMRASMEAGIKVPKLCATDMVDAFGSCRLCLVEIEGRNGTPSSCTTPVAANMVVHTQTGRLKDIRRGVMELYISDHPLDCLTCAANGDCELQDMAGAVGLRDVRYGYEGDNHVKARSNGDINLKWMPKDESNPYFTYDPSKCIVCSRCVRACEEVQGTFALTIEGRGFGSRVSPGMHEHFIDSECVSCGACVQACPTATLTEKSVIQIGQPEHSAVTTCAYCGVGCSFKAEMRGEELVRMVPWKDGQANRGHSCVKGRFAYGYSTHKDRILNPMIREKVSDPWREVSWDEAFAHVATEFRRIQYQYGREAIGGITSSRCTNEETYLVQKLIRAGFGNNNVDTCARVCHSPTGYGLGQTFGTSAGTQDFDSVEHSDVVIVIGANPTDGHPVFGSRLKKRLRQGAKLIVIDPRRTDIVRSPHIEASYHLPLKPGTNVAVMTALAHVIVTEGLFDETFIRERCDWSEFEDWAAFVAEPQHSPEETEIFTGVPAADLRGAARLYAKGGNGAIYYGLGVTEHSQGSTTVIAIANLAMATGNIGRPGVGVNPLRGQNNVQGSCDMGSFPHELPGYRHISDDATRDIFEKLWGVKLNNEPGLRIPNMLDAAVDGSFKGIYIQGEDILQSDPDTKHVAAGLAAMECVVVHDLFLNETANYAHVFLPGSTFLEKDGTFTNAERRINRVRKVMSPRNGYGDWEVTQKLAQAMGLDWNYSHPSEIMDEIAATTPSFAMVSYDYLEKMGSVQWPCNEKNPLGSPIMHVNGFVRGKGKFIRTEYVATDERTSPRFPLLLTTGRILSQYNVGAQTRRTENVVWHAEDRLEIHPHDAEQRGVRDGDWVKLGSRSGDTTLRALITDRVAPGVVYTTFHHPTTQANVITTDFSDWATNCPEYKVTAVQISPSNGPSEWQLEYDEQARQSRRIAGKLEAAE

SEQ ID NO: 61981 - protein, 297 aa, Triticum aestivum
  misc_feature (136)..(136): Xaa can be any naturally occurring amino acid
  misc_feature (162)..(162): Xaa can be any naturally occurring amino acid
  misc_feature (180)..(180): Xaa can be any naturally occurring amino acid
PRARARRRWSSTCWVALALSFVGGLSTSLGALLVIVNPSPDLKRLGLLQGFAAGLMLSISFLDLAHNALNSIGFLKANLWFFAGVLFFGFVVKFIPEPTFVPTTDASKKKTDDDGSGKDMMKKHRRQVLFSGIITXAVGISLHNFPEGMAVFLGSVKGSSRXGVNFGFSLLALHNIPEGXVAVALPLYFATKSVSFFLAYKSKWQAFKYATLSGLAEPLGVFFVAVLFPSNLNPEILEGLLASVGGVMAFLTLHELLPLAFDYAGQKQAVKAVFVGMAVMSASLYFLEISLPKEISL

SEQ ID NO: 61982 - protein, 223 aa, Pseudomonas syringae pv. syringae B728a
MTQDQLKQAVAQAAVDFILPKLDDKSIVGVGTGSTANCFIDALAKHKAAFDGAVASSQATAARLKAHGIPVYELNTVSDLEFYVDGADESDEHLNLIKGGGAALTREKIVAAVANTFICIADGSKLVPVLGAFPLPVEVIPMARSHVARQLVKLGGDPVYREGVLTDNGNIIIDVHNMSITNPVELEAQINAIVGVVTNGLFAARPADLLLLGTAEGVKTLTR

SEQ ID NO: 61983 - protein, 511 aa, Streptomyces coelicolor A3(2)
MHNPGNATPDRFPAQDRFADGAQYIAGRLTKGTSGRTHTVVDPATGEDVLTYDLAGPDDVDAAVAAARAAFPGWAGATPGERSDALHRFAAVLAERAEDFARAESLQCGKPLKLTREFDVPGTVDNAAFFAGAARHLQGQSAGEYSGDHTSYVRREPIGVVGSIAPWNYPLQMAAWKILPAIAAGNTIVLKPAEITPLTSLMFAQAATEAGIPDGVINVVSGTGREAGEHLVAHPDVAMTSFTGSTAVGKRVAEVATATVKRLHLELGGKAPFLVFDDADLDAAVHGAVAGSLINTGQDCTAATRAYVQRPLYEAFVEKTAALMDTVRVGDPFAPGTDLGPLVSHVQRDRVAAFVDRARSYARVVTGGEVPQGDLKDGAYYRPTLVADAAQDSEVVQSEIFGPVLVVLPFDTDDEGIRLANDTPYGLAASAWSRDVYRANRATREIKAGCVWINDHIPIISEMPHGGYKASGFGKDMSAYSFEEYTQVKHVMFDNTAVAAKDWHRTVFGDR

SEQ ID NO: 61984 - protein, 580 aa, Deinococcus radiodurans R1
MPPGEDPMSHKTLPLTDHYDVKRGEDGHRYLRPLVRGFNLTRIPLLNKGTAFTAEEREAHGLDGLLAPQVDSLEVLIERAYREFSKRGAALEKHVYLRNLQDRNEVLFYALLSHHVEEMLPIVYTPTVGDAVKKFSQIYRYPRGLTLSTRTIERAEQALANVPLNDVRIIVATDSSAILGIGDQGFGGMAISIGKLSLYTVAGGVGPDKTLPVELDVGTGRADLREDPHYLGVKHERLTGEEYFAFIDKFVEATIQRYPKAIIQWEDFSKDAAFEVLARYRKVVPSFNDDIQGTGAVVLAGVLNACRIKGEALKDQVVVVHGAGAGGAGVAAAIREGMHREGLSPDEIARRVFVLDSRGLLTDDRSMEAYKQALATPRALVSGWSGTDLLGVVREAKATVLLGLSGVPGTFDEDIVKAALANTPRPLVFPLSNPTAHSEALPEDILRWTDGAAIVATGSPFAPVEHGGQTHEIGQGNNAFIFPGLGFGAILARVREITDEMVTEAAYALADYTQAHHPGRTYPPVNELSQASVQVAVAVIKQAIKDGVATEFSVRRLSDGELRAFVERKFWEPKFLPYHS

SEQ ID NO: 61985 - protein, 145 aa, Brassica napus
MASLATIAAVQPSATVKGLGGSSLAGAKLFIKPSRQSFKPKSTRAGAVVAKYGDKSVYFDLEDLGNTTGQWDLYGSDAPSPYNPLQSKFFETFAAPFTKRGLLLKFLILGGGSLLTYVSASSTGDVLPIKRGPQEKPKLGPRGKL

SEQ ID NO: 61986 - protein, 478 aa, Aspergillus niger
EIRLEDEVYNYLMFWMAQHPSTKRSTQFVASTKISSGARYYDSDDEGDLGDEDEYDENGNVVSDFDDYWAKTVARDKFKRLRFTPAEGSHYFWFRGRLLTFTRAKEENNNTISYMRYVPERLFISCFGRDPTILKELLAEAQRAWVARDGNSTVIYRGQKNGGYTDWVRCMARHPRPLSTVVLDPAQKQSFIKDIKEYLHPRTRRWYSNRGIPYRRGYLLHGPPGTGKTSLCFAASGLLGLPLYLLEPFNLPKGSSWDEDDLMSLFQDLPRRCIVLLEDIDCAGMTSKRAANSTQDDKNKSDPNNANTNPAAAPNTATNTPAGSSTDKKPSEETTDNKGITLSGLLNVIDGVAASEGRILIMTTNHPEKLDAALLRPGRVDMTITFGYAHSQDIRELFSSIYSTLEGDLRSVSPNRRKDAITSHDGKANGVKKTTIGDGMEERPPVSDKIVRLAKDFAAGIPAGEFTAAEVQGYLVEL

SEQ ID NO: 61987 - protein, 546 aa, Saccharomyces cerevisiae
MVSSSVSILGTSAKASTSLSRKDEIKLTPETREASLDIPYKPIIAYWTVMGLCLMIAFGGFIFGWDTGTISGFINQTDFKRRFGELQRDGSFQLSDVRTGLIVGIFNIGCALGGLTLGRLGDIYGRKIGLMCVILVYVVGIVIQIASSDKWYQYFIGRIVSGMGVGGVAVLSPTLISEISPKHLRGTCVSFYQLMITLGIFLGYCTNYGTKKYSNSIQWRVPLGLCFAWAIFMVIGMVMVPESPRYLVEKGKYEEARRSLAKSNKVTVTDPGVVFEFDTIVANMELERAVGNASWHELFSNKGAILPRVIMGIVIQSLQQLTGCNYFFYYGTTIFNAVGMQDSFETSIVLGAVNFASTFVALYIVDKFGRRKCLLWGSASMAICFVIFATVGVTRLWPQGKDQPSSQSAGNVMIVFTCFFIFSFAITWAPIAYVIVAETYPLRVKNRAMAIAVGANWMWGFLIGFFTPFITRSIGFSYGYVFMGCLIFSYFYVFFFVCETKGLTLEEVNEMYEERIKPWKSGGWIPSSRRTPQPTSSTPLVIVDSK

SEQ ID NO: 61988 - protein, 481 aa, Burkholderia sp. 383
MANVTYTDTQLLIDGEWVDAASGKTIDVVNPATGKPIGKVAHAGIADLDRALAAAQRGFDAWRKVPAHERAATMRKAAALVRERADAIAQLMTQEQGKPLTEARVEVLSAADIIEWFADEGRRVYGRIVPPRNLGAQQTVVKEPVGPVAAFTPWNFPVNQVVRKLSAALATGCSFLVKAPEETPASPAALLRAFVDAGVPAGVIGLVYGDPAEISSYLIPHPVIRKVTFTGSTPVGKQLAAMAGLHMKRATMELGGHAPVIVAEDADVALAVKAAGGAKFRNAGQVCISPTRFLVHNSIRDEFTRALVKHAEGLKVGNGLEEGTALGALANPRRLTAMASVVDNARKVGARIETGGERIGTEGNFFAPTVIADVPLEADVFNNEPFGPVAAIRGFDKLDDAIAEANRLPFGLAGYAFTRSFANVHLLTQRLEVGMLWINQPATPWPEMPFGGVKDSGYGSEGGPEALEPYLVTKSVTVMAV

SEQ ID NO: 61989 - protein, 381 aa, Methanothermobacter thermautotrophicus str. Delta H
MLTMDGKEEIIETEIAMGPVHSAAIEPYRVRLFVEDEIVRDAEITVGVNHRGIERIMEGLPVEKANSLTEKVCGICSGVHLWNSVLVAEKGLGVEIPERASYIRIIIGELERLHSHLLYLAHGNEVLGHETFSMRLFYIRETVMELLRLIGGNRVQYGVPIIGGIRPRADLDEMKVQRIREGIDLIEEKVEAFAERFTSDPMIMSRITGVCPISRKDALRLHVTGPTLRATGVDLDIRREMPCYDPFEFEVITQDEGDVRANLLMRVLEIFESVKIIRQALRDLPGGKVVDRSWEMQDTGIIKSYVEAPRGRLYHSYAIEDGRVRGSVIRTPSMSNIGAMQYACIGHHITDAQLGIVQCDPCFTCTDRAIEIVDLSDNPRR

SEQ ID NO: 61990 - protein, 356 aa, Triticum aestivum
  misc_feature (179)..(179): Xaa can be any naturally occurring amino acid
  misc_feature (324)..(324): Xaa can be any naturally occurring amino acid
  misc_feature (334)..(334): Xaa can be any naturally occurring amino acid
MSAYCGKYKDELIQNAAYIGTPGKGILAADESTGTIGKRFASINVENVEDNRRALRELLFCTPGALQYLRGVILFEETLYQSTKGGKPFVDILKAGNVLPGIKVDKGTIELAGTNGETTTQGFDDLGKRCAKYYEAGARFAKWRAVLKIGATEPSQLSIDQNAQGLARYAIICQENGLXPIVEPEILGDGPHDIDRCAYVTEIVLAACYKALNDQHVLLEGTLLKPNMVTPGSDSKKVAPEVIAEYTVRTLQRTVPAAVPAIVFLSGGQSEEEATLNLNAMNKLQTKKPWNLSFSFGRALQQSTLKAWSGKTENEEKARAAFLXRCKANSEATXGTTRATHLAEGASESSRQGYKY

SEQ ID NO: 61991 - protein, 255 aa, Arabidopsis thaliana
MSTREENVYMAKLAEQAERYEEMVEFMEKVAKTVDVEELSVEERNLLSVAYKNVIGARRASWRIISSIEQKEESKGNEDHVAIIKDYRGEIESELSKICDGILNVLEAHLIPSASPAESKVFYLKMKGDYHRYLAEFKAGAERKEAAESTLVAYKSASDIATAELAPTHPIRLGLALNFSVFYYEILNSPDRACSLAKQAFDDAIAELDTLGEESYKDSTLIMQLLRDNLTLWTSDMTDEAGDEIKEASKPDGAE

SEQ ID NO: 61992 - protein, 352 aa, Burkholderia sp. 383
MPQSKTANRQIILNSRPVGAPTPGNFRTESGEVPTPGAGQVLLRTVWLSLDPYMRGRMSDAPSYAAPAELGQPMVGGTVSQVVSSNLPAFREGDLVVAGAGWQDYALSDGRDLIPLGRNFAHPSYALGVLGMPGFTAYTGLLKIGEPKAGETVVVAAASGAVGAVVGQIAKLKGCRVVGVAGGADKCAYVTDTLGFDACVDHRDPAFAAKLKEACPNGIDIYFENVGGAVFDAVWPLLNDHARVPVCGIIAHYNDAAYDDKAVSTGRDRVPALVGTILRKRIRMQGFIILDHYATGYATFMKDMSEWVAQGKVKTLEDVVPDLADAPEALIGLLAGKNFGKVVVRVGPDELA

SEQ ID NO: 61993 - protein, 215 aa, Saccharomyces cerevisiae
MSGLRTVSASSGNGKSYDSIMKILLIGDSGVGKSCLLVRFVEDKFNPSFITTIGIDFKIKTVDINGKKVKLQLWDTAGQERFRTITTAYYRGAMGIILVYDVTDERTFTNIKQWFKTVNEHANDEAQLLLVGNKSDMETRVVTADQGEALAKELGIPFIESSAKNDDNVNEIFFTLAKLIQEKIDSNKLVGVGNGKEGNISINSGSGNSSKSNCC

SEQ ID NO: 61994 - protein, 272 aa, Bacillus licheniformis ATCC 14580
MTLQEKIMQELNVKPSIEPKQEIEKRVGFLKSYLKKTGAKGFVLGISGGQDSTLAGRLAQLAVEELREEGIQAEFIAVRLPYGVQQDEDDAQLALKFIQPDKSFAFDIASTVGSFAAQYQSVTGEALADFHKGNVKARVRMITQYAIGGQNQLLVIGTDHAAEAVTGFFTKYGDGGADLLPLTGLTKRQGRSLLEELGAPERLYTKSPTADLLDEKPQQSDETELGLTYDNIDDYLEGKAVSSEVAEAIEKRYKASEHKRQVPASMFDDWWK

SEQ ID NO: 61995 - protein, 516 aa, Bacillus licheniformis ATCC 14580
MTTPYKHEPFTNFGIEENRKAFEKALETVNNEWLGQSYPLVIDGERYETENKIVSINPANKEEVVGTVSKATQDHAEKAIQAAAKAFETWRYTDPEERAAVLFRAVAKVRRKKHEFSALLVKEAGKPWNEADADTAEAIDFMEYYARQMIELAKGKPVNSREGERNQYVYTPTGVTVVIPPWNFLFAIMAGTTVAPIVTGNTVVLKPASAAPVIAAKFVEVLEESGLPKGVVNFVPGSGAEVGDYLVDHPKTSIITFTGSREVGTRIFERAAKVQPGQTHLKQVIAEMGGKDTVVVDEDCDIELAAQSIFTSAFGFAGQKCSAGSRAVVHEKVYDEVLKRVIEITESKKVGEPDSADVYMGPVIDQASFNKIMDYIEIGKEEGRLVSGGKGDDSKGYFIEPTIFADLDPKARLMQEEIFGPVVAFSKVSSFDEALEVANNTEYGLTGAVITKNRDHINRAKQEFHVGNLYFNRNCTGAIVGYHPFGGFKMSGTDSKAGGPDYLALHMQAKTISEMF

SEQ ID NO: 61996 - protein, 384 aa, Oryza sativa (japonica cultivar-group)
MAETKIEGPTIAVKLFVDKERSRVLFAESDKDFVDVLFGFLTLPLGTVVRLLGRQSQVGCLDELYKSVEDLSADYFHTKACKAMLMKPHNTAAEQCCLLKVKVDDTDQSAVYVCRDANCSANGDCGVTSVAGSVCKCGKVMEYIGEWPQDGGSTAAAGSDGGVFVKGCYKFIVTDDLHVAPASTSLMMSIFDKYGVRDPANLEQKILQLNAEKITCLLKRSLTSKQTLTGYYFDVPNPNDEANLYVLPESLYSEQDAEVDHKLNNMKIKVLQRKNNTSLLYAEVGEDFVDLLFGLLSIPLGSILKTYGKWSSNGCVDNIYMSIDGSAKGCMNPERQMLLVSPNVASFFGCSATNMLIQLGEAAPKQRNISGCFKCFKIAGFWPL

SEQ ID NO: 61997 - protein, 539 aa, Pseudomonas syringae pv. phaseolicola 1448A
MKLLAVRRLFRIQRVVIRYRLDDLLFALPLPWWMLAVRFVLPWRWLPRRKSELSRGVRFRLALQDLGPIFIKFGQLLSTRRDLLPEDIADELMLLQDRVPPFDQQVAINLIEEQLGARICDVFSRFDETPLASASVAQVHAACLKTGEEVVVKVVRPGLKPVIGQDLAWLFILARMAERVSADARLLHPVQVVMDYEKTIYDELDLLREAANSSQLRRNFEGSDLLYVPQVYWDWCRPKVLVMERIYGLQVTDMAGLADQRTDMKLLAERGVEIFFTQIFRDSFFHADMHPGNIFVSTVNPWSPKYIAIDCGIVGSLTPEDQDYLARNLFAFFKRDYRRVAQLHIDSGWVPAETKLNEFEAAIRTVCEPIFEKPLKDISFGQVLMRLFQTARRFNMEVQPQLVLLQKTLLNIEGLGRQLYPDLDLWSTAQPYLERWMRERVSPKTLFGNLQSQVEQLPHIAGMTRDLLERMSRPHASDPPRPWHERKDEPVLRLIGAALLVGGAIQGWVMSEAATQLLTLTAWPAAIMLIAGLYLIVRR

SEQ ID NO: 61998 - protein, 421 aa, Rhizobium leguminosarum bv. viciae
MTRRFTRRGGKMSKIIIVGGGECGARAAFALREQGFNGDITLIGAEPHLPYERPPLSKTGLASAAPPQYVAGPARYEEARITILTGVPVDTVDRQSKLVRLSDGRKFPYDQLLLATGARPRPFAGVSGDPGLGRICMLRNHGDAVAIHEALAPGKSLAVVGGGFIGLEIAATARKLGAEVLLIESSPRVLSRGVPAEIAKVVTERHRQEGVNILCGEQITSIATENDKVQILFANGTTRLADIVVVGIGVIPNVELAEAAGLLIDNGIAVDATLRTSDPDIFAAGDCCSFPLSHYRERRVRLEAWRNAQDQGMLVAANLLGRGLAIASVPWFWSDQYELTLQIAGLSDGAATTVRRDLDQGAFILFHLDGEDRLIAASGIGPGNAVARDIRLAEMLIAAKRRLDPEALASPKTNLKKLLAA

SEQ ID NO: 61999 - protein, 227 aa, Glycine max
MEAVCGSGSSVWVTSSLTRSPKITLPLFRASYQHLTAFPSQSLLFSYHPSRYANARTLRARTSSKPIFLPHLIASLEQVDQTYIMVKPDGVQRGLVGEIISRFEKKGFKLTGLKLFQCSKELAEEHYKDLKQKSFFPKLIDYITSGPVVCMAWEGVGVVASARKLIGATDPLQAEPGTIRGDLAVQTGRNVVHGSDSPENGKREIALWFKEGEVCDWTPVQSPWLRE

SEQ ID NO: 62000 - protein, 357 aa, Clostridium pasteurianum
MKEFKIAVIPGDGIGPDIVREAVKIMTKVGEKYDTKFNFVEVKAGGDAIDAYGEPLPKETIDVCKSSAAVLLGAVGGPKWDNLEGSKRPERALLGLRGALGLYANLRPAKVYNVLKSASPLKNEIIDEGVDLLVVRELIGGIYFGDRGTKEVNGVETAFDTEKYNVDEVKRIAHSAFKAAMKRRKKVTSVDKANVLDASRLWRKTVNEVSKEYPEVELSHLYVDNTAMQLVRKPSQFDVILTNNIFGDILSDEASMITGSIGMLASSSIREDSFGMYEPIHGSAPDIAGLDIANPLAQILSAAMLMEYSLDMSEAARDVEAAVEKVLNEGYRTADIYIEGTKKVGTSEMGNLVLERL

SEQ ID NO: 62001 - protein, 746 aa, Bradyrhizobium sp. BTAi1
MMGASFRIRLRLRRFTRRHHTLFTILRSAMIFMAGFGGAYGFIKASLSETSGYNPHAFAIGASFLFALACVGLATLSMRLRFMRKKMHKLALHNEVLADRNWELQEAEQRARSLFEQQGDLIVMRESDGTIIFVNDAYCRMAGLDRENLLGSQFSFDLLEQGDSALEPSGTRVHDQRIDSAIGPRWIAWREALVRSDAGHPAVQQCVGRDVTDRTETERALAEARDQANAANRAKSRFLAMASHEIRTPLNGILGMSGLLLETQLTPEQTTYAKAVRSSGEALMSLINELLDYSKIEAGKLALEAQPFALTALIEEITELLAPRAQGKQLEIAAYLDERLPTWVTGDAARLRQVLLNLAGNAIKFTSKGGVALIAEPGIWPNEISFQVRDTGIGIAADAQERIFREFEQADDSVARSFGGTGLGLAISDRIVKRMGGRIALQSQPGAGSTFEVSVPLPPALERGEQNSFRGPDLTGQSIMLIAPAGLQAELIERRLQNWGAQTCLVAETEIAAALLPERAWHAVLIDDAIGSEAARRLGEAAHHHTTRLIVLVTPTSRHELAPAAPFNGYLVKPLRAASLAARVSFDLDAGAAFAEHPIPTIAPSIAARAGTGLAILVAEDNDINALLMRSLLTKLGHHADIAVHGEAALDSWLAARAAGTPYDLILMDVQMPRLDGIAATRRIRAHEASEPGRRTPILALTANALVEDRYACFEAGMDGFLVKPIDRDKLDEALANLAAARQVAA

SEQ ID NO: 62002 - protein, 450 aa, Azoarcus sp. BH72
MPFQSSSDLLQRSLAAVWHPCTQMKHHETLPLVPIVRGEGAWLIDADGRRLLDGISSWWVNLFGHCNRRINAALREQLETLEHVMLAGFTHPPAVELAERLAALTGHRLGHAFYASDGASATEIALKMSVHYWRNRGEAGKNRFISLAGSYHGETAGALAVTDVALFRDAYAPLVRPGATVPTPDIRLAVAGESASSLARRAAQALEAHLAEHHAETAALIVEPLVQGASGMVMYDAEYLRQARALCDHYQVHLIADEIAVGCGRTGTFFAWEQVAADDAAGWPDFICLSKGISGGYLPLSLVLSSDDIYAAFYDDSSTRAFLHSHSYTGNPLACRAALATLDIFREDDVVAENRGRAERMRRQADERFANHPAVRHLRQQGMILAFDVDTGTLGAGEFARRFFAAALDHGLLLRPIGNTVYFMPPYVLGEDELRHLVDGAAAALERALR

SEQ ID NO: 62003 - protein, 312 aa, Thermus thermophilus HB27
MTDLEAPLRRFEEALSELVQSDVLFIRLIHQDLVTAGGKRIRPRLVFLASRALGGAPFELELALAVELLHSATLLHDDLIDDAETRRGKEAAFRKYGNAVSVLSGDFLLSRLLHVIAKTGRMELVERFAEVAKTLSEGEVLQFQVAALEDYSLENYERIITAKTAVLMALATEGPALLLGAESRVREALYRYGLLYGQAFQMRDDYLDLMGTPEVLGKPVGGDLREGKATLIPLLLMERYPEVREVLRRRAREAGDLERVRALARESGAAEEAVRRIRERAEAAAQALEALPPSPFREALRELALKEAERVR

SEQ ID NO: 62004 - protein, 322 aa, Solibacter usitatus Ellin6076
MASKQAERRQRAIQEQVARADKKRPKKESTQAMQAGGRPYPAPPFPRQHQPKPGSEKTLNPPPLYDVPFYLGSKKLADKVALITGGDSGIGRAVAILFAREGADIALAYLSEHQDAAITKERVEAEGKRCLLIAGDVRSQKFCEKAVARTVKEFGRLDVLVNNAAFQIHVSQFEDLTAKHFDETLKTNLYGYFFMAQAAVKKMKSGSAIINTGSVTGLLGSESLLDYSMTKGGIHAFTRSLASHLVPRGIRVNAVAPGPVWTPLNPSDKEAANVSKFGADTPMKRPAQPEEIAPAYVFLASPHCSSYITGEILPIIGGYSGG

SEQ ID NO: 62005 - protein, 330 aa, Oryza sativa
MPIASKLVYFQRRRPSPAPPEPEPEPPDPRRRPCRAGAGASAARRRKPVHLYGGQVTSWKNDRGDELLFVSSKATFKPPKAIRGGIPICFPQFGTHGILEKHGFARNRFWAIDDNPPPFPTSTAAKAFVDLILKTSEEDLKIWPHSFEFRLRVALGPGGDLALTSRIRNTNTDGRPFSFTFAYHTYFSVSDISEVRIEGLETLDYIDCLRGKERSTEQGDAIVFESEVDKIYLDAPAKIAIIDHEKKRTFVLRKDGLPDAVLWNPWDKRTKNMQDFGDEEYKHMLCVEPAAVEKPITLKPGEEWKGKMDLSAVPSSYCSGQLDPNKVLQG

SEQ ID NO: 62006 - protein, 88 aa, Brassica napus
  misc_feature (31)..(31): Xaa can be any naturally occurring amino acid
RIILIILKGSAYCRMLSTVMGSYTKIDQGLXAVLGAASLMAGSMRMTVSLSMIFRYLTKHPLLLPMTMFVLRNASTVGDSFKLSIYEI

SEQ ID NO: 62007 - protein, 576 aa, Lactobacillus plantarum WCFS1
MAEKVLKGIAASDGVAIAKAYMLVDPDLSFEKTTVSDTDAEVARLHDAFDASKAELKVIKDKAVENLGEEEAEVFEAHITILSDPEMLGQIEGKIKDDKVNAEEALKEVTDTFISMFEAMTDNAYMQERAGDIRDVTKRVLSHLLGVTLPSPALIDSEVIVVAHDLTPSDTAQLDRKYVKGFITDIGGRTSHSAIMSRTLEIPAVVGSESATTDIKEGDTVVLDGINGDALVAPTDAEVADYQQKAKDFVAQKAEWAKLKNEATVSKDGKHFELASNIGTPDDMDGVLDAGSEAIGLFRSEFLYMNSSELPDEDTQFEAYKKVVEGMNGKPVIVRTMDIGGDKELPYLPLPDEMNPFLGYRAIRISLDRDDIFRTQLRALLRASHYGQLRIMFPMIATLDEFRKAKAIFEEEKAKLVAAGTPVADDIKLGIMIEIPAAAILADQFAKEVDFFSIGTNDLIQYSFAADRGNEQVSYLYQPYNPSLLRLIKHVIDAAHANGRFTGMCGEVAGDQIAVPLLMGLGLDEFSMSSTSVLKTRSLMKKLDTKEMAKLADKALNECVTNEEVKELVEKNVFGK

SEQ ID NO: 62008 - protein, 395 aa, Nocardia farcinica IFM 10152
MKAVTWQGRRKIAVDEVPDPRIQQPTDAIVRITSTAVCGSDLHLYEVLGPYMTPGDVLGHEPMGIVEEVGAQVRDLKPGDRVVVPFQISCGHCAMCDTGLPTQCETTQVRSQGSGAALFGYSELYGQVPGGQAEYLRVPYADHTHITVPEGPDDQRFLYLSDVLPTAWQAVEYAAVPDGGSVTVLGLGPIGDMACRVAAHRGYRVIGVDRVPERLSRVAARGIEVIDFSAVDADLGDVIRDRTDGRGTDAVIDAVGMEAHGSPIGSVAHRSAALLPDVVARKVMDTAGVDRLAALHEAIDIVRRGGTISLVGVYGGMVDPLPMRVLFDKQIQLRMGQANVTRWAPEILPLLTDDDPLGVDTFATHRLPLSKAPAAYEMFQQKADGAVKIVLDPAA

SEQ ID NO: 62009 - protein, 197 aa, Bradyrhizobium sp. BTAi1
MRSATIKRKTKETDIEVAVNLDGTGVVNIATGIGFFDHMLDLLARHSRIDMTVKAVGDLHIDFHHTTEDVGIALGQAVRQALGDMAGITRYASIHMPMDETLTRVVIDVSGRPMLVFRTTFPRDKIGEFDTELVREWFNAFAMNAGITLHVETLYGENAHHIAESCFKGLARALRSALAIDPRNQGEVPSTKGQLGG

SEQ ID NO: 62010 - protein, 182 aa, Triticum aestivum
  misc_feature (81)..(81): Xaa can be any naturally occurring amino acid
  misc_feature (101)..(101): Xaa can be any naturally occurring amino acid
MAPAVMASSATTVAPFQGLKSTAGLPVSRRSGSAGLSSVSNGGRIRCMQVWPIEGIKKFETLSYLPPLSTEALLKQVDYLXIRSKWVPCLEFSKVGFVFRXEHNSSPGYYDGRYWDNVEAAYVRGATDATQVLNEVEEVKKEYPERYVRVIGFENMRKCMRNSCRHKLQGTGRLKSVQLIKL

SEQ ID NO: 62011 - protein, 117 aa, Zea mays
MASFAVATAPSLAAPAAKRRPAAGVTYVEGMNAYSGLKGLNKVTMLGVRKTADYSFAKVVASLSPAGRKRRGGAFGAQMNAAAEIFRIAATMSGLVLVGVAVGFVLLRVEAGVEEAE

SEQ ID NO: 62012 - protein, 368 aa, Mycobacterium smegmatis str. MC2 155
MNSGPLEFTVSANTNPATDAVRESILANPGFGKYYTDHMVSIDYTVDEGWHNAQVIPYGPIQLDPSAIVLHYGQEIFEGLKAYRWADGSIVSFRPEANAARLQSSARRLAIPELPEEVFIESLRQLIAVDEKWVPPAGGEESLYLRPFVIATEPGLGVRPSNEYRYLLIASPAGAYFKGGIKPVSVWLSHEYVRASPGGTGAAKFGGNYAASLLAQAQAAEMGCDQVVWLDAIERRYVEEMGGMNLFFVFGSGGSARLVTPELSGSLLPGITRDSLLQLATDAGFAVEERKIDVDEWQKKAGAGEITEVFACGTAAVITPVSHVKHHDGEFTIADGQPGEITMALRDTLTGIQRGTFADTHGWMARLN

SEQ ID NO: 62013 - protein, 256 aa, Streptococcus thermophilus CNRZ1066
MEDIMPKNVLIIGATSGIGEATARAFAREGANLILTGRRVERLEALKAEFEATYPNQKVWTFALDVTDMEMVKDVCQAILKSVGQVHVLVNNAGLALGLIAYQDYEEWDLLTMLDTNVKGLMMVTRQILPSMVATNEGHIINMGSKAGIYAYAGAAVYSATKAAVKTFSDGLRIDTIATDIKVTTIQPGIVETDFSQVRFHGDKDKAAKIYQGLEALQAQDIAEAVLYVTKQPRRVQISDMTIMANQQATGFTIHR

SEQ ID NO: 62014 - protein, 494 aa, Streptomyces coelicolor A3(2)
MSASETPAGEFPPEQEPGHVVVVGAGIAGLAAAHRLLEAGARVTVLEASGRVGGKLLPGEIAGVRVDLGAESMLARRPEAVGLARAAGLADRLQPPSTATASLWTRGALRPMPKGHVMGVPGTAAALSGVLSEEGLARIERDAELPRTEVGDDVAVGEYVAARLGREVVDRLVEPLLGGVYAGDAYRISLRSAVPQLFEAARTHTSLTEAVRALQGRTATSPPSGPVFMGIEGGIGTLPPAVADSVRARGGEIVTQAPVTELRRTASDGWRIVAGDRVLHAGAVVVAVPAGPAAELLRAEAPAAAAELSAVEYASMALVTLAYRRSEAAALPEGSGFLVPPVDGHTIKASTFASRKWGWIADEDPDLVVLRTSVGRYGDTEILGRDDAGLVAVSRHDLAEATGLTAAPVATRVTRWQDGLPQYPVGHHARVARVREHVAKLPGLAVCGAAYDGVGIPASIASAYAAADQIRGDLGGVEELTAHPVQSLHGGAGE

SEQ ID NO: 62015 - protein, 158 aa, Oryza sativa (japonica cultivar-group)
MVVGLINANPVVYEKKERRSRQAPETTDENAAEAIDQLEIFDHIRDIKDPEHPYSLEELNVVTEDSVEINDELSHVRVTFTPTVERCSMATVIGLCLRVKLMRSLPPRYKVDIRVAPGSHATETAVNKQLNDKERVAAALENPNLLDIVEECLSPTFA

SEQ ID NO: 62016 - protein, 478 aa, Bacillus licheniformis ATCC 14580
MIHQRLRPFPDHFLWGSASAAYQIEGAWNEDGKGLSVWDVFTKIPGKTFKGSNGDIAVDHYHRFKEDVALMAEMGLKAYRFSVSWPRIFPQGRGEANESGLRFYDDLINELLAHDIEPVLTLYHWDLPQALMDEYGGFESRRIIEDFNAYCVTLYKRYGGRVKYWVSLNEQNYNFNHGFITAMHPPGVKDRKRFYEANHIAFLANAKAIDSFRRYVPDGKIGPSFAYSPAYPLSSRPDDILAFENAEEFTNYWWLDMYCRGTYPDIPLKYLKEKGWAPTIEDGDMELLAKGKPDFVGVNYYQTITYEMNPLDGVSEGKMNTTGQKGSNQETGMPGLYKTKRNPHLETSNWDWAIDPIGLRIGLRRISSRYGLPLFITENGLGEFDKVENDGTIHDDYRIAYLRAHLEQCRQALNDGVDLIGYCSWSFTDLLSWLNGYQKRYGFVYINRDEENVKDLKRIKKDSFYWYQNVIQTNGEEL

SEQ ID NO: 62017 - protein, 454 aa, Pseudomonas syringae pv. syringae B728a
MSANNPQTLEWQALSSEHHLAPFSDYKQLKEKGPRIITRAEGVYLWDSEGNKILDGMSGLWCVAIGYGREELADAASKQMRELPYYNLFFQTAHPPVLELAKAISDIAPEGMNHVFFTGSGSEGNDTMLRMVRHYWALKGQPNKKTIISRVNGYHGSTVAGASLGGMTYMHEQGDLPIPGVVHIPQPYWFGEGGDMTPDEFGIWAAEQLEKKILELGVENVGAFIAEPIQGAGGVIVPPDSYWPKIKEILSRYDILFAADEVICGFGRTSEWFGSDFYGLRPDMMTIAKGLTSGYVPMGGLIVRDEIVAVLNEGGDFNHGFTYSGHPVAAAVALENIRILREEKIVERVRSETAPYLQKRLRELSDHPLVGEVRGVGLLGAIELVKDKTTRERYTDKGAGMICRTFCFDNGLIMRAVGDTMIIAPPLVISFAQIDELVEKARTCLDLTLAVLQG

SEQ ID NO: 62018 - protein, 178 aa, Triticum aestivum
  misc_feature (88)..(88): Xaa can be any naturally occurring amino acid
  misc_feature (100)..(100): Xaa can be any naturally occurring amino acid
  misc_feature (112)..(112): Xaa can be any naturally occurring amino acid
  misc_feature (134)..(135): Xaa can be any naturally occurring amino acid
  misc_feature (138)..(138): Xaa can be any naturally occurring amino acid
  misc_feature (142)..(142): Xaa can be any naturally occurring amino acid
  misc_feature (144)..(144): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSKWVPXCLEFSKVGLSSXSKNASPGYYDGXRYWTNVGSCLCSGCTDATQVIXXVEXVKKXYXDPYVRSSDSKHRVNAQILQRAARRKAKNYSHRHA

SEQ ID NO: 62019 - protein, 452 aa, Pseudomonas syringae pv. syringae B728a
MSTNLDQLTDWLKEHKITEVECMMSDLTGITRGKISPTNKFIAEKGMRLPESVLLQTVTGDYVEDDIYYELLDPADIDMICRPDQNAVYLVPWAVEPTAQVIHDTYDKQGNPIELSPRNVLKKVLKLYADQGWQPIVAPEMEFYLTKRSDDPDYPLQPPIGRSGRPETGRQSFSIEAANEFDPLFEDVYDWCELQNLDLDTLIHEDGTAQMEINFRHGDALSLADQILVFKRTMREAALKHDVAATFMAKPMTGEPGSAMHLHQSIIDIETGKNIFSNEDGTMSELFLNHVGGLQKFIPELLPLFAPNVNSFRRFLPDTSAPVNVEWGEENRTVGLRVPDAVPQNRRVENRLPGADANPYLAIAASLLCGFIGMVEGINPSAPVVGRGYERRNLRLPLTIEDALERMENSKTIEKYLGKKFIIGYVAVKRAEHENFKRVISSWEREFLLFAV

SEQ ID NO: 62020 - protein, 381 aa, Ludwigia peploides
NVLDKIKEFSERIRNGSWVGATGKQLTNVIAIGIGGSFLGPLFVHTALQTDREACECARGRQLRFLANVDPIDVARNIMGLNPETTLVVVVSKTFTTAETMLNARTLREWISSALGPSAVAKHMVAVSTNLPLVEKFGIDPKNAFAFWDWVGGRYSVCSAVGVLPLSLQYGFAIVEQFLLGARSIDQHFNSAPFEKNIPVLLGLLSVWNVSFLGYPARAILPYSQALEKFAPHIQQVSMESNGKGVSIDGLPLPFETGEIDFGEPGTNGQHSFYQLIHQGRVIPCDFIGVMKSQQPVYLKGEVVNNHDELMSNFFAQPDALAYGKTPEQLRKENVPEHLVPHKTFTGNRPSLSILLPSLNAYNVGQLLAIYEHRVAVQGFI

SEQ ID NO: 62021 - protein, 501 aa, Calylophus toumeyi
MASPALISETEAWKDLKAHVEGIKRTHLRELMGDAERCQSMMVEFDNIFLDYSRQQASPDTINKLYKLADAAHLKQKIDRMYNGDHINSTENRSVLHVALRAPRNSTICSDGKNVVPDVWNVLDKIKDFSERVRSGSWVGATGKVLKDVIAVGIGGSFLGPLFVHTALQTDPEASKNARVRELRFLANVDPIDAARNISGLDPETTLVVVVSKTFTTAETMLNARTLREWISSALGPSAVAKHMVAVSTNLPLVEKFGIDPNNAFAFWDWVGGRYSVCSAVGVLPLSLLYGFAVVEKFLQGAHNIDQHFSSAPFEKNIPVLLGLLSVWNVSFLGYPARAILPYSQALEKLAPHIQQVSMESNGKGVTIDGLPLPFESGEIDFGEPGTNGQHSFYQLIHQGRVIPCDFIGVVKSQQPVYLKGEVVNNHDELMSNFFAQPDALAYGKTPEQLKKENVSEHLIPHKTFIGNRPSLSILLPTLDAYRIGQLLAIYEHRVAVQGFV

SEQ ID NO: 62022 - protein, 597 aa, Zea mays
SPHLSEANPWVCVAESFLRVAAFVFPSSADPSPCGCQALLESKKTHGELGDFTTNRRSPLLLAIVEGERERERPRSVGFGFGRQLQLSATATMGLRVAATAPAPAGVRVLGRGAARVTPRPWAAVGGRRRFSVRMSVATTEATTTIAVGASEDQALEARNSKTVVAVILGGGAGTRLFPLTRRRAKPAVPIGGAYRLIDVPMSNCINSGINKVYILTQFNSQSLNRHLSRAYDFSNGVAIGDGFVEVLAATQRPGTEGKRWFQGTADAVRQFDWLFDDAKSKDIEDVLILSGDHLYRMDYMDFVQSHRQRGAGISICCLPIDGSRASDFGLMKIDDTGRVISFSEKPKGDELKAMQVDTTVLGLSKEEAENKPYIASMGIYIFKKDILLNLLRWRFPTANDFGSEIIPASAKEIDVKAYLFNDYWEDIGTIKSFFEANLALAEQPPRFSFYDADKPMYTSRRNLPPSMVNNSKITDSIISHGCFLDNCRIEHSVVGVRSRIGSNVHLKDTVMLGADYYETAVERGELLAEGKVPIGIGENTTIQKCIIDKNARIGKKVVISNSEGVDEADRTSEGFYIRSGITVVLKNAIIADGLVI

SEQ ID NO: 62023 - protein, 395 aa, Lactobacillus plantarum WCFS1
MTLFRDDLNETISHIQVSTIRQFDEEVSAIPDMVKLTLGEPDFNTPEHVKAAAKKAIDDNYSHYTGMAGLLELRQAAAHFQETKYGVHYDAEDQVLVTVGATEAIATALTTICNPGDAIIIPSPIFPAYIPIIQEAHAKPLFMDTGVNDFVITPKMVDDFIAAHPDENFKGIVLNYPNNPTGVTYVEDEIKALADCFHRHNLWVVSDEIYSELTYGSDHVSIAKFIPDEVILINGLSKSHAMTGWRIGFLFASKEMTAQLKKVHQYYVTAATTIAQKAGVEALTNGIDDAQPMRQEYQARRDFVYQTMSKLGFKIARPTGAFYIFAKIPAGFEQDSMAFCKDLARKNQLAIIPGTGFGAEGEGYVRLSYAASMEKLHQAMDRLTAYMQEPANCIN

SEQ ID NO: 62024 - protein, 491 aa, Gaura lindheimeri
WKDLKAHVEGVKRTHLRELMGDSERCQSMMVEFDNIFLDYSRQQASPDTINKLYKLADAAHLKQKIDRMYNGDHINSTENRSVLHVALRAPRNSAICSDGKNVVQDVWNVLDKIKDFSERVRNGSWVGATGKELKDVIAVGIGGSFLGPLFVHTALQTDPEASKNARGRELRFLANVDPIDAARNISGLDPETTLVVVVSKTFTTAETMLNARTLREWISSALGPSAVAKHMVAVSTNLPLVEKFGIDPNNAFAFWDWVGGRYSVCSAVGVLPLSLQYGFAVVEKFLQGAHNIDQHFSSAPFEKNIPVLLGLLSVWNVSFLGYPARAILPYSQALEKLAPHIQQVSMESNGKGVSIDGLPLPFQSGEIDFGEPGTNGQHSFYQLIHQGRVIPCDFIGVMKSQQPVYLKGEVVNNHDELMSNFFAQPDALAYGKTPEQLKKENVSEHLIPHKTFTGNRPSLSILLPTLDAYRIGQLLAIYEHRVAVQGFVWG

SEQ ID NO: 62025 - protein, 209 aa, Glycine max
VSCALTFDLERIGSRLGKASGLNESDAEDDDDDDDDVDDDVGVPPVIATKQKLLSKEEPIDNSPSKPTATGPARGTPSSKSSKGKRKLNEETKPSNTATPKKVKVENEPKVSTKDGNGSASKNSAPPKGTPPLSSKAGSSTTTSGPVSEEEIRAVLRQKTPVTTQDLVAKFKARLRCSEDKQAFAEILKRISKIQKTTSGASYVILRDK

SEQ ID NO: 62026 - protein, 519 aa, Methanothermobacter thermautotrophicus str. Delta H
MMRCGEGYPGLILAKEDFIMKPVDMAAADINAEYLGVPRLSLMENAGRAVAEEIGNAVDSGRVAIFCGPGGNGGDGFVAARHLLNMGFEVEVHLLGHPERIGSEEALVNWGVLGAMQPHPGGFSVDFVRDSSEIKPTDADVVVDAILGTGVRGSIREPSRSAIEIINRSEAFRVSVDIPSGLNPETGAVEDIAVSADLTVTFHRMKDGLKLADPAVTGEIVVRDIGIPPAAEIFMGPGDLLRIPSRRPGSHKGENGRVLIIGGSRQYSGAPAIAAKAALRAGADIVMVAAPGSAARAIRSLSPDLIVRELEGGYIGMESLDEILELAEKADSVLMGCGAGRETSTARTFMRAIEDLHEMEKPIVLDADALRLMDYSDVSEYRELTVTPHMAEFSSFFKLKSMIFNDFRESVSAFQSISSRIRGTVLLKGRIDMIFQGDRLRLNKTGCPGMTVGGTGDALAGLTAGLRALGLSSFDSASLAAFINGMAGELAMERHGNGFTASDMVDMIPSVMDPGFYGF

SEQ ID NO: 62027 - protein, 312 aa, Burkholderia sp. 383
MPLDPQAQALLAAFAQAPAIDFAQLTVPAYRASLADGGAFAPGDAVVAEEDWQIPASGRQLSARLYRPAVDGPLPLTVFFHGGGFVSCGIDTHANLCRSLAARARTLVLSVDYRLAPEARFPAAAHDACDAMRWAAASARDLGARAGALAVAGDSAGGNLAAVAALQLRGSGIAIAHQLLLYPVVDCATEHPSYETLGNGYFLTADMMRWFKRQYFDEGADRASPLASPLAAPDVAGAAPATIVSAEFDPLRDEAEAYALRLAQAGTPVTLVRWPGQLHGFASMLGAVDAADRVLTFGADALRRAFDATEAP

SEQ ID NO: 62028 - protein, 219 aa, Edwardsiella ictaluri
MTQDELKKAVGWAALKYVRPGTIVGVGTGSTASHFIDALATMKGQIEGAVSSSDASTARLKSLGIPVFDLNEVDSLDIYVDGADEINGAMQMIKGGGAALTREKIVAAVAKKFVCIVDASKQVDILGSFPLPVEVIPMARAYVARELVKLGGQPVYRQGVLTDNGNVILDVHNLQIMEPCKLENAINAIAGVVTVGLFANRGADVALVGCADGVKTLTL

SEQ ID NO: 62029 - protein, 194 aa, Triticum aestivum
  misc_feature (2)..(2): Xaa can be any naturally occurring amino acid
  misc_feature (13)..(13): Xaa can be any naturally occurring amino acid
  misc_feature (21)..(21): Xaa can be any naturally occurring amino acid
  misc_feature (36)..(36): Xaa can be any naturally occurring amino acid
  misc_feature (43)..(43): Xaa can be any naturally occurring amino acid
  misc_feature (46)..(46): Xaa can be any naturally occurring amino acid
  misc_feature (57)..(58): Xaa can be any naturally occurring amino acid
  misc_feature (60)..(60): Xaa can be any naturally occurring amino acid
  misc_feature (78)..(78): Xaa can be any naturally occurring amino acid
  misc_feature (84)..(84): Xaa can be any naturally occurring amino acid
  misc_feature (87)..(87): Xaa can be any naturally occurring amino acid
  misc_feature (95)..(95): Xaa can be any naturally occurring amino acid
  misc_feature (97)..(97): Xaa can be any naturally occurring amino acid
  misc_feature (99)..(99): Xaa can be any naturally occurring amino acid
  misc_feature (101)..(101): Xaa can be any naturally occurring amino acid
  misc_feature (109)..(110): Xaa can be any naturally occurring amino acid
  misc_feature (119)..(119): Xaa can be any naturally occurring amino acid
  misc_feature (126)..(127): Xaa can be any naturally occurring amino acid
  misc_feature (133)..(134): Xaa can be any naturally occurring amino acid
  misc_feature (137)..(137): Xaa can be any naturally occurring amino acid
  misc_feature (140)..(140): Xaa can be any naturally occurring amino acid
  misc_feature (143)..(143): Xaa can be any naturally occurring amino acid
  misc_feature (150)..(150): Xaa can be any naturally occurring amino acid
  misc_feature (160)..(161): Xaa can be any naturally occurring amino acid
MXGLYEKTSETYXKKRARYPXEWFSMLASLTAGQQXAWEAGCXSGXASVSIAEHYNXXVXTDVSEGQVRHAIAQPKVXYLHTRXTPXGRTLPLVXGXGXLXLVILGNAXXWFDVPLFYXVVKRVLXXTGGVLXXWGXKLXHQXFGDKLHXTLFPACGVIXXRQGMGQLRSFPPVAQSRSIRGITGDRFIRSHKR

SEQ ID NO: 62030 - protein, 160 aa, Triticum aestivum
SIVRRDVQENDEEAVRVKEQSILELGTLLAKTGQAAELGGLLKFVRPFLISISKAKAARLVRSLLDLFLDMEAATGQEVELCLECIEWAKAEKRTFLRQALEARLISLYFDTKRYQEALALGTQLLQELKKMDDKALLVEVQLLESKTYHALSNLPKARA

SEQ ID NO: 62031 - protein, 394 aa, Legionella pneumophila subsp. pneumophila str. Philadelphia 1
MHLKRTLSLTLLAFYGLGTILGAGIYALVGEVAKEAAQFTPLSFLIASIIALFTAISYAELSSRLPLSAGSALYVRRAFHQKWLSGLIGWIVVLTGVISAATLSHGFVKYFQLFLPLPPSLIITILTVILAGVAVWGIRESATLILYMTLMEVGGLLMIIYYGRYSFASIDIQSFSLPHSFDGVLIGAFIAFYAFIGFEDMVNTAEETINPEKTLPKAIFLALISATILYVAVAWVIVSTIPSNALVKTDMPLIEIIKLQGQSPLLFSIIALISITNGILVQIIMASRLIYGMANQQNAPQIFSFVYSKTQTPVNSTLLVSLIILLFAYALPITTLAKLTSSIILCIFIIIHASLIKIKLTKKKPTNAISFPIVFPMISILLTLAFLIIQFFLK

SEQ ID NO: 62032 - protein, 488 aa, Bacillus cereus ATCC 10987
MNSATNQATSKTETTKGKGELRRGLKSRHLTMISLGGTIGTGLFLASGGVIHSAGPGGALIAYAAIGIMVYFLMTSLAELAAYMPVTGSFSTYATKFVDPSLGFALGWNYWYNWAITIAAELAAVTLIMKFWFPNTPSLIWSGLCLAIIFLLNYLSVKGFGESEYWFALIKVVTIIIFLIVGFMMIFGIMGGETVGFKNFTVADAPFNGGIMAIIGVFMAAGFSFQGTELLGVAAGETSDPERNIPKAIRSIFWRILLFYILAILVIGLLIPYTTESLAASDVTVSPFTLIFEKAGVAFAASVMNAVILTAVLSAGNSGMYASTRMLWDLARQGKAPKFLGKLDSRGVPVNALIVTSIVGSIAFIASLFGDGVVYIWLLNASGMSGFIAWVGIAISHYRFRKAYIAQGKDLKDLPYKAKWFPFGPLFAFTLCIIVILGQNYGAFMGESIDWNGVLVSYIGLPLFLVLWLGYKFTKKTKVIPLDKCELK

SEQ ID NO: 62033 - protein, 311 aa, Streptomyces coelicolor A3(2)
MTRFVLGQNQYGKAENRVVKITRDGDTHHIKDLNVSVALSGDMEEVHRSGSNANVLPTDTTKNTVFAFAKEHGIESAEDLGVKLARHFVDNNEPIHRARIRIEEFGWERIETSKGGARFVGAEEIAHSFVRTGQETRVAEITYDGHGIQVLSGFKDLTVLNSTNSEFFGYLKDKYTTLKEDYDRILATTVSTWWRHNWDGVDSHAPDWDRSYHGVRKHALQAFAETYSYSLQQTLFEMGVRVLNSRDEVDEIRFSMPNKHHFRSDLSPFGIDNEAKDGAVYYAADRPYGLIEATILRDGAEQLIPVDMTNL

SEQ ID NO: 62034 - protein, 286 aa, Pseudomonas syringae pv. phaseolicola 1448A
MNEEYPKPPFASQPQEVPGLQGKMDPYPDCGEKSYKGSGHLQGKIAWITGADSGIGRAVAIAFAREGAQVAISYLNEHEDAEETKRWVEEAGRKCLLLPGDLAQKQQCEDIVSKTVAEFGRIDVLVNNAAFQMNHETLEEISDEEWVKTFDINITAMFRICKAAVPHMPRGGSIINTSSVNSDMPKPTLLAYATTKGAIANFTGGLAQLLGDKGIRVNSVAPGPIWTPLIPATMTDEDVKSFGSETPLGRPGQPVEVSPIYVLLASDEASYISGSRYAVTGGKPIL

SEQ ID NO: 62035 - protein, 371 aa, Epilobium canum
ERVRNGSWVGATGKELKDVIAVGIGGSFLGPLFVHTALQTDPEASKNARGRELRFLANVDPIDAARNLSGLNPETTLVVVVSKTFTTAETMLNARTVREWISSALGPSAVAKHMVAVSTNLQLVETFGIDPNNAFAFWDWVGGRYSVCSAVGVLPLSLQYGFAVVEKFLQGAHSIDQHFLSAPFEKNIPVLLGLLSVWNVSFLGYPARAILPYSQALEKLAPHIQQVSMESNGKSVSIDGLPLPFETGEIDFGEPGTNGQHSFYQLIHQGRVIPCDFIGVVKSQQPVYLKGEVVNNHDELMSNFFAQPDALAYGKTPEQLKKENVSEHLIPHKTFTGNRPSVSILLPTLDAYRVGQLLAIYEHRVAVQGFI

SEQ ID NO: 62036 - protein, 407 aa, Moorella thermoacetica ATCC 39073
MRYLIIGNSAAGVAAARAIRQADPAGEITMVGDEPYPFYARVLTSYYLGGLVPRDRLWLVDREWYRRQRIQLLTGRRATGLNTGACRVTLDDGTELAYDRLLIATGASPQRVDFPGAGLAGVFTLRTIDDAAAIGKFARPGGRAVVIGGGLVGLKAAEGLHARGLKVRLVVSSGRLLSQAMDDSGAELVRRAMAAAGFTIHLREDVVALEGRERVMAAVLRSGATVPVDVAVVGKGVRPNVDFLSGSGVVVNRGVVVDDYLSTGIPGVYAAGDVAEAYDRAWQKPRLNAIWGNAVEQGRLAGLNMAGHHTPYRGGIGQNSLVVHGLGVISGGIVNPPGEGYEVITRLDEKRSLYRKIVLQGRRLVGMVSVGPPNGAGSFQALIGREVKEKYIASFLDGSFTWAMVGR

SEQ ID NO: 62037 - protein, 371 aa, Epilobium canum
ERVRNGSWVGATGKQLKDVIAVGIGGSFLGPLFVHTALQTDPEASKNARGRKLRFLANVDPIDAARNISGLNPETTLVVVVSKTFTTAETMLNARTLREWISSALGPSAVAKHMVAVSTNLQLVEKFGIDPYNAFAFWDWVGGRYSVCSAVGVLPLSLQYGFAVVEKFLQGAHSIDQHFSSAPFEKNLPVLLGLLSVWNVSFFGYPARAILPYSQALEKLAPHIQQVSMESNGKGVSIDGLPLTFESGEIDFGEPGTNGQHSFYQLIHQGRVIPCDFIGVVKSQQPVYLKGEVVNNHDELMSNFFAQPDALAYGKTPEQLKKENVAEHLIPHKTFTGNRPSLSILLPTLDAYRIGQLLAIYEHRVAVQGFI

SEQ ID NO: 62038 - protein, 113 aa, Synechococcus sp. CC9311
MRFLLSVVFALVLVLSMPLRAMASDTVRGGQIFNTNCAACHAGGGNIVKSERTLRQDDLEAFLPNYLTGHETGIVAQVTYGRNAMPAFLDVLSENEIADVAAYVEDQASHGWS

SEQ ID NO: 62039 - protein, 371 aa, Epilobium brachycarpum
ERVRNGSWVGATGKELKDVIAVGIGGSFLGPLFVHTALQTDPEASKNAKGRELRFLANVDPIDAARNLSSLNPETTLVVVVSKTFTTAETMLNARTVREWISSALGPSAVAKHMVAVSTNLPLVEKFGIDPNNAFAFWDWVGGRYSVCSAVGVLPLSLQYGFSVVEKFLQGAHSIDQHFSSAPFEKNIPVLLGLLSVWNVSFLGYPARAILPYSQALEKLAPHIQQVSMESNGKGVSIDGLPLPFETGEIDFGEPGTNGQHSFYQLIHQGRVIPCDFIGVVKSQQPIYLKGEVVNNHDELMSNFFAQPDALAYGKTPEQLKKENVSEHLIPHKTFTGNRPSVSILLPTLDAYRVGQLLAIYEHRVAVQGFI

SEQ ID NO: 62040 - protein, 435 aa, Bordetella parapertussis 12822
MPGGRACARLQGFVALQSCGAPAARGLFPPLFLSPFRIPIMRKFSRIERLPPYVFNITGELKMAARRRGEDIIDMSMGNPDGATPQHIVDKLVEASTRPDTHGYSVSKGIPRLRKAICDWYMRRYAVEFDPDSEAIVTIGSKEGLAHLMLATLDRGDTVLVPNPSYPIHIYGAVIAGANIRSVRMTPGIDFFEELERAVRESIPKPKMMILGFPSNPTAQCVDLSFFERVVALAKEHDILVVHDLAYADVCFDGYVAPSIMQVPGARDVAVEFFTMSKSYNMAGWRIGYMVGNRELVGALARIKSYHDYGTFTPIQVASIAALDGPQDCVNEIVAQYQRRRDVLARGLHEAGWNVEIPKASMYIWAQIPEPYRAMGSLEFTKRVLSDAKVAVSPGIGFGEYGDEYVRFALIENEQRTRQAVRGIKDMFRKDGLLK

SEQ ID NO: 62041 - protein, 373 aa, Epilobium brachycarpum
ERVRNGSWVGATGKQLKDVIAVGIGGSFLGPLFVHTALQTDPEASKNASGRKLRFLANVDPIDAARNISGLNPETTLVVVVSKTFTTAETMLNARTLREWISSALGPSAVAKHMVAVSTNLQLVEKFGIDPYNAFAFWDWVGGRYSVCSAVGVLPLSLQYGFAVVEKFLQGAHSIDQHFSSAPFEKNLPVLLGLLSVWNVSFFGYPARAILPYSQALEKLAPHIQQVSMESNGKGVSIDGLPLPFESGEIDFGEPGTNGQHSFYQLIHQGRVIPCDFIGVVKSQQPIYLKGEVVNNHDELMSNFFAQPDALAYGKTPEQLKKENVAEHLIPHKTFTGNRPSLSILLPTLDAYRIGQLLAIYEHRVAVQGFIWG

SEQ ID NO: 62042 - protein, 441 aa, Lactobacillus plantarum WCFS1
MQSHRHQSLEEINQSVAVPDVHQTAFWRKFLAYSGPGALVAVGYMDPGNWLTSLAGGGQFQYRLLAVLALAIIVAMFMQGLAIRLGVVARQDLAQAIASKLPRPVRYAAWILNEVAMMATDMTGVIGTAIALKMLFGLPLLAGILLTIADVLVVLLFLRFGIRRVEVIVLVAILTVGIIFGIEVGRAHVQFGNVLLGLVPTPLIVKNHTALVLSLGILGATIMPHNLYLHSSLAQSRRYDYHNPAQVTEALRFANWDSTVHLIAAFLINALLLVLGGTLFFGHTNALASLQAVFDGLKSTTVVGALASPVMSWLFALALLITGLISSITSTLAGQIVMEGYLHIRLPLWQRRLLTRAVTLIPILIIGMLVGFSDAAFENLIIYAQVALSIALPFTLLPLVALTNDASLMKAHVNRPAVTWVGYGLAGIITVLNIYLVYSLF

SEQ ID NO: 62043 - protein, 166 aa, Megacorax gracielanus
SAILPYSQALEKLAPHIQQVSMESNGKGVSIDGLPLPFETGEIDFGEPGTNGQHSFYQLIHQGRVIPCDFIGVVKSQQPVYLKGEVVNNHDELMSNFFAQPDALAYGKTPEQLKKENVSEHLIPHKTFTGNRPSLSILLPTLDAYRIGQLLAIYEHRVAVQGFIWG

SEQ ID NO: 62044 - protein, 460 aa, Lactobacillus plantarum WCFS1
MSKQTHLSRQMESRHVLMISLGGVIGTGLFLSSGYTIHQAGPIGTLLAYTIGAILVYLVMLCLGELSVAMPYTGAFHVYAKKYIGPGTGFTVAILYWLTWTIALGSEFTAAGLIMQTWFPHIATWIWSLVFMVVIFTVNALSVRWFAETEFWFASIKVIAIIAFIVLGGLAMVGILPLHGHTSAPFLSNYTRNGWFPNGFGGVFTTMLTVNFAFSGTELIGITAGETKDPAHTIPTAIKTTLWRLIIFFIGSMFVMAALIPYKQAGVTQSPFVLVFKAIGIPYAADLMNFVVLTAIMSAANSGLYASTRMLWSLANEGTIPKVFKRTTKRDVPLVALITSMLGGILALLSSVYAAGSVYLVLVSISGLAVVIVWMAIALSEINFRKAYLKSGQSLDQLTFKTPGYPVVPWLAFILSGLSCILIWFDPNQRIALYYTIPFVAICYLGYYLNQRYRRTHAAK

SEQ ID NO: 62045 - protein, 420 aa, Pyrococcus furiosus DSM 3638
MKAIILAAGKGERLRPLTDDRPKVVLKIANKPIISYVLENLDPFVDEFIIVVKYMKEKVIDLLGDEFRGKPITYVEQGEEEGTAAAVYSVKEFIESNEEFFVVNGDLYFEPDAVKGLLHVFKKEKGDAGIVVKEFENLSQYGMVEVENGKVKGIIEKPGNVKGYANLGIYIFKSDVFDYIENTEISERGEYEITDTINLMIKDGKSVVYYNYEGFWSDIGRPWDLLEVNEYILKTKLKHEIRGVVEEGATIIPPVEIGEGTIVRAGSYIIGPVKIGKNCRIGPNCYIRPYTSIGDNCHIGNAVEVKNSIIMDNSNAPHLNYVGDSIIGENTNLGAGTITANLRHDKGTIKVEVKGKLEDSGRRKLGAIIGHNVKVGINVTIYPGRKIGSNSFIGPGVIVDKNIPQNVLVTVKQEKKVIEK

SEQ ID NO: 62046 - protein, 521 aa, Xanthomonas campestris pv. vesicatoria str. 85-10
MTNIHTDKILILDFGAQYTQLIARRIREIGVYCEIWAWDHDPSEIAGFGAKGIILSGGPESTTSPGAPVAPQEVFDSGLPVFGICYGMQTLAAQLGGATEAADQREFGHAEVDVVAADALFSGLTDHAGASRLNVWMSHGDHVSQVPPGFTITATTDRIPVAAMSNEAKRWYGVQFHPEVTHTLQGQTLLRRFVVDVCGCQTLWTAANIIEDQIARVREQVGDDEVILGLSGGVDSSVVAALLHKAIGDKLTCVFVDTGLLRWQEGDQVMAMFAEHMGVKVIRVNAADRYFAKLEGVSDPEAKRKIIGNLFVEIFDEESNKLANAKWLAQGTIYPDVIESAGSKTGKAHVIKSHHNVGGLPEHMKLGLVEPLRELFKDEVRRLGVELGLPRTMVYRHPFPGPGLGVRILGEVKREYAELLAKADAIFIDELRKADLYDKTSQAFAVFLPVKSVGVVGDARAYEWVIALRAVETIDFMTAHWAHLPYDFLGTVSNRIINELRGVSRVVYDISGKPPATIEWE

SEQ ID NO: 62047 - protein, 675 aa, Oryza sativa (indica cultivar-group)
MPPPRLPCLAAFLALALVVVVCAAEPDADRAALLDFLAGLGGGRGRINWASSPRVCGNWTGVTCSGDGSRVVALRLPGLGLSGPVPRGTLGRLTALQVLSLRANSLSGEFPEELLSLASLTGLHLQLNAFSGALPPELARLRALQVLDLSFNGFNGTLPAALSNLTQLVALNLSNNSLSGRVPDLGLPALQFLNLSNNHLDGPVPTSLLRFNDTAFAGNNVTRPASASPAGTPPSGSPAAAGAPAKRRVRLSQAAILAIVVGGCVAVSAVIAVFLIAFCNRSGGGGDEEVSRVVSGKSGEKKGRESPESKAVIGKAGDGNRIVFFEGPALAFDLEDLLRASAEVLGKGAFGTAYRAVLEDATTVVVKRLKEVSAGRRDFEQQMELVGRIRHANVAELRAYYYSKDEKLLVYDFYSRGSVSNMLHVPICSHVKLEPSKFIFLVLDFCLKLAMLIENELIGKRGEDRTPLNWETRVRIALGAARGIAHIHTENNGKFVHGNIKASNVFLNNQQYGCVSDLGLASLMNPITARSRSLGYCAPEVTDSRKASQCSDVYSFGVFILELLTGRSPVQITGGGNEVVHLVRWVQSVVREEWTAEVFDVELMRYPNIEEEMVEMLQIAMACVSRTPERRPKMSDVVRMLEDVRRTDTGTRTSTEASTPVVDVQNKAESSSAAH

SEQ ID NO: 62048 - protein, 492 aa, Arabidopsis thaliana
ENSKEKLQMQSHQNRSRLSLILRSRFIPSFSSPLSLFVVLAAVPLPIYFSGLLSGRNNKPLSVMRLNSNLASSMVESNISCTTFNILAPIYKRVDQKNHSTRESDFRTLWLARNQRILDLLLHQRSSVICLQEVWVGNEELVNLYHHQLSSSGYTIYQLARTNSRGDGLLTAIHKDHFKVVNYRELLFKDFGDRVAQLLHVKTVIPFPLNGKQDVQQEVIIVNTHLLFPHDSSLSIVRLHQVYKILEYLEAYQKENKLNHMPIILCGDWNGSKRGHVYKFLRSQGFISSYDDAHQYTDSDAHRWVSHRNHRGNICGVDFIWLCNPSDSRKPLRTSWVEAVFSIIKYQLHKASIAEDDAFTFLGAKNHSDSLTYSDFCLALQKVNLTGIPHGLSFEETKELWVRADLDGNGVFDYEELKKIWNMTMVNQPGNCKESVMESKKEEGEDEAIGLKVNKAILYPQEAEKGLWPENYNISDHACLTVQFSPVKMLCS

SEQ ID NO: 62049 - protein, 437 aa, Synechococcus elongatus
MRELTLTTTVFQTTKSQEIFAAAQKLMPGGVSSPVRAFKSVGGQPIVFDHVKGAHIWDVDGNQYIDYVGSWGPAIVGHAHPEVIDALHAALEKGTSFGAPCLLENILAEMVIAAVPSVEMVRFVNSGTEACMAVLRLMRAYTQREKVIKFEGCYHGHADMFLVKAGSGVATLGLPDSPGVPKATTAATLTAPYNDLEAVSRLFEQYPNDIAGVILEPVVGNAGFIPPDAGFLEGLRELTKQYGALLVFDEVMTGFRIAYGGAQEKFGVTPDLTTLGKVIGGGLPVGAYGGRAEIMKMVAPAGPVYQAGTLSGNPLAMTAGIKTLEILSRPGSYEHLDRITGKLVQGLLDAAREFGHEVCGGHISGMFGLFFTAGPVTNYEQAKQSDLKKFAAFHRGMLEQGIYLAPSQFEAGFTSLAHTEADIERTIAAARTVLSQL

SEQ ID NO: 62050 - protein, 359 aa, Streptococcus pyogenes MGAS10394
MKPSIYSLTRDELIAWAVERGQKQFRATQIWDWLYKKRVQSFEEMTNISKDFVSILNDSFCVNPLKQRVVQESADGTVKYLFELPDGMLIETVLMRQHYGHSVCVTTQVGCNIGCTFCASGLIKKQRDLNSGEITAQIMLVQKYFDDRKQGERVSHVVVMGIGEPFDNYKNVMCFLRVINDDNGLAIGARHITVSTSGLAHKIRDFANEGVQVNLAVSLHAPNNDLRSRIMRVNRSFPLEKLFSAIEYYIEKTNRRVTFEYIMLNEVNDSIKQAQELADLTKTIRKLSYVNLIPYNPVSEHDQYSRSPKERVLAFYDVLKKNGVNCVVRQEHGTDIDAACGQLRSKTMKKDREKVTATK

SEQ ID NO: 62051 - protein, 282 aa, Legionella pneumophila subsp. pneumophila str. Philadelphia 1
MLLFLFKFWFDLTVNILYLIMMGERMNFLNNKIVMITGASSGIGQACARLFAAQGARLILAARRVERLHELSSGLKHHNNQEHYILPLDVCKKDLVRQQIESLPGQWNSIDVLINNAGLALDTLPLHQGILEHWDTMIDTNIKGLLYISRLILPGMLERNSGHVINIGSIAGHECYPNGNVYSATKHAVHAISKSMRLDMLGSAVRVTEIAPGAVETEFSEVRWKDKQRAIDFYKDFQPLMAEDVADAALYCATRPLHVDIEQMIIMPTVQASANHLSRKGR

SEQ ID NO: 62052 - protein, 372 aa, Arabidopsis thaliana
MTEQEICVRVTRAAAKRKASTAMGIDGDRVNKKRVVLGELLNVSNVNLLANLNQKKETQKPKRNLKPPPAKQIKSAPVAIIDLESKSDIDSRSDDPQMCGPYVADIYEYLRQLEVKPKQRPLPDYIEKVQKDVTPSMRGVLVDWLVEVAEEYKLGSETLYLTVSHIDRFLSLKTVNKQKLQLVGVSAMLIASKYEEISPPKVDDFCYITDNTFSKQDVVKMEADILLALQFELGRPTINTFMRRFTRVAQDDFKVPHLQLEPLCCYLSELSILDYKTVKFVPSLLAASAVFLARFIIRPKQHPWNQMLEEYTKYKAADLQVCVGIIHDLYLSRRGGALQAVREKYKHHKFQCVATMPVSPELPVTFWEDVTI

SEQ ID NO: 62053 - protein, 384 aa, Clostridium difficile 630
MSNNINQDLETKIIHWGHSADPTTGALATPICQTATFAAKTVEHFEELCMTWGYVYTRECNPTLTELEAKLAMLENAESAISSTSGMGAITSTILALVKSGDHIVSSDGIFSHTKLFMSELLSKFGVEVTFVDAVNPQNVKEAMRPNTKIVYIESPLNPSLDLVDIKTIAEIAHENKSLAIVDSTFGTPIVQRPIDLGADLVIHSLTKFINGHGDTLGGAVAGSKELIDLVRWPSLCCFTGASLPPMSAWMILRGMKTLDMRMKKHCENGLAVAEFLEEEENVELVKYPALKSHPQYELCKTQMNGLGGGVVSFKLKDGINGLTRDQASRRLMNSLELATIATSLGEEHTLVQMNGENLIRIAVGLESSNDIINDFKQAIKKLK

SEQ ID NO: 62054 - protein, 242 aa, Bacillus cereus ATCC 10987
MQQFEEVHSILEKAKKITVLTGAGASTESGIPDFRSANGLYADANVEMYLSRGYYNRSPKEFWKHYKEIFQINTFHQYKPNRGHRFLAELEEQGKDITILTQNIDGLHQLGGSKHVIDLHGTLQTAHCPKCKAGYDLQYMIDHEVPRCEKCNFILNPDVVLYGDTLPQYQNAVKRLYETDVLIVMGTSLKVQPVASFPQIAKREVGATTILVNEELTGQEYNFDYVFQNKIGEFVEGLSSRK

SEQ ID NO: 62055 - protein, 370 aa, Arabidopsis thaliana
MNRRKNDFLVRPKRIRCYTQLSTLPIDLIIEILSRLPMNSIAICRLVSKQWASILQSSDFTESFLIKSPPRPRLLFTIRYGSKWHLFSAPQPRNFDENFPVVATDYHKGFSGNWCMQSFQLVNGFIYLNNRLSLKGKIDRVSVIWNPSTGQQIPLPDLGVKNSHSKSFFGYDPIEKQFKVLCITSSKEHQVLTLGTGRKLSWRKIEYSYPHYPRKKSNGICINGVLYYRNTNAMIVRFDVRSEEFRFVEIKMYVEILSLINYKGKLGVLFPNTDLAQLWVLDDTNKVEWSKHNFVFPDTTFEAIRATDTGEMFCASSCWRDSLYVSYYDLEKESVKKVKIKGIEDKLSIGKHHANEFFIFPNHVENVMVL

SEQ ID NO: 62056 - protein, 468 aa, Rhizobium leguminosarum bv. viciae 3841
MSYDVIIIGTGPGGYVCAVKAAQLGLKVAVVEKRATYGGTCLNVGCIPSKALLHASEMFHQAGHGMSALGIDVPAPTLNLGNMMAHKDATVKSNVDGVAFLFKKNKIDAFQGTGKIVSAGKVSVTADDGKVQDIEGKNIVIATGSDVAGIPGVQVEIDEKTIISSTGGIALEKVPETLIVVGGGVIGLELGSVWSRLGAKVTVVEYLDTILGGMDGEVSKQFQRMLAKQGIDFNLSAKVTGVEKADKGAKVTFEPVKGGDKVTLDAEVVLIATGRKPYTAGLGLEEAGVTLDNRGRVEIDGHYKTNVDGIYAIGDVVKGPMLAHKAEDEGVALAEILAGQHGHVNYEVIPSVVYTQPEIASVGKTEEELKAAGVAYKVGKFPFTANGRARAMLATDGFVKILADKETDRVLGGHIVGFGAGEMIHEIAVLMEFGGSSEDLGRTCHAHPTMSEAVKEAALATFFKPIHM

SEQ ID NO: 62057 - protein, 110 aa, Candida albicans SC5314
MYSDLECDYINPIELCNKLNPWFIPEAGLHGFITVLFLINGYWFCFLLNLPLFAYNANKFYNKNHLLDATEIFRTLSKHKKESFLKLGFHLLLFFFYLYRMIMALVNDEQ

SEQ ID NO: 62058 - protein, 425 aa, Rhizobium leguminosarum bv. viciae 3841
MATEIRVPTLGESVSEATVGTWFKKVGDAIKADEPILELETDKVTIEVPAPASGTLSEIVVAAGETVGLGALLGQIAEGAAAAAAPAAAAPTAAPAAPAPAQPAAAAPAQPAVAAAAASSSSASVSTMPPAPAASKMLAENNLSADQVDGSGKRGQVLKGDVIAAVAKGISAPAAVPAATPAAARGPSTVEDASREERVKMTRLRQTIAKRLKDAQNTAAMLTTYNEVDMKAVMDLRNKYKDIFEKKHGVKLGFMGFFTKAVTHALKELPAVNAEIDGTDVIYKNYCHVGMAVGTDKGLVVPVIRDADQMSIAEIEKELGRLAKAARDGSLSMADMQGGTFTITNGGVYGSLMSSPILNAPQSGILGMHKIQERPVAIGGQVVIRPMMYLALSYDHRMVDGKEAVTFLVRVKESLEDPERLVLDL

SEQ ID NO: 62059 - protein, 213 aa, Deinococcus radiodurans R1
MTPLKIGVGGPVGSGKTALLEVLCRELRDRYDLAVITNDIYTFEDQRILTRAAALAPERIRGVQTGGCPHTAIREDSSLNQETVEALQGEFPGLELLFIESGGDNLASSFSPELVDAWLFVLDVAGGEKVPRKGGPGIRHSDLLVINKTDLAPLVGADLRVMDADARAQRRAGDEVRPYVFTNLKSGAGVDEIIAWIEHDLLFRDVTPPRVGL

SEQ ID NO: 62060 - protein, 281 aa, Megacorax gracielanus
ERVRNGSWVGATGKELKDVIAVGIGGSFLGPLFVHTALQTDQEASKNARDRELRFLANVDPIDVARNISGLNPETTLVVVVSKTFTTAETMLNARTLREWISSVLGTSAVAKHMVAVSTNLPLVEKFGIDPNNAFAFWDWVGGRYSVCSAVGVLPLSLQYGFAVVEKFLQGAHSIDQHFSSAPFEKNIPALLGLLSVWNVSFLGYPARAILPYSQALEKLAPHIQQVSMESNGKGVSIDGLPLPFETGEIDFGEPGTNGQHSFYQLIHQGRVIPCDFIGVV

SEQ ID NO: 62061 - protein, 371 aa, Hauya elegans
ERVRNGSWVGATGKELKDVIAVGIGGSFLGPLFVHTALQTDPEASKNARGRELRFLANVDPIDVARNISGLNPETTLVVVVSKTFTTAETMLNARTLREWISSALGPSAVAKHMVAVSTNLPLVEKFGIDPNNAFAFWDWVGGRYSVCSAVGVLPLSLHYGFAVVEKFLQGAHNIDQHFSSAPFEKNIPVLLGLLSVWNVSFLGYPARAILPYSQALEKFAPHIQQVSMESNGKGVSIDGLPLPFETGEIDFGEPGTNGQHSFYQLIHQGRVIPCDFIGVVRSQQPVYLKGEVVNNHDELMSNFFAQPDALAYGKTPEQLQKENVPQHLIPHKTFTGNRPSLSILLPSLDAYRIGQLLAIYEHRVAVQGFI

SEQ ID NO: 62062 - protein, 182 aa, Campylobacter upsaliensis RM3195
MKELSQKERDFLIQSIRVIPNFPKEGIIFRDITTLLNDIKALSFLLKHLEDRYKDMNLDFIVGTESRGFIFASMICARLNLPFVPIRKPGKLPYKTFSCSYDLEYGSDTIEIHQDAFRSVEKAKVLLVDDLIATGGTALASYDLIQKAGGICVESCFLINLKDLNGWKKLNALCPVYSVLEF

SEQ ID NO: 62063 - protein, 269 aa, Lopezia grandiflora
ERVRNCSWVGATGKELKDVIAVGIGGSFLGPLFVHTALQTDQEASKNARGRELRFLANVDPIDVARNISGLNPETTLVVVVSKTFTTAETMLNARTLREWISSALGTSAVAKHMVAVSTNLPLVEKFGIDPNNAFAFWDWVGGRYSVCSAVGVVPLSLQYGFGVVEKFLQGAHSIDQHFSSAPFEKNIPVLLGLLSVWNVSFLGYPARAILPYSQALEKLAPHIQQVSMESNGKGVSIDGLPLPFETGEIDFGEPGTNGQHSFYQLIHQ

SEQ ID NO: 62064 - protein, 506 aa, Moorella thermoacetica ATCC 39073
MGIWRTKKIADLMQEAGDNQKLKRSIGTPELVALGVGAIIGSGIFVLTGVAAANYAGPALVFSFILSGLAAGLAALVYAEMAAMIPVTGSAYTYAYASLGEIIAWLVGWNLVLEYLVASGAVAVGWSGYITDMLASVGVFLPRALVNSPLSGGLVNLPAILITVVMTGVAIVGTTTSARTNKIIVGVKILVILAFLALGAPRVNPAYWHPFLPFGVTGVVHGAAIIFFAYIGFDAVATAAEEVRDPARELPLGIIGSLALATILYVAVTIVLTGLTPYTNLNTPSPVTTGLLAAGVRGASLIVGTGALAGLTSVLLVNIFAQSRVFMAMGRDGLLPPLFTRVHPRFHTPWLTTLIVGAFITLIGGFLPVDIIAELANVGTLSAFFVVSVGVMVLRRTQPDLKRPFKVPLMPWTPLLAIAFAVYLFFNLPGLTWIRFGVWVTLGLVVYFAYGRRHSVLAREEESKAVPRPTYRPSPLEMPAPARKPFPFKLPAPDLLRMFLPRWRRD

SEQ ID NO: 62065 - protein, 230 aa, Lopezia grandiflora
AILPYSQALEKLAPHIQQVSMESNGKGVSIDGLPLPFETGEIDFGEPGTNGQHSFYQLIHQGRVIPCDFIGVMKSQQPVYLRGEVVNNHDELMSNFFAQPDALAYGKTPEQLKKENVSEHLIPHKIFTGNRPSLSILLPTLDAYRIGQLLAIYEHRVAVQGFIWGINSFDQWGVELGKSLATQVRKQLHASRVNGEAVEGFNFSTKTLLTRYLKETSDVPADPSTLLPKI

SEQ ID NO: 62066 - protein, 432 aa, Nostoc sp. PCC 7120
MVNTTIKTTKSQEIFAAAQNLMPGGVSSPVRAFKSVGGQPIVFDHVKGAYIWDVDGNQYIDYVGTWGPAICGHAHPDVIGALHDALEKGTSFGAPSFLENVLAEMVIAAVPSIEMVRFVNSGTEACMAVLRLMRAFTNREKVIKFEGCYHGHADMFLVKAGSGVATLGLPDSPGVPKSATSSTLTAPYNDLEAVKALFEENRDQIAGVILEPVVGNAGFITPDAGFLEGLRELTHEHGALLVFDEVMTGFRIAYGGAQEKFGVTPDLTTLGKVIGGGLPVGAYGGRRDIMSMIAPAGPVYQAGTLSGNPLAMTAGIKTLELLQKPGAYEYLERITKKLADGLLQVALETGHAACGGHISAMFGLFFTSGPVHNYEDAKNSDTAKFGRFHRGMLERGVYLAPSQFEAGFTSLAHTDEDIDQTIAIAREVLSSI

SEQ ID NO: 62067 - protein, 278 aa, Lactobacillus plantarum WCFS1
MQPITTEIVSRTIIKRPADSHKGNYGRIMLIGGNQNFGGAIIMAATAATYSGAGLVTVATDPSNFTSLHARLPEAMVIDYHQTDTLLNLLAGMDVIVIGPGLGTDTVADQLLTAVLAATHVPQRLVIDGSALTLLAQQARPLPATDIVVTPHQMEWQRLSGIAIKDQTPTANHDAQQRLGVMAVVKAHRTTVYTDERVWFNPGGTPAMATGGMGDTLAGMIGGFVSQFHNFTDAVLSAVYLHSAIADDLAATRYVVLPHQISTRIPTYMHRFSQIERP

SEQ ID NO: 62068 - protein, 96 aa, Methanothermobacter thermautotrophicus str. Delta H
MVDEGILREVYRVLEDRRDRPIDSYTSRLMRDDDKMAEDKILEKIGEEAAEVIIASKNDENLVEEAADLIFHTLLLLVYKGVPLDSLLEEFAARRK

SEQ ID NO: 62069 - protein, 564 aa, Bacteroides fragilis YCH46
MEQRIKFPRSEKVYLSGKLFPEIRVGMRKVEQVPSTTFEGEKKVITPNPHVYIYDTSGPFSDPDIEIDLKKGLPRLREEWILNRGDVEQLPEISSEYGRMRRDDGSLDHLRFEHIALPYRAKAGRHITQMAYAKQGIVTPEMEYVAIRENMNCEELGIETHITPEFVRQEIAEGRAVLPANINHPEAEPMIIGRNFLVKINTNIGNSATTSSIDEEVEKAMWSCKWGGDTLMDLSTGENIHETREWIIRNCPVPVGTVPIYQALEKVNGKVEDLTWELYRDTLIEQCEQGVDYFTIHAGIRRHNVHLAEKRLCGIVSRGGSIMSKWCLVHDRESFLYEHFDDICDILAQYDVAVSLGDGLRPGSTHDANDEAQFAELDTMGELVVRAWEKNVQAFIEGPGHVPMHKIRENMERQIEKCHNAPFYTLGPLVTDIAPGYDHITSAIGAAQIGWLGTAMLCYVTPKEHLALPDKEDVRVGVITYKIAAHAADLAKGHPGAQVRDNALSKARYEFRWKDQFDLSLDPERAFSYFHAGRHTDGEYCTMCGPNFCAMRLSRDLKKTQKQK

SEQ ID NO: 62070 - protein, 460 aa, Burkholderia sp. 383
MNQPEDQLHRGLEERHINLMALGATIGVGLFLGSASAIRVAGPAILLTYLLGGIAIFLIMRALGEMAIANPVAGAFSRYARDYLGPLAGYLTGWTYWFVWIVTCMAEITAVGVYMHMWFPGVPNWIWALAALMAMGSVNFIAVKLYGEFEFWFALIKIVTIVLMIIGGGLMIAFGIGNGGVAIGLSNLWAHGGFMPNGINGVIAALPIVMFAYLGVEMLGLTAGEARNPEKSLTKAVNSVFWRVLIFYIGALFVIMSLYPWDQIGTQGSPFVMTFSRLGIPAAAGIINFVVLTAALSSCNSGLFSTARMLYNLAQQGQAPSKLGKVNRNGVPVYGVIVSVALLLIGVLLNYLAPQHVFTWLTSVSTFGAIWTWCVILIAQMRFRRTLSADKIARLPIRVPFYPLGSFVALGFLVLVVVLMAFTPDTRVALVIGPVWIVLLGITYALFYANRPAASVPTKS

SEQ ID NO: 62071 - protein, 1068 aa, Clostridium difficile 630
MPKLDSIKKTLVLGSGPIIIGQAAEFDYSGTQACQSLKEEGIEVVLINSNPATIMTDKEVADKIYIEPLTIEFIEKIIEKERPDSLLAGMGGQTGLNLAVELYEKGILDKYGVKIIGTSVESIKKGEDRDIFREVMKEINQPVIVSDIVTDLQAGLDYALTIGYPVVVRPAYTLGGTGGGIADNEEELREILSHGLQLSPVGQVLIEKSIKGWKEIEYEVIRDSKGNCIVVCNMENIDPVGVHTGDSIVVAPTQTLSNKECAMLKKASLDILNAVEVQGGCNVQFALNPHSFEYAVIEINPRVSRSSALASKATGYPIAKVSSKIALGYTLDEIENAVTKKTYACFEPTIDYVVAKIPKWPFDKFKKANRKLGTKMMATGEIMSIGSNFEAAILKGIRSLETGKYSLVHTPSEERSIEELKKRVVVPDDERLFDLAEMIRRGYKVEMIEQITGIDKWFINKFKWIVEQEEKLKVMKIEDLTKDYLLELKKKGFSDKGISDLMKISPEKLYELRSLYNIKPAYKMVDTCAGEIDAISPYYYSTYEQYDEVVVSDKKKVIVLGSGPIRIGQGIEFDYCSVHCVKSLRKMDIETIIINNNPETVSTDFDTSDKLYFEPLTEEEVLSIIEKEKPEGVILQFGGQTAIKLAKFLHEKNIPILGTDFDDIDAAEDREKFDDLLERLDINRPKGKGVWSLNEGIEVANELGYPVLVRPSYVLGGQGMEITYNEEKLSQYLQDAFDRDHKNPVLIDKYLTGREIEVDAICDKEDILIPGIMEHLERAGVHSGDSTTMYPSQNISDEIKEKIVEYTKKIALDLNVLGMVNIQFIEFQNELYIIEVNPRASRTVPYISKVSGVPIVDLATKCMLGAKLKDLGYGTGVYKEPKLVSVKVPVFSMSKLSKVEVSLGPEMKSTGEVLGVGENLEEALYKGFLAAGRHMSDERGVVLATVNNHDKDEFIEIAKDMKELGYTFVATEGTANSLRENGIEADIVNRVEESRPNILDAIRNKQVDIVINTPTKGNDSTRDGFKIRRTAIEFSTEIMTSLDTLKALVEVKKKHLNKDELKVYNIAE

SEQ ID NO: 62072 - protein, 906 aa, Bacteroides fragilis YCH46
MDKKRVYTFGNGLAEGKAGMRNLLGGKGANLAEMNLIGVPVPPGFTITTDVCTEYYEMGQEKVVSLLKEEVEKAIANIENLMRSKFGDVENPLLVSVRSGARASMPGMMDTILNLGLNDEVVEGLTRKTGNARFAWDSYRRFVQMYGDVVLGMKPVNKEDQDPFEAIIEEVKHAKGVKLDNELEVEDLKELVKKFKAAVKAQTGKDFPTCAYEQLWGAICAVFNSWMNERAILYRKMEGIPDEWGTAVSVQAMVFGNMGDTSATGVCFSRDAATGEDLFNGEYLINAQGEDVVAGIRTPQQITKIGSQRWAQLAGVSEEERASKYPSMEEAMPEIYKQLDELQTKLENHYKDMQDMEFTVQEGKLWFLQTRNGKRTGAAMVKIAMDLFRQGMIDEKTALMRVEPNKLDELLHPVFDKSALKQAKVLTRGLPASPGAATGQIVFFADDAAEWHAAGKRVVMVRIETSPEDLAGMAVAEGILTARGGMTSHAAVVARGMGKCCVSGAGALNIDYKARTVEVDGVLLKEGDFISLNGSTGEVYQGKVETKAAELSGDFADLMKLADKYTRLQVRTNADTPHDAEVARNFGAVGIGLCRTEHMFFEGEKIKAMREMILAENAEGRRKALAKILPYQQADFKGIFKAMAGCPVTVRLLDPPLHEFVPHDLKGQQEMADTMGVSLQYIQQRVESLCEHNPMLGHRGCRLGNTYPEITQMQTRAILGAALELKKEGIETHPEIMVPLTGILYEFQQQESVIRAEADNLFEEVGDRIDFKVGTMIEIPRAALTADRIASSAEFFSFGTNDLTQMTFGYSRDDIASFLPVYLEKKILKVDPFQVLDQNGVGQLVRMATEKGRAIRPDLKCGICGEHGGEPSSVKFCHKVGLNYVSCSPFRVPIARLAAAQAAIEE

SEQ ID NO: 62073 - protein, 118 aa, Helicobacter hepaticus ATCC 51449
MRNRYIQSFQEAQIGKKQVPQFKAGDTLRLGIKIQEGDKTRIQHFEGVCISIRGNGVDRTFTTRKMGANNIGVEKTFPLYSESLDSIEVLRIGRVRRAKLYYLRSRRGKAARIKELRK

SEQ ID NO: 62074 - protein, 136 aa, Candida albicans SC5314
MARTKQTARKSTGGKAPRKQLASKAARKSAPVSGGVKKPHRYKPGTVALREIRRFQKSTELLIRKLPFQRLVREIAQDFKSDLRFQSSAIGALQEAVEAYLVGLFEDTNLCAIHAKRVTIQKKDMQLARRLRGERS

SEQ ID NO: 62075 - protein, 148 aa, Thermococcus celer
MVTISSEEIMKVIEEEFPDVKYLALSGNLCVDKKPNAMNFINGRGKSIIAEAVIPREIVEEKLKTTPELIAEVNYRKNLVGSAQAGSYGFNAHFGNVVGAIFLATGQDEAQITEGSHGITLAEVTPEGDLYISVTMPSLEIGTVGGGT

SEQ ID NO: 62076 - protein, 668 aa, Prosthecochloris aestuarii DSM 271
MQQDPIDTLSINTIRLLAADMVEKAGSGHPGMPMGAAPMAYVLWTKIMKHNPRDPHWLNRDRFVLSAGHGSALLYSLLHLCGYELTMEDLQQFRQWQSRTPGHPEYRHTPGVEMTTGPLGQGIATAVGMAVAERFSAERLNRQSFNIIDYHTYVICGDGDLMEGLSSEAASIAGHLKLEKLICLYDDNRISIEGPTSLAFTENVGKRFEAFGWNVLDVDGNDPEAVEEALRKVRKGTGKPNLIRATTNIGYGSPNKQDNAASHGSPLGKEELAMVRKKFGFPEDESFVIPEAVTAHMRAISDKGEQSQAEWTTLWEAYSQAHPDLATQINDLINKRLPDSWQTLLPEFNPEEQLATRQALNKILHALIGKIPFLAGGSADLAPSNGTAVKNAEDFNPDNYGGTNFHFGVREHAMGAIINGMALSGMLKPYGATFLVFADYMKPALRLAALMQIPSTFIFTHDSIAVGEDGPTHQPIEQLVMLRSIPGMTVIRPADANETKAAWKYIMTAQTPVSLILSRQALPILDSSLYPSEEGTARGGYILADWGNASGSGSKPVILIATGAEVHLAVQAQQQLEEEGIPARVISMPSVELFLQQPEEYREEVLPTSIRRRVVIEAASTIGWHRFITEEGTIVGIDRFGSSAPGSRVLKEYGFTAEHIVATVKTLL

SEQ ID NO: 62077 - protein, 252 aa, Petunia x hybrida
MRVNRNATVFIALNLILFLVFVFTAFALSGQENTGGFCGEEEEKGNNYIEMALLGGIRDSHPESQNSDEIHSLAKFAVDEHNKKENAMFELARVVKAKEQVVAGTLHHLTLEVVDAGKKKLYEAKVWVKPWLNFKELQEFTHVEDAPAITSSDLGVKKEEQCSGFKSVPVHDPVVQEAAEHAIKTIQQRSNSLLPYELQEIVHANAEMIEDSTKLHMLIKTSRGGKEEKFKVQVHHSNEGAFHLNHMEPDRS

SEQ ID NO: 62078 - protein, 325 aa, Bacillus licheniformis ATCC 14580
MAQMTMIQAITDALRTELKNDENVLVFGEDVGVNGGVFRATEGLQKEFGEDRVFDTPLAESGIGGLALGLGLQGFRPVMEIQFFGFVYEVMDSVSGQMARMRYRSGGRWNSPVTIRSPFGGGVHTPELHADSLEGLVAQQPGLKVVIPSTPYDAKGLLISAIRDNDPVVFLEHMKLYRSFRQEVPEEEYTIEIGKADVKREGKDLSIITYGAMVHESLKAAEELEKEGVSAEVVDLRTVSPLDIDTIIASVEKTGRAIVVQEAQKQAGVAANVVAEINDRAILSLEAPVLRVTAPDTVFAFSQAESVWLPNHKDVLETAKKVLEF

SEQ ID NO: 62079 - protein, 377 aa, Oryza sativa (japonica cultivar-group)
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYSFTTSAEREIVRDIKEKLAYVALDYEQELETAKNSSSIEKSYELPDGQVITIGSERFRCPEVLFQPSMIGMESAGIHETTYNSIMKCDVDIRKDLYGNVVLSGGTTMFPGIADRMSKEITALAPSSMKIKVVAPPERKYSVWIGGSILASLSTFQQMWISKDEYDESGPAIVHRKCF

SEQ ID NO: 62080 - protein, 470 aa, Bacillus licheniformis ATCC 14580
MVVGDFPIETDTLVIGAGPGGYVAAIRAAQLGQKVTIVEKGNLGGVCLNVGCIPSKALINAGHRYENAKHSEEMGITAENVKVDFTKVQEWKASVVNKLTGGVEGLLKGNKVDIVKGEAYFVDSNSVRVMDENSAQTYTFKNAIIATGSRPIELPNFKYSDRVLNSTGALALKEIPKKLVVIGGGYIGTELGTAYANFGTEVVILEGGEEILPGFEKQMSSLVKRNLKKKGNVEIHTKAMAKGVEEKADGVTVTFEVKGEEQTIDADYVLVTVGRVANTDELGLEQVGVEMTDRGIIKTDKQCRTNIPNIYAIGDIIEGPPLAHKASYEGKIAAEAIAGEAAEIDYLGIPAVVFSEPELASVGYTEAQAKEEGLSVTAAKFPFAANGRALSLNETDGFLKLVTRKEDGLVIGAQIAGASASDMISELSLAIEAGMTAEDIAMTIHAHPTLGEITMEAAEVAIGMPIHVVK

SEQ ID NO: 62081 - protein, 376 aa, Methanothermobacter thermautotrophicus str. Delta H
MAKRDYYEILGVDRGADKKEIKKAYRRLARKYHPDVSDDPDAAEKFKEISEAYAVLSDDEKRARYDRFGHAGMDGFSQEDIFNNINFEDIFSGLGFDIGNIFDMFGFGGGRRHGPQRGADISYTLDISLEDAYNGLETDIRVPHTKKCPVCHGSRAEPGTGTRTCQTCGGSGQVRQVRNTILGQMMNITTCPDCQGEGTVVEKPCSNCNGKGVVRKTSTIHVKVPAGVETGSRLRVPGEGEMGLRGGEPGDLYVVIKVKPHSIFRREGANLYTEKPISFVQAALGDTVEVPTLDRPVKLRIPAGTQSGTTFRVKGHGMPHLKWNGYGNLYVKVKVVTPRKLSPRQKELLREFASISGDEIHEDKGFFDKVKDAIIH

SEQ ID NO: 62082 - protein, 559 aa, Zea mays
MELAVGGGMRRSASHTSLSESDDFELTRLLSKPRINVERQRSFDDRSLSDVSHSGGYGRGGFDGMYSPGGGLRSLVGTPASSGLHSFEPHPIVGDAWEALRRSLVLFRGQPLGTVAAVDHASEEVLNYDQVFVRDFVPSALAFLMNGEPDIVKNFLLKTLLLQGWEKKVDRFKLGEGAMPASFKVMHDAKKGVETLHADFGESAIGRVAPVDSGFWWIILLRAYTKTTGDLTLAETPECQKGMRLILSLCLSEGFDTFPTLLCADGCCMIDRRMGVYGYPIEIQALFFMALRCALQMLKHDNEGKEFVEKIATRLHALSYHMRSYFWLDFQQLNDIYRYKTEEYSHTAVNKFNVIPDSIPDWLFDFMPCQGGFFIGNVSPARMDFRWFALGNMIAILSSLATPEQSVAIMDLIEERWEELIGEMPLKICYPAIENHEWRIVTGCDPKNTRWSYHNGGSWPVLLWLLTAACIKTGRPQIARRAIDLAERRLLKDGWPEYYDGKLGRYVGKQARKFQTWSIAGYLVAKMMLEDPSHLGMISLEEDRAMLKPVLKRSASWTN

SEQ ID NO: 62083 - protein, 208 aa, Oryza sativa (indica cultivar-group)
MASYHQQQGGSTFMAIPTINFQMYSEIAGDDEWWEYIPCPFCYIEVEVPFLCDHLQEEHCFDMKNAVCPICADNLDKDTDEHFRVQHSHLLKRRKSSSFSCKPSSAAADKGSYEEDSYFEAPSHCMGRPAPDSSPDPLLSQFICCSLAPPVDSPRRSEADAEGHGSSSSDDQKRREQGVMDDASKEELEERLQRIEFVKQMLMTTIAY

SEQ ID NO: 62084 - protein, 340 aa, Aspergillus oryzae
MTDHPDQPFTGQEYALDDIVKLIKTGKATRIVVLAGAGISTAAGVPDFRSPATGLYDKLAPLKLPFPEAIFHINYFRHTPEPFYAIARARNPKNLQPTISHAFLALLAKKNLLDFVFTQNIDGLELDAGVPAEKVLSCHGNWKSQRCHKCKTPYPDGPMAEAIETGQVPYCQVPDCGGAVKPDVVFFGEPLPAAFEVEEKRVFGADLMIVMGTSLKVAPCARLPRQVKEGTPRLLVNMVQVGDFGTRPSDVCILGSCDDGVRQLADSLGWREELESLWTHAVAGKQVEVNTDDVKTLDECIEELAERMRIAGKISDGHKRMLEKHLEEKFANVLPKPPIS

SEQ ID NO: 62085 - protein, 260 aa, Aspergillus oryzae
MDLHSQLQAAWDHVRTTYKPGTIELTGVIVTQIVGFIIPATLYMLIDVLFPKFSQRHKIQNIRRQPTRQQILHCVQVTMLNHVWVVALYALLVYLTGLDYAFTNQDPVVPPWKTFIVDFTFGLLAREISFYYVHRALHHPSIYAYIHKMHHKYTAPVAFAAEYAHPVEHILANILPLTLPLYLKGAHFLSIVFFFVFELWEAAADHSGYDFLKLPPAELHDLHHEKFRVNYGTIGLMDWIHGTDVVGWDRPKARKVKIAE

SEQ ID NO: 62086 - protein, 400 aa, Bacillus licheniformis ATCC 14580
MTVLSKSEKIMKQTAHFGANNYHPLPIVISEAEGAWVKDPEGNRYMDMLSAYSAVNQGHRHPKIIQALKDQADKITLTSRAFHNDQLGPFYEKVASLTGKDMVLPMNTGAEAVESAVKAARRWAYDVKGVPDNQAEIIACEGNFHGRTMLAVSLSSEEEYKRGFGPMLPGIKLIPYGDLEALKQAITPNTAAFLIEPIQGEAGIVIPPEGFLKQAAEVCKERNVLFIADEIQSGLARTGKMFASDWEDVTPDMYILGKALGGGVFPISCIAANRDVLGVFNPGSHGSTFGGNPLACAVSIAALEVLEDERLAERSLELGEYFKEKLSQIDNPKIKEVRGRGLFIGVELTEAARPYCERLKEEGLLCKETHETVIRFAPPLVISHEDLDWAIEKITRVLSK

SEQ ID NO: 62087 - protein, 481 aa, Bacillus licheniformis ATCC 14580
MNHENREQYTLKRTMKSRHLFMISLGGVIGTGFFLGTGYTINEAGPIGAILSYLAGGMIMYFTMLCLGELAVAMPVSGSFQTYATKFIGPATGFAVGWIYWLGWSVTVALEFLSAGQLMKRWFPDVGVWIWCLIFGLLLFSLNALSAKAFGESEFWLSGIKIIVILLFIILGGGAMFGLIDLKDGQAAPFFSNLIGDGIFPNGFGAIFITMITVNFAFQGTELIGIAAGESENPEKTVPRSIKQTVWRTLVFFGLSVFVLAGLIPWEKAGVVESPFVVVFEQIGIPYAADLMNFVILIALLSVANSGLYASTRMLYSLAKEGMAAQALSRVNKRGIPMNALWITLGFAGLSLISSVVAAETLYIWLLSLAGLSAQVGWITITVSQLLFRRRYVKEGGKVEDLKFKTPLYPYLPLTGFILNSAVLVSLAFDSEQRMALYCGILFMSACYFVYHVFVKKRQALDRQEAMIYQNKTNDEVVIDE

SEQ ID NO: 62088 - protein, 216 aa, Thermococcus litoralis
TTIIDDKMTRAPLLKCPDARRAREVAQWVEENLEYLQEKAVSKVTRHGKLRGVKPYIVGNNLYLRFEFETGDAMGMNMVTIASEEIMKVIEEHFPDVKYLALSGNLCVDKKPNAMNFINGRGKTVIAEAIIPREIVEKKLKTTPELIAEVNYRKNLVGSAQAGSYGFNAHFGNIVGAIFLATGQDEAQITEGSHGITLAEVTPEGDLYISITMPSL

SEQ ID NO: 62089 - protein, 148 aa, Thermococcus stetteri
MVTIASEEIMKVIEEEFPDVKYLALSGNLCVDKKPNAMNFINGRGKTVIAEAVIPRDIVEKKLKTTPELIAEVNYRKNLVGSAQAGSYGFNAHFGNIVGAIFLATGQDEAQITEGSHGITLAEVTPEGDLYISITMPSLEIGTVGGGT

SEQ ID NO: 62090 - protein, 147 aa, Pyrodictium occultum
MATIATDKAAEWILRNYPGEAKLIAISGNLCTDKKPALLNAILGRGKTVVAEATIKRDIALRVLKAAPEDIDTVNRVKNLLGSARAGSPSFNAHYANIIAAIFIATGQDVAQVVESSMGYTWTEVRNGDLYISVTLPSLELGTVGGG

SEQ ID NO: 62091 - protein, 172 aa, Phaseolus vulgaris
NVYKGYIDDGSTPVAIKRLKSDSQQGLKEFMNEIEMLSQLRHLHLVSLIGYCYESNEMILVYHFMDRGTLRDHLYYTDNPSLPWKQRVEICIGVARGLHYLHTGVKQVIIHRDVKSSNILLDEKWVAKVSDFGLSRIGPTGISMSHVNTQVKGSIGYLDPEYYKRQRLTEKS

SEQ ID NO: 62092 - protein, 772 aa, Xanthomonas oryzae pv. oryzae KACC10331
MSRSKPQAAPNTHPPSPSCTPVASQVGYPRRLDLPRRRTPPHDVRPPAGHRAMTLPRRALPLVLGLLPLAACADPAFDRCLAGLQTQAAAKGVDPAGFQRFTAGLVPDPSVLPLLDAQPEFTTPIWDYLASLVDNQRVTDGQAMLVTHRALLTRLSEQTGVDPATIVAVWGVESDYGRVTGKRPLLVSLATLSCAGRRQPFFRDEFLALLSLLQRGDLAADGLTGSWAGAFGQTQFMPSTYTRIAVDGDGDGRRDLVASIPDALASTANYLVKAGWERARPWGMEVTLPRGFDASKAGRTRRQPLQAWQTAGLLGTDGKPLAPIGLPAETPAALLLPAGATGPAFLVFRNYDAIYAYNAAESYALSIALLADRLRGGPGLIATWPTDDPGLGRPERRELQQLLLARGYQIGEADGMVGSATRRAIQVEQIRLGLQPADGRPGQRILTALRAAPPLAGVAAVRATAFKLPTAYPAFAQSAIVHKASPMSDTTGLTTGDFHGFPSLLIETPFSTAAISLFGGQLVSFVPKGGQDVMWLSPLAKQPPTPIRGGAPVCWPYFGRQGQIGDVPAHGFVRTVAWRLTESRREDDGTVVLTLTPPRLDDLALRLRMTLRIGRTLEQRLITENTSAAPVRFTQALHNYFRVGDALKISVQGLDGLDYLDKYENYATAHRQQGDWSLRDPRDPGRSDRIYTNAGGRYTLTDPVLGRRIVIATEGSRSLVAWNPGEEAGKKMADVGDGWRDYVCLEAANAGPDVIELAPGASHTLTQTISVE

SEQ ID NO: 62093 - protein, 1056 aa, Candida glabrata CBS 138
MPLLFEGFNRISRPIAYASKLSAKQPIHVILVTLVISAFAYLSVIQYYFNGWQLDSKTIFAKASNQDQDKLFNDCTHYYRNPESNGWSMISSTEANDLPLTQHYYLLDMRFEANENMTISKPFIDDTIYESKSEKYVIQKDLQISSELSAPDGTQWRLTTSINDIFEIKQKLFDLYEICIKNINESDPFDISIIVIAYSMMMYTIFSLFNDMRKTGSSFWLSLATLVNSACALFLALFTSQCLLHKEVTALSLIQGLPFLMVVIGFNHKVRLASNALHLFESYNISKKVATYRIIYEAMLEEGGRLLQDHLLCIIAFVGCSIYASSVQPLTNFCILSAFILAYELLLTATFYSAVLSLKLEINIIHRSTLIKQTLEEDGIVSTTADIISKSENKSRNLLFNSNYAVVFVKLAFIAFFVMINFYNLGSDWATDAFSAFYTSNKPPRLPEFIKTSNSSQFHDAVLISIISVTYKPYKRYHQVEDSILSLLRYISVAIRDRFVSKLVFFALVISSLINIYLLNASRIHTKYTVEEVQSKHKPKAEQKIVKQKKVTVEKSRPKLTTGKDISTSESSTSTSTSSFYSSSDEDTNIDEIMKRPIEELEAIMKAGNVSKLKNKEVVSLVIHGKLPLYALEKQLGDTTRAVCVRRKAISILADAPVLATDRLPYKNYDYDRVFGACCENVIGYMPLPVGVIGPLVIDGVSYHIPMATTEGCLVASAMRGCKAINAGGGVTTVLTKDGMTRGPCVRFPSLTRAGACKIWLDSEEGQNQIKKAFDSTSRFARLQHAQTALAGDLLFIRFRTTTGDAMGMNMISKGVEFVLKQMVEEFGWHDMEIVSVSGNYCTDKKPAAINWIEGRGKSIVAEAIIPGDVVRKVLKSDVSALVELNISKNLIGSAMAGSVGGFNAHAANLVTAVYLALGQDPAQNVESSNCMTLMNDVNGDLKISVSMPSIEVGTIGGGTVLDPQGAMLDLLGVRGPHPTNPGANARQLAKIVACAVLAGELSLCAALAAGHLVQSHMTHNRKPAAAGAVESKPTQSVNNADIKRLEEGSKICIKS

SEQ ID NO: 62094 - protein, 340 aa, Zea mays
  misc_feature (132)..(132): Xaa can be any naturally occurring amino acid
MFQAVPDKNEGKENPKPAAVCVAVGFLSYCVRGPRCAHAATGGSSYCYNYLYSRPSLAHATQAQTRAIRSDPELCRPAMATRVLLTALLLAFLLVATPFTARVARADSEEDAAAAEVVEGADLGIVGDDTPXGVFFPSDGPLSPAPGVETVVVFPKNAGKIVLAGEETELLVGLQNEGESTLNVVAVHSTLHLPFDHNMYGQNLTVQNFFNASVPVSVQATFPYKFVVSKFLQPGAYDLVGYIVYEIDQHPYQNVFYNGTIEVVEAGGLLSVESVFLITLGTALLGLFGLWAYGQVQQLSKKTKKAPKVELGTGTTDANIDEWLEGTSFVQRSKSKKKQT

SEQ ID NO: 62095 - protein, 170 aa, Phaseolus vulgaris
NVYKGVLKNGMTVAVKRSQPGSGQGLPEFQTEIMVLSKIRHRHLVSLTGYCDERLEMILVYEYMEKGTLRDHLYNTKFPTLSWKARLQICIDSARGLHYLHKGAAGGIIHRDVKSTNILLDENHVAKVADFGLSRSGPLGTESYVTTGVKGTFGYLDLEYFRSQHLTEKS

SEQ ID NO: 62096 - protein, 179 aa, Carica papaya
FGGVYRGVLRDNTKVAVKRGVPGSRQGLPEFQTEIAILSKIRHRHLVSLVGYCEEQSEMILVYEYMEKGPLKKHLYGPGCTPLSWKQRLEICIGAARGIHYLHTGSAQGIIHRDIKSTNILLDENNIAKVADFGLSRSGPCLDETHVSTGVKGSFGYLDPEYFRRQQLTDKSDVYSYGI

SEQ ID NO: 62097 - protein, 1072 aa, Candida glabrata CBS 138
MKSSNEDKEKDISSTFKRTEVIGRGKFGIVYKGYHVKTKQVYAIKVLNLDSSEDEVEDVQREIQFLASLKQIPNITRYYGSYLRGTSLWIIMEYCAGGSLRSLLRPGKIDEKYIGVIMRELLVALKVIHKDNVIHRDIKAANVLITNEGQVKLCDFGVAAQLNQTSLRRQTMAGTPYWMAPEVIMEGVYYDTKVDIWSLGITAYEIATGNPPYCDVEALRAMQLIIKSKPPRLEERNYTPQLKEFIALCLDEDPQERLSAEELLKTKFIKTHKATPTTILKELISRYLLFRDKNKSYKDSAYLADDIPNAKAELTNEEKRRLSSDSSDGKEELSEIDVKWDFDSLSSNDYIIDNNIQMDAIPQDSGPDWPINQVDHFNFAYPEEDQYYMYHTNNNIQKTYQGTTIGKGNVGTIVHNSTLNAPISHTTTQFGNKATGTASNITGSHSNPSNASKRLETKALKQLLQLFEDNEVISEETDISTELPVLAKNSSSLHIKTNFNGGVSEDTMGSASSEARKYPGVLTGSSYYSQSSPMVPVTSHKYQQGNGPMSSTLTAAPTSIEIEIPEELPTSTSTLQSQETSSGPTKPRSSTVSNPQLSFKQQNGVSRRLTVGAGANRNDNQVQSSLSTLKQNITEDNQKENPKQSSTVNNQSNGQLSSATKSHHRTPSPSRLFANGSSPNKPLNISPTMSTASHLGGSSAPPMMKPMSNTVDRKDDTPSFSSPMGIVGKPSMNNSPSDGKSGVVLDKNGAAIPFTPLGNSSSRVNGEFRRMNPNLKLQMPLPTNAGARNKLLENSVTTSTPSNLGVNTAAAATAPASTNDSINQFGFNTSVTSALPVSMTPINEKSMDFNAKIKRSHSTSKRKNSLTLDQGVSSANLSASSINIGGGGSSNSSLQVNQENQPQLTPNSVLSDGASMNSGNTGTTITASMNSNSTAVNLNSSNVSASALSVKTVTTQPNSNTVTAAGTPVTGGNPIAITAPNVSAPTATAATANNGSNESVLADLPVMQAPPKQLQMDIFLDRNVYSTTNKMMDKKPQVLYELEKMLKMYEQGFPALEHALKSQLEKITAEDK

SEQ ID NO: 62098 - protein, 172 aa, Phaseolus vulgaris
HVYKGYTDGGSTPVAIKRLKPGSQQGAHEFMNEIEMLSQLRHLHLVSLIGFCNEMNEMILVYDFMARGTLRDHLYNTDNPAIPWKQRLQICIGAARGLHYLHTGAKHTIIHRDVKTTNILLDDKWVAKVSDFGLSRIGPTGMDKAHVSTVVKGSMGYLDPEYYKRQRLTEKS

SEQ ID NO: 62099 - protein, 403 aa, Arabidopsis thaliana
MDHLSNLPDELLCHIMSFLTTKEAALISVLSKRWRNLIAFVPNLDIFDCDILHWEVRKEERDDIRQLFMDFVDRVLALQGNSPLKKFSLCCGGGSYSDRVDCWIQNVMVRGVSELDLSMIFDTSYHMYPQVFENKKLNFEIFLRALPALEELVMNHIYWKELDVNVHVSVSSASLKTLTIKCIVCLHTKSFDTPSLAYLSYSDYAMGDYPVAKMENLFEARISLFVPEDDISRLMNSIRNVRYLYFSRDTLEVLSLCCESMPVFKNLKSLSIKSVESRGWQAMPVLLRNCPHLETLVLEALLHHVTDKCGDACACVSREEKGRSLKSCPVKVLEIKEFQGTMKEMHMIKHFLDYLPCLKEMKISYMKKNDHTTQFRVIPQVIAEMVEHYNKLSNCNVQLVVSG

SEQ ID NO: 62100 - protein, 214 aa, Zea mays
  misc_feature (177)..(177): Xaa can be any naturally occurring amino acid
  misc_feature (202)..(202): Xaa can be any naturally occurring amino acid
MSSMQFSSVLPLEGKACVSPVRREGSACERLKVGDSSSIRHDRASRRMCNGGRGPAATGAQCVLTSDASPADTLVLRTSFRRNYADPNEVAAVILGGGTGTQLFPLTSTRATPAVPIGGCYRLIDIPMSNCFNSGINKIFVMTQFNSASLNRHIHRTYLGGGINFTDGSVEVLAATXMPGEAAGWFRGTADAVRKLSVCLRXYYKNKSIEHILI

SEQ ID NO: 62101 - protein, 152 aa, Streptomyces antibioticus
AGRIVFKLFDDVVPKTAQNFRELATGQHGFGYAGSPFHRVIPNFMLQGGDFQPRVNGTGGKSIYGEKFADENFKLKHDRPFLLSMANAGRNTNGSQFFITTVVTDWLDGKHVVFGEVVEGPGTWSRRSQSYGSSPAGTTSASIKVAESGALN

SEQ ID NO: 62102 - protein, 463 aa, Ralstonia eutropha JMP134
MERVPRSRGKGGKPMRTRKADFVVIGGGSAGVACARRAASHGASVVLIERDEIGGTCVNRGCVPKKMLSYGATWAAILSGCLSHTGGHEDWRDAIVRVNAEVARLNVVYAQRLLEAGVDILRGDAVVTAPDEVRVGDEVIRAKRILIATGARPKTLDIPGGELASNSDDVFTWQTVPGSIAVIGGGYIGVEQASILSRYGVKVDLLVAGDRLLPHFDAEIAEALAGALETKGVRLHLNASVNLISQANGALEVCYRPGNKPGQTESIRAQAALVAVGRVSNVDGLGLDAIGVKLGDKGGIKVDRQFRSSVRSIHAIGDAIEGLHLTPVATSQGRWLADRLFGRRGERADFDFVPTAVFCEPAIGAVGLTEAQAIEEAGKPERIRTVVKRFVSLENRFGGNGMQSVFKLVLNARTGRVLGVHLMDNAAPEIVQAMAVALRLGVRESHLETTLQLHPTVAEELFG

SEQ ID NO: 62103 - protein, 388 aa, Xanthomonas campestris pv. vesicatoria str. 85-10
MIRTGTMPLTTKLPKVGTTIFTVMSQLAAEHGAVNLGQGFPDFAVPQRLVDELSKAMAAGHNQYPPMTGVAALRQAIAGKAQRCYGAQVDADTEITVTSGATEAIFNAIHAVVRAGEEVIVLDPAYDCYEPAIDLAGARAVHVALHPQTFAVDWAALRAAITPKTRLLMINSPHNPSGAMLSAEDMQTLTELLRGTDIFLLSDEVYEHIVFDGRRHESVLRWPELRERALVISSFGKTYHCTGWKIGYAIAPPALTAEFRKVHQYNTFTSFGPAQHAFAAMIRDEPEHDEQLGAFYQAKRDHFRERLLTTRLKPLPVPGGYFQLVDYSAISDLPDTEFVKWLTIEKGVAAIPLSPFYQNAPAGQRLARLCFAKNDATLDAAIERLRRL

SEQ ID NO: 62104 - protein, 514 aa, Geobacillus kaustophilus HTA426
MNVTTRLAQIAKQLPDKEAYVFMKERCTYQQLDEAISRFADGLARLGVRRGDHIALLLGNSPQFVIGLYGALRLGATVIPINPIYTPEEISYILHNGDVKAVIGLDLLAPLFVEAKKRLPLLEHAIVCETPEGKEKGVSLSEGMKSFAEVLADGSQDFTGPELGDDDVAVILYTSGTTGKPKGAMLTHKNIYSNAQDTADYLGINENDRVIAALPMFHVFCLTVALNAPLMNGGTVLIMPKFSPAKLFQLAREEKATIFAGVPTMYNFLYQYEGGSADDLRTLRLCISGGASMPVALLENFEKKFNVIISEGYGLSEASPVTCFNPLDRPRKPGSIGTNIKNVENKVVNEYGEEVPVGEVGELVVRGPNVMKGYYKMPEETSAALRDGWLHTGDLARMDEDGYFYIVDRKKEMIIVGGYNVYPREVEEVLYSHPDVVEAAVIGVPDPDYGEAVRAYVVAKNPELTEAELIAYCRERLAKYKVPSAIDFLDELPKNATGKILRRALKERLASSHA

SEQ ID NO: 62105 - protein, 768 aa, Zea mays
MEINEEAMAAHKRAFLDFLDQDVGKGVYMQAVRDMVQNKRHRLIIGMDDLRNHNLDLARRVIRTPGEYMQPASDAVSEVARNLDPKFLKEGERVMVGFSGPFGFHRVTPRDLMSSFIGTMVCVEGIVTKCSLVRPKVVKSVHFCPVTGDFLSREYRDITSFVGLPTGSVYPTRDDNGNLLVTEYGMCEYKDHQTLSMQEVPENSAPGQLPRTVDVIVEDDLVDCCKPGDRVSIVGVYKALPGKSKGSVSGVFRTVLIANNVSLLNKEANAPVYTREDLKRMKEISRRNDTFDLLGNSLAPSIYGHLWIKKAVVLLMLGGVEKNLKNGTHLRGDINMMMVGDPSVAKSQLLRAVMNIAPLAISTTGRGSSGVGLTAAVTSDQETGERRLEAGAMVLADRGVVCIDEFDKMNDQDRVAIHEVMEQQTVTIAKAGIHASLNARCSVIAAANPIYGTYDRSLTPTKNIGLPDSLLSRFDLLFIVLDQMDPEIDRQISEHVARMHRYCTDDGGARSLDKEGYAEEDDGDANAAIFVKYDRMLHGQDRRRGKKSKQDRLTVKFLKKYIHYAKNLIQPRLTDEASDHIATSYAELRDGSANAKSGGGTLPITARTLETIIRLSTAHAKMKLRHEVLKSDVEAALQVLNFAIYHKELTEMEEREQREMEMKQQADHDAGATGGTVDGHGSSGNDPMDVDVGSNDQNVSAERIQAFEALLGQHVLANHIDQMSIDEIEQMVNRESTAPYTRSQVEFILERMQDANRVMIRDGVVRII

SEQ ID NO: 62106 - protein, 463 aa, Oryza sativa (indica cultivar-group)
MSTPGAAWSRNGSRTLDAVATAPGRTLGVGAAAATPSFGRGSFGHAIGLPPPPRSRGRGRGSVAAATTIPAFSIDGSVGGDFTSSIGPHASSQPWFDAAGGDPSSPGSWDQDVRPPGGFMSYFGNEAHNSHLVGAVIHMSPLNQAHNGSSPPEVEILHGNDSVRTEKRIMWTPDEDVRVMSAWLEHSTDSTCGADKGGVQYWGEVVETYNKTTPPLRRRNAKQCKDRWHKINKWIDLFECAYAKARRVFTSGYSAEMWLDAAHKFYVDDNKECKDVVGPYMLTEVWKICRDVPKWKTYNENLKNARKRKAFHLEGESEENEDTCDEMPQRPIGQKAAKKAALAAKNGKLKGSSSSDDGHSKDSPIELDKFDRYSKFQEANNEKRMKLLDRQEKIASEKLEATKIAHLTAQEYIEGKKLDKETKMMETYNNLVSQDTSSMSDEEKAQRAMMMKCLMKALFPETA

SEQ ID NO: 62107 - protein, 459 aa, Pneumocystis carinii
MNAARRVTRQTATFNLNDENKLHGQISRVKQVSTQGLEGVNKPWTAATRKRAALGDVSNVHNKENQTAKTKTQPLSTKARVVTKTGVQSHQSKESVHTVPTGELRGEETTRKRRTSKVLTEQEVIIEVEQTQASKKVRTDGLLNGSVQEHPASQDWDDLDADDAHDPLMVSEYVEEIMGYMRELEVLTLPLPDYMDRQKELQWKMRGILVDWLIEVHAKFRLLPETLFLSVNIIDRFLSLRVCSLPKLQLVGITALFIAAKYEEVMCPSIQNFMYMADGGYTNEEILKAEQYVLQVLGYDMSYPNPINFLRRVSKADNYDIQTRTVAKYLMEISLLDHRFLPFVPSNIAASGIYLARIMVTGGNWNANLIHYSGYKESDLVPCSKMMLDYLSRSVIKHEAFFKKYASKKFMKASLFVRDWVKKHYDLEANVRLNTISFDYDNHESNEIHQDLEEEEGSL

SEQ ID NO: 62108 - protein, 176 aa, Carica papaya
LGRCIRAILDGLDVAIKRISKDSKQGRKEYVSEVKIINRLRHRNLVCLIGWCHARGEFLLVYEFMPNGNLNSHLYRSENPLGWPARHKIALGLASALFYLHEECEPYVVHRDVKPSNVMLDSAFNAKLGDFGLARLVDHDCGLRTTNLAGTLPYMAPEYLRNGTASKESDIYSYGM

SEQ ID NO: 62109 - protein, 259 aa, Zea mays
MAAAAAWTGAASPNSLLLSRSPPHAAVLAPSPGSSMRRRLLLGVGTPAVAALAAAAPPAVLQDGAVTVLITAGAYSLVRVFDELTERRLIEKSLSRKVVHVLSGVLFMSSWPLFRELLRGPLYYVLVLLFSVLVFWRESPIGIVSLSMMSGGDGFADIVGRRYGSAKLPFNRKKSWAGSISMFISGFLLSAMMMLYFSSLGYIDVIWEEALGKLALVALAATVVECVPVTEVVDDHISVPLATMLVAFLLFSSNRTIVN

SEQ ID NO: 62110 - protein, 170 aa, Phaseolus vulgaris
NVYKGVLKNGMTVAVKRSQPGSGQGLPEFQTEIMVLSKIRHRHLVSLIGYCDERLEMILVYEYMEKGTLRDHLYNTKFPTLSWKARLQICIDSARGLHYLHKGAAGGIIHRDVKSTNILLDENHVAKVADFGLSRSGPLGTESYVTTGVKGTFGYLDLEYFRSQHLTEKS

SEQ ID NO: 62111 - protein, 206 aa, Oryza sativa (indica cultivar-group)
MERLSAWLNNSNDPINGNSKKGPHYWKQVAEEYNTYAPKGKKRTAMQCKNHWNSISTLVAKFHGCCSELSKTYQSGHSDQQLMELVHEEYKKVKGTNKPFAFEYWWRVELTLLLQTETLMKQLMLNTVDHKDRRQQKSSGRGRGKGSWGRVGYQMKVWDNSIICKSKKSEAIKKMAHAASEHAQAIAIQAEADKEKAKMEKNQAVQ

SEQ ID NO: 62112 - protein, 115 aa, Kluyveromyces lactis NRRL Y-1140
ESSNKHIYNNQTMSGRGKGGKGLGKGGAKRHRKILRDNIQGITKPAIRRLARRGGVKRISGLIYEEVRNVLKTFLESVIRDAVTYTEHAKRKTVTSLDVVYALKRQGRTLYGFGG

SEQ ID NO: 62113 - protein, 597 aa, Coccidioides immitis RS
MDAPTSVPAVPASQDQSTQGSPSTLPTTAPDTPSPSISDNPKPQSDSTTTGEDRRNKRKDLGRKAWSRQPLDRRRRNEEQAAKRRKAEDGEDIPIYATQFSKEDIEADKRRPKRKVAVLLGYSGTGYHGMQMSAKEKTIEGEIFPALVAAGAISKANAMDPKKSSFVRCARTDKGVHAAGNVISLKLIIEDPDLVNKVNNILSPQIRIWGIEPTNKGFSCYQFCDSRIYEYLIPTHCFLPPHPSTFLAKKLLEAAEKEGDIGDYKKRQEEVLSYWEDVDHEYIRPILSTLPESTRLKVQESLCIKDRSQSIQNAEGKEELDCSSDINAVKDEKEGGNLTPGNSDSEDQKINEVIKTVRAAYFKAKKAYRIHPARLARVQEVLDLYIGTRNFHNYTIQKTFRDASARRVIKSFNISKDPIIIDGTEWLSLKVHGQSFMMHQIRKMVAMAALVVRCGTDPQRITQSYGPQKIPIPKAPGLGLLLERPIFDTYNKKATNELDKNPIEFGKYEKEIEEFKNREIYQRIFREEEETNAFGNFFNHIDTFREDSFLYVTSSGIPAAPEGATPSTTETGKDKEALAEVESESEDEVVNGGEEGG

SEQ ID NO: 62114 - protein, 380 aa, Populus trichocarpa x Populus deltoides
NSLSINKERKISLKMAAMKSYSMCSRESDLHFPHHNCVDNYKRRSGKWRPPQAAVKPNLHLPMRSFEVKNMTSAEDMKSLRLITAIKTPYLPDGRFDLEAYDALVNMQIANGAEGVVVGGTTGEGQLMSRDEHIMLIGHTVNCFGSSIKVIGNTGSNSTREAIHATEQGFAVGMHAALHINPYYGKTSVEGMVSHFDSVLPMGPTIIYNVPGRTGQDIPPRVIHTIAQSPNLAGVKECAGNDRVEQYTDKGIVVWSGNDDQCHDARWNHGATGVVSVTSNLVPGLMRRLMFEGNNTELNSKLLPLIDWLFQDRNPIALNTALAQLGVVRPVFRLPYVPLPSAQRVEFVNLVKKIGRENFVGEEDVQVLEDDDFILIARLC

SEQ ID NO: 62115 - protein, 131 aa, Streptomyces antibioticus
SAGRIVFKLFDDVVPKTAMNFRELATGQHGFGYAGSPFHRVIPNFMLQGGDFTQGNGTGGKSIYGEKFADENFKLKHDRPFLLSMANAGRNTNGSQFFITTVVTDWLDGKHVVFGEVRRGARDLVKKVEST

SEQ ID NO: 62116 - protein, 309 aa, Bacillus licheniformis ATCC 14580
MNCRHNKELEYFVTEAKKVTDKGKVASYIPALAELSEDDLSAAVYFTDGTCISAGDVEKAFTLQSISKVLSLALVLIDHGPEKVFHYVGQEPTGDPFNSIIKLETVNPGKPLNPMINAGALVVTSMIKGETNADKIGRLLDFIKKLANNRSITVCGKVAESEFETSMVNRAMCYYMKEHGIFQAEVEDVMDVYTKQCAIEMNSLDLAKIGSVFALNGKHPETGEQIIPKDIARICKTFMVTCGMYNASGEFAIKIGIPAKSGVSGGIMGLSPYRFGIGIFGPSLDEKGNSIAGIRLLELLSANYSLSIF

SEQ ID NO: 62117 - protein, 479 aa, Lotus japonicus
MASAGLYRRVLPSPPAIDFASPEGKKIFVEALGQGTMEGFFKLVSYYQTQSEPAYCGLATLTVVLNALSIDPGRKWKGPWRWFDDSMLDCCEPLEKIKVQGITFGKVACLARCNGAHVEAFRSNESTVSDFRDRVISCCSSEDRHLIVSYHRSGLKQTGEGHFSPIGGYHAERDMVLILDVTRYKYPPHWVPLTLLWDAMNTIDRATGLQRGYMIISKLKRAPSILYTVSCRHEGWSSVAKFLTENVPLLLKSEDLKDIQEVLSVVFKSPPSELREFITWIAEVRRQEDGNLTLSEEEKGRLAIKADILEQIRTTTLFKHVTSWLDSQRSRCRTIAKLQDRDMLPELAAGVCCQGACLLTGCCLPGGKCCSQIDVKHLNVDHKNIVTLVSGTVASGSSSEQGVDVLVPLCQMGPEGHCIGMHPSTADVLTVLLLALPLHTWSGIKEEKLCAEVTSLLTTENLPPLLQEEVRFSLETVLF

SEQ ID NO: 62118 - protein, 439 aa, Thraustochytrium sp. ATCC21685
MGKGSEGRSAAREMTAEANGDKRKTILIEGVLYDATNFKHPGGSIINFLTEGEAGVDATQAYREFHQRSGKADKYLKSLPKLDASKVESRFSAKEQARRDAMTRDYAAFREELVAEGYFDPSIPHMIYRVVEIVALFALSFWLMSKASPTSLVLGVVMNGIAQGRCGWVMHEMGHGSFTGVIWLDDRMCEFFYGVGCGMSGHYWKNQHSKHHAAPNRLEHDVDLNTLPLVAFNERVVRKVKPGSLLALWLRVQAYLFAPVSCLLIGLGWTLYLHPRYMLRTKRHMEFVWIFARYIGWFSLMGALGYSPGTSVGMYLCSFGLGCIYIFLQFAVSHTHLPVTNPEDQLHWLEYAADHTVNISTKSWLVTWWMSNLNFQIEHHLFPTAPQFRFKEISPRVEALFKRHNLPYYDLPYTSAVSTTFANLYSVGHSVGADTKKQD

SEQ ID NO: 62119 - protein, 417 aa, Bacteroides fragilis YCH46
MKNIFKDLKSKDHKRYLGGLDVFRYIGPGLLVTVGFIDPGNWASNFAAGSEFGYSLLWVVTLSTIMLIILQHNVAHLGIVTGLCLSEAATQYTPKWVSRPILGTAVLASISTSLAEILGGAIALEMLLDIPIVWGAVLTTVFVSIMLFTNSYKKIERSIIAFVSVIGLSFIYELFLVDIDWPMAVEGWVTPAIPKGSMLIIMSVLGAVVMPHNLFLHSEVIQSHEYNKQDTASIKKVLKYELFDTLFSMIIGWAINSAMILLAAATFFKSGIQVEELQQAKSLLEPLLGSNAAIVFALALLMAGISSTITSGMAAGSIFAGIFGESYHIKDSHSQVGVILSLGIALLLIFFIGDPFKGLIISQMVLSIQLPFTVFLQVGLTSSRKVMGDYVNSKWSTFVLYTIAVIVTVLNIMLLFS

SEQ ID NO: 62120 - protein, 820 aa, Bacteroides fragilis YCH46
MNISYNWLKEYVNFDLTPDEVAAALTSIGLETGGVEEVQTIKGGLEGLVIGEVLTCVEHPNSDHLHITTVNLGNGEPTQIVCGAPNVAAGQKVVVATLGTKLYDGDECFTIKKSKIRGVESIGMICAEDEIGIGTSHDGIIVLPEDAVPGTLAKDYYNVKSDYVLEVDITPNRADACSHYGVARDLYAYLVQNGKQAALTRPSVDAFAVENHDLDIKVTVENSEACPRYAGVTVKGVTVKESPEWLQNKLRIIGLRPINNVVDITNYIVHAFGQPLHCFDANKIKGGEVIVKTMPEGTTFVTLDGVERKLNERDLMICNKEDAMCIAGVFGGLDSGSTEATTDVFLESAYFHPTWVRKTARRHGLNTDASFRFERGIDPNITIYCLKLAAMMVKELAGGTISSEIKDVCAAPAQDFIVELTYEKVHSLIGKVIPAETIKSIVTSLEMKIMDETAEGLTLAVPPYRVDVQRDCDVIEDILRIYGYNNVEIPSTLKSSLTTKGDCDKSNKLQNLVAEQLVGCGFNEILNNSLTRAAYYDGLESYPSKNLVMLLNPLSADLNCMRQTLLFGGLESIAHNANRKNADLKFFEFGNCYHFDAEKKNPEKVLAPYSEDYHLGLWVTGKMVSNSWAHADENTSVYELKAYVENIFKRLGLDLHSLVVGNLSDDIYSTALTVNTKGGKRLATFGVVTKKMLKAFDVDNEVYYADLNWKELMKAIRSVKVSYKEISKFPAVKRDLALLLDKKVQFAEIEKIAYETEKKLLKEVSLFDVYEGKNLEAGKKSYAVSFLLQDESQTLNDKMIDKIMSKLVKNLEDKLGAKLR

SEQ ID NO: 62121 - protein, 1182 aa, Glycine max
  misc_feature (882)..(882): Xaa can be any naturally occurring amino acid
MAVGVELPEGRSGGGGGIVMEFPAGDEESFSSPTRLPKRLRRRLRDAECKSPSTVEEIEAKLHNADLRRQKYYEKLSNKARAKPRSPSRCSSQEEDLGQRLEAKLQAAEQKRLSILTKAQMRLARLDELRQAAKTGVEMRYENERMRLGTKVESRVQQAEANRMLILKALRQRRASHRERSSQTLMRRMARENKYKECVRAAIHQKRTAAETKRLGLLEAEKNRAHARVSQVIHVAKSVSHQREIERRKKKDELEDRLQRARRQRAEYLRQRGRLRGYAQENRNWMPKQAEYLSRNLARCWRRFLRQKRTTFTLTKAYDVLGINEKSVKSMPFEQLALLIESASTLQTVKTLLDRFESRLKVSTAVAPAKNLSSLDNIDHLLKRVASPKKRATPRSSVRSRQAKKVDSVRESNNSLARLSRYPVRVVLCAYMILGHPDAVFSGMGECENTLAKSAQEFVQMFELLIKIILDGPIQSSDEESVSVSMKLCTFRSQLAAFDKAWCSYLNCFVVWKVKDARSLEEDLVRAACQLEASMIQTCKLTPEGAGGKLSHDMKAIQHQVSEDQKLLREKVLHLSGDAGIERMESALSETRSRYFGVKDDGSPVGSPMIPSMPASPTPLSTAASSSERNISDESNDRASRVVRSLFKETNTSPGESSFSAPRTSSDSQLGTSSEKLLAENEVLVNEFLHEHHYSVTDEFDVSDHIQNSVEGKIKQTMEKAFWDGIMESVEVDHPNYDRIVQLMGEVRDEICEMAPKSWKEDIFAAIDLEILLQVLKSGNLDIDYLAKILEFSLVSLQKLSAPANEEMMKAAHKKLFHELSEICHSRDESNNSCVVALVKGLQFVFGQIQILKKEISKARIRLMESLVKGSAGLDYLRNAFXNKYGSPSDANTSLPSTLRWISSVWNCKDQEWEEHVSSSSALASNSSQEWLPSTTLRTGGSILLKTTGSPMAFSPDSANAKGDQQPECKGEQLDLGVRLGLLKLVSGISGLTQDDLPETLSLNFPRLRSVQAQIQKIIVISTSILIRGQVLLSEKAVANPADMENLLSKCAAQLLDLLNRVEDADIEDIVEVLCNFPTVEVEDTGKLESRKVVAASMLGKSLQAGDVVFERVFNAVYSALRGVVLGGSGIRGRKLAEMALMKVGAGILTDKVVETAGVLIVAATISVSVHGPWYKHLTDNL

SEQ ID NO: 62122 - protein, 435 aa, Helicobacter hepaticus ATCC 51449
MDILQSINDFNEAKQVIPGGVNSPVRAFGSVGGTPRFIAKGKGAYIYDEDDNEYIDFVQSWGPLIFGHANEVIESALSLAIKDGLSFGAPTEKETTLVKQIIALSGSAEKMRLVNSGTEATMSALRLARAYSNKDDIIKFEGCYHGHSDSLLVSAGSGCATFGTPSSPGVPNDITKHTLVARYNDIESVRACFEQSKNVACVIIEALAGNMGFVPADKKFMQDLRALCDEYNALLIIDEVMSGFRAGLKGAIGLYDVQADLVTYGKVIGGGMPLAAFGGRADIMDMLSPVGGVYQAGTLSGNPIAVSAGLATLLQIKANPTLYEHLEVLAKRLIKGLKEAAQSYEIPLQVDCRGSMFGFFFNQKEVKNFDDAKCSDTAMFARFHQKMLDKGVYFACSQFETGFICSAMNEMIIDEVIMKAKAVFGEITHEIESRI

SEQ ID NO: 62123 - protein, 145 aa, Brassica napus
YNDLSSLLLNTNDDAIRSLFTSRSENEFQIATLAIFFFFVYFLGIITYGIAIPSGLFIPVILAGASYGRLVGRLLGPVSQLDVGLFSLLGAASFLGGTMRMTVSLCVILLELTNNLLMLPLVMLVLLISKTVADCFNKGVYDQIV

SEQ ID NO: 62124 - protein, 867 aa, Zea mays
MLSGIIDGLTGANKHARLKGTVVLMRKNVLDLNDFGATVVDSISEFLGKGVTCQLISSTLVDANNGNRGRVGAEANLEQWLTSLPSLTTGESKFGVTFDWEVEKLGVPGAVVVKNNHAAEFFLKTITLDDVPGRGAVTFVANSWVYPAGKYRYNRVFFSNDTYLPSQMPAALKPYRDDELRNLRGDDQQGPYQEHDRVYRYDVYNDLGEPDGGNPRPILGGSADHPYPRRCRTGRKPTKTDPNSDSRLSLVEQIYVPRDERFGHLKMSDFLGYSIKAITQGIIPAVRTYVDTTPGEFDSFQDIINLYEGGIKLPKIQALEDMRKLFPLQLVKDLLPAGGDYLLKLPIPQIIQGTSQDKNAWRTDEEFAREVLAGVNPMVITRLTEFPPKSTLDPSKYGDHTSTITAEHIEKNLEGLTVQQALDGNRLYILDHHDRFMPFLIDVNNLEGNFIYATRTLFFLRGDGRLAPLAIELSEPYIDGDLTVAKSKVYTPASSGVEAWVWQLAKAYVAVNDSGWHQLVSHWLNTHAVMEPFVIATNRQLSVTHPVHKLLSSHFRDTMTINALARQTLINGGGIFEMTVFPGKYALGMSSVVYKSWNFTEQGLPADLVKRGVAVADPSSPYKVRLLIEDYPYASDGLAIWHAIEQWVGEYLAIYYPDDGALRGDEELQAWWKEVREVGHGDHKDAPWWPKMQAVSELASACTTIIWIASALHAAVNFGQYPYAGYLPNRPTVSRRRMPEPGSKEYEELERDPERGFIHTITSQIQTIIGISLIEILSKHSSDEVYLGQRDTPEWTSDARALAAFKRFSDALVKIEGKVVGENRDPQLRNRNGPAEFPYMLLYPNTSDHSGAAAGLTAKGIPNSISI

SEQ ID NO: 62125 - protein, 329 aa, Streptomyces coelicolor A3(2)
MKAAVIESVGRAVVTEVPDPTPGPREVVVEVAACGLCGTDLHILQGEFAPKLPIVPGHEFAGAVVGVGAQVTEVAVGDQVAVDPSLYCYECRYCRTGHNNLCERWAAIGVTTAGGAAQYAVAPVANCVKLPEHVRTQDAALIEPLSCAVRGYDVLQSRLGAHVLIYGSGTMGLMMLELAKRTGAASVDMVDLNPARLETARGLGVSASAATPDELDRPQGWDLVIDATGNAAAIQDGLDRVAKAGTFLQFGVADYATRVQIDPYRIYNQEITITGSMAVLHSYERAAELFANGVLDPDVFISDRIELARYPQALEQFAAGVGRKIVVVP

SEQ ID NO: 62126 - protein, 129 aa, Glycine max
MAMSWTRALKHGVITRDAAQLVGIRGFAAQAKGKKGGKGGAADAKPVLSKEMKSTTVFGANILKEGSDPKIQPDSEYPDWLWHLVDKRPVLSELRRKDAKTLPYEDLKRFVKLDNRARIKENNALTAKN

SEQ ID NO: 62127 - protein, 406 aa, Brassica napus
MGILNDDAVLIEPGKNSGDPTMVTVNCPDESGLGSTLCRIILEFGLSITKADFSTDGRWCYIVFWVSPDNGSSRFDWDSLKNRLLSACPSCLGSYYSSLQSSNVSKPPSLYLLKFFCRDRKGLLHDVTKVLTELEFTIQRVKVTTTPDGRVLDMFFITDAMDLLHTKQRQTKTCDHLTAVLGEHGVSCEIELAGPELESLQRFSALPPEAADELFGSDVTSISNKVVLTVDNHLSPAHTLLHINCIDQKGLFYDILRTSKDCDVHIAYGRFSSKVKGYRNLDLFVRGTDGKKIADPKHQDSFCSRLKEEISCPLRVIIANRGPDSELLVANPVELSGKGRPRVFYDVTLALKSLGICIFSAEIGRHSSLDRQWEVYRFLLEERREFPLDRARNQIVERVTKTLMGW

SEQ ID NO: 62128 - protein, 372 aa, Nicotiana tabacum
MRPLQPPPPAAAATTSSSTTASPMPPPPSRNRPRRRTDLTLPLPQRDPALAVPLPLPPTSAPSSSSSSSSSPLPTPLNFSELERINRIGSGAGGTVYKVLHRPTGRLYALKVIYGNHEDSVRLQMCREIEILRDVDNPNVVRCHDMFDHNGEIQVLLEFMDKGSLEGIHIPKESALSDLTRQVLSGLYYLHRRKIVHRDIKPSNLLINSRREVKIADFGVSRVLAQTMDPCNSSVGTIAYMSPERINTDLNHGQYDGYAGDIWSLGVSILEFYLGRFPFSVGRSGDWASLMCAICMSHGTAPANASREFRDFIACCLQRDPARRWTAVQLLRHPFITQNSPAATTTGNMMPLPNQVHQPAHQLLPPPPHFSS

SEQ ID NO: 62129 - protein, 103 aa, Coxiella burnetii RSA 493
MSQNKIYVGSLSYDVTADELQSFFGQYGEIEEAKLIMDRETGRSKGFAFITYGTQDAAQEAVSKANGIDLQGRKIRVNIARENTGDRRRDGGSGGRGGRGGRF

SEQ ID NO: 62130 - protein, 301 aa, Clostridium difficile 630
MKYKGIICAMITPFDENQNINSQATCQLIDYLIEKGIYGLFILGTNGECHVLTDDEKVEFAKIVINHTNNRVPVFVGTGGNSTREVVDLSKRMEAIGASALSIITPYFVTPTQQELILHYKTIANSVNLPIIMYNMPGKTGINIEPESVRELSKIKNIVGIKDSSGKLDNMKAYIEATKNENFSVFSGSDSLILDSLKAGSQGAVAATTNFLTEIGISIYENFMKGDLEEAQKAQSSIEELRRILKLGTIPSVMKKTIVLNGINVGTARLPVTEPTGEVLEEIKRVVENYRTILNKSSENR

SEQ ID NO: 62131 - protein, 207 aa, Clostridium difficile 630
MISRRIHLMENTLSEFLDNISNELSEFIASIDETSINKACELILEAEKNHGRVHVTGIGKPGHVSGYISSLLSSTGTSAYILHGTEAVHGSSGQVVEGDVVIAISNSGETQELKATLKTLKVNGAKIIGVSGNESSFLKNISDIFLFAGVKQEGDCLNKAPRASILAETIILQSLSVVLQYAKGLNTQQYLKWHPAGSLGKSIREGI

SEQ ID NO: 62132 - protein, 531 aa, Geobacillus kaustophilus HTA426
MNAPLVLHHFFDRAVALYGDKTAMICSGRTVTYRELGERVSRLANGLRGLGVRKGDRVAYLAPNTLEMLEGFYGVFEVGGVMVPLNTRLKPDDYVFILNHSETKVLFVDQELYGLIAPVKNKLETVEEIIVHHKTEAAIDETAYEEWLAAQSSAPVPRPMIDENDICSLLYTSGTTGNPKGVMLTHRNNYLHALVTMHHLRVSDRDTYLHVLPMFHVNGWGAPFYYTANGATQIGLRKVDPKVIFDLVKEHQVTVMHMAPTVLNMLLQYYEQYQPDVPEGVRVVIAGSAPPPAFVARVEEKLGWEFIQVYGMTESSPLSTISLIRPQLDGLPVEQKQRLKAKAGYPMIGCEVKVVDENGEEVPKNGRAIGEVIVRSHGVMKGYWKNEEATAATIRDGWLYTGDMATVDEYGHIDIVDRKKDIIISGGENISSIEVEGALYEHPAVLEAAVIAVPHEKWGETPHAFVVVRPGHTVSEEELIAFSREKLAHFKAITGVTFVDELPKTASGKIQKVHLRRQYWDAIGKSGRYVN

SEQ ID NO: 62133 - protein, 279 aa, Zea mays
MAARLRRSPISSPPPPPSLCISLYPPPHSSVETTYPACSTYLRSPAMTVLDAESRFHVLAVDDSIIDRKLIEMLLKSSSYQVTTVDSGNKALELLGLRDNGAEDASPPSSSSSSSSSSSPDHQEIDVSLIITDYCMPGMTGYDLLKRVKGSSSLKDIPVVIMSSENVPARISRCLQDGAEEFFLKPVKPADMKKLKSHLLKRKQPNQKNKPQAQAVESPEQQLDPHPQPVHEPEEAAADRNGVNKRKAAAMEEGLTVVVTAPESTKPRRLSTSSLTVET

SEQ ID NO: 62134 - protein, 173 aa, Flaveria bidentis
MASIPATFATVAQANMVAPFTGLKANAAFPVTKKVNGFSTLPSNGGRVQCMKVWPPVGKKKYETLSYLPELTEAQLAKEIDYLIRNKWVPCLEFELEHGFVYRENARSPGYYDGRYWTMWKLPMFGCTDSAQVMKELQECKKEYPQAWIRIIGFDNVRQVQCVSFIASKPTGF

SEQ ID NO: 62135 - protein, 237 aa, Caulobacter crescentus CB15
MPTLVLLRHGQSQWNLENRFTGWVDVDLTAEGEAQARKGGELIAAAGIEIDRLFTSVQTRAIRTGNLALDAAKQSFVPVTKDWRLNERHYGGLTGLNKAETAEKHGVEQVTIWRRSYDIPPPELAPGGEYDFSKDRRYKGASLPSTESLATTLVRVLPYWESDIAPHLKAGETVLIAAHGNSLRAIVKHLFNVPDDQIVGVEIPTGNPLVIDLDAALKPTGARYLDDSRAEALPKVG

SEQ ID NO: 62136 - protein, 318 aa, Caulobacter crescentus CB15
MSAFNAVQVGRRVLAVEADALRVLADSLGEAFANAVETIFNAKGRVVCTGMGKSGHVARKIAATLASTGTQAMFVHPAEASHGDLGMIGPDDVVLALSKSGAGRELADTLAYAKRFSIPLIAMTAVADSPLGQAGDILLLLPDAPEGTAEVNAPTTSTTLQIALGDAIAVALLERRGFTASDFRVFHPGGKLGAMLRTVGDLMHGADELPLVAADAAMPDALLVMSEKRFGAVGVVDNAGHLAGLITDGDLRRHMDGLLTHTAGEVMTHAPLTIGPGALAAEALKVMNERRITVLFVVERERPVGILHVHDLLRAGVI

SEQ ID NO: 62137 - protein, 173 aa, Flaveria bidentis
MASIPATVAAVPQTNMVAPFTGLKANAAFPVTKKVNGFSTLPSNGGRVQCMKVWPPVGKKKYETLSYLPELTEAQLAKEVDYLIRNKWVPCLEFELEHGFVYRENASSPGYYDGRYWTMWKLPMFGCTDSAQVMKELQECKKEYPQAWIRIIGFDNVRQVQCVSFIASKPTGF

SEQ ID NO: 62138 - protein, 763 aa, Oryza sativa (indica cultivar-group)
MRGAVLVAVAAAIGNYLQGWDNATIAGAVLYIKREFALETQPAVEGLVVAMSLIGATIITTFSGPVSDLVGRRPMLIASSLLYFAGGLIMLWSPNVYVLLLARLVDGFGVGLAVTLVPVYISETSPPEIRGRLNTLPQFTGSGGMFMSYCMIFAMTLSPSPNWRIMLGVLFVPSLLYLFVTVFYLPESPRWLVSKGRMKEARVVLEMLRGREDVSGEMALLVEGLGTGGDTEIEDYVVGPSEGDAGENEQARDTVTLYGPEQGLSWVAQPVAGGRGSMLGSSLGLQASRHGSMYEQMKDPVVALLGSVHERLPESGGGATGSMRGSTLFPNLGSMLSVNDRPGGSSWDEENVQPGDDDLDEEEEEYLSDDGKDDDDGGGLQAPLLSRQSTDVETKNEPASGQVAMQRHSSIGGGGGVETASTMGIGGGWQLAWKWTENVGPDGVKRGAVKRMYLHEESEAAPGGDAGGGGAAGAAGDAQSTAYVHAAALVSRSMLYTKDVLIGQSPTEPAFANPPEAVAAAASTGPAWRELLEPGVRHALFCGVTIQILQQFSGINGVLYYTPQILDQAGVSVLLASLGLSGDSTSILISGLTTLLMLPSIGVAMRLMDASGRRALLLWTLPVLVASLAVLVVANVVPMAATAHAALSTGSVIVYFCCFVMGFGPIPNILCAEIFPTRVRGLCIAICSLTFWLGDIAVTYSLPVMLSSVGLAGVFSFYAAVCCVALVFVALKVPETKGLPLEVIIEFFNVGAKAGTLPDEEFH

SEQ ID NO: 62139 - protein, 478 aa, Solanum tuberosum
MSSYSELSNLPIREIPGDYGFPIISAIKDRYDYFYNQGEDAWFHNKAEKYKSTVVKINMAPGPFTSNDYKLVAFLDANSFVCMFDNSLIDKTDTLGGTFKPGKEYYSGYRPVAFIDTKDPNHAALKGYILSAFAKRHNLFIPLFRNSLSDHLFNNLEKQVTEQGKSDFNALLPTMTFNFIFRLLCDQTNPSDTVLGAQGPEHLRKWLFPQLIPSLSAKKLPNIIEDTLFHNFLIPFGFIKSDYNKLVDAFSKSAVSILDEAEKLGIKREEAVQNILFLVGINMFAGLNAFSPHLFRFVGEAGASLHTQLAKEIRTVIKEEGGAITLSAINKMSLVKSVVYETLRLRPPVPLQYGKAKKDFMVQSHDASYKINKGQFVVGYQPMASRDPKIFANPDEFVPDRFMNDGEKMLKHVLWSNGRETENPAPDNKQCPGKDLVHLLGRLILVEFFMRYDTFTVEITPLFRAPNVAFKTLTKASK

SEQ ID NO: 62140 - protein, 317 aa, Streptomyces coelicolor A3(2)
MELHCLAADTTPMTTDDDSAPFGRSLCAMVTPFTGSGALDLDGAQRLADRLVARGCDGLVLSGTTGESPTTTDAEKAALVTAVREAVGDRAALVAGVGTADTRHTVELALAAEKAGADGLLVVAPYYSRPPQDALEAHFREVADASGLPVMLYDIPGRTGTRIEPDTVVRLAAHPRIVAVKDCAYDLLGTQKVLSRTGLAYYAGCDEQILPLYAIGAAGYVSTVANVVPELFRAVLDAFDAGDTGRAALLQRRAVPLVESMMAAGLPGTVTAKALLGALGLPAGPVRAPLRSADRETTAGLLAAYGELAADAGQSQA

SEQ ID NO: 62141 - protein, 336 aa, Streptomyces avermitilis MA-4680
MTPGSDVIDDVPKANNDSMAASATLGGERKRSLEQITLLLFIIVPFLALLAAVPLAWGWGVSWLDMGLMVFFYYLGCHGITIGFHRYFTHGSFKAKRPLRIALAIAGSMAVEGPLVRWVADHRKHHKFSDAEGDPHSPWRFGETVPALMKGLWWAHIGWMFDEEQTSQEKYAPDLIKDGAIRAISRQFVLWTGLSLALPPLIGGLVTMSWWGAFTGFFWGSLVRVALLHHVTWSINSICHAVGKRPFKSRDRSGNVWWLAVLSCGESWHNLHHADPTSARHGVERGQLDSSARIIRWCERLGWAYDVRWPSRSRIDSRRHTGEEGSRRKRESADAA

SEQ ID NO: 62142 - protein, 258 aa, Dunaliella salina
MAEAREECTYLAKLAEQAERYDEMVEEMKKVGRMVHDQELSVEERNLLSVAYKNVIGARRASWRIISSIEQKEESKGNEEHVQRIRSYRKMVEKELSDICSSILQLLDEHLIPTASTGESKVFYLKMKGDYHRYLAEFKTGSDRKEAAEHTLLAYKAAQDIALVDLPPTHPIRLGLALNFSVFYYEILNSPERACHLAKQAFDEAIAELDTLGEESYKDSTLIMQLLRDNLTLWTSDMQGPDAEGGGGGEMKVEEADA

SEQ ID NO: 62143 - protein, 557 aa, Pseudomonas fluorescens PfO-1
MYEYDDYDRALVFERVAQFRDQVERFMAGELSEEEFLPLRLQNGLYMQKHAYMLRVAIPYGTLSAEQMRTLASIARDYDRGYGHFTTRQNMQFNWIELHEVPDILERLAQVNMHAIQTSGNCVRNITTEAFAGVAADELIDPRPLAEILRQWSTINPEFLFLPRKFKIAICSAKQDRAAIMMHDIGLYLYPGRDGQMLLRVIVGGGLGRTPILGLQIRDGLPWQHLLSYVEAVLRVYNRHGRRDNKYKARIKILVKALGIEAFAKEVEEEWQHLKDGPAQLTEDEYQRVASAFVPPSYRTLAGTDLDFGTHLAENPAFARWVARNVQPHKVPGYTSVVLSTKPGLAAPPGDVTDAQMQAVADWSERFGFGEIRIAHEQNIVLPDVPKSELFALWQQAKEQGLGAANVGLLTDIIACPGGDFCALANAKSIPIAQAIQARFDNLDYLHDLGDISLNISGCMNACGHHHIGNIGILGVDKNGSEWYQITLGGAQGKNSALGKVIGPSFSAAEVPQVIERIIGTFVRYREAEEQFVETVARIGLEPFKERVYPKALEVSA

SEQ ID NO: 62144 - protein, 615 aa, Geobacillus kaustophilus HTA426
MCGITGWVHFGRNLRRERTVIDSMTETLAKRGPDDTNTWLDTHVAFGHKRLVVVDPAGGKQPMVRQKNGHRYTIVYNGELYNTEDIRKELLRQGYRFDGHSDTEVLLAAYMEWKEKCVDWLNGIFAFAVWDGERELLFMARDRLGVKPLFYREDGGGLLFGSEVKAILAHPDVKAEVNYEGLAEVFGLGPSRTPGHGVFDGIRELRPAHALTFSRSGLRIWRYWNVESDVHRDSFEETVEKLRFLLTDAVTRQLVSDVPVCTFLSGGVDSSAITGIAANAFAADGKGPLHTYSIDYEGNDQYFKANDFQPNTDAPFIEQVSNKFQTVHHRCVITQEELFRHLHEAVIVRDVPGMADVDSSLLWFCKQIRERFVVSLSGECADEIFGGYPWFHRPDDLSRKGFPWMRSVDARMGLLKDEWRQKLRLDDYVQMRYEQTLAEVPRLEGESAEEAKRRELFYLNMIWFMTTLLDRKDRMSMGASLEVRVPFADHRIVEYVWNIPWDMKMYGGREKGLLRKALEGLLPEEVLYRKKSPYPKTHHPLYTKLVKQWLEQLLHDRSSVLHEFFDREKLLALIETEGKSFQVPWFGQLMTGPQLLAYLGQVHVWFDHYGIRIKE

SEQ ID NO: 62145 - protein, 212 aa, Triticum aestivum
ALLGSSSAELWGWRIPRAAGFIKTLTVGDGAVGKTCLLISYTSNTFPTDYVPTVFDNFSANVVVDGSTVNLGLWDTAGQEDYNRLRPLSYRGADVFLLAFSLISKASYENVTKKWIPELRHYAPGVPIILVGTKLDLRDDEQFFVDHPGAVPISTAQGEELKKVIGATAYIECSSKTQQNIKAVFDAAIKVVLQPPKQKRKKRKSQKGCSIL

SEQ ID NO: 62146 - protein, 957 aa, Klebsiella oxytoca
MTKPVLVLVGHGMVGHHFLEQCVSRDLHQQYRIVVFCEERYAAYDRVHLTEYFAGRSAESLSLVEGDFFTQHGIELRLSESVASIDREARVVRDAFGHETHWDKLVLATGSYPFVPPVPGHNLEGCFVYRTLDDLDQIAARAATARRGVVIGGGLLGLEAANALKQLGLETHVVEFAPNLMAVQLDNGGAAMLREKISELGVGVHTSKATTEIVRNEQGLQLNFRDGSSLATDMLVFSAGIRPQDALARSGGLSVGERGGICIDNQCRTSDPDVLAIGECALWENKIYGLVAPGYQMAARRAATLAGEAGSFSGADMSTKLKLLGVDVASFGDAQGRTPGCQSYQWTHGPQQVYKKIVVSADGKNLLGGVLVGDAGDYATLLQMMLNGMALPKHPESLILPALEGSRPKALGVAALPDGAQICSCHNVSKGDICQAVSGGAGDMAAIKSRTKAATGCGGCSALVKQVMEYQLAEQGVEVKKDICEHFPWSRQEIYHLVRVNHIRTFEQLIARYGQGHGCEVCKPLVASVLASCWNEYLLKPAHLPLQDTNDRYFANIQKDGTYSVVPRMAAGEVTPDGLIAIGQIAKRYQLYSKVTGGQRIDLFGARLEQLPAIWRELAEAGFETGHAYGKSLRTVKSCVGSTWCRYGVQDSTGLAVTLEHRYKGLRAPHKIKMAVSGCTRECAEAQGKDIGVIATEKGWNLYVCGNGGMKPRHADLFASDLDEATLIRSIDRLLMFYIRTADRLQRTSTWMDNLEGGVDYLREMILEDSLGIGEELEQEMARVVESYQCEWQTTLNDPQRLALFRSYVNSDEPDETVQRQTLRGQPQLAPFAAQGEPALPSRPWQAICDLDAIPQQAGIGARLGERQIALFRFGDQVYALDNLEPGSEANVLSRGLLGDAGGEPIVISPLYKQRIRLRDGRQCDGGEQAVRAWPVKVENGKVWVGNQQLLARAEAS

SEQ ID NO: 62147 - protein, 583 aa, Betula pendula
MSSLSVRFLSPPLFSSTPAWPRTGLAATQAVPPVVAEVDAGRLEPRVEEREGYWVLKEKFREGINPQEKLKLEREPMKLFMEGGIEDLAKMSLEEIDKDKISKSDIDVRLKWLGLFHRRKHHYGRFMMRLKLPNGVTTSAQTRYLASVIRKYGKDGCADVTTRQNWQIRGVVLSDVPEILKGLDEVGLTSLQSGMDNVRNPVGNPLAGIDIHEIVATRPYNNLLSQFITANSRGNLAFTNLPRKWNVCVVGSHDLFEHPHINDLAYMPAIKDGRFGFNLLVGGFFSPRRCAEAVPLDAWVSADDIILVCKAILEAYRDLGTRGNRQKTRMMWLIDELGIEGFRSEVVKRMPNQELERAAPEDLIEKQWERRELIGVHPQKQEGLSYVGLHIPVGRVQADDMDELARLADTYGCGELRLTVEQNIIIPNIENSKLEALLGEPLLKDRFSPEPPILMKGLVACTGNQFCGQAIIETKARALKVTEEVQRQVAVTRPVRMHWTGCPNSCGQVQVADIGFMGCMARDENGKPCEGAAVFLGGRIGSDSHLGNLYKKGVPCKNLVPLVVDILVKHFGAVPREREESED

SEQ ID NO: 62148 - protein, 460 aa, Arabidopsis thaliana
MTVVGDVAPIPRRNSSTCSNDIAAPLLPECHGDEVAHDEFNGASFSGAVFNLATTIIGAGIMALPATMKILGLGLGITMIVVMAFLTDASIEFLLRFSKAGKNRSYGGLMGGSFGNPGRILLQVAVLVNNIGVLIVYMIIIGDVLAGKTEDGIHHFGVLEGWFGHHWWNGRAAILLITTLGVFAPLACFKRIDSLKFTSALSVALAVVFLIITAGISIMKLISGGVAMPRLLPDVTDLTSFWNLFTVVPVLVTAFICHYNVHSIQNELEDPSQIRPVVRSALMLCSSVYIMTSIFGFLLFGDDTLDDVLANFDTDLGIPFGSILNDAVRVSYALHLMLVFPIVFYPLRINIDGLLFPSARSLSTSNVRFGCLTAGLISVIFLGANFIPSIWDAFQFTGATAAVCLGFIFPASIILKDRHDKATNRDTTLAIFMIVLAVLSNAIAIYSDAYALFKKNAPRE

SEQ ID NO: 62149 - protein, 242 aa, Candida glabrata CBS 138
MSVVDIDNVEQFLDLARTKAGNKLVVLFFYMPWMKSCRVLKEVVLALSRSVGKKHSTFLQINIEGNRDIVSLLGITQVPAFFLVRKGVVIKALSGVDPREFLAAYHECVDNSNCYDHDLDEDSQDIKSDDTLQEPEDFYSEDTESLDKLVNAAPVMVFIKGSPSDPKCGFSRQMVNILRSHQIRFGFFDILKDKITRQQLKDYSDWPTFPQLYINGEFEGGLDIVKESLLEDPDFFNKKLSL

SEQ ID NO: 62150 - protein, 240 aa, Wolbachia endosymbiont of Drosophila simulans
GGTFLVFSDYCRPAIRLSALMKQQVMYVMTHDSIGVGEDGPTHQPIEHLASLRAIPNLYVFRPADAVETLECVSIALEKKESPALFALSRQNVSYMRKFYSDIDQSANLSKFGAYILCECSKELKVTIFATGSEVEIAVEAREKLQEKGIGTRIVSMPCWRLFDEQSDEYKAAILNNDSIKVAIEAGSEMGWHKYIGSNGIFIGMKSFGESAPYKTLYEHFNISADHVVKCVCEKLVYIQ

SEQ ID NO: 62151 - protein, 293 aa, Candida glabrata CBS 138
MSAFSDTDFDSNRYSKSRPSYPQSFYEALSRYHKGNRNILIDVGCGPGTATFQLQEYLPFDQYVGCDMSQPMIDTANGRAQSQNLKNIHFHQGPYQDLSFLKQIGDGKCDMATCVEAVHWFDLKEFQQVVHDSLNENGTLAIWGYIDAVLVDYPEFDQYFQDLTYGDSKMGPYWDQPGKTILRNKYEAVQIDTGLFKDVERHVLTPTDIRKPGFEISKEYLPICTTMPLSGLMDYIRTWSGYHNWKHDPANADKMDLVEETLQHIIDSDNDIDSESKLVKVAWSSFYIFARKI

SEQ ID NO: 62152 - protein, 371 aa, Streptomyces fradiae
MTDASHPTAADDLGALSTLFRSEQGGHERVLLCQDRESGLKAVIALHSTALGPALGGTRFHAYASDEEAVLDALNLARGMSYKNALAGLPHGGGKAVIIGSPAPVSEGGLKSEALLRAYGRFVASLDGRYVTACDVGTYVADMDVVARECRWTTGRSPENGGAGDSSVLTAFGVFQGMRASAQALWGEPTLRGRTVGVAGVGKVGHHLVDHLVEDGARVVVTDVRPESVERVRARHPRVVAVPDTESLIRADLDVYAPCALGGALNDDTVPALTARVVCGAANNQLAHPGVEKDLAGRGILYAPDYVVNAGGVIQVADELLGFDFDRAKAKAAQIFDTTLAIFDRARTDGVPPAVAADRIAEQRMAEARTV

SEQ ID NO: 62153 - protein, 119 aa, Glycine max
TLKSIGKWRCHRESGQSSSSTVRVILLNQIQAQPLPHHCFVSFFSGLSFYTTQEQLKKLFSPFGLVTQADLALDPITKRPKGFGFVSFKSEIEAEKACKAMNGRIVNGRLILVEPANEK

SEQ ID NO: 62154 - protein, 1074 aa, Photorhabdus luminescens subsp. laumondii TTO1
MAKRTDIKSILILGAGPIVIGQACEFDYSGAQACKALREEGYRVVLVNSNPATIMTDPEMADATYIEPIHWEVVRKIIEKERPDAILPTMGGQTALNCALELERQGVLEEFGVTMIGATADAIDKAEDRCRFDIAMKKIGLETPRSGIAHSMEEALAVADQVGFPCIIRPSFTMGGSGGGIAYNREEFEEICERGLDLSPTNELLIDESLIGWKEYEMEVVRDKNDNCIIVCSIENFDAMGIHTGDSITVAPAQTLTDKEYQIMRNASMAVLREIGVETGGSNVQFAVNPKNGRLVIIEMNPRVSRSSALASKATGFPIAKIAAKLAVGYTLDELMNDITGGRTPASFEPSIDYVVTKIPRFNFEKFAGANDRLTTQMKSVGEVMAIGRTQQESLQKALRGLEVGATGFDPKVSLDDPEALTKIRRELKDAGAERIWYIADAFRAGMSVDGVFNLTDIDRWFLVQIEELVRLEEQVAEQGINSLTADFLRYLKRKGFADARLAKLVGVAEKEIRKLRHKYNLYPVYKRVDTCAAEFATDTAYMYSTYEDECEANPNSDKPKIMVLGGGPNRIGQGIEFDYCCVHAALALREDGYETIMVNCNPETVSTDYDTSDRLYFEPVTLEDVLEIVRVEQPKGVIVQYGGQTPLKLARELEIAGVPIIGTSPDAIDRAEDRERFKQAVNRLGLKQPENATVTTIERAVEKANILGYPLVVRPSYVLGGRAMEIVYDEVDLRRYFQTAVNVSNDAPVLLDCFLDDAVEVDVDAICDGERVLIGGIMEHIEQAGVHSGDSACSLPAYTLSQEIQDVMRQQVEKLAFELGVRGLMNVQFAVKDDEVYLIEVNPRAARTVPFVSKATGLPLAKVAARVMVGQSLVEQDATQEIIPPYYSVKEVVLPFNKFPGVDPILGPEMRSTGEVMGVGRTFAEAFSKALLGCNARMPQNGRALLSVREGDKGRVVDLAAKLLKQGFELDATHGTAVVLGEAGINPRLVNKVHEGRPHIQDRTKNGEYSYIVNTTAGRQAIEDSKLIRRSALQYKVHYDTTLNGGFATTMALSADPTEQVISVQEMHAMINS

SEQ ID NO: 62155 - protein, 123 aa, Triticum aestivum
MSAMETDAPDAPPPAAPAPAADAGASSSSSRKPGKRFEIKKWNAVALWAWDIVVDNCAICRNHIMDLCIECQANQASATSEECTVAWGVCNHAFHFHCISRWLKTRQVCPLDNSEWEFQKYGH

SEQ ID NO: 62156 - protein, 626 aa, Pseudomonas putida GB-1
MSFASLGLSEALVRAIEAAGYTQPTPVQQRAIPAVLQGRDLMVAAQTGTGKTGGFALPILERLFPAGHPDKSQRHGPRQPRVLVLTPTRELAAQVHDSFKVYARDLPLVSACIFGGVGMNPQIQAIAKGVDVLVACPGRLLDLAGQGKVDLAHVEILVLDEADRMLDMGFIHDVKKVLARLPAKRQNLLFSATFSKDITDLADKLLHNPERIEVTPPNTTVERIEQRVYRLPASHKRALLAHLITQGAWEQVLVFTRTKHGANRLAEYLEKHGLTAAAIHGNKSQNARTKALADFKANSVRVLVATDIAARGLDIDQLPHVVNFELPNVEEDYVHRIGRTGRAGRSGEAISMVAPDEEKLLKSIERVTKQRIQDGDLMGFDASQVEAEKPEVRERPQNSGRGGRNQQGRGEGGKDANGGRKDKGKAKQQAAEKPADKENSGDKQQQPRKPRDKKPRQQQQASSNSVPKVPADRDPEEFLDDDVDNFGNRADYVSPYQGKNQGRNRRPGGGAGQGQNSGQRSNAGGQGQARSGGQQRSGGSGGGGEKRPARANNGGGARRDGGGRGRPARDDAARQEPAVRNPRQPEKQPVIIRKESKLDRYPTPEQLDDVPTRPRGERPALLTRKG

SEQ ID NO: 62157 - protein, 288 aa, Azoarcus sp. EbN1
MSDQATVEQIPAQHQDTQPGHEEPMVPRPEDEMKHYHGSGKLAGKTAIVTGGDSGIGRAVSIGFAKEGADVAVVYLCEHEDAEHTQRQIEAQGVKCLLLAGDVGDEAFCADVVEKVIAKFGRLDILVNNAAEQHPQEDLAAISREQLERTFRTNLFSMFDLTRCALAHLKEGACIINSTSVTAYRGSSHLIDYSASKGAIVSFTRSLAQSLAKRRIRVNGVAPGPIWTPLIPASFEAEKVEHFGEKQPLGGAGQPDAVAPSYIFLASSDSSYMTGQVLHPNGGEIVNG

SEQ ID NO: 62158 - protein, 226 aa, Oryza sativa (japonica cultivar-group)
MCSIRSFAFVLVLAFSVAVAESRDSFNVLAHKSFPLENKKTGLTSANGKLCQLCEQYSTEALFYLQQNETQTEILSILHHACANVGPLKQQCITLVDYYIPLFFLEVSMVTPEKFCESVHLCRKGTMLRLPSRGDTCGICHHVLVEVLIMLKDPDMQLEIVEIFLKACSKADNYVQQCKKMVLEYTPLILVKSQKFLETTDVCSTIHACKTGTQASAETMLLSAAS

SEQ ID NO: 62159 - protein, 328 aa, Geobacillus kaustophilus HTA426
MAISKDHLLWMYETMYKIRCYEDKMAEAYAEGKSPVFNIGAGPVPGEMHLATGQEPAAAGMCVHLKKEDTVTAPHRPHHHAIAKGVDLNRMTAEIFGKATGLGKGKGGHMHLFDPDVKFSCGGIVGAGIPHALGAALAAKKRGTDWVAVAFIGEGAANQGAFHESLNMAALWKLPFIVVIENNQYGISVPKTASTAVPSNDVRAAAYGIKGYYVKDNDPIDMYNVSKEAVERARTGQGPSIIEIETYRYLGHFQGDPEVYRDKNEVTLLRQKDPIIRLRNYLLNECGVTEETIAQLENKATFEVDQAYAFARESDYPKPEEALEDVFV

SEQ ID NO: 62160 - protein, 339 aa, Geobacillus kaustophilus HTA426
MQQTKQRLLTGNKALAEAIRLEMERDPNVFVMGEDVGVYGGIFGATEGLFQKFGPERVIDTPISETAFIGAAIGAAAEGMRPIVELMFVDFFGVCMDQIYNHMAKIPYMSGGRVKLPMVLMTAVGGGYSDAAQHSQTLYATFAHLPGMKVVAPSTPYDLKGMMISAIRDDNPVVFMFHKTLQGLGWMDQLDASIGHVPEEAYTVPLGKANIVREGTDITIVGIQMTVHQALEAAKRLEQQGIQAEVIDLRSLVPLDKETIIQSVKKTHRLLVVDEDYLSYGMTAEIAAIAAEHCLYDLEAPVKRIAVPDVPIPYSRPLEQFVLPNADKIFREAIQLVNE

SEQ ID NO: 62161 - protein, 436 aa, Geobacillus kaustophilus HTA426
MVVEVTLPKLSDSHDESFITFWHVSEGDAVEKGATLVEVQTEKAVSEIHAPESGTVKEIKKKRGDTAKVGEVLAVIAVETFAPDGGDPQTEIKITPRVKKLAKELGVDWSTVTPTGANGKITEDDIRRAASAGKQRTPQKTFVAAPSVRKFAREQNVSLEEITPSGKNGRILKSDIEAALSVRQQKATDEAAASVEIVKKQESREKVRRVPLTGIRKAIAQAMVRSTRTIPQVTHFGEADATRLVQHRRRIQPLAEQQGVKLTYLAYVVKALAAVLKKYPMLNASLDEEREEIVIHEFIHIGFAVDTDRGLLVPVIRDADQKSLFQIAKEIEELTAKARAGTIQAVEMSGGTCTVSNIGSANGSWFTPIIHYPQSCLLGIGKVEKKPVVVDDSIEIASVMPLSLTYDHRLIDGMMAQHALNECQTYLSEPDWLLVM

SEQ ID NO: 62162 - protein, 287 aa, Geobacillus kaustophilus HTA426
MVTKQQTTLPPQHQTRQPGLQTEMNPQPVTIKDTYKGSGKLKNKTAIISGGDSGIGRAVAVHFAKEGADVAIIYLNEHEDAEETKRLVEQEGRRCLAMAGDIGDEAFCKEAVKQTIKAFGKLDIVVNNAAEQHPQPNFLNITAAQLEKTFRTNVFGYFFLTKAALPHLKNGSTIINTTSVTAYEGNEQLIDYSATKGAIVAFTRSLAKALVGQGIRVNGVAPGPIWTPLIPSTFQSEQVAAFGANTPMKRPGQPSEVAPCYVFLASDESSYMTGQMLHVNGGKFISD

SEQ ID NO: 62163 - protein, 519 aa, Mycobacterium avium subsp. paratuberculosis K-10
MRPFYVTTAITYPNGDPHVGHAYEYIATDAIARFKRLDGFDVRFLTGTDEHGLKMVETAAAEGIGTAELARRNSDVFQRLQERLNISFDRFIRTTDPDHHEASKAIWRRMQAAGDIYLDSYSGWYSVRDERFFVESETKVLDDGTRVAAETGAPLTWTEEQTYFFRLSAYTDKLLAHYEANPDFIAPEVRRNEVVSFVSGGLRDLSISRTSFDWGVKVPDHPDHVMYVWVDALTNYLTGVGYPDTESEMFRRYWPADLHMIGKDIIRFHTVYWPAFLMSAGIELPRRVFAHGFLLNRGEKMSKSVGNIVDPITLVDTFGVDQLRYFLLREVPFGQDGSYTEDAIITRINTDLANELGNLAQRSLSMIAKNLHSVVPEPGDFTGDDRELLQTADGLLPRVRASFDSQAMHLGLEAIWLMLGEANKYFSAQQPWVLRKSESEADQTRFRTVLYVTCEVVRIAALLVQPVMPESAGKLLDLLGQGQDRRAFDALGARLAPGTVLPPPTGVFPRYQAESEKVD

SEQ ID NO: 62164 - protein, 429 aa, Desulfovibrio vulgaris subsp. vulgaris str. Hildenborough
MSILNSNAALRGLLDQHLADLSREEGLAPETIRDAIERGTMVLLGNPSHPSLRPILVGQPARVKVNANIGTSPMRNHPECEMQKVDAAVEAGADTIMDLSIAGDLDAIRREMLARCPLPLGTVPLYSVAQKYIECGKDPALIDPEEIFAEIEKQAQQGVDFMTVHCGLTRRGAEWAAKGDRLLGIVSRGGSILARWMLRHDRENPLLTGYDRILDIARKYNVTLSLGDGLRPGAGADAGDAAQWEEVMVLGQLAKRGLEAGVQCMIEGPGHVPMNEVEAQIVGIKKLTHGAPLYVLGPLVIDSCPGYDHIAGAIGGALAVRSGVDFLCYLTPAEHLTLPTREDVRAGVIASRIAAQAGEVALGRPHALARELGMGKARKALDWPGMERHALDAAMVDERRGEHRNEEECAMCGKFCAVKMLRDDPQGAF

SEQ ID NO: 62165 - protein, 250 aa, Candida glabrata CBS 138
MSPSREDSVYLAKLAEQAERYEEMVESMKEVASSGQELSVEERNLLSVAYKNVIGARRASWRIISSIEQKEESKEKAEHQVELIRTYRGKIETELTKISDDILSVLDSHLIPSATSGESKVFYYKMKGDYHRYLAEFSSGDVRDKATEASLEAYKTASEIATTELPPTHPIRLGLALNFSVFYYEIQNSPDKACHLAKQAFDDAIAELDTLSEESYKDSTLIMQLLRDNLTLWTSDMSEAQDEQNDEPPK

SEQ ID NO: 62166 - protein, 471 aa, Acidobacteria bacterium Ellin345
MPDTIYDVVIIGSGPAGYTAAIRAGQFGLKTALIEKDAKLGGTCLHVGCIPTKSLLFNAEIYDHIKEAEEFGIEGLGTPKLNWSKVQERKQAIIDKHAKGLQFLMKKNKVTVIPGFGRLTGPAKGGIHSVEVEADGKKQNVQAKNVLLSTGSVARMLPGLQADDRILTNIEILSLKEIPKSLVVIGSGAVGVEFASIYKSFGTDCTIIEMLPRLVPVEDEEVSKELLRNYKKRGINCHVNAKTDKFEKTKTGVKVTFTVDGKQESIEAEKCLVAIGRAPRTEGVGIEKTNIKLERGFVPVNEWMQTTEPGVYAIGDIVLGLQQLAHAGAMEGMVAVAHIAGKPTKPVRKDRVPGATYCHPEIGSVGLTEAQAKEAGHEVKIGKFPFTANSRASIVNQHEGFVKVVADAKHGEILGVHIIGPQATELVAEAVAMLELEATADFMMTVIHAHPTLAEAMLDAVSAVYGMAINA

SEQ ID NO: 62167 - protein, 359 aa, Rhodopirellula baltica SH 1
MSFGMRLNQQAAKFGPAGTDQRCGACGYSHDATTSKWHAVCVSRDVQCCWPDRPCISRHQSSASWQTTPLKRNVTGRSQTTLLDFQFTSMTDWLQQQTPVLQALLAGIFTWVLTALGAAVVFGLTNVPRKLFDAMLGFAGGVMLAASYWSLLAPSIEAAAEQGWPSWLPAAVGFLIGGAFLYGLDRGLPHLHRGMPTESAEGPKTAWQRSVLLIAAITLHNIPEGLAVGVAFGSASAGIESATLSGATALAIGIGLQNLPEGIAVAVPLRGEGMSRMKSWLIAQASAIVEPIAAVLGAAIVVYAAPVLPFALSFAAGAMVYVVVEELIPETHQEGNEDLATLCLTLGFTVMMILDVSLG

SEQ ID NO: 62168 - protein, 408 aa, Candida glabrata CBS 138
MLSIASKRPLALSARSVVGIGRTMATAKEKSQPVPDENENVEISLPETSFEGYMLEPPSLNYSATKGSLLQMFKDMVIIRRMEMACDALYKAKKIRGFCHLSVGQEAIAVGIENAITKRDSVITSYRCHGFTYMRGASVQAVLAELMGKRSGVSFGKGGSMHLFAPGFYGGNGIVGAQVPVGAGLAFAHQYKNEDACSFTLYGDGASNQGQVFESFNMAKLWNLPVVFCCENNKYGMGTAAARSSAMTEYFKRGQYIPGLKVNGMDILAVYQASKFAKEWCLSGKGPLVLEYETYRYGGHSMSDPGTTYRTRDEIQHMRSKNDPIAGLKMHLLELGIATEEEVKAYDKAARKYVDEQVELADKSAPPEAKLSILFEDVYVKGTETPTLRGRIPEDTWDFTKNDFLVRD

SEQ ID NO: 62169 - protein, 347 aa, Listeria monocytogenes str. 4b F2365
MKNTIKWIAIGFAGIILLPLLIVFFIYKKAVGKKEYNPEVLENLDEASQEFVKNTSPLSDVDSRYKYMRLATKALPSAKDIEIGDVENKKIDGPAGKIPIRIYTPQEDGPFEIIVYYHGGGFVLGGLQTHDAIARKLVQTTGARVVTVDYRLAPENPFPAAVEDAYAALLWVQNHRTSLRAKSSDIIVAGDSVGGNLATVVTQIAKSKGKPNITAQILLYPATDIFSRDASVLYPSMDEFAEGYVLTKESLDKFFKLYIANASDRKYDPLVAPIRSKDLVGLPKTFIATAEFDPLRDQGEAYAKKLKDAGVEVFAKRFEKVPHGFMTTNSEATDETYELISEFLEEK

SEQ ID NO: 62170 - protein, 499 aa, Hordeum vulgare
MIGTRVLAHSRVDPAIRWGVAARGRVVFAAIRWGAAARGRVVFAAVRWGAAARGTKREAGQETSTSETKKTKRKWGRGFCGMASHEVEEPLTSETKKTKRKWGRGFCGMASHEAEEPLTSETKKKRKNVAASSEPDKKRWFKNKIWKKKKAKNEQLATLVKEISLATKLNSAMHVNINLSMNICPTQTYEEHSGTYLRNLAVIAVKQLDKDGLQGNREFLVEVLMLSLLHHPNLVTLLGYCTECDQKILVYEYMPLGSLQDHLLDLTPKSQPLSWHTRMKIAVDAARGLEYLHEVANPPVVYRDLKASNILLDGNFSAKLADFGLAKLGPVGDKTHVTTRVMGTYGYCAPEYAMSGKLTKMSDIYCFGVVLLELITGRRAIDTTKPTREQILVHWAAPLFKDKKKFTKMADPLLDSKYPLKGLYQALAISSMCLQEEAISRPLISDVVTALTFLADPNYDPPDDIEPLPISVPNYDKGISLREAEISLSGFEEKQVEDS

SEQ ID NO: 62171 - protein, 257 aa, Acidobacteria bacterium Ellin345
MADLFNLSGKVAVVVGGTTGIGRAISFGLADAGADVVSTARREEQVNAAADEIERRGRQTLRVCSDVTSRASIQSLCNAVLAKFQKVDILVNCAGTTKRTPTLTVSEDEWNKILDTNLTGALRACQVFGKHMIERGYGRIINIASLSSFVALHEVAAYSASKAALLSLTRSLAVEWSKKGVTVNAIAPGVFRTALNTELLDNTPRGQEFLMRTPMQRFGNTEELVGAAVYLASDAASFVTGQAITVDGGFLASGVNQ

SEQ ID NO: 62172 - protein, 248 aa, Pseudomonas fluorescens PfO-1
MDKVIVITGGGRGIGAATALLAAEQGYRICINYQTDEQAAHHVLDQVRERGATAIAVRADVSIEDEVIALFNRVDSELGRVTALVNNAGTVGHKSRVDEMSEFRILKIMKTNVLAPILCAKHAILRMSPKHGGQGGSIVNVSSVAARLGSPNEYVDYAASKGALDTFTIGLSKEVAGEGIRVNAVRPGYIYTDFHALSGDPDRVSKLESAIPMARGGRPDEVAEAIVWLLSDKASYATGTFVDLGGGR

SEQ ID NO: 62173 - protein, 514 aa, Arabidopsis thaliana
MAGGAFVSEGGGGGRSYEGGVTAFVIMTCIVAAMGGLLFGYDLGISGGVTSMEEFLTKFFPQVESQMKKAKHDTAYCKFDNQMLQLFTSSLYLAALVASFMASVITRKHGRKVSMFIGGLAFLIGALFNAFAVNVSMLIIGRLLLGVGVGFANQSTPVYLSEMAPAKIRGALNIGFQMAITIGILVANLINYGTSKMAQHGWRVSLGLAAVPAVVMVIGSFILPDTPNSMLERGKNEEAKQMLKKIRGADNVDHEFQDLIDAVEAAKKVENPWKNIMESKYRPALIFCSAIPFFQQITGINVIMFYAPVLFKTLGFGDDAALMSAVITGVVNMLSTFVSIYAVDRYGRRLLFLEGGIQMFICQLLVGSFIGARFGTSGTGTLTPATADWILAFICVYVAGFAWSWGPLGWLVPSEICPLEIRPAGQAINVSVNMFFTFLIGQFFLTMLCHMKFGLFYFFASMVAIMTVFIYFLLPETKGVPIEEMGRVWKQHWFWKKYIPEDAIIGGHDDNNTN

SEQ ID NO: 62174 - protein, 163 aa, Triticum aestivum
MAAMMVAARQGRELQRYSASTGGRIVVGCIPYRVRDDNGEVEVLVICSRKKGASAGVLFPKGGWELDESMDEAARREALEEAGVRGETGQSLGRWCYQSRSYEATYEGYMFPLRVTDELERWPEMSGRGRTWVTVQDAMDRCPHLWMREALQRFADRVADAAL

SEQ ID NO: 62175 - protein, 641 aa, Gossypium hirsutum
MCFRFSNLLTLLLISFAAAEDVGFIYNGFRSANLNLDGIAELTSNGLLKLTNKTVQETGHAFYPHPVDFKNSTNGSVFSFSSTFVFAILPEYPTLSGHGIAFVIAPTKGLPGSLPSQYLGLFNGSNNGNDTNHVVAVELDTIRSTEFDDINDNHVGIDINGLKSPTSSPAGYYEDDSHDFKNLTLISGKQMQVWVEYHGLEKRMDVTLAPFKVPKPDTPLLSLSRDLSSIVNRENVCWFFIVNWFGPHISLCFGLELSRLMVQAEELTLSQLPKLPRLGPKKKPKVLTIGLPLILVSLALAGVSGAAYLVRRKRKFADVVEDWELEYGPHRFKFKDLYIATKGFKDKELLGAGGFGRVYRGVLPSNKLEVAVKRVSHESRQGMREFVAEIVSIGRLRHRNLVQLLGYCRRKDELLLVYDYMPNGSLDKYLHDQPKVTLNWRQRFRVIKGVASGLFYLHGEWDQVVVHRNVKASNVLLDGELNGRLGDFGLARLYDHGTDPQTTHVVGTLGYLAPEHTRTGKATPSTDVFAFGAFLLEVACGRRPIEAKSPTEDVILVDWVYSCWSNGDIMEAKDPNLGSGYEAEEVELVLKLGLLCSHSEPEARPTMRQSPSVFRRGSSISRNVITQSHFQWTNIWTSTRV

SEQ ID NO: 62176 - protein, 460 aa, Oryza sativa
  misc_feature (397)..(397): Xaa can be any naturally occurring amino acid
MGIGNGSPSDSRHVSHKEIRDETTPLLPIKEEEEGIHEFNGASFSGAVFNLSTTIVGAGIMALPASIKMLGIIPGILMIILVALLTEASIDMLVRCSHEGKITSYGWLMGETFGQWGRIALQASVVINNIGMMIVYMIIVGDVLSGTSTSGVHHRGIFEGWFGPHLWNSRPVVLLATTLFVFGPLVSFKRLDSLRYTSALSVALAVVFVVITAGIAIVRLIEGTVEIPKLFPELDGTNSIWELFTAVPVVVTAYICHYNVHSIDNELEDRTQTKPIVQTSLALCSSVYIATSFFAYLLFGEGTLADVLANFDSNLHIPFSSVFNDVVRVSYVVHIMLVFPIVFFALRLNLDGLLFPTARHISRDNRRFAIITGSLLAVIYLAAIFIPSIWDAFQFTXGATAAVLIGFIFPAMIILRDPYGIATKRDKILALTMIVLAVLSNSVALYSDALNIIFHRKVEA

SEQ ID NO: 62177 - protein, 316 aa, Burkholderia xenovorans LB400
MAASMSATPEVQRPDILALGEAMIEFNQSVKDEPNYLQGFGGDTSNFCIAAARQGARTGFVSAVGADHFGRLLVDLWEREQVDTSLVRVDPHASTGVYFVSHGPEGHAFDYLRAGSAASRYAPQDLPLEAIAAARVIHLSGISLAISLSACDAALAAIAHARANGVRVSFDTNLRLKLWPLARARAVMLEAIRQTDICLPSWDDVTELTGLTGRDEIVDFLLSHGPGVVALKLGKQGSYIATPNERRVVPGQLVDAVDATGAGDCFGGAFIARIVAGDDPFAAARYANVAAALSTQGYGAVAPIPSRETVEQLLAD

SEQ ID NO: 62178 - protein, 553 aa, Azospirillum brasilense
MAWLGHRRLSINDLSPAGNQPLLHAGGGTGDVLALVCNGEIYNAPTLRTELEALGHAFASRSDNEVILHGYRAWGDAVVDRLTGMFAFVLWDDRRRRLLAARDRVGIKPLYWAEPGDGGIAFASEARPLATLPGIGPAVELRALGHALTLGYVPAPLSAWRGIHKLEPGRLLVWEPGQGAALRRYWEAPRSLAAAGDGDAGWAGLFDRAVADHLLSDVPAGLFLSGGLDSAAVATAAVGAGLRPAAYTLCYPGRPDAEAEVAAAVARHLGLEHRLVPAPTDGLADRLAGVAALFDEPQGYSALVTMAGIARAAAAEHKVVLSGDGGDEVLGGYAWYAGLDPDGPPPGAEAGDAHAAFAARSVLHRHAMRLFPRFLPDEVEALFAPAGLRFGEEEMLAPLEAAFEPGLPLRRALQRVDLATFCADSILAKVDRASMAYGLEVRVPFLDHRLVEWGLSRPPAAEEAVHGKPVLRRYLAGRVPERVFGHPKTGFSLKDTGPFDWNAALDRVAAGPLVRHGLLDPGFRRIVEARSPYRQARIWALLALSLWAGSWME

SEQ ID NO: 62179 - protein, 478 aa, Sinorhizobium meliloti 1021
MSSKRSVAQETAKVSKSSKIPLALHAARGVKTWTEAVDWLKIRGIEDIECITPDLAGVARGKMMPTSKFTSNTSLALPSAIYRHTISGEYPEETGQFRYDSRDSDIKLVPDLSTLSIVPWESDPTAQVICDIVGSQGEQISYTPRNVLKRVIELYRQKGWKPVVAPEIEFYLVAQNDDPDYPLRPPKGRSGRSILGGQGYSIAGINEFDELIDDIYHFSEKQGLEIDTLIHEEGPAQLEINLRHGDPIELADQVFLFKRTIREAALKHGIYATFMAKPMQGQPGSAMHIHQSVIDIETGRNIFSNPDGSPSQAFFSFIGGMQLYVPRTLSMMAPYVNSYRRLTPDMSAPVNTAWGYDNRTTAFRIPVSDPVARRIENRLPSSDANPYLALAASLGCGYLGIIEGLQATPPTEHTANEGEIELPRGLLEAVSLLESAPALAEVFSAEFIAIYAGVKRGEFETFMQVISPWEREFLLLNV

SEQ ID NO: 62180 - protein, 451 aa, Pichia angusta
MGTKSMTDVTAEELSKDSVAMMLAKDRELKNKYLKQKHISEQPWTWENWHRHINWLNFTLVLAVPLAGLISTKWVPLKLHTFVTAVILYCFGGLSITAGYHRHWAHRAYDCRLPVKIFFALFGASAVEGSIKMWGHQHRVHHRYTDTPRDPYDAKRGFWYSHMGWMLLVPNPRYRARADISDLLDDWVVRVQHRHYLLLMVVMAFFFPAILTHFLFNDFWGGFIYAGLLRAVFIQQATFCVNSLAHWIGEQPFDDRRTPRDHILTALVTFGEGYHNFHHEFPSDYRNALKWYQYDPTKVVIYLLSKVGLAYNLKRFSQNAIDQGILQQQQKKLDRMRAKLNWGPQLSELPVWDKSTFFEKAKEQKGLVIISGIVQDCSNFLTEHPGGQALLKTSFGKDATMAFNGGVYAHSNAAHNLLATMRVAVIRDGGANGDTFDAQLRYLASKENKKE

SEQ ID NO: 62181 - protein, 444 aa, Mycobacterium avium subsp. paratuberculosis K-10
MLDILPSLGHAAPPRFDPAIWPVTAHPDEEGRLCVGGVPLGDVADEFGTPAYVVDEADFRCRARRYRRALRGVEVVYAGKSLLSTAVARWAREERLGVDVCSAGELATALAGGVDPARIVMHGNAKSPEELREAVRVGVGRIVLDSTIEIAYLAGLARRRQPVLIRVTPDIDIHGHRAVTTGVSDQKFGFTLAGDHAADAVRRVLAHPILDLVGLHCHLGSQVSDPALYGEAIRRMIAAMADIRARHGVILTELNIGGGHAIPYASGDPELNLDQLADVIEDALDEACAAERFPRPQIVVEPGRAISGRAGVTLYRVCSVKTQGGGRTFVAVDGGMSDNPRVSLYGARYAVALANRHPLGLKQRVTVAGRHCESGDEIARDVELPADLRPGDLLAVACTGAYHHSMASNYNMVGRPPLVAVSEGRARELVRRETVADLLARDRG

SEQ ID NO: 62182 - protein, 355 aa, Verticillium dahliae
MSRSNAPNPSGSRKISFNVSEQYDIQDVVGEGAYGVVCSAIHKPSGQKVAIKKITPFDHSMFCLRTLREMKLLRYFNHENIISILDIQKPRGYDTFNEVYLIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKCRRAREYIRSLPFKKKVPFRTLFPKTSDLALDLLEKLLAFNPVKRITVEEALKHPYLEPYHDPDDEPTAPPIPEEFFDFDKHKDTLSKEQLKQLIYQEIMR

SEQ ID NO: 62183 - protein, 429 aa, Mycobacterium avium subsp. paratuberculosis K-10
MPIIEQVGAREILDSRGNPTVEVEIALTDGTFARAAVPSGASTGEHEAVELRDGGERYGGKGVQKAVQAVLDEIGPAVIGLNADDQRLVDQALVDLDGTPDKSRLGGNAILGVSLAVAKAAADSAELPLFRYLGGPNAHILPVPMMNILNGGAHADTAVDIQEFMVAPIGAPSFAEALRWGAEVYHSLKSVLKKEGLSTGLGDEGGFAPDVAGTTAALDLIGRAIESAGFKLGTDVALALDAAATEFYSDGTGYKFEGSTRTAEQMAEFYAGLLGAYPLVSIEDPLSEDDWDGWAALTASIGDRVQLVGDDVFVTNPERLEEGIEKGVANALLVKVNQIGTLTETLDAVALAHHSGYRTMMSHRSGETEDTTIADLAVAVGSGQIKTGAPARSERVAKYNQLLRIEEALGDAARYAGDLAFPRFALETR

SEQ ID NO: 62184 - protein, 295 aa, Listeria monocytogenes str. 4b F2365
MEKKVGTDRVKRGMAQMQKGGVIMDVVNAEQAKIAEEAGAVAVMALERVPSDIRAAGGVARMADPRIVEEVMNAVSIPVMAKARIGHITEARVLEAMGVDYIDESEVLTPADDEFHLLKSDFTVPFVCGCRDIGEALRRIGEGAAMLRTKGEPGTGNIVEAVRHMRQVNGQIRQIAGMTDDELMVAAKNFGAPYELIKEIKTLGKLPVVNFAAGGVATPADAALMMELGADGVFVGSGIFKSDNPAKFASAIVQATTYYTDYELIGKLSKELGSPMKGIEMSRLNPEDRMQDRSI

SEQ ID NO: 62185 - protein, 551 aa, Desulfovibrio vulgaris subsp. vulgaris str. Hildenborough
MSVHPLAGERPSHDRLVNIPALMGEYYTGHPDTTAVERRVAFGTSGHRGSSLHGTFNEEHILAVTQAVCDIRREDGIAGPLFLGMDTHALSECAHRTALEVLAANGVNVRLQTGGGFTPTPVISHAILCWNAHRDRPRADGVVITPSHNPPEDGGFKYNPPHGGPADTTVTRRIERRANELLDNGLAGVRRVVLHKALRTPGIEAVDLVSAYVNDLASVLDMDAIRGAGLRIAADPLGGSSLAYWDPIAEKYGLDITVVNREADPTFRFMPQDKDGKVRMDCSSPWAMRGLIDLRQSYDIAFGNDPDADRHGIVTAQGLLNPNHYIAAAVWYLYRHRPGWNTTCGIGKTLVTSSMVDRVAKLLGRKVVEVPVGFKWFVPLLLDGSCGFGGEESAGASFLRSDGTPWSTDKDGIIMNLLAAEMMAVEERSPSEIYAELTERCGTPYYERLQSPATAAQRAVFAGLTPERVKATSLAGAPITAMLTHAPGNGAAIGGLKVVTDDGWFAARPSGTEDMYKIYTESFVSPEHLQRIQKDAVDIVASIFADADASS

SEQ ID NO: 62186 - protein, 109 aa, Glycine max
  misc_feature (81)..(81): Xaa can be any naturally occurring amino acid
SKGFLRAGAMSSPYLPATTDSLALATEAKDPSEAISILYRVLDDPSSSPDALRMKEQAITNLTKLLTDENRGEDLRSLLTXTSDLQIALCKEMVLWTRAEKRTFLRQRV

SEQ ID NO: 62187 - protein, 289 aa, Caulobacter crescentus CB15
MVELKVSRRAGLAALAATVTAACSPLSIFATVTPKDAARREAKGARYTDGPRGGVDIYAPPIAHGPAPVAVFFYGGSWDSGRRGDYGWAARAIAAQGFLTLAPDYRLYPEVRYPDFLDDCAKAVRWAVDNAAALGGDPERIVLIGHSAGAYNAAMLALDPRYLRGVGVDPGAVRAFAGLSGPYDFLPLKGAITERTFGGAADLAATQPVSFARADAPAAFLATGDKDTTVYPRNTRKLAAALRDKGARVEERHYPGVDHAGAVLALSRPFRRKATLLTDMTAFLKDVTA

SEQ ID NO: 62188 - protein, 256 aa, Kluyveromyces lactis NRRL Y-1140
HTHNSHTIMARTFFIGGNFKMNGSKASIKEIVDRLNGASIPSNVEVVIAPPAIYLDHAVALNKRKEVKISAQNAYSKASGAYTGENSVEQIKDVGAEWVILGHSERRTYFNETDEIVAEKTKFALDSGVKVILCIGETLEEKQQNITLQVVQRQLQAVLEKVQDWTNVVVAYEPVWAIGTGLAATAEDAQDIHHSIREFLAEKLSRDVADSVRILYGGSANGKNAVTFKDKADVDGFLVGGASLKPEFVDIINSRV

SEQ ID NO: 62189 - protein, 140 aa, Oceanicola granulosus HTCC2516
MATERTLSIIKPDATKRNLTGKINAKFEDAGLRIVAQKRIKLTQEQAGEFYAVHKERPFFGELTEFMASGPVVVQVLEGEGAIAKNREVMGATNPADAAPGTIRAEFAESVGENSVHGSDAPETAKEEISFFFSGLELVG

SEQ ID NO: 62190 - protein, 552 aa, Coccidioides immitis RS
MVDSVLIVLSNRLGLTQLALKSTAIDKFLYLSAIRKNNVHLFYRLVVDHLKALTPLIYTPVVGEACLKWSEIYQQPEGMYISYEDRGNIAGVIQNWPQPNVEITCITDGSRILGLGDLGINGMGIPIGKLALYTACAGIRPEVTLPLTLDLGTSNKSLREDPLYMGSRREKVTPEQELEFLDELMTALTERWPGIVIQFEDFKNPFPALARYRHNYTCFNDDIQGTGAVILAGVMNAVKKSGIPPQNHKAVFLGAGSAGVGVAKQIVDFFVREGMTEDEARACFYLVDTKGLVTADRGDKLAAHKVYFARTDNGGRQYKTLEEVVDYVRPTMLMGLSTLGGVFTPQILKKMSDWNKKPIIFPLSNPSANSECNFESAVVNTDGRCLFASGSPFQPFSYTNHAGETKTHYPGQGNNMYVFPGIGLGTILSKAVEITDTMIYASAQALSTALTSEEIEQGLLYPDITRIREVSVLVARGVIRAAQEAKVDRETGIRTFSDSDLDAWIKSRMYNPHGEVQSLEREVGLLLSSIGRLNVNREEGSAAHEVNGDSKL

SEQ ID NO: 62191 - protein, 818 aa, Oryza sativa
  misc_feature (86)..(86): Xaa can be any naturally occurring amino acid
MAATPTTSASAAATTRLFLPTRRHLHETASVPAPSRTIARRYSGGVRSLGPPRAAAGELGGGAGGTITGKGAVRIVSIVGDGSISXPLKDTPWEEVMRHTANRMKWVDEGFEMLVFTDKSIGHDELRKELAQCDMLVNVAITSQETVQWLINNSEDIPNIICFQSSPTLENKLGGRYVQYTGRQDMFCKLTNIGETGGMKESAEVLKAVSNAWERHNSDDIRFCLLVVVNAYIRPVDMLQNLRAKGLSTLSCMIRNCGPQILNCLFDPNCRKALQCLNSCSPTDQVCNYRCIASYESPHLEAFSLCVLQKNNCLDLNAEIPSKPSVPPLTMFREQMLSHELAEDMFVGWLDNLEWSWRVVAGQNPAYDQFPCQYQLFYRGKAKGSFWYEPIFQVRTLEGELVWRRRKYRVRRALIPGTFYFSVLDNGVVSKEFWTIVDVSDDFSWGLFHYHGAAQAAGLAYTGAVLVSPDGSCPDLDDPRLASALDKCGIKKWELYMVDNCSCTGAPLGTPGDAKLHYQIAPGKESDPPQQFALFTVQDWSCGPVEVIEKKQRARMAGLYERPSETYTKKRPRYPDAWFSKLAALTAGHHRAWDAGCGTGQASISIAEHYDSVVATDASEGQIRHAVAHPKVRYLHTPVDLSEDDLVAMVGGEGSLDLVVVATSIHWFDIPLFYAVANRVLKRPGGVLAVWGYNYEIHPFEDKLHGQLYPAMRPYMDPRTRLAMDRYRDLPFPFEPVGVGREGEPADVDIEVDMTLDDLVGFLKTGSVVTTAREKGVDLEAVTKDVMKGVEAEWGDPAVARKLVFKAFMLAGKPKVLN

SEQ ID NO: 62192 - protein, 585 aa, Coccidioides immitis RS
MGLEEHAVRPSNDDSRIDSSAEDLSASHDEDVEKGNGSLVRALRERHLQMIGIGGSIGAGLFIGSGQALSNGGPASTFLGFAITGAMVLCNLQALAELAVIYPVNGAFYTYAFRFIDPAWGFAMGWQYAVSWLIMLPIELTSAGLMITFWTSDINVGVWSAIFLVMVTVVQFFGIKGYGETEYILALVKVITCVGLIIVGLIINVGGVPTDNRGYIGGRYWHDPGAFRDGAKGFISVLVTAAFAYTGTEMIGLAAAETVNPRKSIPKATKQMLWCIVFFYVINILFVSLNIPSDSPALLGAKGGNIKASPFVIAAELAGIKVLPSIINAVIMLSIIGAANLCSYGSTRTLQALAATGNAPKFFAYIDSKGRPVWCILLQIAFGMLTFISEAASSEVVFTWMMALSGLSGLFLTTSICFTHIRFRRAWKLQGKNEEDIPYRSPFGVVGSIIGMGLSTIAIVATLYLGIFPIHATSRVEFFFQTCMAAPLALVAMLGWKIYKRNWKFGVDLRRVDLDEGRRMDYYSSGEDDHELREKGSSLTKKVAPWIHKEPYPGKMSAKPWAFLMDDSLKEHVRRGSTTPNSLTA

SEQ ID NO: 62193 - protein, 665 aa, Pseudomonas putida GB-1
MPSRRERANAIRALSMDAVQKANSGHPGAPMGMADIAEVLWRDYLKHNPSNPSFADRDRFVLSNGHGSMLIYSLLHLTGYDVTIDDIKGFRQLHSRTPGHPEYGYTPGVETTTGPLGQGIANAVGFALAEKVLAAQFNRDGHNIVDHNTYVFLGDGCMMEGISHEVASLAGTLGLNKLIAFYDDNGISIDGEVHGWFTDNTPARFEAYNWQVIRNVDGHDAEEIKMAIETARKSDRPTLICCKTIIGFGSPNKQGKEDCHGAPLGNDEIALARKELNWNHGPFEIPADIYAEWDAKAAGAKAEADWNQRFDAYAKAYPELAAEFKRRDSGELPADFSEKAQAYINEVAAKGETIASRKASQNALNAFGPLLPEFLGGSADLAGSNLTLWKGCKGVEANDASGNYVFYGVREFGMTAIMNGVALHGGLVPYGATFLMFMEYARNAVRMSALMKQRVIHVYTHDSIGLGEDGPTHQPIEQLTSLRSTPNLDTWRPADAVESAVSWKNALERKDGPSALIFSRQNLQHQDRNAQQIADISRGGYVLKDCAGEPELILIATGSEVGLAVQAFDKLTEQGRKARVVSMPCTSVFDAQDAAYKQSVLPLEVGARIAIEAAHADFWYKYVGLEGRIIGMTTYGESAPASALFEEFGFTLENILGTAEELLED

SEQ ID NO: 62194 - protein, 347 aa, Zea mays
  misc_feature (212)..(212): Xaa can be any naturally occurring amino acid
  misc_feature (239)..(239): Xaa can be any naturally occurring amino acid
MENMLHLAPSSQAQALALDRSSVFSREHVPPAVSAVTSLPVIDMSRSRDEVRRAILDAGMEFGFFLVVEHGIPEEVMRDMLEVCEEFFQLPAASKAYMYSEDSQRPNRIFSGTTYDTGGDKYWRDCLRLACPSSFPVGSGTRDDWPHTPQRLRGVVERFTALTRGLGVELLRLLSEAMGIRPDYLEGDISAGEVVLKVNHYPPCPSPEKTLXGLPPHWDGNLIPLLLQGSVYGLDVAYXGEWIKVEPMPGPLVVNLGQQLEVVTNGLLKSIEPRVVPSLTLARTAVATFIMPPPDCLIGPSKEFLPGDKPPCYRPIRLGDFMRMYNPVKGGSSINQITDFKNFQKKI

SEQ ID NO: 62195 - protein, 466 aa, Frankia sp. CcI3
MALHRQASGDRAEETVDVRPHLAPLGEEVVVPRFRMPQESTAPETAYQIVHDELMLDGKARLNMATFVTTWMDSYADRLMAECAPKNMIDKDEYPQTAALEERCVNILADLWHAPDAEHAVGCSTTGSSEACMLAGLAMIRRWRARRRSAGAPADRPNIVMGVNVQVCWEKFARYWDVEARLVPMAPGRTHLTADEAVAHCDENTIGVVAILGSTFDGSYEPVAGIVAALDHLAASGGPDVPVHVDAASGGFIAPFCDPDLVWDFQLDRVVSINTSGHKYGLVYPGVGWVLWRDRAHLPAELVFQVDYLGGTMPTFALNFSRPGAQVVAQYYTLLQLGYKGYRRVAQACRDNARWLAAEVAAMGPFELVSDGSGIPAFAFKLRDDITDYTVFDVSELLRTRGWLVPAYRFPPGLTDLAVLRVVVRHEFSRDLAGLLIADLRRVVNRLAHPGRRTAGDRPGESSFHH

SEQ ID NO: 62196 - protein, 580 aa, Dechloromonas aromatica RCB
MSFTLHGLGVSGGIAIGRAMLMSHATLEVSHLTLAPRMVDKEIERFDMAVNAVKEELILMKENTEHAPAELNAFIDIHTMFLEDPELAVKPRDIIRERRCNAEWALVQQMEHLVGQFEQFDDPYLRERKFDVVQVVERVVKELLGHRSRNALKTAKRSKEEALIVVAHDLSPADTIAFKEHRFAAFITDVGGATSHTSILARSMAIPAVLGLENARGLIRDGEQLIVDGMRGVVIVNPDQRVLDEYQLRKEQIELEKTKLKRLKTAKSETIDGVSVHLFANIELPNDVPVALDCGAEGIGLFRTEFLFLDRGDMPDEQEQYEAYKKVVKGMAGRPVTIRTFDLGADKDLNPQGNAGDRVKTNPALGRRAIRLSLAEPRMFQTQLRAILRASKHGPIKLLIPMLAHAHEIDQTLAALEQAKSSLRGEKATFDENIEVGGMIEIPAAALAVGLFLRRLDFLSIGTNDLIQYTLAIDRSDEQVAGLYDPLHPAVLMLIAHTLSMAEKVGVPVSVCGEMAGDPDLTRLLLGMGLRIFSMHPSQILKVKNRVLKAEVNELAPNVRRILRLDEPMKLREALDKLNA

SEQ ID NO: 62197 - protein, 387 aa, Pseudomonas putida GB-1
MTVLKMTDLDLQGKRVLIREDLNVPVKDGVVASDARILAALPTIKLALEKGAAVMVCSHLGRPTEGEFSAENSLKPVADYLSKALGRDVPLVADYLDGVSVQAGELVLFENVRFNKGEKKNADELAQKYAALCDVFVMDAFGTAHRAEGSTHGVAKFAKVAAAGPLLAAELDALGKALKAPAKPMAAIVAGSKVSTKLDVLNSLSSVCDQLIVGGGIANTFLAAAGHPVGKSLYEPDLVDTAKAIAAKVSVPLPVDVVVAKEFAETAEATVKAIADVAADDMILDIGPQTAANFAELLKSSKTILWNGPVGVFEFDQFGNGTKVLAKAIADSAAFSIAGGGDTLAAIDKYGVSKEISYISTGGGAFLEFVEGKVLPAVAILEERAKA

SEQ ID NO: 62198 - protein, 276 aa, Triticum aestivum
MEQHVLVALALSFVGGLSTSLGALLVIVNPSPDLKRLGLLQGFAAGLMLSISFLDLAHNALNSIGFLKANLWFFAGVLFFGFVVKFIPEPTFVPTTDASKKKTDDDGSGKDMMKKHRRQVLFSGIITAVGISLHNFPEGMAVFLGSVKGLRVGVNLAIAIALHNIPEGVAVALPLYFATKSKWQAFKYATLSGLAEPLGVFFVAVLFPSNLNPEILEGLLASVGGVMAFLTLHELLPLAFDYAGQKQAVKAVFVGMAVMSASLYFLEISLPKEISL

SEQ ID NO: 62199 - protein, 719 aa, Pseudomonas fluorescens PfO-1
MTRPKKAEPAAHAEPSRIREGLPFPLGATWDGLGVNFALFSANATRVELCIFDDAGEVELERIELPEYTDEIFHGYLPDAHPGLIYGYRVYGPYDPANGHRFNHNKLLIDPYAKQLVGELKWSEALFGYTIGHPDADLSFDERDSAPFVPKCKVIDPAHTWGHDHRVSVPWDKTIIYETHVRGISMRHPSVPENVRGTFAGLMVDDVLEHIRKLGVSTVELLPIHAFVNDQHLLHKGMTNYWGYNSIAFFAPDPRYLASGKIAEFKEMVAHLHDANLEVILDVVYNHTAEGNEQGPTLSMRGIDNASYYRLMPDDKRFYINDSGTGNTLDLSHPCVLQMVTDSLRYWASEMHVDGFRFDLATILGRYHDGFDERHSFLVACRQDPVLRQVKMIAEPWDCGPGGYQVGNFPPGWVEWNDKFRDTVRAFWKGDDGQLADFASRMTASGEMFNQRGRRPYSSVNFVTAHDGFTLNDLVSYNDKHNEANDENNQDGSNNNLSWNHGVEGPTDDPEINALRHRQMRNFFATLLLSQGTPMIVAGDEFARTQDGNNNAYCQDSEIGWVNWDLSEDGKTLLKFVKRLIKLRLAYPILRRGRFLVGEYNEDIGVKDVTWLAPDATEMTTEHWHDAQNRCMGMLLDGRAQETGIRRKGGDATLLLVVNAHHDIVNFTLPEVPEGSFWTCMIDTNQPSIRGQERFEFGHEYSVTGRSLLLFELQREEED

SEQ ID NO: 62200 - protein, 274 aa, Oryza sativa (indica cultivar-group)
MAAATSTMSLIPPITQQQRWHAADSLVVLASRRHDSRRRRRCRYVVPRARLFGPAIFEASKLKVLFLGVDEEKHQHPGKLPRTYTLTHSDVTARLTLAVSHTINRAQLQGWYNKLQRDEVVAEWKKVQGHMSLHVHCHISGGHVLLDLIAGLRYYIFRKELPVVLKAFVHGDGNLFSRHPELEEATVWVYFHSNLPRFNRVECWGPLRDAGAPPEEDDAVAAAAAEEVAAEQMPAAGEWPRRCPGQCDCCFPPYSLIPWPHQHDVAAADGQPQQ

SEQ ID NO: 62201 - protein, 280 aa, Brassica napus
INIPENWIGVSTDLGGVIKPTKAVSKFQTLALKNGAVLRDNTKVANINKDGENEGGVIVSTVKGEKFHGKKCIVTAGAWIGKLVKTVAGIEFPVDPLETTVCYWRIKEGHEDKFAIDSEFPTFASYGAPYVYGTPSLEYPGLIKVAVHGGYLCDPDKRPWGPGVKLEELKEWIKERFGGMVDTEGPVATQLCMYSMTPDEDFVIDFLGGEFGKDVVVGGGFSGHGFKMAPAVGRILAELATEGEAGGGVEMKQFSLRRFEENPKGNAKEYPDQVILGSCL

SEQ ID NO: 62202 - protein, 505 aa, Geobacillus kaustophilus HTA426
MIYSKPGEKDAKVQFKTRYDNYINGEWIPPISGRYFQNITPITGEVFCEVARSQAEDIELALDAAHAAKEAWGKTSPADRALILNKIADRMEENLEMLAVAETWDNGKPIRETLNADLPLAIDHFRYFAGAIRAQEGTISQIDDDTIAYHFYEPLGVVGQIIPWNFPLLMAAWKIAPALAAGNCIVLKPAEQTPASIMVLMELIGDLLPPGVLNVVNGFGLEAGKPLASSPRIAKIAFTGETTTGRLIMQYASQNIIPVTLELGGKSPNIFFPDVMEKDDDFLDKAIEGFVMFALNQGEVCTCPSRALIHESIYDEFMERALERVKKIRTGNPLDTSTMMGAQASAEQMEKILAYIDIGKQEGAECLIGGEKNIIPGFENGYYIKPTVFKGHNKMRIFQEEIFGPVVSVTTFKDEQEALEIANDTLYGLGAGVWTRNINLAYRFGRGIQAGRVWTNCYHAYPAHAAFGGYKQSGIGRETHHMMLAHYQQTKNLLVSYNPKPLGFF

SEQ ID NO: 62203 - protein, 296 aa, Ostreococcus tauri
MENYEKVAKIGEGTYGVVYKAKSLRDDAMVALKRIRLDQDDEGVPSTAIREISLLKELRHENVVSLLEVIHEETKLYLVFEYLDLDLKKHMDSSPHISNDRMVIKGYVYQICAGIAFCHSHRVLHRDLKPQNLLIDTTNNVLKLADFGLARAFGIPVRAYTHEVVTLWYRAPEILLGVRTYSTPVDVWSIGCIMAEMVNHAPLFPGDSEIDELFKIFKTLGTPGETLWPEAKQLPDYQEGFPKWKAKPWESLCPALDEAGVDLLRSLLQYSPEKRISAKYATQHRWFDDYREHIGR

SEQ ID NO: 62204 - protein, 368 aa, Candidatus Kuenenia stuttgartiensis
MNKLQLTSITELDLSESVELCRSLGEPSYRGKQILSWMYKKGATDFNQMSDIPLPFREKLEEAHNVFQTKIHTINTSQDGTEKFLIHLPDNNLIECVLLRDGKRRTACVSTQVGCAMGCSFCASGVLGLTRNLKTGEIIEQVLHIKNHLPANEHITNIVFMGIGEPLANYDKVVKSLRIMNADWGLAIGARNITISTVGLIEGIRRLAKEGLKVNLAISLHASNDNTRNKLVPSNSKTGIKNILGAAQEYFNATHRDISFEYTMIDGINDSKQDAKLLAQILKGVQCNVNILPVNPIKEGNFAPPVQKTVETFCTVLKNHGIVATVRQRKGINVNAACGQLRLQIQKHCHGEKILHTPPSLFLPANYK

SEQ ID NO: 62205 - protein, 329 aa, Ostreococcus tauri
MGGHSINDAYEKLEKIGQGTYGKVYKARDRATGRLVALKKTRLEMEEEGVPSTALREVSLLQMLSESPYIVRLLRVEHVEEDGKAMLYLVFEFLDQDLKQFMDLTGRGPSNPLPTTTVQNYMYQLCLGCAHLHKHGVMHRDLKPQNMLVDKAKNLLKIADLGLGRAFSVPVKSYTHEIVTLWYRAPEVLLGGSHYSTPVDMWSVGCMFAEMARKQPLFPGDSELQQLLHIFKLLGTPSEQVWPGVSNLRDWHEFPQWKPQDLAKLIPQLDAHGIDLLQKLLVFDPAKRIHATDALEHPYFDSLDKTQFEKIEREFEIEFLREKENRMAQ

SEQ ID NO: 62206 - protein, 535 aa, Ostreococcus tauri
MAPEPARASAPSAAVDAARDAEQRAPRSPAPAPSSANDDGVRPRRYDNWGARSVECYEKLEQIGEGTYGQVYMARCKETMDIVALKKIRMDNEKEGFPITAIREIKILKKLRHRNVVDLKEIVTSKASASNGHKGSIYLVFEYMDHDLTGLAERPGMKFSVPQIKCYMKQLLMGLHYCHNNNILHRDIKGSNLLINNNGVLKLADFGLAKPITNENAQPLTNRVITLWYRPPELLLGATQYGPSVDMWSAGCIFAELIHGKPILPGKSEMEQMDIIFKLCGSPTPENWPDADKLPYAKHFTQKKTYPRRLREVFSQFTPSAKDLLEKFLTLDPAKRISAKDALMHDWFWEVPKPCEPEDLPRYEPSHEYQTKKRRQEAKRAEQQNKRQRMDGHRPPPPMDDQKPASGPDVRPRGHAGPPGGMRPGMPPSGRYGAGGSASGWSSGGQQKQSYAQRSIGRQPTSGYGSIGGGMNRLGGSGGSYSNLNITTGTSGGSYSGYRGGSKTAGWAGGGQKAGSQKAGWANVSKDAKDGERRN

SEQ ID NO: 62207 - protein, 466 aa, Caulobacter crescentus CB15
MADYDFDLFVIGAGSGGVRAARLAALSGAKVAVAEEYRVGGTCVVRGCVPKKFMVYASEVTSQLKTAKGYGWTIEDARFDWKTFLHEKDVEIARLSGIYVTNLQKAGAHLLHGRAQIVDAHTVEVLPKDGSDDAGTYTARKILVATGGRPVRPVFPGAELGITSDEAFHLPTLPKSVLVVGGGYIAVEFAGIYAGLGVQTTLLYRGANILRGFDDDVRMHLADELEKRGIKVVLGCSHKSIEKLDDGRLLSTLSNDLTFETEAVMFATGREPYVQGLGLEKAGVKLNDKGAIAVDKYSKTNVDSIWAVGDVTDRINLTPVAIREGAAFAQTEFYGNPTTFDHDLVASAVFSQPPVGAVGMSEAEARQAFGKVDIYRSIFRPMKVTFYGGQERCLIKLVVKQDDERILGVHVVGPDSPEIIQMAAIAVKMGVTKPQWDSTCAVHPTLAEELVTMREKYVPAEVGGAG

SEQ ID NO: 62208 - protein, 227 aa, Caulobacter crescentus CB15
MSADDQKRISGEAAAELVENGMVVGLGTGSTAAWFVKALAARGLKDIRGVPTSDATAALARELGIPLAALDDVKTVDLTVDGADEIGPGLSLIKGGGAALLREKLVWEASTRCVVIADAAKRVPALGKFPLPIEVVRFGHVHTGYRLADIAAEFDLPPPRLRTAERGMVVTDGGNLIYDMASGKIEDPTALAAALKSVTGVVDHGLFLDLADEALVGTDEGVVRLQP

SEQ ID NO: 62209 - protein, 367 aa, Bacillus megaterium
MTKKVAVLPGDGGQSNQRRCCRLKAIGERLRHQFEFTYGLIGGAAIDEAGSSSSRSTIETCNEADAVLLGSVGGPKWDRFPSHLRPEKGLLAIRKELDLYANLRPVTFYDSLADASPLKKEYIEGVDFIIVRELTGGLYFGKPSDRRTEGNKETVVDTLFYKRTEIERIIASIDTAVNRRKKVTSVDKANVLESSRVWREVAEEVAKDYPDVELEHMLVDSAAMQLIRNPKYFDVVVTENMFGDILSDEASMLTGSLGMLPSASLTADGPSLYEPVHGSAPDIAGQNKANPIAAAILSAAMLLRHSFGLEKEAAVIEQAVESVLHAGHRTADLADGNHYLGTDKMVEVITAVIANDSAISSIMTASR

SEQ ID NO: 62210 - protein, 389 aa, Ostreococcus tauri
MERYERGRTLGEGTYGVVHEARVKETNEVVAIKKIRLGKLKEGVNFTAIREIKLLQEIKHEHVIELVDVFAHKKNLNLVFEYCGGDLEMVIKDKATPLSAGEVKSYARMTLRAVAHCHENWVLHRDLKPNNLLIAPNGCLKLADFGLARIFGSPDRRFTHQVFARWYRAPELLLGSKTYGPGVDVWAVGCILAELMLRKPFFAGSSDIDQLGKVYAALGTPTETNWPGVSALPDFIEFIYVPPPNLHDTFPNETNESLDLLKRMLEYDPNKRITAAQALEHPYFHTKPAPIPFEELPKRFATKNFTQHASGGTSPSREAKTGEKRRLEDADEAPDSTDPNFRPKPRRRRTGEGVAAVAKGAFGTPPFARRSRGDELKTRRFSPTPLAGN

SEQ ID NO: 62211 - protein, 368 aa, Ostreococcus tauri
MISFQKNYDVEIPPTGAPGEMAYGKKQRITSALRDLTNGELDNTRRRAPRPVQFSQVHPAEDIDTGLKSKDETSVIRRLHSPDVADIDDMQLAIAEDIHASLLKTQAFLVASKRFPPEISTSMRNILVDWMIEVAEEYKLVPETLFLSVMYTDVCLQEMNIHRSELQLLGTTCIMVAAKYEEIYAPPIDELCYITDNSYTRSQIIKMERAVLKCLEFSLTRTTVNTFLTFYLSRIHTSTRCSSLAAFLAELTLMCQTFLDFTPAVVATAAIFLAEYNLSDARPRILELDLFELLDNNQLTRCIESMNKEFASYDAEKFHALHEKYSSQKYNEVATVVAKGNPLAMLKQKCTIQRGAGRPNEQNIHREV

SEQ ID NO: 62212 - protein, 138 aa, Catharanthus roseus
MASKSTSALALFLALNLIFFTLVSACGDCPKPKPKPKPKPKPSCPPPPYVPKATCPRDALKLGVCADLLGGLISAVIGAPPKTPCCSLIEGLADLEAAVCLCTAIKANVLGINLNVPVSLTLLLNVCSKKVPEGFICA

SEQ ID NO: 62213 - protein, 452 aa, Arabidopsis thaliana
MKNSIPIDLIYEILSRLPAKSVARCRCVSKRWRSILRHQVFTELFLTRSNARPRLLIGVQQDGEWSFLSTPQPQNRHESSSLVVAAADFHTKFSSGKSRHQCTYASDEDAKRVLCDPLTGQYVILPELRVGGSYSYLGFDPIDKEFKVLFMDTCDFIASKDEDHYILTLGTGELKWRKIQCPFTHEPFWERICINGVLYYSAYYSDSNGRSHLIACFDVRSEKFNFIATKHRYDQLINYKGKLCGINLEYARHVGGFPVKLSMWVLEDVEKPEWSKHVYSLWTESEVVKVNRNLSVSGMTATGDIVLSMEDATNPFYVFNFNPDRNTLQVQSVEIQGLGANRDHIACHAFVDYVEDFSVSDAVLQLKSSPLQQQGQDTSHDLSKSVKNKQLDNYEFLANKLNHSGRSIVINKSKPQQRRHTSRDLCKSAPSVKNKQHNKYESLANILYHSVG

SEQ ID NO: 62214 - protein, 129 aa, Oryza sativa (indica cultivar-group)
MARLIASSSSSAAVYCFVVLLINAMAMAPATATETAAAAAVDKCERDLDLLMGSCEEYLRFPAEAKAAPSMACCGAVRRVDVGCLCGMVTPEVEQYVCMDKAVYVAAYCHRPLLPGSYCGSYHVPGPVV

SEQ ID NO: 62215 - protein, 363 aa, Glycine max
MATLKSLCFRGTAFPVCPSNVTNNRNSRSSYWRPAQAAVKPNFHLPMRSFELKNRTSPEDIKALRLITAIKTPYLPDGRFDLEAYDDLVNMQIGQGAEGIIVGGTTGEGQLMSWEEHIMLIAHTVNCFGGKIKVIGNTGSNSTREAIHATEQGFAVGMHAALHINPYYGKTSLDGMLAHFQSVLSMGPTIIYNVPARTGQDIPPHVIQTLAESANLAGVKECVGNDRIKQYTDDGIVVWSGNDDQCHDARWGYGATGVISVVSNLVPGLMRELMFGGVNPTLNSKLLPLIDWLFHMPNPIGLNTALAQLGVVRPVFRLPFVPLPVDKRIEFANLVKEIGREHFVGNKDVEVLDDDDFFLVSRY

SEQ ID NO: 62216 - protein, 278 aa, Zea mays
MGDGRTGGANRPAWLQQYELIGKIGEGTYGLVFLARLKPPHPAPGRRGPPIAIKKFKQSKEGDGVSPTAIREIMLLREINHENVVKLVNVHINHADMSLYLAFDYAEHDLYEIIRHHREKLSSSINPYTVKSLLWQLLNGLNYLHSNWIIHPDLKPSNILVWCHQLYRNIIAQFLQTCPLADTYFICATKVMGEGDEHGIIKIADFGLARIYQAPLKPLCDNGVVVTIWYRAPELLLGGKHYTSAVDMWAVGCIFAELLTLKPLFQGVEAKNPPNPFQ

SEQ ID NO: 62217 - protein, 334 aa, Oryza sativa (japonica cultivar-group)
MVDGSNWMAAATRRSMVEDEDYGGGRRRLGQRGQRMSSLLQAVCEHLGVDLCEGDDSPRRLGTFSSSPTPHAAASTSSPPLSFPNADLVLRLDPCPDYEVDFDVSEDHHSSIDLHVLLIMEEEGFYTNLMNEGNDSLDWDSLSTMPVEDDMSNQLDENGMSSEPVTQQFPTIERTTVARPNQKRSKNFSEQEDKILVSAWLHVSLDPVLGTNQTRAAYWTRIYEHLYKTSKSTPDRSQNSLMHRWKTIQENVNKFCGYLSQIEGRRQSGVSIHDKIAQAIAVFKELEDKPFQFLHCWTLLRSQSKWHDKMKQITSQKPCATKKQKASTDGKPPR

SEQ ID NO: 62218 - protein, 1317 aa, Pseudomonas putida GB-1
MATTTLGVKLDDPTRERLKAAAQSIDRTPHWLIKQAIFNYLEKLEGGATLTELNGHVSNLADDAGEVQADHSHQCFLEFAESILPQSVLRSAITAAYRRPEQEVVPMLLEQARLSAPLAEATNKLAAGIAEKLRNQKSAGGRAGIVQGLLQEFSLSSQEGVALMCLAEALLRIPDKGTRDALIRDKISTGNWQPHLGNSPSLFVNAATWGLLLTGKLVSTHNESGLTSSLTRIIGKSGEPMIRKGVDMAMRLMGEQFVTGETIAEALANASRFEAKGFRYSYDMLGEAALTEHDAQKYLASYEQAIHSIGKASHGRGIYEGPGISIKLSALHPRYSRAQYERVMEELYPRLLSLTLLAKQYDIGLNIDAEEADRLELSLDLLERLCFEPSLAGWNGIGFVIQAYQKRCPYVIDYVIDLAKRSRHRLMIRLVKGAYWDSEIKRAQVEGLEGYPVYTRKVYTDVSYVACARKLLAVPEAIYPQFATHNAHTLSAIYHIAGQNYYPGQYEFQCLHGMGEPLYEQVVGKIADGKLNRPCRVYAPVGTHETLLAYLVRRLLENGANTSFVNRIADHSISIQELVADPVASIERMGTQEGSIGLPHPRIPLPRDLYGNERANSAGIDMANEHRLASLSCAMLATAHNDWKAAPLLACAASDSAAVPVLNPADLRDVVGHVQEATVADVDNAIQCALNAAPIWQATPPAERAAILERTADLMEAEIQPLMGLLIREAGKTFANAIAEVREAVDFLRYYAVQARNDFSNDAHRPLGPVVCISPWNFPLAIFTGQVAAALAAGNPVLAKPAEQTPLIAAQAVRLLLEAGIPEGVLQLLPGRGETVGAGLVGDERVKGVMFTGSTEVARLLQRNVAGRLDNQGRPIPLIAETGGQNAMIVDSSALTEQVVIDVVSSAFDSAGQRCSALRVLCLQEDSADRVIEMLKGAMAESRLGCPDRLAVDIGPVIDAEAKAGIEKHIQGMREKGRSVYQVAIADAAEIKRGTFVMPTLIELDSFDELKREIFGPVLHVVRYNRRNLDQLIEQINNSGYGLTLGVHTRIDETIAKVVETANAGNMYVNRNIVGAVVGVQPFGGEGLSGTGPKAGGPLYLYRLLSTRPADAIGRHFQQQDGEGKPDRTLHEQLIKPLHGLKAWAESNQLADLAALCDQFASQSQSGIARLLPGPTGERNSYTILPREHVLCLADNEADLLAQLAAVLAVGSSAVWADSEPGKALRARLPRELQAKVKLVADWNKDDVAFDAVIHHGDSDQLRSVCQQVAKRAGAIVGVHGLSSGDHQIALERLVIERAVSVNTAAAGGNASLMTIG

SEQ ID NO: 62219 - protein, 391 aa, Lactococcus lactis subsp. lactis Il1403
MDLLKKFNPNLDKIEISLIRQFDQQVSSIPDVIKLTLGEPDFYTPEHVKQAGIVAIENNQSHYTGMAGLLELRQAASEFMNKKYGLSYAAEDEILVTVGVTEAISSVLLSILVAGDEVLIPAPAYPGYEPLITLAGGSLVEIDTRANDFVLTPEMLEQAIVEREGKVKAVILNYPANPTGVTYNRGQIKALAEVLKKHEVFVIADEVYSELNYTDQPHVSIAEYAPEQTIVLNGLSKSHAMTGWRIGLIFAARELVAQIIKTHQYLVTSASTQSQFAAIEALKNGAYDALPMKKEYLKRRDYIIEKMSDLGFKIIEPDGAFYIFAKIPADLEQDSFKFAVDFAKENAVAIIPGIAFGQYGEGFVRLSYAASMDMIEQAMARLTDYVTKKRG

SEQ ID NO: 62220 - protein, 247 aa, Glycine max
MSAAMDMSLDDIIKNNKKSGSGSSRGRIRPSGSGPSRRFPNRAANRAAPYATAKAPEATWQHDLYADQQVAAAGYPAQGGRAASIETGTKLYISNLDYGVSSDDIKELFAEVGDLKRHAVHYDRSGRSKGTAEVVFSRRADAVAAVKRYNNVQLDGKPMKIEIVGTNISTPGVAPARNGAIGNFDGVPRSGQGRGGALRRPGGRGQGVRRDRGRGRGRGGAGRGEKVSADDLDADLEKYHAEAMQLN

SEQ ID NO: 62221 - protein, 327 aa, Arabidopsis thaliana
MDLFSSLPNELLYHILSFLSTKEAALTSVLSKRWRNLFAFVPYLEFDDSVFLHPEERKREKEGILQSFMDFVDRVLDLHGDSLIKTFSLKCKTGVDSDHVDRWICNVLARGVSDLDLFIDFRDLYSLPHEVGVSRTLVVLRVGSESDLYWWQKFLCLPMLKTLVLDSCWLCIGQFQILLLACPALEELDMTNTRWKDSNVTVSSSILKELTIDLHGCCSVVNLKSLSFDAPSLVYFYYCDSLAEDYPQVNLKNLVEAQINLLLTQAQIEQVRALNNEMLVADDVFPGLGNAWKLITGLRNVQQLYLSPDTLEVSFLSLVYFWLVGRI

SEQ ID NO: 62222 - protein, 512 aa, Oryza sativa (japonica cultivar-group)
MGLPGRRNPLLSARRAAASLRRSRRLPVYVAAVFFVASVLLMFRDEILYLTTARSPSSSLPTTGGSAGGAGLARKEELVSVNKPVLLGHGGKPEKHHSVTERHRPKVSAKRRPNKKAAKAARKKFMASPSVAAGAEVNVPETCNLSKGKWVFDNATYPLYREQECEYLTAQVTCTRNGRRDDGYQKWRWQPRDCDLPLAFDARLFMERLRGKRLMFVGDSLNRNQWESMVCLVRPALSPGKSYVTWWDGQRVVLHAWEYNATVEFYWAPFLVESNSDDPKAHSIRDRVIKPEAIAAHAGDWVGVDYLVFNTYIWWMNTVNMKVVLPTRHDQFTVIRRPTGKTWEEYDEVGRIEAYRRVLDTWATWVNDNVDPARTSVFFMSVSPLHISPEAWGNPGGVRCAKEDAPVQNWHGPLWLGTDWDMFRAARNASRAAGRVPVTFVDVTAMSELRKDGHTSVHTIRQGRVLTPEQQADPATYADCIHWCLPGVPDVWNLMLYARILSRPPAAAGHVA

SEQ ID NO: 62223 - protein, 125 aa, Oryza sativa (japonica cultivar-group)
MEVAKPRWYERTLVLAVQRVFFNAYFLGYLLSPKLAHRVVGYLEKEAIHSYTKYLKDNEAGKIENVPASPIAIDYWRLPAGATLKDVVVVVRANEAHHRDVNHFASDVHFQGMDLKDTPAPLDYH

SEQ ID NO: 62224 - protein, 481 aa, Oryza sativa (japonica cultivar-group)
MAGPTIVLLPAWGSGHFMSALEAGKRLLVAGGGAVSLTVLVMQAPTEIEASVVEAHVRREAASGLDVTFRRLPAVEHPTGCEATEEFMSRYVERHAHHVKAAIAGLASPVAAVVVDLFFTPLLDAAHELSLPAYVYFASTAAFLALMLRLPELRDDLTVGFDGMEGTVDVPGLPPVPPSYMPVCLVSKTVKNYDWFEYHGRRFTEAKGIIVNSSVELEGAVLAAIADGRRPAPAIHAIGPVIWFDATLPPEQPHECVRWLDAQPAASVVFLCFGSIGFLDAAQVRELAAGLERSGHRFLWVLRGAPAGGVRYPTDADPGELLPEGFLEATAGRGMVWPRWAPQKDILGHAAVGGFVTHCGWNSVLESLWFGVPMATWPLYGEQHLNAFEAVASMGVAVELRRTTAKDGDAARSLVEAAEVERAVRRLMAPQGGGSSEAREKAAEVSAACRKAVEEGGSSHAALQRLVREIVRVVAGHTRPE

SEQ ID NO: 62225 - protein, 459 aa, Oryza sativa (japonica cultivar-group)
MGTRRRRNPVIFLFLWFVMAFELCASLNHEGVALMRFKEMIDADPFDALLDWDEGNASPCSWFGVECSDDGRVVALNLPNLGLKGMLPQEIGTLAHMRSIILHNNSFYGIIPTEMKYLHELKVLDLGYNTFSGPFPSELRNILSLKFLFLEGNKLSGSLPIEYELASMDQTSLNKISTERKTSTVVPFSPTASGQLHTATLGEIAAVSTLVTYASGWTTVAEAQFKDKVEVLSKVSHKNLMNLVGYCEDEEPFTRMMVFEYVSNGTLFEHLHVKEADQLDWQSCLRIAMGVMYCLNYMQQLNPPVLLRDLSTSCIYLTEDNAAKVSDISFWGDKKEDEKSEASDEHITVYKFALLLLETISGRRPYSDDYGLLILWAHRYLIGDKPLMDMVDPTLKSVPEEQVRELTKLVKLCLSEDPMERPTVAEVTAWMQEITGISEEEAIPKNSPLWWAELEIITS

SEQ ID NO: 62226 - protein, 302 aa, Candida glabrata CBS 138
MSSSQFKQLEKLGNGTYATVYKGLNKSTGVYVALKEVKLDSEEGTPSTAIREISLMKELKHDNIVRLYDVIHTENKLTLVFEYMDNDLKKYMDSRTVGNAPRGLEMNLVKYFQWQLLEGLAFCHENKILHRDLKPQNLLITKRGQLKLGDFGLARAFGIPVNTFSSEVVTLWYRAPDVLMGSRTYSTSIDIWSCGCILAEMITGKPLFPGTNDEEQLKLIFDKMGTPNETTWPGVTSLPKYNPNFQQRLPKDLKAELQPYVKEPLDDNVIDLLHGLLQLNPDMRLSAKQALLHPWFSEYYES

SEQ ID NO: 62227 - protein, 524 aa, Oryza sativa (japonica cultivar-group)
MALKSPVDFAGSITSGQKDPCCFGVPGCNPRCVRYNKKSRTCRLVTRAISVDRPQLDFSNSDWKKQFQEDFDRRFSLPHLKDVIDVEPRPTTFSLKSRTPLENVNGSMQGSWNGYVNDDDRALLKVIKFASPTSAGADCIDPDCSWVEQWVHRAGPRKQIYFEPQYVKAGIVTCGGLCPGLNDVIRQIVLTLEKYGVKNIVGIQHGFRGFFEDHLAEVPLNRQVVQNINLAGGSFLGVSRGGANISDIVDSIQARRLDMLFVLGGNGTHAGANLIHEECRKRKLKVSIVGVPKTIDNDILLMDKTFGFDTAVEAAQRAINSAYIEAHSAFHGIGLVKLMGRSSGFITMHASLSSGQVDICLIPEVPFTLDGPNGVLQHLEHLIETKGFALICVAEGAGQEHLQQSNATDASGNMILGDIGVHLHQKIKAHFKEIGVHSDVKYIDPTYMVRAVRANASDAILCTVLGQNAVHGAFAGFSGITTGICNTHNVYLPISEVIKSTRFVDPNSRMWHRCLTSTGQPDFH

SEQ ID NO: 62228 - protein, 129 aa, Desulfovibrio vulgaris subsp. vulgaris str. Hildenborough
MTAKKSISTTKAPAAIGPYSQAISAQGLLFVSGQLPIDPATGTLIKDDIEAAAHQVFTNLRAIAEAAGITLDHAVKTTVFMADLADFKAVNAVYAQYFATPFPARSAIQVAALPLGGTIEVEAIFALEG

SEQ ID NO: 62229 - protein, 340 aa, Arabidopsis thaliana
MESLGKLQLHHQPFHLSFTHTSSSTFPKNLFKSSIQPISSLKSASIKASSSKFQNSITPLPKSTPFRLFKSTCITLTTAAALLLANLHLKSPAIAAPIAPPPSVESKENVTLEEEERALDEHLITHPSDVDALRSLMEVKIKSRKLTEAVEVIDRLIKLEPEEKEWPVLKANIFTYSGDLDLAKTGFEEILAKDPLRVEAYHGLLMAYSDAGLDLKEVESRIEEAMLKCKKENNQNDFRDFKLLVAQIRVIEGKHSEALKLYQELVKEEPRDFRPYLCQGIIYTLLKKKDKAEEQFDNFRKLVPKNHPYREYFMDNMIATKLFSEKAQREMAEEMAGSTS

SEQ ID NO: 62230 - protein, 472 aa, Lactococcus lactis subsp. lactis Il1403
MVVGAQATEVDLVVIGSGPGGYVAAIRAAELGKKVTIIEKDNVGGVCLNIGCIPSKALINIGHHYQESLEEEKGENPFGLSVGNVKLNWESAQKWKQDKVVNQLTGGVKMLLKKHKVDVIQGTAEFIDNNTINVEQEDGFQLLQFNDVIISTGSRPIEIPSFPFGGRIIDSTGALSLPEVPKHLIIVGGGVIGSELGGAYRMLGSKITIVEGLDHILNGFDKEMSDIIANRVKSAGSEIFTSAMAKSATQTDKDVTLTFEVDGKEQTVTGDYLLVSVGRRPNTDLIGLNNTDVKLTDRGLIEVDDSYATNVPHIYAIGDVVPGPMLAHKASFQAKVAAAAIAGAEDDVDLHVALPAVAYTTTELATVGETPESVKDRKDVKISKFPFAANGRAISMNDTTGFLRLITETKEGALIGAQIVGPGASDLISGLSLAIENGLTSKDISLTIQPHPTLGEAIMDTAELADGLPIHV

SEQ ID NO: 62231 - protein, 532 aa, Lactococcus lactis subsp. lactis Il1403
MTEIFKMPDIGEGMHEGDIANWLVKVGDVVKEDDPIAEVQNDKLMQEILSPYSGTVTKLFVEAGTTVEVDSPLVEFDGDGSGSSAAAPTPQETAGSDTATTDAPSGEAQIFTMPDIGEGMHEGDIANWLVKVGDEIKEDDPVAEVQNDKLMQEILSPYSGKVTKLFVEAGTTVEVGAPLIEYNGNGAAPAAASPAPVAEAPKAASPASPANAPLTKTTSTGHILAMPSVRHYARKAGIDLSQVPATGRHGHTTLADVKAFESGSVAPIAQTTPEAAPAPKADKPAAPVAEKAPSVKAGAGDRREAMNPTRKVVSKVMTAQHTHIPPVTNFDQVEVSKLVKHRAVFKEIAAKQDIKLTYLAYVAKALATTAHKFPDINASVDYEKQEIVYHEHVNLGIAVNAPTGLYVPVIHEAETKSILEIAKEIAELATATREGTLKPQQMQGSTITISNIGSARGSWFTPIINGSDVVILGLGSIVKEPIVNGEGEIVVGQNMKLSMTYDHRLIDGMLGQTSLNYLKSLLADPEFMLMEI

SEQ ID NO: 62232 - protein, 326 aa, Lactococcus lactis subsp. lactis Il1403
MAVKTYIAAITEALDLALEKDKDALIFGEDVGQNGGVFRATDGLQAKYGEERVFNTPLAESGIGGMAIGLATQGFHPIMEIQFGTFIFEVFDSIAGQMSRTRYRFNNTRSNNIVVRTPYGIGTKTPEMHADSIEGLFSQIPGIRVVMPSNPADAKGLLLASIENNDPVIFLENLHLYRSLKGEVPEGYYTTPLDTAAVAKEGSDVSIIAYGGTVPLALKAAEQLEKDGIKAEVLDLRTVAPLDIESIGKTVEKTGRVVVVQEAQRTAGIAANVMAEISERFVLNLKAPIGRVSGPDSIFPFAQAENDWAVKAEDIVNKVKEVVDYD

SEQ ID NO: 62233 - protein, 423 aa, Alkalilimnicola ehrlichei MLHE-1
MFLECNPRFVSRLTRDTLALIMAGGRGGRLSNLTDWRTKPAVPFGGKFRLIDFPLSNCINSGIRRIEVLTQYKAHSLIQHIQRGWGFLRGEFGEFVELVPAQQRMDKPLWYAGTADAVYQNIDIIKAHNPSYVLVLAGDHVYKMDYGGMIARHAESGAAMTVGCVEVPRKRASAFGVMSVNEERQVLAFNEKPKDPTPMPGNPDRALVSMGIYVFDRDYLFQLLREDAENFDSSRDFGKDVIPNAIANHKVQAYPFSDPVSGQQAYWRDVGTVDAFFQANMELIGEDPELNLYDEEWPIWTYQAQLPPAKFIQGRDGRHGTAINSMVSGGDIIHGAEVRDSLLFSQVVVQPGATVHEAVILPDVRVGEGCRIRKAVIDEGCRIPAGTVIGEDPAEDRRRFFVTPKDVVLVTAEMLGQEVAHVR

SEQ ID NO: 62234 - protein, 520 aa, Streptomyces avermitilis MA-4680
MRLGGVGMTEGDQVRRERVPHVRVAVIGSGFGGLGAAVRLRREGVTDFVVLERADSVGGTWRDNSYPGCACDVPSHLYSFSFAPHPDWPRTFSGQEHIRAYLEHVTDTFRLRPHLRFNSEVKRMTWDADQLHWTVETATGTLTADLVVSATGPLSDPRIPDVPGIETFPGKVFHSARWDHDYDLRGKRVAMIGTGASAIQIVPEIQPRVAKLTLFQRTPPWVMPRVDRAIGRAERGLHRMLPFTTQVRRGLLWGIRELQVQAFTKHPDELGLVERLARRNIARAIEDPGLRARLTPDYRIGCKRILLSNTYYPALARPNVDVVASGLAKIDGSTLVAADGSSAEVDAIVFGTGFHVTDMPIAERVVGADGTSLAQSWSGGMKALRGASAPGFPNWMSIIGPNTGLGNSSMILMIESQLNYLADFIRQLDVLGGKVALDARPGAVHAWNSKVQERMRRTVWNTGGCTSWYLDANGVNTTVWPGTTTEFRNATRRVDLAEYEVVRAPRPAAAGVRAKAEADA

SEQ ID NO: 62235 - protein, 516 aa, Oryza sativa
  misc_feature (440)..(440): Xaa can be any naturally occurring amino acid
TLAPGRSHPPFLSPASPPLERVAGNRATCRDGSSEATNPGARGRPGVKGWRGEPGRPRDAGAWRLIRRRHRQIWHPRSWIRCPRRPLPSPPPPPPQRQIRPHLRNHLLPLLHAATSTASSSPLHLTHRLLSTAARSPFSVEHYLIATCGLTAAQARRASPKLSRLNSSSNPDAVLALLSSSAAGLDSLSLSRADLAAVVAAEPRLVRARPGTIARRIASLRGRANLSAPQIAASSCPAARRTAGSSDVSPKLAFWVPFLGSFDMLLKILRRCNAILATDVDRVVRPNVALLGECGLGVCDIVQMTQNAAWLLTFNPERLKIVVRRAEELGVPTSSWAFKDAVCTVARNNEGTIAARMEFLRGTLGCSMDKLRSAISRKPSILGFSEKTLRGKIEFLLTKVQLETEYILQRPVMLTLSLDKRLAPRHYVLQALVEKGLIKXDVDYYSCVCFGNEHFVARYIDRHEDALPGLTDAYAAVHAGKSPAQSLTQHLKTDRYRSDGEATYVLRNQPVGMEDK

SEQ ID NO: 62236 - protein, 374 aa, Lactococcus lactis subsp. lactis Il1403
MSNSEQILDFKAQLELQDTTFPMLQILNEEGKIVDEDGLKRAGLSDEKLVELFKSMLFARQVDIRSMKLAKQGRMGFFGPHAGQEASQMASSFAFTDEDWLFPGYRDLPQIYAKGWPIWKGLLWSRGHQLGNEYTTDDGKPVNSWFPQIIIGAQYVEAAGVALGLKKRKKDAVAFVYTGDGGSSQGDTYEGINFAGAYKAPLVAFIQNNGYAISTPRSLQSAAPHLAAKGWAAGAPSIVVDGMDAIAMYLASKEARAWAVAGNGPVVIEAITNRLEPHSTAGDDPLRYRTKEDIEAWWKKEPLVRMRNFLTEKGLWDTEKEEAYIAELDAGIDADIKKANNVEKQKISSFIKNTLEVPSQAMAEQIAKFESEGK

SEQ ID NO: 62237 - protein, 150 aa, Brassica napus
MGRKRKHSEAEAAAPVKKDDSAPERPKRTLLGWKDKKEDVEEAKEVSAPSAPGFRNKEKVLVTCSRRISFRYRHLMLNIVSLLPHCKKDSKVEAKSSKGATLNELVELKGSSSCLFFECRKHKDLYMWMVKSPSGPSVKFLVNAVHTMEE

SEQ ID NO: 62238 - protein, 278 aa, Saccharophagus degradans 2-40
MDTYMVVGNPIAQSKSPLIHTMFAAQTEQQLEYSRQLLEPGEFDAAAKTFFAGQGKGINITMPFKQDAYNFADELSPRALSAGAVNTLIKREDGSILGENTDGVGLINDITDNLNWTLSGRKVLIVGAGGAVGGILLPLMEQNPAEVLIVNRTASKAEELAARFASMGNIRGAGYGELSAAEGGSCSAFDVIINGTSTSLTGDLPPIPPAVITNTSCVYDMVYGAEPTPFMVWAQNHGAAATADGLGMLVGQAAESFYLWRGIRPDIAPVMAALRQSQ

SEQ ID NO: 62239 - protein, 564 aa, Desulfovibrio vulgaris subsp. vulgaris str. Hildenborough
MPWLQSYDKDVPARIDYEVAPLFAFLDEAAERHPKQTAIIFRNYKVSYAKLRLLAERFAANLRAQGVLPGDRVSVMLPNVPQAIIAFWGLLKAGCTVVMTNPLYMEKELVHQIHDSGAEYMIALDLVWPKIEPLRDRLGIRKFFITRISDALGFPLNLLYRFKAKREGTWRDVPFDGETVIPWKTLFKKKEGYSAKVENPREALALLQYTGGTTGISKGVMLTHYNLSVNVQQIKAILGESTRMRHTFLGLMPYFHVYGLTTCLTLPTALGATIIPFPRYVPRDVLVGIDKHKPTIFPGAPSIYISLMQQKDVGEFDLKSIKYCISGSAPMPLEHIRRFHELTGAQVIEGFGLTEASPVTHLNPIHGVQKPGSIGVPFPDTEARVVDMEVGLVPLPPGKIGELIIRGPQVMQGYLNRPDETANTLRNGWLYTGDIATMDEDGYFFIVDRKKDMIIVGGYNVYPREIDEVLHEHPKVKEAVTVGVPHATRGEIIKAYIVPREGVKLTKAEIVAHCREQLANYKVPKQVEFRNELPKTIVGKVLRRILRAEEEERLKNAPAGNGED

SEQ ID NO: 62240 - protein, 363 aa, Acidobacteria bacterium Ellin345
MTARYDVAVIGAGVFGAWTAHALRQSGKRVVVVDAYGPANSRASSGGETRITRMAYGDDEIYSRWAFESLPEWRALEQRSGRQLFFETGVLTFSDANTNWVQKSVEVIHKIGGEAELLSHDECRHRYPQIGFKPSEIAVFEPRSGALLARHAINLLVEELIRNGCEYRQQSISSPEDAFRLNAEQYVFACGAWLPKLFPDILGPHITPIRAEIFFLGVPPNTPAFDPPQMPTWIFMGNENWDAYGMPSLENRGFKLAVDLIKQPADPDTMDRQPTAPYVAQMREFVRERFPLLADAPIVETRVCQYENTPTHHYLVDHHPRWENIWLVGGGSGHGFKNGPALGKYVADAITKHAPLEPLLRLP

SEQ ID NO: 62241 - protein, 332 aa, Zea mays
MSSRMAGAALLRHLGPRLFAAGPAVSGLTARGGMPAAARLLPARMASTAAEAAREDAGANKQHGGTEKHEEEAAGGQSKKAVVSYWGIDTPKLVKEDGTEWKWTSFRPWDAYTSDTSIDIGKHHAPTTLPDKAAYLIVKSLRVPMDLFFQRRHASHALLLETVAAVPGMVGGMLLHLRSLRRFEHSGGWIRALLEEAENERMHLMTFLEVTQPRWWERALVLTAQGVFFNAYFLGYLLSPKFAHRVVGYLEEEAVHSYTEYLKDLEAGIIDNTPAPAIAIDYWRLPADAKLKDVVTVVRADEAHHRDVNHFASDIHYQGMKLKDTPAPLSYH

SEQ ID NO: 62242 - protein, 178 aa, Oryza sativa
  misc_feature (87)..(87): Xaa can be any naturally occurring amino acid
MQRAIQAIGSHGSLLKSAVLRHISAPKPSILPAVYSRSMSVSSAQIEESGFETATVADILKSKGKSADGSWLWCTTDDSVYDAVKSXYLRKIIVQGRSSKSTKVGDIMTEENQLITVKPDTRVLQAMQLMTEKRIRHIPVIDGTGMVGMVSIGDIVRAVVSEHREELNRLNAYIQGGY

SEQ ID NO: 62243 - protein, 555 aa, Acidobacteria bacterium Ellin345
MPTDVIMPQMGESIFEGTITKWLKQPGDQVQRDEPLFEISTDKVDAEIPAPAAGILKEIKAQAGQTVQVNTVVAIIDAAGSATTSAPKPAAAAPPKSAPQPDGVSSSAPSTSAPSVPAAGPKTDVVMPQMGESIFEGTITKWLKNVGDTVQRDEPLFEISTDKVDAEIPAPVAGVLSEIKVQAGATVQVNTVVATIGGAAGASARAPQAAAPAPSAPAPAAPAPQAPAAAEPEEEEISASGDRVRTSPLVRKMAKEANVDLGKVRGTGMGGRITKEDIQAFVEKQKTAPTPTPQPQAAQPSAPAPAPSAPVAATPNKFAGTPGAIEPMSVMRKKIADHMVMSKRTSAHVHGVFEVDFTKIVKLREKNKNSFQEKTGLKLTYTPFYARAVAHALRAWPIINASVEGENIHYKKDINLGIAVALDWGLIVPVVKQADGLSFVGLQRAITDLGERARAKKLKPEDVQGGTFTITNPGIFGAKFGMPIISQPQLAILGIGAITKVPMVVTDKDGNDSIAIRSRCHISIGYDHRVIDGAVADQFMVVVRDYLQNWNEPLI

SEQ ID NO: 62244 - protein, 345 aa, Oryza sativa (japonica cultivar-group)
MADELDELLGFLSSPQPNVRGAAAGIVRGLTGDADGLRALSARADRALPALLRLLASAGGELGTGGAAADSLVNLSQDGALSARLVSLGAVVAAMDVVAKRGGEQPGLARSLVMLLANLTQVDSGVAALLQVGDEKMQGLYVAKLVRSFCRSSSESEEEDIFEHVASILVNISKVEAGRRILMEPKRGLLKQIIRQSDSTNQLRKKGVVSTIRNCCFEADTQIQNLLSLAEYIWPALLLPVAGKKIYSEEDRSKMPPELANALSHEREAVENSEIRQQALEAIYMIVLQDEGRRAFWSVNGPRILQVGYEDEEDPKVMEAYELIGSLLVGKGDDEQDQEQGGQKP

SEQ ID NO: 62245 - protein, 431 aa, Oryza sativa
MRAVSMAATHRRHRRTDGRLQHNTVTVTEEAGATIPAANMLAAAASVKLSTAGTATAPKMALFKPLHLPPLFAAAAAAAGPRPLSLSARPLYRQQDPLFLASRVASPAPPPPSATADGARPVEAAPAGAAPEEAARRAKIGVYFATWWALNVIFNIYNKKVLNAFPYPWLTSTLSLAAGSAIMLASWATRIAEAPATDLDFWKALSPVAIAHTIGHVAATVSMAKVAVSFTHIIKSGEPAFSVLVSRFFLGEHFPAPVYFSLLPIIGGCALAAITELNFNMIGFMGAMISNLAFVFRNIFSKKGMKGKSVSGMNYYACLSMLSLVILLPFAFAMEGPKVWAAGWQKAVAEIGPNFVWWVAAQSVFYHLYNQVSYMSLDEISPLTFSIGNTMKRISVIVASIIIFHTPVQPINALGAAIAILGTFIYSQAKQ

SEQ ID NO: 62246 - protein, 335 aa, Alkalilimnicola ehrlichei MLHE-1
MASRKITVLPGDGIGPSIVEATQRVLDRLNCGLEYEYADVGLTALEQGRELIPQEALDAIERNGIVLKGPITTPVGEGFTSVNVTLRKEFQLFANVRPVITIPGTRARYENIDIITVRENTEGMYSGIGQTLSEDGNTAEARSVITRDESLRLVRFAFDMARRLGRQQVTVVHKANILKTTSGLFLNCAREVAEDYPDIEMNEMIVDACCMKLVMNPEQFDVIVTTNLFGDIISDLCAGLVGGLGMAPGANIGEDKALFEAVHGSAPDIAGKNIANPTAMMLAAALMLDHMQLHEPASRMRTAIRNAIFAGDRVTPDLGGHGTTTGFTDAVIERI

SEQ ID NO: 62247 - protein, 488 aa, Pseudomonas fluorescens PfO-1
MTVSEKAPRNNDLIYGLNDRPHFTATVFAALQHVLASFVGIITPTLIMGGALGLQSEIPYLISMALFVSGLGTFVQAKRFGPVGSGLLCLQGTSFSFISVILSAGFMVKARGGGTDEILSTIFGVCFFAAFIEVVLSQFIGKLRMLITPVVTGTIITLMGLSLIKVAMTDIAGGFGAADLGAASHVFLAALVLGTIVVLNRVDVPFLRLGAIVIGLTLGYVVAWLMGTVDFANLPEVPVVSVPVPFKYGFNFDWVAFVPVAVIFLVSPLEAAGDLTANSMISRQPVKGPLYIRRIKSGLLADGLNSAMAAVFNSMPMVTFAQNNGVIQLTGVASRYVAFFIAGLLVLLGLFPMIGAVLQLMPKPVLGGAELVMFGTVAVAGIKILAEAGLHRRNMLIVAISVGMGLGIAAVPEVLRELPQALRNIFESPITVGALCAIVLNIFLPEEFIELEEDDFDPEASILQVMENPDLPAKAEPATKAAVAQLNR

SEQ ID NO: 62248 - protein, 107 aa, Cucumis sativus
GNVISTPAIKGTILPGITRKSIIDVARSLGFQVEERLVAVDELLEADEVFCTGTAVVISPVGSVTYLGKRIAYGNGVGVVSQQLYSVLTRLQMGLIEDKMNWTVSLS

SEQ ID NO: 62249 - protein, 180 aa, Triticum aestivum
  misc_feature (87)..(87): Xaa can be any naturally occurring amino acid
  misc_feature (100)..(100): Xaa can be any naturally occurring amino acid
  misc_feature (121)..(121): Xaa can be any naturally occurring amino acid
KPICCGVGLAVLSQDVQACGRDELQVTDSIQVLREGGAPWEVLVDRGHGRCNSLSRDELHPVRILALKAWWFAKNDAHLVISIKGIXVASTRVAEPVLAXEVEMLTPDQFKPSEQVTKEPXSSGLVCVVGGSGMPYKPREGFRGGKEEAVLFWLSFWLGKSNSGIYLTTNHTILLVSRQR

SEQ ID NO: 62250 - protein, 198 aa, Solanum chacoense
MSASRFIKCVTVGDGAVGKTCLLISYTSNTFPTDYVPTVFDNFSANVVVDGSTVNLGLWDTAGQEDYNRLRPLSYRGADVFILAFSLISKASYENVSKKWIPELRHYAPGVPIILVGTKLDLREDKQFFVDHPGAVPLSTAQGEELRKSIGAAAYIECSAKTQQNIKAVFDAAIKVVLQPPQQKKKKKRKGQKACSIL

SEQ ID NO: 62251 - protein, 626 aa, Pseudomonas putida GB-1
MTKQEKAINLSESAQVDQQSVQPFPRSRKVYVEGSRPDIRVPMREISLDDTPTDFGGETNAPVLVYDTSGPYTDPNVIIDVRKGLADVRSAWIDARGDTERLDGLSSDFGQQRLNDAELAKLRFAHVRNPRRAKAGANVSQMHYARRGIITAEMEYVAIRENMKLQEARAAGLLKEQHAGHSFGANIPKEITPEFVRQEIARGRAIIPANINHPEVEPMIIGRNFLVKINGNIGNSALGSSIEEEVAKLTWGIRWGSDTVMDLSTGKHIHETREWIIRNSPVPIGTVPIYQALEKVNGVAEDLIWELFRDTLIEQAEQGVDYFTIHAGVLLRYVPLTAKRVTGIVSRGGSIMAKWCLAHHKENFLYTHFDEICEIMKAYDVSFSLGDGLRPGSIADANDAAQFGELETLGELTKIAWKHDVQCMIEGPGHVPMQLIKENMDKQLECCDEAPFYTLGPLTTDIAPGYDHITSGIGAAMIGWFGCAMLCYVTPKEHLGLPNKDDVKTGIITYKIAAHAADLAKGHPGAQIRDNALSKARFEFRWEDQFNLGLDPDTARAFHDETLPKESAKVAHFCSMCGPKFCSMKITQEVREYAAKIEAVDVTVEEGMREQAERFRQEGSQLYHKV

SEQ ID NO: 62252 - protein, 846 aa, Magnaporthe grisea
MTVVAGPTYPLELLQGTKVTKFAKKRGSTTSRKQLMLVLDAQSAKITWDKSKPSKSIYIDDIKDIRTAEDIRQYRLDFGIPESEEPLCFSIIYATHDVKPKTKMMHLVAGDPAIVDMWVSTLHTISMHRQDIMSSLMAFNDKAIRTYWKNELHKQLKNTSNNGEENIDFLGVERVCQNLHIHVSSETLKEKFLEALGTSSVDADASVKNGRLNFSQFQEFVRLMKRRADIRPIFRERASDIERGMTLLDFVSFLTDVQNEDVDADRAYWEAIFARFAKRNKSKDLEGDDVPRISEAALVSFLTSTYNVPIVSAPKNYTLDRPINEYYISSSHNTYLLGRQVMGFSSVEGYISALMRGCRSVEVDCWDGGDGWPLVSHGWTMTTNIAFREVMNVINKYAFVKSEFPLWISLEVHCNPDQQRKMVAIMKEIFGARLVTEPLEGLPADKLPSPSQFKNRILIKAKKPGHEEPNPERTGRRRGNSLTSPYTKPVMLDNSTIPSQSLPHSPLLTPTHSQIRRMGAKTRVYTITEGRVHDSTSGSPSDCDSGSERDIQQPISPNSGTSKIVKELGDLAVYCAGIKFSGFEHPDSKTVNHIFSFHEGTFQRHGRPGDAKRALYRHNMRYMMRVYPHRGRVYSSNFDPLLMWRRGVQMAALNWQTFDLGMQLNHAMYDGGMDQSGYVLKPKEFREIQHFPYLPEHMVGGKRPRKNVKFSIDVISAQQLMRPHNLRDRHTLDPYIEVEAFLADDKRNTNKEYSDAGPSKTKHKTPIAKDNGFNPIFDQRYNFNFNTKYPDLIFIRWTVRLSEGGSQSDRSTILGTESVNKLRSLGRTVFNRSNNSPKSSVDGGSQ

SEQ ID NO: 62253 - protein, 294 aa, Triticum aestivum
MSAPPPPASSDDDGKPADEEGVEIREVWANNLEAEFAVIRDVVDDYPYIAMDTEFPGIVCRPLGSFRSNDEYNYATLKANVDMLSLIQLGLTLSDENGALPARGTGGRPCAWQFNFRGFDPRSDPANADSIDLLRNSGIDFDRFTTEGADTGHFAELLMSSGVLLNAELQWVTFHSGYDFGYLLKLLTGRNLPDTMPGFFDLIRIYFPVLYDIKHLMKYCGSLHGGLSKLGELLGVQRVGICHQAGSDSLLTLRCFKKLKEAYFRGSTENYAGVLYGLISDGGENRPPAALLIE

SEQ ID NO: 62254 - protein, 275 aa, Caulobacter crescentus CB15
MSKSVQKRSPRYGATALVTGASDGIGEAFARELARRGYNLILVARREDRLRALADAVQSKYGVQARVIAADLGKAEDVERVIAATAAEDVGLLVAAAGFGTSGAFVEQPIEPELDMIDVNCRAVVALTHAFARRFIRRGAGGIVLFGSLVGFQGVPRAANYAATKAFIQSFVEGLRPELKQFGVDVISVAPGPVASGFAARANMVMGAAAKPGRIPREALAALGRKTTVRPGFLSKALEALFFGLPRGARTLIMTQVMKSMARGTAEGMPSPPGR

SEQ ID NO: 62255 - protein, 117 aa, Arabidopsis thaliana
  misc_feature (19)..(19): Xaa can be any naturally occurring amino acid
HQTLRPSSTLSSATMVASXAQAGIYTPGNGLKSSAAFPATRKANNNITSITSNGGRVNCMQVWTTIGKKNFETLSYLPDLTDSELAKEVHYLIHNKSIPCVQFKLQHPFVYRKHSNS

SEQ ID NO: 62256 - protein, 114 aa, Brassica napus
  misc_feature (8)..(8): Xaa can be any naturally occurring amino acid
  misc_feature (51)..(51): Xaa can be any naturally occurring amino acid
YVCQREFXALKHLPDDPLFQLVLKLYEVVPPVLTELGKVKNPWPNVDAHSXVLLNHYGLTEARYYTVLFGVSRSLGICSQLIWDRALGLALERPKSVTMDWLDAFCKKAKASSA

SEQ ID NO: 62257 - protein, 94 aa, Brassica napus
MVVATTIALYASPPSTVCSTPHQITASCDLDLNPRSSSSSSSTTIGGLSLLFKSSSPSSSSSASHPSLGDELPSIRHDRTEDHRTTLSSSFSYS

SEQ ID NO: 62258 - protein, 1212 aa, Daucus carota
MHTQRRMDSMSLLFLLILLFCNFSESRKLSGQVKDQGNEVEGLANFKKFSVDAGPNGFLKTWDSSSSSSPCSWKGIGCSLEGAVTVLNLTGAGLVGHLQLSELMDNLPSLSQLYLSGNSFYGNLSSTASSCSFEVLDLSANNFSEPLDAQSLLLTCDHLMIFNLSRNLISAGSLKFGPSLLQPDLSRNRISDLGLLTDSLSNCQNLNLLNFSDNKLTGKLTSFLSSCKNLSTVDLSYNFFSQIHPNFVANSPASLKFLDLSHNNFTGNLVNLELGTCHNLTVLNLSHNSLSGTEFPASLANCQFLETLDMGHNDFHLKIPGDLLGNLKKLRHLSLAQNSFFGEIPPELGNACRTLEVLDLSGNQLIEQFPTEFSLCTSLVTLNVSKNQLSGDFLTSVLSPLPSLKYLYLSFNNITGSVPPSLTNATQLQVLDLSSNAFTGTIPTGFCSTSSSFSLEKLLLANNYLKGRIPSELGNCKNLKTIDLSFNSLIGPVPSEIWTLPYIADIVMWGNGLTGEIPEGICIDGGNLQTLILNNNFISGSIPQSFVKCTNLIWVSLSSNQLRGTIPAGIGNLLNLAILQLGNNSLTGEIPPGLGKCKSLIWLDLNSNALTGSIPPELSSQSGLVSPGPVSGKQFAFVRNEGGTACRGAGGLLEYEGIRAERLEKFPMVLACPSTRIYSGRTVYTFASNGSIIYFDLSYNALSGTIPESFGSLNSVQVMNLGHNNLTGSIPSSFGGLKYIGVLDLSYNNLQGAIPGSLGGLSFLSDLDVSNNNLSGSVPSGGQLTTFPSSRYENNAGLCGVPLPPCGSENGRHPLRSNSQGKKTSVTTGVMIGIGVSLFSIFILLCALYRIRKYQQKEELRDKYIGSLPTSGSSSWKLSSVPEPLSINVATFEKPLQKLTFAHLLEATNGFSANSLIGSGGFGDVYKAQLGDGRVVAIKKLIHVTGQGDREFMAEMETIGKIKHRNLVPLLGYCKIGEERLLVYEYMKWGSLESFIHDRPKVGGGLRIDWPARKKIAIGSARGLAFLHHSRIPHIIHRDMKSSNVLLDENFEARVSDFGMARLVNAFDTHLSVSTLAGTPGYVPPEYYQSFRCTAKGDVYSYGVVLLELLSGKRPIDPAQFGDDNNLVGWAKQLHKEKRDLEILDSELLLHQSSEAELYHYLQIAFECLDEKAYRRPTMIQVMAMFKELQMDSETDILDGLSVKNSVIDESL

SEQ ID NO: 62259 - protein, 518 aa, Oryza sativa (japonica cultivar-group)
KRRELRPLARRRRRPVLRGGRGKLSTVVRARRPEATARQDLARRARVREISPQNPGRKKKGGTPEASDAAAAAPARTLGCGVGSATAALPFSRGGRGVGLAPPPRSLGRGGGPAVAAIPPGGFPSYSASMDGFPFPPPFDGSYRGGFPSSSAWLDASGGDESSPGSWDKDVHPRGGFMSYFGNHAQNSHLVGAPIYIADASSPPEVEILQGNDDGNGNGNVRTEKRILWTEEEDIILMSAWIEHSTDSTCGADKGGGQYWGEVVESYNKTTPPLRKRNLKQCKDRWHKINRWTDLFECAYVKARRIFTSGYSNQMWIDAAHKFYVDDNKEAKLGPFVLMEVWKICREVSKWKTYNDNLRNARKRKSFHLEGDSEEADDTFDEMPKRPMGQKAAKKAALDAKIKSNGLGSSDDGHSKESPIQLDKFDRYSKFQEENNDKRMKLLDRQEKISSEKLEATKIAHLTAQEYKEGRKLEKESKMMETYNSLISQDTSSMSAEEKAQRVSMMKCLMKTLFPESD

SEQ ID NO: 62260 - protein, 435 aa, Frankia sp. CcI3
MAQIGGSTVNGPSEDDVEAGVGGPPAAGEPGVTEPVLPGPAAAGGPVAGALPADPRTHGVDVRPAGTPTRRGGALLLSGSLGMGHDVMAQACGASLTRRGFTTRTADSLRMLGGRNGSRGEKVFRGMIAVPGLYDAVHFSQMRTGGRLAQAIERTSSRFVVPALREELAAQPTDLVISIFATGAAAASRVKAEFPGLVTAVFSTDCCVHRLWVHDNTDLYLVTSQTAARYVRRFSPNALISVVPTPVREPFYDPPTQEEARAALGIPADAPCVLLMSGSWGLGPLVEGAAAMAAAGIYVLAVAGRNQRLAARLASLSEQQHKVIPFGFTDRVPALMAASDLVVTSSGDTCSEARVIGRDLLLIDVVPGHGRDNLQKELERGHAEVTNTDPVSLTRSALACLDRVKPPSDRVAIGPHAWERAFGAALAQIGFGADW

SEQ ID NO: 62261 - protein, 462 aa, Bacillus subtilis subsp. subtilis str. 168
MANKELKRGLGARHIQMIALGGTIGVGLFMGSASTISWTGPSVLLAYAICGIFIFFIMRAMGEMLYVEPSTGSFATFGHQYIHPMAGYITAWSNWFQWIIVGMSEIIAVGSYTKYWFPDLPAWIPGIVAMVILGAANLISVKSFGEFEFWFAMIKIVTIILMIIAGIGIIFFGFGNGGDAIGLSNLWSHGGFFAGGFSGFFFALSLVIAAYQGVELIGITAGEAKDPQNTLRNAIQSIIWRILIFYIGAIFVIVTVYPWDELNSLGSPFVSTFSKIGITAAAGIINFVVITAAMSGCNSGIFSAGRMLYTLGVNGQAPKFFKKISRNGVPLYGTIAVLIGLAVGVVLNYIAPPKIFVYVYSASVLPGMIPWFIILISHIGFRKAKGAALDKHPFKMPFAPFTNYLTIAFLLMVLVGMWFNDDTRISLIVGVIFLALVVISYYVFGIGKRTQANLTKSEQAAE

SEQ ID NO: 62262 - protein, 368 aa, Prunus cerasus
MGKGGMSSQGGALEPMDGEQENMAAWLVGVNTLKIQPFKLPTVGPNDVRVKIKAVGICGSDVHYLKTMKCADFIVQEPMVIGHECAGIVDEVGSMVKNLLPGDRVALEPGISCWRCEQCKGGRYNLCPDMKFFATPPVHGSLANQIVHPADLCFKLPENVSLEEGAMCEPLSVGVHACRRANIGPETNVLVIGAGPIGLVSVLSARAFGAARIVIVDVDDERLSIAKSLGADDSVKVSTNPQDLENEVSKISKAMRGGVDVSFDCVGFNKTMSTALSATRPGGKVCLVGMGHGVMTVPLTPAAAREVDVVGIFRYKNTWPLCLEFLRTGKIDVKPLITHRFGFTQKEIEEAFETSARGGNAIKVMFNL

SEQ ID NO: 62263 - protein, 148 aa, Azoarcus sp. EbN1
MTTMTVRQILETKGAGAHAVSPGVSVFDALAVMAKHDIGAVLVTENDHLTGIFTERDYARKLVLKGLSSKEATVGELMTPNVCTITPSHTVDEVMNIMTENRFRHLPVVERGKIAGIVTIGDVVKSIIVQQEETISHLSSYIAGDITN

SEQ ID NO: 62264 - protein, 324 aa, Trichodesmium erythraeum IMS101
MLTHKSIKQQLKSVIEQEISAISKLCESIDDSWLKAVLRLRDCKGKLVVSGIGKSGSISQKIAASFTSTGIPAIFIHPTEASHGDLGLLDSSDILLVLSASGQTSELLDIMQYASRLKSSIILITKNPNSSLAHFADIILQIPDLPEACINGLAPTISTTCQLVLGDALVVTLMSLRGFTSEDFKQFHPGGNLGALLVPVKNLMYKEHQIPLIDLGASIKEAIIEMNFKSLGCVGVINHRNQYVGIFTDGDLRRSLEAKVSLEEPVSQHMTPSPLSIQSDLIISELIDFFQKNQIPNVFVVENNEPIGIVHVHQLTSILGRDVI

SEQ ID NO: 62265 - protein, 355 aa, Arabidopsis thaliana
IYHRKVVFTYVRAKRFYHFLNIEMVTDFKSLLPVIDISPLLAKCDDFDMAEDAGVVEVVGKLDRACRDVGFFYVIGHGISDDLINKVKEMTHQFFELPYEEKLKIKITPTAGYRGYQRIGVNFTSGKQDMHEAIDCYREFKQGKHGDIGKVLEGPNQWPGNPQEYKDLMEKYIKLCTDLSRNILRGISLALGGSPYEFEGKMLRDPFWVMRIIGYPGVNQENVIGCGAHTDYGLLTLINQDDDKTALQVKNVDGDWIPAIPIPGSFICNIGDMLTILSNGVYQSTLHKVINNSPKYRVCVAFFYETNFEAEVEPLDIFKEKHPRKETSQVAKRVVYGQHLINKVLTTFANLVENS

SEQ ID NO: 62266 - protein, 657 aa, Shigella flexneri 2a str. 301
MTQLAIGKPAPLGAHYDGQGVNFTLFSAHAERVELCVFDANGQEHRYDLPGNSGDIWHGYLPDARPGLRYGYRVHGPWQPAEGHRFNPAKLLIDPCARQIDGEFKDNPLLHAGHNEPDYRDNAAIAPKCVVVVDHYDWEDDAPPRTPWGSTIIYEAHVKGLTYLHPEIPVEIRGTYKALGHPVMINYLKQLGITALELLPVAQFASEPRLQRMGLSNYWGYNPVAMFALHPAYACSPETALDEFRDAIKALHKAGIEVILDIVLNHSAELDLDGPLFSLRGIDNRSYYWIREDGDYHNWTGCGNTLNLSHPAVVDYASACLRYWVETCHVDGFRFDLAAVMGRTPEFRQDAPLFTAIQNCPVLSQVKLIAEPWDIAPSGYQVGNFPPLFAEWNDHFRDAARRFWLHYDLPLGAFAGRFAASSDVFKRNGRLPSAAINLVTAHDGFTLRDCVCFNHKHNEANGEENRDGTNNNYSNNHGKEGLGGTLDLVERRRDSIHALLTTLLLSQGTPMLLAGDEHGHSQHGNNNAYCQDNQLNWLDWSQASSGLTAFTAALIHLRKRIPALVENRWWEEGDGNVRWLNRYAQPLSTDEWQNGPKQLQILLSDRFLIAINATLEVTEIVLPAGEWHAIPPFAGEDNPVITVVWQGPAHGLCVFQR

SEQ ID NO: 62267 - protein, 573 aa, Glycine max
MTTSFGPATTSAPLKDHKVQIPSFHGLRSSSASALPRNALSLPSSTRSLSLIRAVSTPAQSETATVKRSKVEIFKEQSNFIRYPLNEDILTDAPNISEAATQLIKFHGSYQQYNREERGSRSYSFMIRTKNPCGKVSNQLYLTMDDLADQFGIGTLRLTTRQTFQLHGVLKKDLKTVMGTIIRNMGSTLGACGDLNRNVLAPAAPLARKDYLFAQQTAENIAALLAPQSGFYYDIWVDGEKILTSEPPEVVQARNDNSHGTNFPDSPEPIYGTQFLPRKFKIAVTVPTDNSVDILTNDIGVVVVTDDDGEPQGFNIYVGGGMGRTHRLETTFPRLAEPIGYVPKEDILYAVKAIVVTQRENGRRDDRKYSRLKYLISSWGIEKFRSVVEQYYGKKFEPFRALPEWEFKSYLGWHEQGDGKLFYGLHVDNGRIGGNMKKTLREVIEKYNLNVRITPNQNIILTDVRAAWKRPITTTLAQAGLLQPRFVDPLNITAMACPAFPLCPLAITEAERGIPNILKRIRDVFDKVGLKYSESVVVRITGCPNGCARPYMAELGLVGDGPNSYQIWLGGTP

SEQ ID NO: 62268 - protein, 418 aa, Emericella nidulans
MSDLQVQGRKVFKVFNQDFIVDDRYTVTKELGQGAYGIVCAATNVQTGEGVAIKKVTNVFSKKILAKRALREIKLLQHFRGHRNITCLYDMDIPRPDNFNETYLYEELMECDLAAIIRSGQPLTDAHYQSFIYQILCGLKYIHSANVLHRDLKPGNLLVNADCELKICDFGLARGFSIDPEENAGYMTEYVATRWYRAPEIMLSFQSYTKAIDVWSVGCILAELLGGRPFFKGRDYVDQLNQILHYLGTPNEETLSRIGSPRAQEYVRNLPFMPKVPFQRLFPNANPDALDLLDRMLAFDPSSRISVEEALEHPYLAIWHDASDEPSCPTTFDFHFEVVDDVQEMRRMIYEEVVRFRQSVRMPPQAQSLAQQQQIGNIPIPEHQQGVWRQEEPRPQEAGAVGGNHNDLESSLQRGMDA

SEQ ID NO: 62269 - protein, 297 aa, Ustilago maydis 521
MLVLVIGDLHIPFRAHDLPAKFKKLLVPGKIQQIICTGNVCNTDYLHYLRTIAGDVHLVKGDYDDNPHFPSSLILNHPPLRIGVLHGHQVVPAGDTQSLAAVARAMDVDILLTGHTHRFEAFELEGRFFVNPGSATGAWHPTWPLRDPASLAALSERTAAKTKEDATIADKKADEPKPKKGAKTSDNKKNDDSAKDKPSASELKDANKDAESNKDGDEEEEEAKEAAAPVPSFALLDIQGAVVVTYVYQLIDGDVKVEKIEYRKNLDSNSLALQRGASGNAVAVGASATNYGQYGGR

SEQ ID NO: 62270 - protein, 461 aa, Candida albicans
MAPTSTKNSIKHFDYLVIGGGSGGVASARRAAKYGAKVLLIESNFKKFGGTCVNVGCVPKKVMWYTADLAHKKHDLYAYGLDKEPESIKYGDFDWAKLKHKRDAYVTRLNGIYENNLKREKVDYAYGFAKFINSEGEVEVTLSGDQELPFLDEGKTYKKGEKLVFSADMTLIATGGTAIVPPSVPGAELGTTSDGFFALEKQPKKVAIVGAGYIGVELSGVFSSLGSETHFFIRGDTVLRSFDEVIQNTVTDYYIDNLGINIHKQSTITKIEGSKDGKKVVHLKDGTSVEVDELIWTVGRKSLIDIGLDKVGVKINDKQQIVADEYQVTNNPKIFSLGDVVGKVELTPVAIAAVSSIDIVSDCKIMDIHIHQCILTSRAGLWFITREPLKIRGGNLKYIILNLSPMYYAMMMIKKINHLSSTRSFVSDPEEKVIKMGATKKDFDNCVAIHPTSAEELVTMT

SEQ ID NO: 62271 - protein, 399 aa, Candida albicans SC5314
MTIESSTNYSFGTKAIHAGAPLDPSTGAVIEPISLSTTFAQSEPSKPLGIYEYSRSSNPNRDNFEIAVAALESAKYAIALSSGSATTALVIQSLPINSHIVSSGDVYGGTHRYFTKVANTHGVEAQFVGNLVEDLQGALRENTRLVWLETPSNPTLQVTDIAKVKSILVDHEAKTGNKVLLAVDNTFLSPYLSNPLTHGADVVVHSVTKYINGHSDVVMGVLATNDSQLHERFRFLQNAIGSIPSPFDSWLAHRGLKTLHLRVRQASNSAQRIAEYLSQHSAVLKVNYPGLKSHRNHDVVLRQQRDGLGGGMISFRIAGGAKGAAVFTSSTKLFTLAESLGGIESLIEVPAIMTHGGIPKEEREANGVYDDLVRVSVGIEDTEDLLKDIEQALQKAASV

SEQ ID NO: 62272 - protein, 400 aa, Oceanicola granulosus HTCC2516
MQLLSATLDRVKPSPTVAMSGRALELKAAGRDVIGLAAGEPDFDTPPHVAAAGIRAIEEGRTRYTAVDGTAELKRAICAKFARDNGLDYGPAEISVGTGGKQVLYNALMATLNPGDEVVIPAPYWVSYPDMVRLAGATPVIVEAPLSAGFKITPAQLEAAITGRTRWLILNSPSNPTGAAYSEAELKGLTDVLLRHPHVWVLSDDIYEHLVYDGFRFTTPAQVEPRLKARTLTVNGVSKAYAMTGWRIGYAAGPEALIAGMRKVQSQSTSNPCSISQFAALAALEGPHDFLAERNAAFLRRRDMVVARLNEIDGIDCPVPEGAFYVYPSIKGLIGKVSAGGTEIADDEAFAMALLDEAEVAVVFGAAFGLSPAFRISYALADETLAQACDRIARFCAGLR

SEQ ID NO: 62273 - protein, 186 aa, Zea mays
  misc_feature (103)..(103): Xaa can be any naturally occurring amino acid
MLSSSSPASTTAHPPPSPETYQTPLSLLSLPQITRRYVFKTLSLCLAAPSLSIAPVHARGLFQMPPLRLSNRYECSCYKTVMLLVRFQFTLNSEELVSLPYTXLPSLWFLFLILDVFWFLLETSYYLVRAGESDYESLGVINTNPVAKTSVDSGLSEKGKKQTVRAALQLKEMGACDRNCWLWPSI

SEQ ID NO: 62274 - protein, 226 aa, Methanosarcina barkeri str. Fusaro
MPEVKRLSDGIFEVIKDKKQLATKNLDPGKTVYGEKLIAVEGVEYRTWDPRRSKLGAMVLKKFNIPLTKNSKVLYLGAASGTTVSHVSDIVSEGAVYAVEFAPRSMRDLIGLASRRKNIHPILADAGKPDSYSHLVEPVDLIFQDVAQPNQAEIAARNAVRFLKREGYLLLSIKARSIDTVAKPKEVFKAEVKKLEQAFEPRFEILNAKDLMPYHEDHLGVLAKLK

SEQ ID NO: 62275 - protein, 106 aa, Brassica napus
MAPTVFGHQDIKRAVLLMLLGGVHKTTHEGINLRGDINVCIVGDPSCAKSQFLKYTASIVPRSVYTSGKSSSAAGLTATVAKEPETGEFCIEAGALMLADNGICCI

SEQ ID NO: 62276 - protein, 75 aa, Glycine max
  misc_feature (10)..(10): Xaa can be any naturally occurring amino acid
  misc_feature (39)..(39): Xaa can be any naturally occurring amino acid
  misc_feature (54)..(54): Xaa can be any naturally occurring amino acid
ASSMISSPAXTTVNRAGAGMVAPFTGLKSMACFPTQKTXHDITFIASNRGRMQXLQVLQPICKKNFETFSYFQTL

SEQ ID NO: 62277 - protein, 539 aa, Bacillus subtilis subsp. subtilis str. 168
MNQLHRRMGTFSLMMVGLGSMIGSGWLFGAWRAAQIAGPAAIISWVIGMVVILFIALSYSELGSMFPEAGGMVKYTQYSHGSFIGFIAGWANWIAIVSVIPVEAVASVQYMSSWPWEWAKWTSGLVKNGTLTGEGLAFASVLLLIYFLLNYWTVNLFSKANSLITIFKIIIPGLTIGALLFVGFHGENFTGGQSIAPNGWASVLTAVATSGIVFAFNGFQSPINMAGEAKNPGKSIPIAVVGSLFVATVIYVLLQIAFIGAVNPSDIAHGWSHLNFNSPFADLAIALNINWLVIVLYADAFVSPSGTGITYTATTSRMVYGMEKNKYMPSIFGKLHPIYGVPRQAMFFNLIVSFIFLFLFRGWGVLAEIISVATLISYITGPITVMTLRRTGKDLYRPLRLKGLNVIAPLGFIFASLVLYWARWPLTGQVLFIILIGLPIYFYYQAKAKWKGFGRNFKAGVWMVFYLLAMMVISYLGSDKFGGLNVIHYGWDMVLIAMVSLVFYVWALKSGYQTEYLKDAKEINSQLLNGQSEAAAGKE

SEQ ID NO: 62278 - protein, 541 aa, Oryza sativa (japonica cultivar-group)
MARRLRWHDLVGLGLGGMVGAGVFVTTGRATRLYAGPGVVVSYAIAGLCALLSAFCYTEFAVDMPVAGGAFSYLRVTFGELAAFLTGANLIMEYVFSNAAVARSFTAYLGTAVGVDAPSKWRIAVPGLPKGFNEVDLIAVGVILLISVCICYSTKESSVVNMVLTAVHVAFILFIIVMGFWRGDTRNLTRPVDLAHNPGGFFPHGAAGVFNGAAMVYLSYIGYDAVSTMAEEVERPSRDIPVGVSGSVVLVTLLYCLMAASMSMLLPYDAIDTEAPFSGAFKGSSGWGWVSNVIGAGASLGILTSLMVAMLGQARYLCVIGRSGVMPAWLAKVHPCTATPVNASAFLGVFTAALALFTELDVLLNLVSIGTLFVFYMVANAVVYRRYVAADDDDADHRRAWPTLVFLAAFSLVALCFTLLWQFAPAGRARTGLLAACGAAAVATVGAFRALVAEARRPELWGVPAMPWVPAASVFLNVFLLGSLDRPSYVRFGFFTAAAVLVYVLYSVHASYDAEEGGGAGAGAAALDGAKVQDEAADFKV

SEQ ID NO: 62279 - protein, 444 aa, Bacillus subtilis subsp. subtilis str. 168
MLNIFKPAPHIERLDDSKMDAAYKRLRLQVFIGIFIGYAGYYLLRKNFAFAIPYLQEQGFSKTELGLVLAAVSIAYGFSKFIMGMVSDRCNPRYFLATGLFLSAIVNILFVSMPWVTSSVTIMFIFMFINGWFQGMGWPPCGRTMAHWFSISERGTKMSIWNVAHNIGGGILAPLVTLGIAMFVTWKSVFFFPAIIAIIISFLIVLLVRDTPQSCGLPPIEEYRNDYPKHAFKNQEKELTTKEILFQYVLNNKFLWYIAFANVFVYFVRYGVVDWAPTYLTEAKGFSPEDSRWSYFLYEYAGIPGTILCGWISDRFFKSRRAPAGVLFMAGVFIAVLVYWLNPAGNPLVDNIALISIGFLIYGPVMLIGLQAIDLAPKKAAGTAAGLTGFFGYIGGSAFANAIMGFVVDRFNWNGGFIMLISSCILAIVFLALTWNTGKRAEHV

SEQ ID NO: 62280 - protein, 345 aa, Zea mays
MTSPAPTSWFSGLSRSSSTMAGGVASAPTPASASASGPASVFLPDAPKSVIGAGSGGGKRNHLCGALFKYGPKSAQVAFRTGDFNHQVIFIGGLTDGLLATDYLEPLSLALEVEKWSLVQPLLSSSYTGYGISSLQQDALELEQLISYLINKENSEGVILLGHSTGCQDIVHYMRTNFACSKAVSGVILQAPVSDREYRATLPETAEMIDLAAKLISEGRGMDLMPRKANSDAPITAYRYHSLCSYMGDDDMFSSDLSEDQLRQRLGHMSITQCQVIFSMGDEYVPEYVDKRALLDRLCRALGGAEKVEIEWGNHALSNRVQEAVVAIVDFVKREGSKGWDDPWS

SEQ ID NO: 62281 - protein, 815 aa, Alkalilimnicola ehrlichei MLHE-1
MLAELPAPCTATRRQSRNIKGDATLQEYVVNFDTLGMGDVDRVGGKNASLGEMISHLSAAGVSVPGGFATTAKAYWDFLDESGLRERINGLLEPLDIEDVDALVRTGAEIRQLIIDTPFPAALEQAITEAYQKLEAETPGEASFAVRSSATAEDLPDASFAGQQETFLNVRGLDGIMEAVKHVFASLFNDRAISYRVHHGFEHSQVALSAGIQRMVRSDIGAAGVIFTMDTESGFRDVVFITSSYGLGETVVQGAVNPDEFYVHKPTLEAGRPAVLRRNLGSKAIKMVYSGDQTHGKTVATVDVDEAERLQYSLTDDEVQDLARQAMIIEKHYDRPMDIEWGKDGQDGKLYILQARPETVKSRDAGQTLERFHLKARGDVLSTGRAIGQRIGAGPARVVDSINDMNKVKAGDVLVTDMTDPDWEPIMKRASAIVTNRGGRTCHAAIIARELGIPAVVGTGDGTERIKDGHEVTVSCAEGDTGYIYAGKQDYEVRKIALDKLPELPFKIMMNVGNPDRAFDFASLPNAGIGLARLEFIINRMIGIHPKALLEFDQQDENLKQVIRTQAAGYSDPVQFYVDKLAEGISTLAAAFTPKPVIVRLSDFKSNEYANLIGGAQYEPDEENPMLGFRGASRYTADSFRDCFALECKALKKVRDEMGLDNVWVMVPFVRTVEEGKGVLAELEKNGLKKGENGLKVIMMCELPSNALLADEFLEHFDGYSIGSNDLTQLTLGLDRDSSLIAELFDERDEAVKKLLSMAIQSARRAGKYVGICGQGPSDHPDLARWLMDEGIESVSLNPDSVVETWLYLAGEQAQ

SEQ ID NO: 62282 - protein, 362 aa, Frankia sp. CcI3
MGAQTVEAVVAREKGAAVSLEQIVVPDPGPGEARVRVRACGVCHTDLHYREGAINDDYPFLLGHEAAGTVESVGEGVVGLAPGDYVVLAWRAPCGTCRACRRGMAWYCFDSRNARNPMTLADGTPLAPALGIGAFTPLTLVAAGQCVPVDPAARPEAAGLIGCGVMAGFGAAVNTGRVTRGETVAVIGCGGVGGAAIAGASIAGARKIIAVDVDDRKLTWARRFGATDVVNATADDPVAAIRALTDGFGADVVIDAVGRPETYRQAFDARDLAGRLVLVGVPDPTMTVELPLAEVFGRGGHLSSSWYGDSLPSRDFPILIDLYRRGRLDLDAFVTETIGIGDVEEAFTRMQRGDVLRSVVIL

SEQ ID NO: 62283 - protein, 558 aa, Triticum aestivum
  misc_feature (511)..(511): Xaa can be any naturally occurring amino acid
LTALMGVSGAGKTTLMDVLVGRKTSGYIEDNITISGYPKKQETFARVSGYCEQNDIHSPNVTVYESLAFSAFLRLPANVESSTRKMFIDEVMELVELSPLRHALVGLPGVSGLSTEQRKRLTIAVELVANPSIIFMDEPTSGLDARAAAIVMRAIRNTVDTGRTVVCTIHQPSIDIFESFDELFLMKRGGEEIYVGPLGRHSCELIRYFEAVEDVRKIKDGYNPSTWMLEVTSATQEQMTGINFSQVYKNSDLYRRNKNLIKELSTPPEGSSDLSFPTQYSQTFLTQSFACLWKQSLSYWRNPPYTAVKYFYTTVIALLFGTMFWGIGKKRHNQQDLFNAMGSMYSSVLFMGVQNSASVQPVVAVERTVFYRERAAHMYSPLPYALGQVAIELPYIFVQSLIYGVLVYAMIGFEWTAVKFFWYLFFMYFTLAYFTFYGMMSVGLTPNYNVASVASTAFYALWNLFSGFITPRTRIPIWWRWYYWLSPIAWTLNGLVTSQFGDVTEKFDNGXRVSDFVESYFGYHHDFLWVVAVVVVSFALLFAFLFGLSIKLFNFQKR

SEQ ID NO: 62284 - protein, 531 aa, Gibberella zeae PH-1
MGIAGVLKKVVRNDAMKTDPEEIYNWRVFAVVAGSCFGGMLFGWDTGAIGGVLAMKATQERFNYTPEAKVTLDQNIVSTLQAGCFAACFFTSYFTERYGRRWCLIGTGAVTTIGVILQAASTAQGSLPVMYIGRFVAGLGVGAASSLVPLYVSECAPRAIRGGLTSFYQLFIVTGVMLSFWINYGALLHLSAPTVYALPLALQALPAVLLIACMLAAPESPRWCARKDDWERAKSILIGLRQLPETHPYVQTELQEMSAQLEAEKRLTGNASASTLWKELVTIPGNRKRAIISVLLMVCQQMTGVNAVNYYAPQIFQSLGMTGTTVSLFATGVYGIIKVLGCATFLIFFADSLGRRRSLLWTSAAQFLAMYIIGIYGRVEPPVAGAGISAFGYVAIVCIYLWAAFFQFGWGPCCWILVSEIPTARLRALNVAIAAATQWLFNFIVARTVLTMQKTMGPAGYGMFFMFGTFDLLMGIFVWLFVPETKGLSLEQMDELFGVADVQGKLDAEGPEGARTPSIREEVAHIKSNKS

SEQ ID NO: 62285 - protein, 409 aa, Corynebacterium glutamicum ATCC 13032
MVKGVKGRPNVLAIVLAGGEGKRLFPLTEDRAKPAVPFGGTYRLIDFVLSNLVNSGFLKIAVLTQYKSHSLDRHISLSWNVSGPTGQYIASVPAQQRLGKRWFTGSADAILQSLNLISDEKPDYVIVFGADHVYRMDPSQMLDEHIASGRAVSVAGIRVPREEATAFGCIQSDVDGNITEFLEKPADPPGTPDDPDMTYASMGNYIFTTEALIQALKDDENNENSDHDMGGDIIPYFVSRNDAHVYDFSGNIVPGATERDKGYWRDVGTIDAFYECHMDLISVHPIFNLYNSEWPIHTTSEGNLPPAKFVRGGIAQSSMVSSGSIISAGTVRNSVLSNNVVVEEGATVEGAVLMPGVRIGKGAVVRHAILDKNVVVRDGELIGVDQVRDAQRFKVSAGGVVVVGKNQVV

SEQ ID NO: 62286 - protein, 1153 aa, Rhodopirellula baltica SH 1
MSLPMLPKSVVSVLLAGVLACTAAHAQRPPTGVPNGIEKVLRIEPRPGNGRNSEGDFVQLKDGRLLLVYTKFIGTGDHAPAALVSRHSNDNGITWTTEDDSVIERGDDDANLMSVSLLRLQDGRIGLFYIRKYDPTPDAKHLFLDDILMRTSSDEGDTWSEPTRIVPKDTPSYSVLNNDRVIQLSSGRLIVPLAVHYRVGWPGYRKSAEMVCYLSDDQGATWKRSQSALTSESLAQEPGVVELSDGRVMMFCRSSNAQLLSYSDDQGDTWSDLKPSSFTQPTVSPASIERIPSTGDLLMLWNNGDDELAKKQPVGRRPFTAAISKDDGKTWQNIQNVGTDPEGWYCYTAIEFVDDHVLLAHCEYPRLNSLQLTRIPVSWFYPGETVSANTPAESQTAPLDYAVSLEVTHEGFDGKECWVHARVGTVPDASGAATAVMTTQKLLLSGSDVFYRLHESRKTPESNAWSKLSPIDSFSRQKVEGDRIPRGGKGAEAMLQEGDETTVCDFVPQWHAASQRLLGIGQTVWYRNNRVMHVRPRGVAYSVMDPQNSSWNDWKVLELPDEPQFQNAGSGSAQRVDLPGGDVLLPVYCKRPDQKQYSSLIVRCRFDGETLHYIEHGNALTIPVERGMAEPSLTHYDGRYYMTIRNDQHGYVATSDDGLHFDEPQRWKFDDGKDLGSYNTQQHWVTHSNGLFLVYTRRGANNDHVFRHRAPLFMAQVDPNSLRVIRATERVLVPEHGARLGNFGVTRVSKDETWVSVTEWMQPAGVEKHGSDNRIFIAKLRWNQPNDLASMTSNPGISVETTAYCKPPQAMTEELGDYRSPLIFENGTRVPHASQWPQRRKEIQTRWESLLGKWPKPITDPQVTISETVHLDSVTKHTIEFQWTPNEKATAYLLVPNTVEHADHDLPAVLSVYYEPETAIGLGKPHRDFALQLAHRGFVTLSIGTTEATEAKTYSLYHPSIDDASVQPLSMLAYAATTAWQVLADRPEVDPNRIGVVGHSFGGKWAMFAACLSERFACGAWSDPGIVFDESMSGVNYWEPWYLGYHPKPWRKRGLITQDNPARGLYPRLIAQGHDLHELHALMAPRPFLVSGGSADPIRRWTALNHSVAVNALLGHDDRVAMTNRADHSPNEDSNSVLYAFFEKHLAPSDVSL

SEQ ID NO: 62287 - protein, 305 aa, Aspergillus nidulans FGSC A4
MEDAHAAVLDLQAKQSGSNDQPTDPDRRLAFFGVYDGHGGDKVALFAGENVHKIVAKQETFLKGDIEQALKDGFLATDRAILEDPKYEEEVSGCTAAVSIISKKKIWVANAGDSRSVLGVKGRAKPLSFDHKPQNEGEKARISAAGGFVDFGRVNGNLALSRAIGDFEFKKSPELSPEQQIVTAYPDVTVHELTEDDEFLVIACDGIWDCQSSQAVVEFVRRGIAAKQDLYRICENMMDNCLASNSETGGVGCDNMTMVIIGLLNGKTKEEWYNQIAERVANGDGPCAPPEYGKSLEEPTASNPY

SEQ ID NO: 62288 - protein, 511 aa, Silicibacter sp. TM1040
MTKEMIDITGRVATLLRDLTGTSEVRSYVGGELVQGSGAELELTDPASGVVFARYRDAGPDVVARAAEAAQVAQKIWYAKTASERGRILFEIGRQIRQHAAALSELEALSSGRPMRDTGGEPARMAEMFEYYAGWCDKITGDVIPVPSSHLNYTRQEPLGVVAQITPWNAPLFTCCWQVAPAICAGNAVMIKPSELTPLTSVVIGILCEKAGAPKGLVNVIAGDGPGSGQAMIAHPETALVVFVGSAEAGSKIAAAAAKRLIPSVLELGGKSANIVFDDADIDRAVVGAQAAIFASCGQSCVAGSRLLVHRSVQTEVVEKLSAAAARIPVGDPMDPATQVGPVNNLRQWNKIDTMVQAATRAGASVASGGGKPAALAASGGFFYAPTVLDAVTPQMEIANEEVFGPVVSVLPFDDEEEAIQLANATPYGLAGAVWTRDVGRAHRVAGAVRAGTFWINSYKTINVMSPFGGFGRSGYGRSSGREALSAYTQTKSVWVETAENPAQGFGYAPG

SEQ ID NO: 62289 - protein, 207 aa, Oryza sativa (japonica cultivar-group)
METELCSSRVLSLPRYDSGDEELSVLPRHTKVIVTGNNRTKSVLVGLQGVVKKAVGLGGWHWLVLKNGVEVKLQRNALSVLEPPTGNEDDDDIDGNNSFCSSSDMGDKDMDYLAIIEYHKPTKPRVRHTRPWSSCTKSSNRGNFHPSSILQTRVNLTRLGTPTLWRYWKHFNLVSSLDPTNLTFHFHGLMLKNYAQAAKRLKTLYHS

SEQ ID NO: 62290 - protein, 383 aa, Alkalilimnicola ehrlichei MLHE-1
MSKSDYYEALGVARNASDSEIKKAYRRMAMKYHPDRNPGDKEAEARFKEAKEAYEILSDPQKRAAYDQFGHAGVDPSAGMGGAGGPGGPGGPDFADIFSDVFGDIFGGGGRRGGGGRRVFRGADLRYNLELSLEDAVRGTEVQIRVPTQEVCDACDGKGTKEGSQPETCPTCKGHGDVRIQQGFFSVQQTCPRCGGSGSVITDPCRKCGGRGRVQSQKTLSVRVPAGVDTGDRIRLSGEGEPGENGGPPGDLYVQIMVREHEFFQRDGANLRCEVPISITKAALGGEVEVPTLDGRVNLRIPAGAQSGKVFRVRGKGVKPVRGGPQGDLLCRVHVETPVNLTKKQKELLEEFGRTMDDTGDKHTPRTSSWLDKARKFFEDWKL

SEQ ID NO: 62291 - protein, 553 aa, Pinus radiata
MENRRSSGGSGWWVCVLPLFTKDGPAYFLHSSSDDVSAWRQWPLYIALLIVAVCAVLVSWLSPGGCAWAGRHKRGRVAIPGPKGWPIIGSLMDMSVGLPHRKLESLARLHGAKQLMSFSLGCTPAVITSDPEVARELLTSPHFANRPLKQSAQQLLFGRAIGFAPNGGYWRLLRRIASAHLFAPRRIAAHEAGRQADVVAMLDDIQKEYHSKGVVRVRRHLQGAALNNIMGSVFGRRFDMSHENEEVKKLREMVDEGFQLLGAFNWADHLPWLRPLDPLRIHARCARLVPRVTTFVSNIIEQHRREEQRRESGDQCDFVDVLLSLQGEDKLDEEDMIAVLWEMIFRGTDTTALLTEWTMAELVLHPEAQKKAQAELDAVVGHDRSVKDSDIPKLPYIQAVVKEALRMHPPGPLLSWARLSTEDVNMGDGMCVPAGTTAMVNMWSITHDPNIWESPYEFRPERFVVFEGGEEVDVRGNDLRLAPFGAGRRVCPGKALGLATVNLWVAKLLHHFEWLPHAEHPVDLSEVLKLSCEMARPLHCVPVTRVPFAKFSD

SEQ ID NO: 62292 - protein, 828 aa, Frankia sp. CcI3
MAGGEGTRLRPLTANLPKPLLPVVNRPIMEHVLRLLKRHGFDETVVTVQFLASMIRTYFGSGDELGMHLSYATETTPLGTAGSVKNAEDALRDEAFLVISGDALTDIDLTDLVAFHRRQGALVTVALKSVPDPLEFGIVITGEDGRIQRFLEKPTWGQVFSDTVNTGIYVMEPEVLAQVPPGEAVDWSGDIFPRLVEAGAPVYGYVASGYWEDVGTIASFQRAQADVLNRQVDVEIGGFEVSPGVWIGEDAEVHPEAILKGPLVVGDYSKVEAGAELREFSVLGSNVLVKSGAFLHRAIVQDNALIGPQTNLRGCVIGKSTDVLRAARIEEGAVVGDECVVREEAFVSHDVKVYPFKTIEAGAVVNTSVIWESRGQRTLFGPRGVSGLVNAEITPELVVRLAGAYATTLKKGATVTTARDGSRAARALKRAVISALTAGAINVRDLEVAPMPVTRFDVRSSNAAGGIMLRTTPGDPERIDIIFLDADGDDLSPVAQRKLDRVFSRQEFRRAFPGEIGDLRFPARTMDLYIQDLLDRVDTAGVAEADLKIVVDSSGGSASLVLPTLLGRLGVDVLTVNGRVDETIPPRSALEDLRATDRLGALVASSGAAFGVRFDHVGERVTIVDERGDLIDDDRALLVFLDLVAAENPGAEVALPVTITRVADQVTRFHGLTVRRTSLSAAALTGVARDDGIVFAADGRGGFIVPEFAPAIDGIAAFVKLLALVARTRLTLSTIDARIPSVAILRRSVPTPWAVKGTVMRRVVESVDPDTGYVIDTTDGVRIVGPDGSWILVLPDPSEAVTHLWSEGADIEEAHVLLRRWVEVVEAR

SEQ ID NO: 62293 - protein, 191 aa, Methanosarcina mazei Go1
MRISKISRKTKETDIQLEINLDGKGTADVSTGIGFFDHMLSSFARHAEFDLKVRAEGDLYVDEHHLIEDTGIVLGKALAEALGDMAGIARFGEARIPMDEALAEVALDVGGRSYLVMKADFIAPQVGQFSTQLVKHFFETVASNAKITIHASVYGDNDHHKIEALFKAFAYAMKRAVKIEGKEVKSTKGTL

SEQ ID NO: 62294 - protein, 149 aa, Streptococcus pneumoniae
QPNWINRDRFILSAGHGSMLLYALLHFSGFEDVSMDEIKSFRQWGSKTPGHPEFGHTAGIDATTGPLGQGISTATGFAQAERFLAAKYNREGYNIFDHYTYVICGDGDLMEGVSSEAASYAGLQKLDKLVVLYDSNDINLDGETKDSFT

SEQ ID NO: 62295 - protein, 285 aa, Xanthomonas oryzae pv. oryzae KACC10331
MSTNDNWYIEHFQPTGSAIGFRISGKLDEVQSLFQKIEIYQTTDWGKLMLIDGAVMLTSRDNFFYHEMISHPALFTHPTPKRVVIIGGGDCGTLREVLKHPGVESATQCDIDEQVTRMSEKYFPELCDSNHDARAELLFDDGVAYMANCPAGSVDIVIVDSTDPVGPAEGLFNKAFYESCFKALKDDGLLVQQSESPLALLDLIKEMRTEMGKAGFQSFKTLPFPQPCYPTGWWSVTMASKQAKADFAFRQGAAQAKGFETLYYTAHLHTGVLVAPPFVAKALGE

SEQ ID NO: 62296 - protein, 227 aa, Aspergillus nidulans FGSC A4
MSHHHHSHNNGHGHCHGDGGDGHDHSNDITPALQSLLYSQIRFDSITTLNEATPQSGAAIVKKTWAERQNDTPELESDADEQLLMYIPFTGQVNVHSILIYTAPTPSAPRTLKLFKNRDDLDFSTASELKPTQTIEVPQPIPGTDVFELPLNRAHWNATTSVTLFFEDNWSRGEEEVTKVGYIGLKGQFMALNREPVSFLYEAAANPNDHVAIPGVNGVGGRIMPGQ

SEQ ID NO: 62297 - protein, 459 aa, Zea mays
MPMPSAGRDNATAAEGAAQAFLLPEHAGDNDAPCVGGSASVLGAVCNVSTSVVGAGIMSIPAAMRVLGVAPAVALIAGVAVLARAAVNFMLRYTRGAPSYAALMGDAFGSAGAALLNVFVALNGFGTLTVYLIIIGDVVSGTASGGVAHPGVLQEWFGRQWWTSREVVLVAAAAILLPLVLRKRVDSLRFTSAISILLAVVFMLISSGIALYALFKGTATMPRMFPDFSRLSSPFELFTAVPVIVVAFTFHFNVHPIRAELSKTSDMKVAVRVSLVLCAAIYAAVGFFGFLLFGDATMADVLANFDRSSGAGVPQALNDAARLSYALHLVLVFPLLLFSLRVNVDELLFPGRRPLAADTRRFVSLTAVLMAVLYVLAIAIPSIWTLFEYSGSTFAVTISLIFPGAIVLRDVHGIAKRKDKALAATMIVLAVVTSSIAIASNIMSSISDEDRGGHVAGRR

SEQ ID NO: 62298 - protein, 469 aa, Lactococcus lactis subsp. lactis Il1403
MGFMRKADFELYRDADKHYNQVLTTRDFLALGVGTIISTSIFTLPGQVAAQFAGPGVVFSYLLAALVAGFVALAYAEMSTVMPFAGSAYSWISVLFGEGFGWIAGWALLAEYFIAVAFVGSGFSANLQQLLAPLGFHLPKVLANPFGTDGGVVDIISLLVILLSAIIVFRGASDAGRISQILVVLKVAAVIAFIIVGITVIKPANYHPFIPPHNPKTGFGGFSGIWSGVSMIFLAYIGFDSIAANSAEAKKPQKTMPRGIIGSLLIAVVLFAAVTLVLVGMHPYSAYAGNAAPVGWALQQSGYSVLSEVVTAIALAGMFIALLGMVLAGSRLLYAFGRDGLLPKGLGKMNARNLPANGVWTLAIVAIVIGAFFPFAFLAQLISAGTLIAFMFVTLGIYSLRRRQGKDLPEATYKMPFYPVLPALGFIGSLFVFWGLDVQAKLYSGIWFLIGILIYFAYGNRRSRKSEEK

SEQ ID NO: 62299 - protein, 86 aa, Glycine max
  misc_feature (19)..(19): Xaa can be any naturally occurring amino acid
  misc_feature (47)..(47): Xaa can be any naturally occurring amino acid
GESNLERRHKEESEVIRSXIALQSPNSETIKVISELEKEISAFNTEXRLLELRKKQLALLLHVVDATCMFSMDKQMSLRYSSKIQT

SEQ ID NO: 62300 - protein, 112 aa, Pseudomonas syringae pv. tomato str. DC3000
METLFTKIINREIPAKIIYEDDQVLAFHDIAPQAPVHFLVIPKKPIRTLNDLTEEDKGLAGHILFTAQRLAIELGCEEGFRVVMNCNELGGQTVYHIHMHVLGQRQMSWPPG

SEQ ID NO: 62301 - protein, 317 aa, Arabidopsis thaliana
MSFNKVPNIPGAPALSALLKVSVIGGLGVYALTNSLYNVDGGHRAVMFNRLTGIKEKVYPEGTHFMVPWFERPIIYDVRARPYLVESTTGSHDLQMIILDIPSFDVMLRPFNAALRACFRKFWVWFEVKIGLRVLTRPMGDRLPQIYRTLGENYSERVLPSIIHETLKAVVAQYNASQLITQREAVSREIRKILTERASNFDIALDDVSITTLTFGKEFTAAIEAKQVAAQEAERAKFIVEKAEQDRRSAVIRAQGEAKSAQLIGQAIANNQAFITLRKIEAAREIAQTIAQSANKVYLSSNDLLLNLQEMNLEPKK

SEQ ID NO: 62302 - protein, 1113 aa, Oryza sativa (japonica cultivar-group)
MEIPAVESSAAGRMPPRIRRRLLEGSRVGGGAPTSAEEIEAKLKEAELRRQQFHEWVSCKARKKPRSPSWSSQEEDQGQRLEAKLQAAEQKRLSLLAKAQNRLAKLDELRQAAKNIVEMRIEKEREELGTRVESRVRQAEANRMRLLHAHMQKRAAMKERTARSLVRKQTSERKYTERVKSLILQKRNAAEKKRLALLEAEKRKAQARILHIQRAAKTVCSKRESERRQLQEQLESKLQKAKRQRAEYLKQRVSPRSSAHADYIKHAEFLSTKLARCWKRFLKSNKTTYALVQAYDALGINEMSVKSMPFENLAMLMESPTTLQTTKAVLDRFEKRLLLSQPTGSSSAENIDHLLKRLGSPKRKAPASRSRVAAKKPAKGSETSKLSRYSLRVVLCSYMILAHPGAVLSGQGEKENLLMESAENFVKEFELLVKTVLDRPGGASMQSTDAASQKKFRTQLAAFDKAWCAYLYHFVVWKLKDAKSLEQDLVRAACKLELSMMQTCKLSSDGQSHDLSHDMKAIQKQVTDDQKLLREKIQHLSGDAGIERMNSALSDTRSKFFEAKENGNPLATSVANVSTPLSINSSGQVPNPTSKPTVEGSSFTAQSLPGAASSSSSTSPMKPPTDNEQMVNEMLHEDDVSFARNSDNVSSAEKDFQAKVKATMEKAFWDLVTDSMRGDKPDYSQLINLVKEVRNSLHELASNELKEEILENIDLEILSQVLQSGSQDTRYLGQILQYSLDMVRKLSAPAKEDDMKRSHEKLLNELAASSEVNDNGISSFVIAVIKGLRFTLEEIKQLQTEVSKARIQLMQPIIKGSAGVEYLQKAFTDRYGPPANASVSLPITKQWVSATKSIVEQEWSSHLESLQALPADHAQHVVPVLRAGHGAPAPQASSSAASSSGLPECKGEKIDKLTRVGLLQLISNVEGLNMQSTPETFQINLLRLRAVQDQFQKVIVIATSMLVLHQVLMLKIAPPELQNTISELYDALVKLLDNNADASTKEIVEAMTRSLASVGSLPEEQIQDTTELATKMLLKSLQAGDIVFGKVSRAVYFAFRGVVLGGGAKGKKLAEAPLRRLGAAKLADRVVKAGEVLIKMAVISEKVHGQWYKALAL

SEQ ID NO: 62303 - protein, 265 aa, Oryza sativa
MSPAEPTREESVYKAKLAEQAERYEEMVEYMERVARAAGGASGGEELTVEERNLLSVAYKNVIGARRASWRIISSIEQKEEGRGNDAHAATIRSYRGKIEAELARICDGILALLDSHLVPSAGAAESKVFYLKMKGDYHRYLAEFKSGDERKQAAESTMNAYKAAQDIALADLAPTHPIRLGLALNFSVFYYEILNSPDRACNLAKQAFDEAISELDSLGEESYKDSTLIMQLLRDNLTLWTSDANDDGGDEIKEAAAPKEPGDQ

SEQ ID NO: 62304 - protein, 357 aa, Vibrio parahaemolyticus RIMD 2210633
MSKQQKILFIDRDGTLIVEPPIDFQVDRLDKLKLEPFVIPSLLSLQDAGYRLVMVTNQDGLGTDSYPQEDFDAPHNMMMEIFESQGVKFDDVLICPHFEEDNCSCRKPKLGMVKEYLQGGKVDFQNSVVIGDRQTDLQLAENMAIRGIQYNPETMGWKQILKDLTVKARVAEVIRTTKETDIKVAVNLDEQGGNDISTGLGFFDHMLDQIATHGGFQMVCKVDGDLHIDDHHTIEDTALALGQALKEALGDKRGIGRFGFSLPMDECLAQCALDLSGRPYLKFDAKFSRDQVGDLSTEMVVHFFRSLTDTLACTLHLSSAGDNDHHIIESLFKAFGRTLRQAIKVEGTELPSSKGVL

SEQ ID NO: 62305 - protein, 140 aa, Vibrio vulnificus YJ016
MFSLQSRRNIIMTKVLHTDSAPAAIGPYIQGVDLGNMVLTSGQIPVNPATGEVPADIAAQARQSLDNVKAVVEASGLTVGDIVKMTVFVKDLNDFGTVNEVYGNFFDEHNVAHYPARSCVEVARLPKDVGIEIEAIAVRK

SEQ ID NO: 62306 - protein, 444 aa, Spinacia oleracea
MVTIKSVKARQIFDSRGNPTVEADIHLDDGTFARAAVPSGASTGIYEALELRDGGKDYMGKGVFKAVQNVNEIIGPALVGKDPTEQTAIDNFMVQELDGTTNEWGWCKQKLGANAILAVSLAVCKAGAQVKKIPLYQHIAEISGNKKMVLPVPAFNVINGGSHAGNKLAMQEFMILPTGASSFREAMKMGSEVYHHLKSVIKKKYGQDATNVGDEGGFAPNIQENKEGLELLKTAIEKAGYTGKVVIGMDVAAAEFYSKDKTYDLNFKEENNDGSQKISGDALKDLYKSFVSEYPIVSIEDPFDQDDWEHYGKLTAEIGDKVQIVGDDLLVTNPKRVEKAINGKSCNALLLKVNQIGSVTESIEAVKMSKRAGWGVMASHRSGETEDTFIADLSVGLSTGQIKTGAPCRSERLAKYNQLLRIEEELGDKAIYAGADFRAPVEPY

SEQ ID NO: 62307 - protein, 149 aa, Streptococcus pneumoniae
QPNWINRDRFILSAGHGSMLLYALLHLSGFEDVSMNEIKSFRQWGSKTPGHPEFGHTAGIDATTGPLGQGISTATGFAQAERFLAAKYNREGYNIFDHYTYVICGDGDLMEGVSSEAASYAGLQKLDKLVVLYDSNDINLDGETKDSFT

SEQ ID NO: 62308 - protein, 211 aa, Vibrio parahaemolyticus RIMD 2210633
MSFKAAEVSSLSERINWEKVDGLVPAIVQDFQSSQVLMMGYMNQDALAKTGETGQVTFFSRTKERLWTKGETSGNVLQLVNISLDCDNDTLLVRVNPIGPTCHTGTTTCWDGDAQEESQMVWLHQLEQLLAARKSADPDSSYTASLYARGTKRISQKVGEEGVEVALAATSGDKAELVCESADLIYHLLVLLQDQGLSMNDVVNKLKERHK

SEQ ID NO: 62309 - protein, 371 aa, Silicibacter sp. TM1040
MIKTRAAVALEAGKPLEIMEVNLEGPKAGEVLVEIKATGLCHTDEFTRSGDDPEGIFPAILGHEGAGVVIEVGEGVKSLKPGDHVIPLYTPECRECDYCLNPKTNLCQAIRSTQGQGLLPDGTTRFSLPDGTPIHHYMGCSTFANHTVVPEIALAKIREDAPFDKVCYIGCGVTTGIGAVINTAKVEIGSTAIVFGLGGIGLNVIQGLRLAGADQIVGVDLNPGKVAMAEKFGMTDFVNPSEVEGDLVAHLVELTGGGADYTFDATGNVSVMRTALEAAHKGWGESIIIGVAPAGAEISTRPFQLVTGRSWRGTAFGGASGRTDVPKIVDWYMDGKIEIDPMITHKLTLDQINEGFDLMHEGKSIRAVVEF

SEQ ID NO: 62310 - protein, 339 aa, Glycine max
MDHSADAQRTDLMTITRFVLNQQSNHPESRGDFSILLSHIVLGCKFLCSAVNKAGLAKLIGLAGETNVQASEQKKLDVLSNDVFIKALVSSGRTCILVSEEDEEATFVEASKRGKLYCVVFDPLDGSSNIDCGVSIGTIFGIYLIKEDHEPTIEDVLQPGKNMLAAGYCMYGSSCTLVLSTGSGVNGFTLDPSLGEFILTHPDIKIPKKGKIYSVNEGNAKNWDDPTTKYVENCKYPRDGSSPKSLRYIGSMVADVHRTLLYGGIFLYPADKKSPNGKLRVLYEVFPMSFLMEQAGGQAFTGNQRALDLVPKKLHERSPIFLGSYEDVEEIKALYAAEE

SEQ ID NO: 62311 - protein, 412 aa, Hyphomonas neptunium ATCC 15444
MQMPAEGRPWDEVRADMLARGAGDVAWRDGKTAVYVFNAGEDVHALQHEAYGLFMAENGLGPLAFPSLAQMEKDVISMALGLLHGPEGSTGAITSGGTDSITMAIKTARDYARAKGMAKDRHNIVIPRSGHLAFHKAALLMDIEIRSVPLKTDGSYEADPAAMAAAIDGATIMMVGSAPNFPHGIIDPIAELGKIAEEKDVWLHVDACVGGYFAPFARMNGVPVPDFDFAIPAVKSISADLHKYGYCAKGASTVLFRSVDLYKHMPFSLSEWSGAPMKTPTLAGTRPGGAISAAWAVMNVLGISGYREKQGLVCQTRERIEAGVNALGFEVLGKPLLGLVAFRHPQADTLALYSAMRQRGWFTSFTVEPPSLHLMLSPKHAEVADDYLADLAASLEAVKAGDTAPKVEARYS

SEQ ID NO: 62312 - protein, 869 aa, Xanthomonas oryzae pv. oryzae KACC10331
MSAPHSTDRWIVLKFGGTSVSRRHRWDTIGQLASKRASETGGRVLVVVSALSGVTNALTAIADGAADSAQRVAALDQRHREFLAELELDADAVLGERLAALHALLSDARAATRTLEWQAEVFGQGELLSSTIGAAYLHASGLDMGWLDARQWLSALPPQPNQSEWSKRLSVSCQWQSDADWRARFAAQPTRLLITQGFIARHADGGTAILGRGGSDTSAAYFGALLGASRVEIWTDVPGMFSANPKEVPDARLLTRLDYYEAQEIATTGAKVLHPRSIKPCRDSGVPMAILDTERPDLPGTSIDGNAEPVLGVKAISRRNGIVLVSMEGIGMWQQVGFLADVFTLFKKHGLSVDLIGSAETNVTVSLDPSENLVNTDVLAALSADLSQICKVKIIVPCAAITLVGRGMRSLLHKLSDVWATFGKERVHMISQSSNDLNLTFVIDESDADGLLPILHAELIDSGAMPVSEGDVFGPRWREITGSVRLRPTPWWHAERAHLLSLSKAGTPRYAYHLPTVRARAHALAQIAAVDQRYYAIKANAHPAILMALEQAGFGLECVSHGEVRRVFQALPELSPRRVLFTPSFAPKAEYAAAFALGVTVTVDNVEALRNWPEVFRGRNIWLRIDLGHGDGHHEKVNTGGKASKFGLSSTRVDEFVDVARTLEVTITGVHAHLGSGVETGEHWRMMYDELAGFARRIGTVETIDIGGGLPIPYSAEDEPFDLDVWAKGLAEVKAVHPGYRLAIEPGRYLVAEAGVLLASVTQVIEKDGVQRVGLDAGMNTLIRPALYDAWHDIENLSQLDAPADSTFDVVGPICESSDVFGKRRRLPAATMPGDVVLVADTGAYGYSMASTYNQRELPREEVIDAPAG

SEQ ID NO: 62313 - protein, 125 aa, Brassica napus
  misc_feature (29)..(29): Xaa can be any naturally occurring amino acid
KTLKIFPPLILVSYFITEDALVWLPLAMXCPSQKVAYRFNMGGVLFSLFCTITGTQGSGGRPSQGQQQSKPVVQTLSRAATSDPASKSQVGVNKTTARSTSRADLMVTANSAAAAACMGVVLTAP

SEQ ID NO: 62314 - protein, 459 aa, Staphylococcus aureus subsp. aureus N315
MNFFDIHKIPNKGIPLSVQRKLWLRNFMQAFFVVFFVYMAMYLIRNNFKAAQPFLKEEIGLSTLELGYIGLAFSITYGLGKTLLGYFVDGRNTKRIISFLLILSAITVLIMGFVLSYFGSVMGLLIVLWGLNGVFQSVGGPASYSTISRWAPRTKRGRYLGFWNTSHNIGGAIAGGVALWGANVFFHGNVIGMFIFPSVIALLIGIATLFIGKDDPEELGWNRAEEIWEEPVDKENIDSQGMTKWEIFKKYILGNPVIWILCVSNVFVYIVRIGIDNWAPLYVSEHLHFSKGDAVNTIFYFEIGALVASLLWGYVSDLLKGRRAIVAIGCMFMITFVVLFYTNATSVMMVNISLFALGALIFGPQLLIGVSLTGFVPKNAISVANGMTGSFAYLFGDSMAKVGLAAIADPTRNGLNIFGYTLSGWTDVFIVFYVALFLGMILLGIVAFYEEKKIRSLKI

SEQ ID NO: 62315 - protein, 448 aa, Oryza sativa (japonica cultivar-group)
MGGGVTERLPEGSSEPLLPTKREGGGGGGEFAGAVFNLSTTIVGAGIMALPATMKVLGLAPGLVAILLAALLTDASIELLVRSSRAAGAPSYGAVMGDAFGWWGRRLLQVCVVVNNIGVMIVYMIIIGDVLSGTSSGGEHHYGVLEGWFGPQWWNGRFFVLLVTTLVVFTPLACLKRVDSLSYTSAISVALAVVFVIITAGIAIVKLIKGQIPMPKLFPDVPDLASIWELFTAVPVLVTAYVCHYNVHPIHNELKDPSQIKPIVHTSLVLCSTVYITTSFFGYLLFGESTLSDVLANFDSNLGIPYSQMLNDAVRVSYAVHLMLVFPMIFHALRLNLDGLLFSSSSPLSSDNRRFSVMTAVLLLVIFLSANFIPSIWDAFQFTGATAAVCIAFIFPAAITLRDPHSIAKKWDKILSIFMIVLAIVSNVVAVYSDAYSMFHRKSSPSIA

SEQ ID NO: 62316 - protein, 140 aa, Bartonella henselae str. Houston-1
MAVERTFSMIKPDATRRNLTGAITKMLEDAGLRVIASKRVWMSQREAEKFYAVHKERAFFSELVELMSSGPTIVQVLEGENAIAKNREVMGATNPEDAQEGTIRKVHALSIGENSVHGSDSAETAKTEIAFWFSEVEIVG

SEQ ID NO: 62317 - protein, 301 aa, Bradyrhizobium japonicum USDA 110
MKTFRGTYTVMITPFTAAGEVDVAALRAFVDWQIAEGIHGLIPLGSTGEFLSLDDDEKALVAEVVIGQAAGRVPVLIGTGAEDTREVVRLSRRAEKLGADGVMIIPPFYSTPTDDELVHHYKTVADAIALPIMVYNNPATANVDLKPQLVARIAEIDNCLYIKESTLEVTRVRDIIRLCGDRMTVFGGILGFESFVEGAQGWVAVASNVVPSEMARIFSLVADEGAIKEARELYLKYLPVIEFVGGQAYVAGSKALLGHMGLAVGGPRPPRLPLPAAQDAAALALVKSFGLAWRGASIAAA

SEQ ID NO: 62318 - protein, 486 aa, Pasteurella multocida subsp. multocida str. Pm70
MGGISMQQFSLLKTKAYINGEYVQAKEHKTFAVTNPANQQIICELPDLSAEETEYAIACAAQAQKKWQKVTPKERANLLRRWYNLVIENQEELAQLLSLEQGKPINESRGEILYGASFIEWFAEEAKRIYGDVLPQDKENHRLLVIKQGIGVVAAITPWNFPNAMITRKAAPAFAAGCAMVLKPAQETPLSALALAELAHQAGLPAGLFNVITSTRSVEIGKVLTEHPTVRKVTFTGSTRVGKILMAQSASTVKKLSLELGGNAPSIVFDDADLENAIEGIIASKFRNSGQTCVCTNRIYVQAGIYDRFVELFSAKVAAFKVGSANEAGVNIGPLISQSAVNKIQEHIDDATAKGANLVIGGKLHTRGGTFFEPTVLRDVTQAMLVAKDETFAPLAPVFKFDTEAQVIEMANDTEFGLASYVYTQDISRIWRVSEALEYGIVGINEGLISNEMAPFGGVKESGLGREGSRYGIDEFLEIKYLCLKV

SEQ ID NO: 62319 - protein, 132 aa, Glycine max
MTMIRSISMLTLLVTLAASISMVSSASSADFVKKTISSHKIVIFSKSYCPYCRRAKSVFSELNQVPHVVELDEREDGGSIQSALGEIVGRRTVPQVFINGKHIGGSDDTVDAHESGELAKLLGVSESTRAEL

SEQ ID NO: 62320 - protein, 617 aa, Mycoplasma mycoides subsp. mycoides SC str. PG1
MLKFRSVRMNNQKIINIAVIAHVDAGKSTLVDALLKQSGVFRQNQEVIEQVMDSNDQERERGITIYSKNCSITYKDYKINIVDTPGHADFSSEVERIMKTVDTVILLVDSSEGPMSQTRFVLQKALEIGLNPILFINKIDKKDQRSLEVVEEVIELFLELNATDEQLDFKTLYGIAKNGIAQYSLEEQSNDLTPLFETIINQVGSYPTELSNNDLVMQVSSLAYDSFIGRIGIGRIFEGSIKENQIVSIVKNDRIIKQGKIAKLMVYQGLNRVQVKQAFAGDIITFAGIEDISIGDTINNLNIIKPLKPIHIEEPTMSMNFLVNTSPFAGRVGKFVTSRNIKERLEKEVEVNVGLRIEPLINSEIEGFKVLGRGELHISVLIEAMRREGFELAISKPEVIFQRNPMTGDLLEPIEKVIINTPTEYSGTVINKLNQRKGIMLDMDSDGIRDKITYSIPLRGLIGFRSEFTNDTHGEGIMVKSSSGYELYKGEIVSRQNGVLVSMANGKSLPYALNNLEERGILFIGPQVDVYEGMIIGQHSRDNDLYVNPTTAKKLTNTRASGTDDAVKLTPARKMSLEEALEYISNDELVEITPTDIRLRKRWLTQAEQKQHRNDKY

SEQ ID NO: 62321 - protein, 230 aa, Synechocystis sp. PCC 6803; identical to SEQ ID NO: 1495

SEQ ID NO: 62322 - protein, 250 aa, Triticum aestivum
AYLGDTLRTSLYKKAGWYRSGIPGISSTHASALCDSDPFHFLAFRELLQEVGFNNGVPITEEFYSANISGWHNDALAGALFPELDHAKGMEFMDRKEALFRKLAAGELKGLEGLQELCTWIEGRNLKRAAVTNAPRANAELVLSLLGLTSFFPVLVIGSECERAKPSPDPYLKALELIGASPDHTFIFEDSASGIRAGVAAGVAVVGLTTGNPEKVLRDAGASLLIEDFRDPKLMAMLQELDPAAADKQG

SEQ ID NO: 62323 - protein, 449 aa, Wolinella succinogenes DSM 1740
MPYIQQTLEQLQKTFPAQKEFHQAVHEVLDSLRPLLAKESKYERYNILQRIVIPERQIGFRVTWMDDAGRIQVNQGYRIQYNSTLGPYKGGIRLHPSVNEGIIKFLGFEQIFKNALTGLAMGGAKGGSDFDPKGKSEAEVMRFAQAFMSELYRHIGPLTDVPAGDIGTGAREIGYLFGQYKKLVNRYEGVLTGKSLLWGGSLARKEATGFGSVYFAEEMLRERGESLEGKTCLVSGSGNVAIYTVQKLLELGAKPITVSDSTGMIHDASGIDLDLLKEIKENRRESLTSYAKEHPGSRFISVGEYPKDHNPLWAIPCFAAFPSATQNELNEKDAKHLLQNGCICVSEGANMPSTPSAVEKFLAAKICYGPGKAANAGGVATSGLEMSQNASMTSWSFEEVDMKLHGIMRGIYRAAKETAKEFGEPHNLVLGANIAGFRKVADAMIEQGI

SEQ ID NO: 62324 - protein, 343 aa, Hyphomonas neptunium ATCC 15444
MSGAETLQQIVLAQYCDGVPKPSDFRLETAPLPEPKDGQFRVAHVWCSVDPGTRSRLSGGDSYAAALPLGKPIDGFSVGVVDASSNPDWPVGTKVFCAGGWKTHSIQSGKGFIGKVMDVPGVPLSAWIGVLGVPGLTAWFGMKDVARFKEGDAVLVTSAAGPVGATAGQLAKGWGASKVVGVAGSDEKCRWLVSEAGFDAAINYKTASDLSGAIAAEFPKGVDVLFDNVGNAMVDTVLPLMALNGRICISGQVADYNLKPEETPGIVHTKPFITHRVNMQGLVVFDFARGFPEALGSMAKMIASGALKIQEDRFEGIAEIPEAFCGLFRGENSGRRVVKVGAE

SEQ ID NO: 62325 - protein, 120 aa, Ipomoea trifida
MRIYNKKREKLNIDEIHDIRGLRFKALRVIHQLWHEVPGRFKDYIMHPKFNGYQSLHIIFIGGGMVPLEVQIRTKEMHLQTEYVALLLIGDTRKMLVQEFATIPDKSLTDYRVEIQRMYD

SEQ ID NO: 62326 - protein, 428 aa, Frankia sp. CcI3
MADVGDLVARDRRVVWHPYASVSGSTPLFPVASAAGTRLTLTDGRELIDGMSSWWAAIHGYRHPVLDEAVRGQLETMSHVMFGGLTHEPAVALAETLVAITPDPLRRVFPCDSGSVAVEVAIKMALQYWTGRGRPGRTRLLTIRRGYHGDTSGAMAVCDPDAGMHHLFSHLLPRHLFASAPACAFDEPCEDAHVAEIEGLLAGHADEIAAVICEPVVQGTGAMRWYAPGWLARLRELCDHYGVLLIADEIAVGFGRSGELFGCDHAGISPDIMCVGKAMTGGYLSMAATLCTDEVAAGVCDSPAGVFMHGPTFMGNPLASAVANASIDLLLSSPWQARVREISAGLAAGLAPAADLPGVADVRVLGAIGVIETREPVDMTVIQPLLVDLGVWVRPFGRLVYTMPPFIISPADVATLAAAMVEAVARTI

SEQ ID NO: 62327 - protein, 1092 aa, Hyphomonas neptunium ATCC 15444
MPKRTDISSILVIGAGPIIIGQACEFDYSGVQAVKALKAEGYRVILVNSNPATIMTDPELADATYIEPILPEVVEKIIAAERPDALLPTMGGQTALNCALDLHYAGILEKYGVELIGAKAEAIEMAEDRKLFREAMDRLGLENPRAAIIASPEIRGEDGKIKSYDRITGLRQAMDALETVGLPAIIRPAFTLGGTGGGIAYNVEEYEEICRSGLAASPNAQILIDESLLGWKEYEMEVVRDTADNCIIICSIENIDPMGVHTGDSITVAPALTLTDKEYQVMRNASIAVLREIGVETGGSNVQFAVNPKDGRLIVIEMNPRVSRSSALASKATGFPIAKIAAKLAVGYTLDELDNDITGVTPASFEPTIDYVVTKIPRFAFEKYKGAEPILTTAMKSVGEAMAIGRSFQESLQKALCSLETGLSGLNELPFENESALRQALGIQSPDRLRVIAQAFRMGLSVEDVQAVTSFDPWFLRQIEEIVKTEALILANGLPGNLASMTEIKAMGFSDKRLAELTGNTEDGVRAHRHALGVRPVYKRIDTCAAEFAAKTPYLYSTYEHAPFGQAAAECEAGPSSRKKAIILGGGPNRIGQGIEFDYCCCHAAFAMEDLGIESIMVNCNPETVSTDYDTSDRLYFEPLTIEHVLEIIHVEQSAGELAGVIVQFGGQTPLKLAGPLFEEQVPILGTSPASIDLAEDREQFAALLDKLGIQQAPSRVARSVEEAEVKANEIGYPVMLRPSFVLGGRAMEIARNDEDLRKFAAEALRVSGDASLFIDRYLSDAIEVDVDAICDGKTVHVAGIMEHIEEAGVHSGDSACALPPFTLSQDLQKRLGEQAAQLAMALNVRGLINIQFAVKGEEIYVLEANPRASRTVPFVAKAVGAPIAAIAAKVMAGEALSSFDLSNARPRRIAIKEAVFPFARFPGVDPQLGPEMRSTGEVMGWDDDFGMAFLKSQLGGGIRLPAEGTVFISVRDSDKKGAEEAARGLVEQGFTILATSGTATHLESKGIPVKRVNKVLEGQPHIVDAMINGDVQLVFNTTEGAASLSDSGSIRRTAVARKIPYFTTLAASLAAVKAIASMKSQEISVRALQSA

SEQ ID NO: 62328 - protein, 225 aa, Gibberella zeae PH-1
MSHCHDEHTGHGHGHDHHEHDHSDDITPAVQFSLYSQINFDHIVTLNEADRDAGLQIVKKNWQERLSTEPELASDVDEQLLMTVPFTAQIKLHSILIRTSPSASAPKTLHLFINRDDLDFAAAEESDPVQTLELSQTGDLQEIPVKRALFGKVQRLVLFFADNFGDGDEDVTRISYIAFKGEWTQLGRAPANIIYEAAANPGDHKLKGTDVNQMGSGIGGRGPGI

SEQ ID NO: 62329 - protein, 380 aa, Gibberella zeae PH-1
MYSGFGGGYDPANPEHLYNMARHGRRPIVQRFDEYYRCYPLVMAPGAERPELNYGSKIILPPSALDKVSKLHVQWPLLMELINGEKGRHSHAGVLEFIAEEGRAYIPQWMMVTLGMDVGDMIQIRTTSLELAKMVKLQPQSVNFLEISDPKAVLEKAFRNFATLTKGDVFNFSYNDEVYDVAVLDVKPETDKMGVSMIETDVSVEFAPPVGYVEPERQSGTSTPRSTRGGAPAGGLLHNQGTMAQSINYSAIAPSVTSNVTNFLGEGQKLVKKSSKASTPKPATPVPTVDIPGMPKRRDGAPAALRLAPNKLFFGYEIKPVKTDADKEKEKESANRPHFAGQGQTLRGAVKRKGEGDDKTKAPEKKGTSEGNRLDGRRPR

SEQ ID NO: 62330 - protein, 284 aa, Glycine max
MGREATKKKKMKKNAKSGGFESLGLNPNVFKGIKRKGYKVPTPIQRKTMPLILSGSDVVAMARTGSGKTAAFLVPMLHRLNQHIPQSGVRALILSPTRDLALQTLKFTKELGHFTDLRVSLLVGGDSMESQFEELAQSPDIIIATPGRLMHHLSEVDDMSLRSVEYVVFDEADCLFGMGFAEQLHQILAQLGENRQTLLFSATLPSALAEFAKAGLRDPQLLRLDLETRISPDLKLAFFTLRQEEKYSALLYLIREHIGSDQQTLIFGSTKPHVEVLNLLVPEK

SEQ ID NO: 62331 - protein, 338 aa, Gibberella zeae PH-1
MAPIKVGINGFGRIGRIVFRNAVEHPDIEVVAVNDPFIEPHYAVYMLKYDSSHGIFKGEVGNQGNDLVVNGKTIKFYSERDPANIKWSETGADYVVESTGVFTTIDKAKAHLQGGAKKVIISAPSADAPMYVVGVNENKYDGSADIISNASCTTNCLAPLAKVINDKFGIVEGLMTTVHSYTATQKTVDGPSSKDWRGGRGAAQNIIPSSTGAAKAVGKVIPELNGKLTGMSMRVPTANVSVVDLTVRLEKGASYDQIKQVIKEASEGDLKGVLAYTEDDVVSSDLNGNTNSSIFDAKAGISLNDNFVKLVSWYDNEWGYSRRVLDLLAHVAKVDASK

SEQ ID NO: 62332 - protein, 337 aa, Ustilago maydis
MSQVNIGINGFGRIGRIVFRNSVVHNTANVVAINDPFIDLEYMVYMLKYDSTHGVFNGDISTKDGKLIVNGKSIAVFAEKDPSNIPWGQAGAHYVVESTGVFTTIDKASAHIKGGAKKVVISAPSADAPMYVCGVNLDAYDPKAQVVSNASCTTNCLAPLAKVIHDKFGIVEGLMTTVHATTATQKTVDGPSAKDWRGGRAAAANIIPSSTGAAKRVGKVIPSLNGKLTGMAFRVPTTNVSVVDLTARLEKGASYDEIKAEVKRASENELKGILGYTEDAVVSQDFIGNSHSSIFDAAAGISLNNNFVKLVSWYDNEWGYSNRCLDLLVFMAQKDSA

SEQ ID NO: 62333 - protein, 653 aa, Magnetococcus sp. MC-1
MCGISGFYQPAASEQELAHNITRMTATLQRRGPDDGGFWLEPSCGLALGHRRLAIQDLSPLGHQPMADASGRYQIVFNGEIYNFLELKQNLERHYGPQPWRGHSDTEVLLALIGHSGLEAALAQCRGMFALALWDRQQRILTLARDRLGEKPLYYGRQGDSLLFASELKALRAHPHWQGGVDRHALTLFMRHSTVPAPYTIHPGIHKLQAGCYQRFQWHPEQGMQDLGMIHYWSMSQVVAHANAHPFDGDETAALQAVEQQLMAIIGRQMVADVPLGAFLSGGIDSSLITAMMQAQSSRPVQSFTIGFAEASHDESAYAQAIARHLGTQHTTLQVTPQDALALVPSLPLIYDEPFSDASQLPTTLLAGLTRQHVTVALSGDGGDELFGGYDRYGESMALWRLRGRVPSPLRRPLARAGRALPSGVWSALLRPVAACLPAKARDNPGDIVHKMMDLLVQPDFAHLYRHMLSHWSDPGNLVVGGHEPPTNLTRGWTQPWRQDPVAQMMYWDTLLYLPDDILVKVDRAAMWSSLECRIPLLDHRLVELVWSMPMHFKRRDGVPKWLLQRLLGKRVPEALFERPKMGFGVPLERWLRGPLKGWAQDLLAPALLQRQGYLNPEPIARIWRQHQQGSHNWHHLLWDLLMWQAWLAEHEG

SEQ ID NO: 62334 - protein, 247 aa, Medicago truncatula
VLLRRFQITHNLSLDGVLDFLNSKNMTEAGPLDLIDDYNSDVEEGVETQTRGKLGLDLPGSVSNRGRPIIQTKCLRIAPTGRSFVAATTEGVLVYSVDESFIFDPTDLDIDVTPEAVDKALNENQPSRALILSLRLNEDSFIKKCIFTVSPADIPAVATSIPYKYLQRLIEALASLLENCPHLEFILRWSQELCKAHANSIQQNSRNLLPSLKSLQKSITSIHQDLADTCSSNEYMLRYLCSSSASK

SEQ ID NO: 62335 - protein, 444 aa, Listeria innocua Clip11262
MAKYTKEDIFRFADEQNVKFIRLQFTDILGIIKNVEIPVSQLKKALDNKIMFDGSSIEGFVRIEESDMYLFPDLDTWVVFPWTAEKGKVARMICDIYNPDMTPFAGDPRANLKRVLKEMEELGFTEFNLGPEPEFFLFKLDENRRPTLELNDSGGYFDLAPTDLGENCRRDIVLELEEMGFEIEASHHEVAPGQHEIDFKYEDAITACDSIQTFKLVVKTIARKHGLHATFMPKPLFGVNGSGMHFNMSLFTEEGNAFFDKEGELELSKTAYHFLAGMLKHARGFTAVTNPTINSFKRLVPGYEAPCYIAWSGKNRSPLVRVPSSRGLSTRLELRSVDPSANPYLAMAVLLKAGLSGIKDELTPPAPVDRNIYGMNEEEREATGIYDLPESLGHALIELEKDDIIRDGLGEHIFEHFIEAKTIECDMFRTAVHPWEREQYLEIY

SEQ ID NO: 62336 - protein, 524 aa, Lactobacillus sakei subsp. sakei 23K
MENGRIRRASRFNKTRFVFILKGLLVGGVTGLVVSLFRLAIEKGLALTIKLYQSLHSQPLNWLWIIGANLLIGLVVAQLLKKEPNISGSGIPQVEGQLEGEFELAWWSILWRKFVGGILSIAPGLFLGREGPSIQLGAAVGQGVADRLDDHGADRRILIAGGAAAGLSAAFNAPIAGTFFVLEEIYHNFSPLVWLTALTSAIGANFISLNFFGLTPTLHITYTHNLPINQYWHLILLGIVLGLLGYVYQKTLLWLPQFYKRLPVPKYYWGLLPLVLVLPIGYFWPTVLGGGNGLITQLGQQVPTLTTVALLLVLRFVFSMISYGSGLPGGIFLPILSLGALIGAVYGLVMVQLGWLAPVYVPNLIIFAMGGYFAGIGKAPFTAILLVTEMVGTLTHLMPLAILSLVAYVVVDLMGGAPIYASLLQRLIGQPKTDMAQFKDRLEVPIFAGAPLEDHQVRDVAWPETCLLIAVRRGEAELIPHGDTLIRAGDTLVILTDHHLRATVRRQIEAAAQTLKKADENLVK

SEQ ID NO: 62337 - protein, 365 aa, Candida albicans
MLTASLYKQLPVLTTTATSTYSFIRLSSTLATPPHSTTTTSPSSPAFHQPNHPQQFANPNTSVFDVSTRIYTQEGIDNNNDTKFLTKAPYPHPVFPQDECENVTVTHRETKTLGDKISFRSIQFMRQCFDLVTGYAVPKTNNPDEFKGTRWEMTEGKWLTRCIFLESVAGVPGSVAGFLRHLHSLRMLRRDKAWIETLLDEAYNERMHLLTFIKIGKPSWFTRSIIYVGQGVFTNVFFLLYLLNPRYCHRFVGYLEEEAVRTYSHLLDELAVPGKLPAFETMKIPEVAVQYWPELTPKSSFKDLILRIRADEAKHREVNHTFANLEQKTDRNPFALKIEGLNKPQPNHGINVMRPTGWEKQDLQL

SEQ ID NO: 62338 - protein, 365 aa, Triticum aestivum
  misc_feature (123)..(123): Xaa can be any naturally occurring amino acid
AAISPDCNRPCLIYLADELIKNAAYIGTPGKGILAADESTGTIGKRFASINVENVEDNRRALRELLFCTPGALQYLSGVILFEETLYQSTKGGKPFVDILKAGNVLPGIKVDKGTIELAGTNXRTTTQGFDDLGKRCAKYYEAGARFAKWRAVLKIGATEPSQLSIDQNAQGLARYAIICQENGLVPIVEPEILVDGPHDIDRCAYVTEIVLAACYKALNDQHVLLEGTLLKPNMVTPGSDSKKVAPEVIAEYTARTLQRTVPAAVPAIVFLSGGQSEEEATLNLNAMNKLQTKKPWNLSFSFGRALQQSTLKAWSGKTENEEKARAAFLVRCKANSEATLGTYKGDATLAEGASESLHVKDYKY

SEQ ID NO: 62339 - protein, 395 aa, Antirrhinum hispanicum
MEKIADGHPLGDDKLIEILLHLPVRSLVRFKCVSISWYNLIRSPTFCNKHFLTSRRNDSVLLVRRFLRPPEDEDVLSFHDVNSPELEQVAPNLSIPFLKDIRLRYNRPYFPEGVTLLGPCNGLLCITHAEFLIFCCPTLREFKRLQPCPYVSPKGFFDRIIGSGFGCTSMTDFKVVLIRSIWFDDVYDYSTYTLVHLYNSNTNSWRITNDVGTLSFKDLWDYPCSQRFFHGNLHWNAASYDYSSRKAILTFNLNTETFGQLEYPDYFKKLHETGICFTIINNCFAIILYKDSKEEPQPLDIWVMKKYGFGESWTKQFTVGPYQVVSCILPWKNDEWLFVESSDGQLATCALHTNEFRRLPIYGVEKTMRAMIYKESLISLNQVYINLFNKLLHGW

SEQ ID NO: 62340 - protein, 372 aa, Urtica dioica
MMMRFLAAVVIMSSAMAVGLVSAQRCGSQGGGGTCPALWCCSIWGWCGDSEPYCGRTCENKCWSGERSDHRCGAAVGNPPCGQDRCCSVHGWCGGGNDYCSGSKCQYRCSSSVRGPRVALSGNSTANSIGNVVVTEPLFDQMFSHRKDCPSQGFYSYHSFLVAAESFPAFGTIGDVATRKREVAAFLAHISQATSGERSDVENPHAWGLCHINTTTVTENDFCTSSDWPCAAGKKYSPRGPIQLTHNFNYGLAGQAIGEDLIQNPDLVEKDPIISFKTALWFWMSQHDNKPSCHDIVLNANSAANRIPNKGVIGNIISRAFGHDDFAVRSSSIGFYKRYCDMLGVSYGHDLKYWFDNTPSSEFQRIQMRVAA

SEQ ID NO: 62341 - protein, 103 aa, Urtica dioica
MMMRFLAAVVIMSSAMAVGLVSAQRCGSLGGGGTCPGLRCCSIWGWCGDSEPYCGPSCETNCWDDERSDHRCGAAVGNPPCGQDRCCSVHGWCGGGNDYCSSS

SEQ ID NO: 62342 - protein, 254 aa, Bartonella henselae str. Houston-1
MSPNIRPFIAGNWKMNGTGESLGELRAIAAGISSDLGRLFEALICVPATLLSRAFDILGGENILLGGQNCHFDDYGPYTGDISAFMLKEAGASHVIIGHSERRTVYQESDAIVRAKVQAAWRAGLVALICVGETLEERKSNKVLDVLTRQLEGSLPDGATAENIIIAYEPVWAVGTGNTATSADVAEVHAFIHHKMHSRFGDEGAKIRLLYGGSVKPSNAFELLSTAHVNGALIGGASLKAIDFLTICDVYRKL

SEQ ID NO: 62343 - protein, 112 aa, Urtica dioica
MMMRFLAAVVIMSSAMAVGLVSAQRCGSLGGGGTCPGLRCCSIWGWCGDSEPYCGPSCETNCWDDERSDHRCGAAVGNPPCGQDRCCSVHGWCGGGWDYCFGENCQYRCSSS

SEQ ID NO: 62344 - protein, 356 aa, Zea mays
  misc_feature (76)..(76): Xaa can be any naturally occurring amino acid
MDGEAIRMGGGNLAPAYLSGAATATAITMQDPNQNQNQNQNQNQSQFLFSANSTALQLFGSAAVPTVGPAGYINYXGNTHLPVMNQASTSNIGAGNENLLKLQVPLSDYHQQSAGRLARVGNPGAVSTGLRLSYEDDERNSSITSGSGSMASLPATMSCVDGFMAELDKESKEINFYLRLQADQICKRMKEANHRWMVSFLASVNQAVGKKLRDKELEVEAVNRKSKELNEQMRQVAMEVQSWQSAAMYNQSVVNTLKNKLMQLVAQNTNLAREGMGDSEDVASSQSPDAGGDALGGLRGTATVGLGACRCCGRKEASVLVMACRHLCLCADCDKVSDVCPVCRFPKSGSVEINMS

SEQ ID NO: 62345 - protein, 422 aa, Bartonella henselae str. Houston-1 [sequence omitted]

SEQ ID NO: 62346 - protein, 506 aa, Petunia x hybrida
MMLLTELGAATSIFLIAHIIISTLISKTTGRHLPPGPRGWPVIGALPLLGAMPHVSLAKMAKKYGAIMYLKVGTCGMAVASTPDAAKAFLKTLDINFSNRPPNAGATHLAYNAQDMVFAHYGPRWKLLRKLSNLHMLGGKALENWANVRANELGHMLKSMSDMSREGQRVVVAEMLTFAMANMIGQVMLSKRVFVDKGVEVNEFKDMVVELMTIAGYFNIGDFIPCLAWMDLQGIEKRMKRLHKKFDALLTKMFDEHKATTFGRKGKPDFLDVVMENGDNSEGERLSTTNIKALLLNLFTAGTDTSSSAIEWALAEMMKNPTILRKAQAEMDQVIGRNRRLLESDIPNLPYLRAICKETFRKHPSTPLNLPRISNEPCIVDGYYIPKNTRLSVNIWAIGRDPQVWENPLEFNPERFLSGRNSKIDPRGNDFELIPFGAGRRICAGTRMGIVMVEYILGTLVHSFDWKLPSEVIELNMEEAFGLALQKAVPLEAMVTPRLQLDVYVP

SEQ ID NO: 62347 - protein, 457 aa, Bartonella henselae str. Houston-1
MSIDILMPALSPTMEEGKLSKWLKKEGDKVSSGDIIAEIETDKAMMEVEAVDEGTLGRICVLEGSEGVKVNTVIAVLLEEGETVEDISQSTNSLNTHQKNGGASSSFSSSVPQLPILDTLPDSDIPAGTKMVTMTVREALNQAMAEEMRRDEMVFLLGEEVAQYQGAYKVSQGLLEEFGTRRVIDTPITEHGFAGLAVGAAFGGLRPIVEFMTFNFAMQAMDQIINSAAKTRYMSGGQMTAPMVFRGPNGAAARVGAQHSQCYAAWYSHVPGLKVVMPYSAADAKGLLKAAIRDDNPIIFLENEILYGHQFDVPQIDDFVLPIGKARIHKSGQDVTVVACGIGMHYAVQALPEIEKLGVDVELIDLRTIRPMDLPTIVSSVKKTGRLITIEEGYPQSSVGTEIATRVMQQAFDYLDAPVATVAGKDVPMPYAANLEKLALPNTAEIVEAVKAVTYKA

SEQ ID NO: 62348 - protein, 158 aa, Zea mays
  misc_feature (25)..(25): Xaa can be any naturally occurring amino acid
MAAAAAAPASVAPSSAPKAAGDNRXKTAVSVDASELEKHVLAVDDSSVDRAVIARILRGSRYRVTAVESATRALELLALGLLPDVSMIITDYWMPGMTGYELLKRVKESAALRGIPVVIMSSENVPTRITRCLEEGAEGFLLKPVRPADVSRLCSRIR

SEQ ID NO: 62349 - protein, 664 aa, Listeria innocua Clip11262
MFDNTDSLAVNTIRTLSIDAIQKANSGHPGLPMGAAPMAYALWSRVLNTNPKNSHWFNRDRFVLSAGHGSMLLYSLLHLSGFKLEIEDLKNFRQWESKTPGHPEYRYTDGVDATTGPLGQGIAMAVGMAMAERHLEAKYNKDGFPVVDHYTYALCGDGDLMEGVASEAASYAGHQQLGRLVVLYDSNDISLDGDLDKSFSENVKQRFEAYGWEHLLVKDGNDTAEILAAIEKAKQNTSQPTMIEVKTVIGFGAPNAGTSKVHGAPLGDEGILEAKKAYGWNYEEKFFVPEEVTTRFKETIGERGEKAEAAWNELFASYKAKYPELAKQLEDSLNNKLPADWDADLPVYDDSKALASRASSGEVINALAAKIPTIFGGSADLAGSNNTTIKTDGEFTKKTPAERNIWFGVREFAMGAALNGMALHGGLQVYGGTFFVFSDYVRAAIRLSAIQHLPVTYVMTHDSIAVGEDGPTHEPIEQLASLRAMPGLSVIRPADGNEVVEAWKLAITSTDTPHVLVLTRQGLPTLPNSAKLSAEGVKKGAYVISPAKGEVPEAIILASGSEVNLAVEAQKELQAQGTDVSVVSVPSFDLFAKQSAEYKESVLPNAVRKRVAVEMGASFGWERYVGLDGKVIGIDKFGASAPGETVIKNYGFTVENVVNTVKSL

SEQ ID NO: 62350 - protein, 489 aa, Oryza sativa (japonica cultivar-group)
MDHERQANLLRVGTSSSSPKLNSPSTSAISLELLGHRLHISQDPNSKHLGTTVWDASMVFVKFLEKNSRKGRFSPSKLKGKRVIELGAGCGLAGLGMALLGCDVVTTDQVEVLPLLLRNVERNKSWISQSNSDSGSIGSVTVAELDWGNKDHIRAVDPPFDYIIGTDVVYSEHLLQPLMETIIALSGPKTKIMLGYEIRSTTVHEQMMQMWKSNFNVKTVSKSKMDVKYQHPSIHLYIMDPKATLIPEVSDNGNNEEEEVVSNPGDDEDPGAESGGPCTGSVDSAEAKTAGYLDDDWEIRRCGAMAARLLKDSASTFFEMLSAYDRRRLARGVSRRRAITGELIDSSSVDCRTIFLCKFCSFATNGSDHSLNLEGLAIPSAPLPSSPSSPSSPTPRSRISSNTVTAPNSHCPHISSSSPVLSKPQTLSPVLSKPQTLSPPPRQAPPCTCKSIGCPVPEDISSEEAEEDEGKRILGLQPWIGIPHFKVIP

SEQ ID NO: 62351 - protein, 460 aa, Euglena gracilis
MAVGSSMSATTQMHVQPAVRATTRVQPTLAMRGQISRLAANSQVYAEAPAAYEFQAPAQASGVSSGIAAMVMAPVAAAAAFFAYKKGQSDAQTYEVADPAGVQTYGTELVFAMNATIGNKYPGNSNTKAAISGFGRIGRNVLRCWYGRNPKPFDIVAINAGSMSPEQAAHLLKYDSVLGTFEADVQYGDDWISVDGKKLKLLTTRDPAQAPWKELGVEIVIEGTGAFNSLDGSSKHLTAGAKKVVITAPGKNCPTYVCGVNEDQYNPATDHVISNASCTTNGMAGVCKVLDENFTVQYGTMTTTHSYTGDQMILDGRHSDLRRARAGAVNIVPTSTGAAKAVALVLPNLKGKLNGIALRVPTPNVSIVDLVVKVDKKTTKEEVNAALKKAADGPLNGVLGYTELPLVSSDFKGTNVSATVDGQLSMVMGEDMVKVVMWYDNEWGYSQRVVDLTAVVAGKL

SEQ ID NO: 62352 - protein, 960 aa, Aspergillus nidulans FGSC A4
MLSESSPPSLSLPAHLATRFARKSSVARRSSAASSRRSSISSLSSQHSNATSHGATATDHIAQHLRRASILDSRKARLADRALHAEKVRLRAALTKAATRNLQREGRALAAQQARERLLAEITAKCEEEVRRAKKKAEDNREKKAAEHARLRIEMAEKLAEAEKRRLLYQQTPRRHRTSSSTLEEKRKVTMKRLSEDAAARRIQRAWKAHHAKLVIKEFLALNLTKERIRDMAFEDVGSLLSEERILSTTAQVLRLCGLQDMTSGTLGGRGAVRTFLSSYLIVTHPAEVLSGDGEQEQDLISKARELIAAFEQVTPLLASGCCPPEAICTDIQTLCEEYNVFFSAFHAWKAHDSSVLIEIMLAQFIELELIWQTVKDDQAGGVADDYRQGIRQNQILLLARLKRLAGSDKAMQMVRDALKKAKRQKKRSASKRAIPRSAEVASATTTTEALTESVASPISESFNNVESAVLQELEKQRTSPHEQFTKILTALPENRALVHELLINKDFKIDEKSYTEPRKRIMEHMCALMRRDIEAGSGTNWIVAMATVIQDRLLRSLRPGNSLHVLISEALDPSLVENQCKAGTFSYDAFFNFMATILPKLCAPYRDPVVNAFAEDTSGDAIERLARLMGIIDLLSLDHTNFMIHVAAPQLIQEAPGYEQRTFERGLQDGSLGIGKSRRFWRTHRKIVADEMRKRDPEDVHGEPQPPALKVYAHGLVDLVFSNAPVSDDLIPETLELDRQRLNALHSQAFKIVATASILLTAKNLLKRDARAQWKAEADRIMSLDLNDVSSDRIQSILESTHPMPPTASAQLAATIRRVLPPVVTACAAASSSAGQTLVEVHTEIPAQGAQSSAAAANPATSGVAGSGVSSFADPVARLILSRLRAHVLSRLSALSASERVRAASTASQSLAGAGMPEFVSQVGQLTEELNKVREVDWLCHGTVYERILGESGPLSPTA

SEQ ID NO: 62353 - protein, 449 aa, Wolinella succinogenes DSM 1740
MRQSWIEKRKNDSVRTQLHYARAGIITEEMQAVANVEGLSEELIRSEVARGRLVIPANIHHLSLSPMGIGVAARTKINANIGSSSLASCIEEEIEKTLVSIKYGADTIMDLSTGGDLDAIRCAVIEHSSVPIGTVPIYQILHDVQGDIKNLTIDSMLEVMERQARQGVSYFTIHCGFLLEHLPKVAKRKMGIVSRGGSLMASYMMHYHKQNPFYEAFDEILAICREYDVTLSLGDSLRPGCLADASDEAQLAELKVLGELTLRAWEKDVQVMIEGPGHVPMNQIERNVKLQKELCHEAPFYVLGPLVTDIAAGYDHIASAIGAAIAAWKGVAMLCYVTPKEHLGLPNAKDVREGILAYKIAAHAADIARGRIGARDRDDAMSDARYAFDWNRQFELALDPDRAKEYHDESLPQEVFKEAKFCSMCGPKFCSYKISQEIVSKHASGESLT

SEQ ID NO: 62354 - protein, 172 aa, Mycoplasma penetrans HF-2
MGYEEIKNTIATIEDFPKKGISFKDITPLLLDHKKMNFIIDELAKFAKTIDFDIIVAPESRGFLFGLPLALNLKKPFVPIRKKGKLPREVISQEYELEYGKATIEVTKNDIPANSKVLIIDDLIATGGTTVAIQDLVTKLGSTVVGQAYLIELVGLCDYEKLQGKFFSMIKY

SEQ ID NO: 62355 - protein, 277 aa, Lactobacillus sakei subsp. sakei 23K
MQIITDELARQVIVARPAISHKGDFGRILIIGGSQQYGGAAIMSASAAVYAGAGLVSVASDLSILASLHTSLPEAMFIDYRQPFVQWAPTVQAADVIVIGPGLGLSAFALLLLKQVLQAAQPEQTLLIDGSALTLIAREKLALPDAQLILTPHQMEWARLSGLSIAQQTVANNQAALADYPKATLVLKKHHTEIYHQTQVSQLMIGGPAMATGGSGDTLTGIIAAFCGQFGTNYQTISAAVYTHSAISDQLAQKQYVTLPTQMIQALPQFMAQMAHQ

SEQ ID NO: 62356 - protein, 362 aa, Perilla frutescens
MVTSAMGPSPRVEELARSGLDTIPKDYVRPEEELKSIIGNILAEEKSSEGPQLPTIDLEEMDSRDEEGRKKCHEELKKAATDWGVMHLINHGIPEELIDRVKAAGKEFFELPVEEKEAYANDQAAGNVQGYGSKLANNASGQLEWEDYFFHCVYPEHKTDLSIWPTKPPDYIPATSEYAKQLRALATKILSVLSIGLGLEKGRLEKEVGGAEDLIVQMKINFYPKCPQPELALGWEAHTDVSALTFILHNMVPGLQLFYEDKWVTAKCVPNSIIMHIGDTLEILSNGKYKSILHRGLVNKEKVRISWAVFCEPPKEKIVLQPLPETVSEVEPPRFPPRTFAQHLKHKLFRKTDGDLDEKPTY

SEQ ID NO: 62357 - protein, 640 aa, Medicago truncatula
MMTSSSSSSVMRKLDVVSPVPSDIDIANSVQPIHISEIANHLNLTPNHYDLYGKYKAKVLLSALDELQESKDGYYVVVGGITPTPLGEGKSTTTVGLCQALGAFLDKKVVTCIRQPSQGPTFGIKGGAAGGGYSQVIPMDEFNLHLTGDIHAITAANNLLAAAIDTRIFHESTQSDKALFNRLCPPNKEGKRSFSDVMFRRLKKFGISKTNPDDLTPEEVNKFARLDIDPDSITWRRVMDINDRFLRKITVGQGPDEKGMVRETAFDISVASEIMAVLALTTSLTDMRERLGKMVIGNSKSGDPVTADDLGIGGALTVLMKDAIHPTLMQTLEGTPVLVHAGPFANIAHGNSSIVADKIALKLVGPGGFVVTEAGFGADIGTEKFMNIKCRYSGLTPQCAIIVATIRALKMHGGGPAVVAGKPLDHAYLTENVALVEAGCANLARHILNSKAYGANVIVAINKFSTDTDAELNAVKKAALDAGAYDAVICSHHAHGGRGAVDLGIAVQKACENATQPLKFLYPLDIGIKEKIEAIAKSYGASGVEYSEQAEKKIELYTKQGFSGLPICMAKTQYSFSDNAAAKGAPTGFILPIRDVRASIGAGFIYPLVGTMSTMPGLPTRPCFYDIDLDTTTGQVIGLS

SEQ ID NO: 62358 - protein, 249 aa, Xanthomonas oryzae pv. oryzae KACC10331
MTRKLVLLRHGQSQWNLDNRFTGWVDVELTDQGRQEAVAAGKLMKDEGLQFDVAHTSVLKRAIHTLQGALKELDQDWLPVSKSWRLNERHYGGLQGLDKAETAAKHGEEQVKIWRRSYDIPPPAMDVDDPGHPCHDRRYATLDRNALPGTESLATTLVRVLPYWHDAIAPQLKAGQTVLVTAHGNSLRALYKYLNDVSNEQILELNIPTGIPLLFELDDNLQVRSFRYLGDPEAAKRAAEAVANQGKAK

SEQ ID NO: 62359 - protein, 735 aa, Medicago truncatula
MASSSLHLSQAFLARAVYLNPEIRAASLSSTSSLSFPALKSSSSSKPPTSRRRTTPAIRATAVETLDKTTEASLVEKSVNTIRFLAIDAVEKANSGHPGLPMGCAPMGHILYDEVMRYNPKNPSWFNRDRFVLSAGHGCMLQYALLHLAGYDSVQEDDLKQFRQWGSKTPGHPENFETYGIEVTTGPLGQGIANGVGLALAEKHLAARFNKPDSEIVDHYTYVILGDGCQMEGISNEACSLAGHWGLGKLIAFYDDNHISIDGDTEIAFTENVDQRFEALGWHVIWVKNGNTGYDEIRAAIKEAKAVTDKPTLIKVTTTIGFGSPNKANSYSVHGAALGAKEVDATRQNLGWPYEPFHVPEDVKKHWSRHTPEGAALEAEWNAKFAEYEKKYKEEAAELKAIINRELPADWEKALPTYTPETPADATRNLSQQNLNALAKVLPGLIGGSADLASSNMTLLKSFGDFQKATPEERNVRFGVREHAMGAICNGIALHSPGFIPYCATFFVFTDYMRAAIRISALCEAGVIYVMTHDSIGLGEDGPTHQPIEHLASFRAMPNVLMLRPADGNETAGSYRVAVLNQKRPSILALSRQKLPNLPGTSIEGVEKGGYTISDNSSGNKPDVILIGTGSELEIAAAAADDLRKEGKTVRVVSFVSWELFDDQSDEYKESVLPASVTARVSIEAGSTFGWHKIVGSKGKTIGIDRFGASAPAGKIYKEYGITKEAVISAAKEVS

SEQ ID NO: 62360 - protein, 460 aa, Cytophaga hutchinsonii ATCC 33406
MALVELVMPKMGESVMEGTILNWLKKPGDRIQQDESVLEVATDKVDTEVPSPFNGILKEIKANQGDVVQVGTAIALIETDVNQAANSEPATTAPAANTNSGTATTQTVQQTAVAEKIPVSTPQTHIPAHTAGAKGGRFYSPLVLNIARQENISLAEVETIAGTGKDGRVTKNDLFDYLQAKKEGKVTAVTQETVVNETPQATEQKAPVAEPVYVNKPASSQSGNVEIIQMDRMRKMIADRMVESKRISPHVTSFVEADVTNIVYWRNRWKNDFMERENVALTFTPIFIEAVVKAIKDYPMVNISIEDDKIIVKKDINIGIAVALPNGNLIVPVIKNADQLNIVGLTKKVNDLAKRARQNKLTADDLSGGTYTVSNVGSFGNLMGTPIIVQPQAAILALGAVVKKPAVIETPQGDTLGIRHMMFLSHSYDHRAIDGSLGGMFVRRVADFLENFDVNRKIFV

SEQ ID NO: 62361 - protein, 497 aa, Escherichia coli
LEPRHAMLLRCRLPGGVITTKQWQAIDKFAGENTIYGSIRLTNRQTFQFHGILKKNVKPVHQMLHSVGLDALATANDMNRNVLCTSNPYESQLHAEAYEWAKKISEHLLPRTRAYAEIWLDQEKVATTDEEPILGQTYLPRKFKTTVVIPPQNDIDLHANDMNFVAIAENGKLVGFNLLVGGGLSIEHGNKKTYARTASEFGYLPLEHTLAVAEAVVTTQRDWGNRTDRKNAKTKYTLERVGVETFKAEVERRAGIKFEPIRPYEFTGRGDRIGWVKGIDDNWHLTLFIENGRILDYPARPLKTGLLEIAKIHKGDFRITANQNLIIAGVPESEKAKIEKIAKESGLMNAVTPQRENSMACVSFPTCPLAMAEAERFLPSFIDNIDNLMAKHGVSDEHIVMRVTGCPNGCGRAMLAEVGLVGKAPGRYNLHLGGNRIGTRIPRMYKENITEPEILASLDELIGRWAKEREAGEGFGDFTVRAGIIRPVLDPARDLWD

SEQ ID NO: 62362 - protein, 442 aa, Bartonella henselae str. Houston-1
MPIKITMPALSPTMEEGNLSKWNIKEGDQVSSGDIIAEIETDKATMEVEAVDEGTVAKIVVPAGTQGVKVNSLIVVLAEEGEDLAEVAKVAEDSPSSFAIKESEGEKQRDSKVAQISHISSVQQVMQQGKKGMRFFASPLARRLATQVGLDLSLVSGSGPHGRIIKRDVEKAMKGGVSKASYSSQIEQPVTANTSDKQILQLFKEDEYTFTPHNNMRKTIAKRLVESKQKVPHFYVTLDCELDALLQLRTQLNAAAPIIKMQEGSKPAYKLSVNDMIIKAVALSLMAVPDANVSWLEGGILHHKHCDVGVAVSVENGLITPIVRHAEKKSLSIISNEMKDFVKRARELKLKMEEYQGGTTAVSNMGMYGVKSFSAILNPPHATIFAIGAGEQRAVVKNGALAAATVMSVTLSADHRAVDGALAAELARTFKKMIENPLTMLI

SEQ ID NO: 62363 - protein, 700 aa, Oryza sativa (japonica cultivar-group)
MIAAVTSLSHPSTASSAKFDGRRSEERRKKGLIVAAASSALTSIPLSLLAMSRNLESPVQTQMAVSALNRALSSEYPSKSRSEGRASGWKRIFVQTDTGCVLAVQLDRGDNAHTVKRKLQLALNVPTEESSLTFGDRVLKNDLSTIRNDSPLLLTKTFMHRSSSTPCLSPTGKDIQQQRDRGGPIELLVCPSRCSRTKQLVKDVARAIRNGVDPIPVNSGLGGAYYFRNSKGENAAIVKPNDEEPFAPNNPKGFTGKALGQPGLKRSVRVGETGFREVAAYLLDYDNSANVPPTVLVKISHPVFNVNECVSSANMKASKDYPGAVSKIASFQQFIPHDFDASDHGTSSFPVSAVHRIGILDIRIFNTDRHAGNLLVRKLTGPGKFGNQTELIPIDHGLCLPECLEDPYFEWIHWPQASIPFSDDELDYIANLDPMKDADMLRMELPMIHEACLRVLILSTIFLKEATSFGLCLAEIGEMMSREFTGMEDQPSELEVVCMEARRLAIEREESSTEIDSGDEDAIQFELDCEDDHEMLKAQPAYHFELKGGSSRNPLSKLDEAIEEEEDDIEEEESNAEKLGYPKAINKWLPNISKLSTSLNGVRLGDKIQCQLPAAPKIMDPVKIFEGNSNHSGSQVGNWRSANEQLPTSASFVKLADMGSETWALFLEKFQELLPEAFRSRKCGAAGQRARQRLGTSCQF

SEQ ID NO: 62364 - protein, 409 aa, Pseudomonas putida
MATHVAIIGNGVGGFTTAQALRAEGFEGRISLIGDEPHLPYDRPSLSKAVLDGSLERPPILAEADWYGEARIDMLTGPEVTALDVQTRTISLDDGTTLSADAIVIATGSRARTMALPGSQLPGVVTLRTYGDVQVLRDSWTSATRLLIVGGGLIGCEVATTARKLGLSVTILEAGDELLVRVLGRRIGAWLRGLLTELGVQVELGTGVVGFSGEGQLEQVMASDGRSFVADSALICVGAEPADQLARQAGLACDRGVIVDHCGATLAKGYSPSEMWPVGAAAGGRRSLETYMNAQRQAAAVAAAILGKNVSAPQLPVSWTEIAGHRMQMAGDIEGPGDFVSRGMPGSGAALLFRLQERRIQAVVAVDAPRDFALATRLVEARAAIEPARLADLSNSMRDFVRANEGDLT

SEQ ID NO: 62365 - protein, 551 aa, Zea mays
  misc_feature (90)..(90): Xaa can be any naturally occurring amino acid
MGVWREGAGWCFCSGGGGDDGGRSERVKAAIFSARASALAAVRAQGRHHGSGLLIHRNLLLTTHGNLPSAAAAEDADALLGQGRLVARLXPHRFFISSSILDLTIVGIDYTQGDSTLQGQQPHYLKTSCKPSLDHGSPVYLLGHTGKKELVIGEGKVVIGTDNLIKLSAEGVTWCPGSAGFDAQGNLAFMICDPMKLASSPTARSSSASSSSSHSWKKDQPMQFGIPISVVCDWLYQHWQGSLDEVSKPKLPLVRLMSSRSDHSSTSFTRRHVFKPDDENDDASVCSKPKHQQVSGSTATARISHEANPIVDLRTSCEQGVTTPEIYESPRRSSCQAQKNAAAPIQLLDINFPPRVPKTIFLPLPLKQMLSDENNVETSKPKNRSKDNGFPSGLIWHRNIEAECRDPPVALQHMDCSSEGQSSSSPAEIPEYGCQDQYNSEEETMYSAETMESRNIPSPREKHVGRSQSCVTYSRWSSPRTSSMQNGTLRKQHTLIPVRKTLSQNTTLPQRSHDYLSPTVSSAMKKRNSMEQQQPTKPRRSTIQSSPKWMF

SEQ ID NO: 62366 - protein, 275 aa, Triticum aestivum
  misc_feature (244)..(244): Xaa can be any naturally occurring amino acid
  misc_feature (260)..(260): Xaa can be any naturally occurring amino acid
VTLQNKFVQKSRLPPVRNSRDIVDPRVREDVKSHWSRHIPQGAALEADWDAKFAQYEQKYPEDAATLKSIITGELPAGWADALPQYTTESPADATRNLSQQCLNALAKVVPGLIGGSADLASSNMTLLKMFGDFQKDTPEERNVRFGVREHGMGAICNGIALHTPGLIPYCATFFVFTDYMRGAMRISALSEAGVIYVMTHDSIGLGEDGPTHQPIEHLVSFRAMPNMLMFRPADGKETARAYXVAVLNRKRPSILALSXQKLPHLPGTSIGGVA

SEQ ID NO: 62367 - protein, 659 aa, Oryza sativa (japonica cultivar-group)
MALALPTRPANFVQARPPFVKLATCTTYMAYFYLAAAACLVGVFLNAPHATDAQPMPWHRCNTSSGNYTANSTYQSNIQYLATSLPAYASSSPSLFASGSSGAPPDAIYALALCRGDTTNASSCATCVAAAIQAAQKHCALVKTVAIYDDPCIVRFSNLVFPVSPPYNKGMFVAWDDNNVSAAAAAAFDAAFARLANATAEHAAADSVRRFATGEEAALAVAGEVYPKIYSLAQCTPDMSADACRSCLEDILVRMVPTYLAGRKGGRVLGVRCNFRFETYPFFFGQPLLQLPGSPASSSAPVNGVPTESSTDDMQSIGSLILDLSTLRVATDDFSEHKRLGEGGFGVVYKGDLPKGQEIAVKRLAKTSKQGIEELKTELLLVAKLNHNNLVKLIGVCLEENEKILVYEYMPNRSLDTILFDAQKIKELNWGQRFKIINGIARGLQYLHEDSQLKIVHRDLKASNVLLDSAYNPKISDFGLAKIFERDQSKVITHRIAGTYGYMSPEYAMRGQYSIKSDVFSFGVLVLEIITGRRNFGSYGSDQQDYDLINATWEHWTSDKALELIDPSLGNHYPVDKVLKCIQIGLLCVQPKPADRPLMSAVNVMLTGTIRLPSLSRPAFWFQEIGASSDVNSEQNLLDPHNSTKMYQSEAPITELEPR

SEQ ID NO: 62368 - protein, 386 aa, Candida albicans
MDIVLEICDYYLFDKVYADVFPKDGAVHEFLKPAIQSFSQIDFPSLPNLDSFDTNSTLISSNNFNISNVNPATIPSYLFSKIASYQDKSEIYGLAPKFFPATDFINTSFLARSNIFRETLSLFIITTIFGWLLYFIVAYLSYVFVFDKKIFNHPRYLKNQMSLEIKRATTAIPVMVLLTIPFFLLELNGYSFLYLDINECTGGYKAILWQIPKFILFTDCGIYFLHRWLHWPSVYKVLHKPHHKWIVCTPFASHAFHPVDGFFQSLPYHLYPLLFPLHKVLYLFLFTFVNFWTVMIHDGSYWSNDPVVNGTACHTVHHLYFNYNYGQFTTLWDRLGNSYRRPDDSLFVKDVKAEEEKKIWKEQTRKMEEIRGEVEGKVDDREYVEQ

SEQ ID NO: 62369 - protein, 2275 aa, Emericella nidulans
MPETVGHEEPALPSSPQARGAVAYNAISKELQPLPPTETANGGIIPPASSRIEGSTGRLCALELEDGTVYQGYNFGAEKSVAGELVFQTGMVGYPESITDPSYRGQILVITFPLVGNYGVPSRETMDELLKTLPKHFESTEIHIAALVVATYAGENYSHFLAESSLGQCVKEQGVPAIHGVDTRALTKRIRQKGSMLGRLLLHKADVAETDAALAQDTWKSSFEQIDWVDPNTKNLVSEVSIREPKLFSPPENVALKHPSSRPIRVLCLDVGLKFNQLRCLVARGVEVLVVPWDYDFPTLAGKDYDGLFVSNGPGDPATMTTTVNNLAKTMQEARTPIFGICLGHQLIARSVGAQTLKMKFGNRGHNIPCTSLVTGKCHITSQNHGYAVDSSTLPSDWQELFDNANDGSNEGIRHVSRPYFSVQFHPESTPGPRDTEYLFDVFINAIKDTIASAEALQKPVNFPGGAVAENIKASPRVSVKKVLILGSGGLSIGQAGEFDYSGSQAIKALKEEGIYTILINPNIATIQTSKGLADKVYFLPVNADFVRKVIKHERPDAIYVTFGGQTALQVGIQLKDEFESLGVKVLGTPIDTIITTEDRELFARSMDSIGEKCAKSASASSLEEALQVVESIGFPVIVRAAYALGGLGSGFADNLDELKDLCAKAFAASPQVLIERSMKGWKEIEYEVVRDARDNCITVCNMENFDPLGIHTGDSIVVAPSQTLSDEDYNMLRTTAVNVIRHLGVVGECNIQYALNPYSKEYCIIEVNARLSRSSALASKATGYPLAFIAAKLGLNIPLNEIKNSVTKVTCACFEPSLDYCVVKIPRWDLKKFTRVSTQLGSSMKSVGEVMAIGRTFEEAIQKAIRSVDFHNLGFNETNALMSIKTELQTPSDQRLFAIANAMAAGYRLDDIWKLTNIDKWFLTRLKGLSDFGKLMTNYNASTVTAPLLRQAKQLGFSDRQLAKFLSSNELAIRRLRVEAGIIPIVKQIDTVAAEFPSVTNYLYLAYNASEHDVRFDDNGIMVLGSGVYRIGSSVEFDWCSVRTIRTLREQGHKTVMVNYNPETVSTDYDEADRLYFENINLETVLDIYQLESSSGVIMSMGGQTPNNIALPLHRLNVRILGTSPEMIDGAENRYKFSRMLDRIGVDQPAWKELTSIEEAREFCDKVGYPVLVRPSYVLSGAAMNTVYSEHDLASYLNQAADVSREHPVVITKYIENAKEIEMDAVARNGVMVGHFISEHVENAGVHSGDATLILPPQDLDPETVRRIEEATRKIGNALNVTGPFNIQFIAKDNDIKVIECNVRASRSFPFVSKVMGVDLIEMATKAMIGAPFAEYPPVTIPKDYVGVKVPQFSFSRLAGADPVLGVEMASTGEVASFGRDKYEAYLKALLSTGFKLPKRNILLSIGSYKEKMEMLPSIIKLRDVGFELFATSGTADFLKENGVPVKYLEILPGEDEDIKSEYSLTQHLANNLIDLYINLPSSNRFRRPANYMSKGYRTRRMAVDYQTPLVTNVKNAKILIEAIARHYALNVQTIDYQTSHRSIILPGLINVGAFVPGLGSADSKDFEAVTKASIAAGFSMIRVMPVGVDSSITDARTLKLVQQNAGKASFCDYNFSVVATSSNSAEVGQLTGEVGSLFIPFNHLSGNISKVAAVTSHFGAWPSSKPIITDAKSTDLASVLLLASLHSRNIHVMSVTSKEDIGLIALSKEKGLKVTCDVSIYCLFLSRDDYPEAAFLPTREDQKALWEHLSTIDIFSIGSIPYQLAGEKGSPAAGIAEALPLLFTAVSEGRLTVEDIIARLYENPKKIFELHDQSDSSVEVEIDRPYLFQSAQAWSPFSGKSVKGLVQRVIFQGKTSCLDSEITPDAPKGSDMSGHRIVPASPSLKAMSPRVDGALDRRQSISIAGTPARLGRKPVDHFPAATGAELGPPLYTPVPRASSPLLQMLSRSPFKQKHVLSVNQFNRADLHLLFTVAQEMRLGVQREGVLDILKGRLLCTLFYEPSTRTSASFDVAMQRLGGRTIAISTEHSSTKKGETLQDTLRTLGCYGDAVVLRHPEPSSTEVAAKFSPVPVINGGNGSVEHPTQAFLDLFTIREELGTVGGLTITFTGDLKYGRPVHSLIKLLQFYDVRVQLVAPKDLSLPADIRQQLLATGQLLTESEELTPEIVARSDVLYSTRVQKERFADLEQYERLKNSFIIDNALLKHAKSHMVVMHPLPRNAEVSEEVDFDQRAAYFRLVSLQSRGPSSEFDMLMWMQMRYGLYCRMALIELIMAP

SEQ ID NO: 62370 - protein, 375 aa, Oryza sativa (indica cultivar-group)
MTDVELRVEALSLSGVSAIPPEYVRPEEERADLGDALELARAASDDDATARIPVVDISAFDNDGDGRHACVEAVRAAAEEWGVIHIAGHGLPGDVLGRLRAAGEAFFALPIAEKEAYANDPAAGRLQGYGSKLAANASGKREWEDYLFHLVHPDHLADHSLWPANPPEYVPVSRDFGGRVRTLASKLLAILSLGLGLPEETLERRLRGHELAGVDDDLLLQLKINYYPRCPRPDLAVGVEAHTDVSALSFILHNGVPGLQVHHAGSWVTARPEPGTIVVHVGDALEILTNGRYTSVLHRGLVSRDAVRLSWVVFCEPPPESVLLQPVQELLADGAGKPLFAPRTFKQHVQRKLFKKLKDQQDNNAAAASNGMITK

SEQ ID NO: 62371 - protein, 266 aa, Ralstonia solanacearum GMI1000
MSQIVFITGASSGIGQALARQYAARGATLGLVARRVDALHGFVQTLPAGIAVHCYAADVRDARSMHDAASAFMAVAGVPDVVIANAGISVGTDLREAGDLPAFAAVMETNWMGVLHTLQPFVGPMLARAEPGRPGGTLVGIASVAGVRGLPGAAAYSASKAAVIKLMESLRVEFSPKRRPGLRVVTLAPGYIRTPMTEHNPYPMPFLMPADRFAERAVQAIDRGAHFKVLPWQMGVVAGLLHVLPRWLYDFAFAHAPRKPRNPGIS

SEQ ID NO: 62372 - protein, 578 aa, Vibrio vulnificus YJ016
MTFSIENNKQVVLGEELGKLSDNERLKTQSNFLRGTIEQDLQDRITGGFTADNFQLIRFHGMYQQDDRDIRNERAKQKLEPLHNVMLRARMPGGIITPKQWLAIDKFATEHSLYGSIRLTTRQTFQFHGVLKPNIKLMHQTLNSIGIDSIATAGDVNRNVLCTTNPVESELHQEAYEWAKKISEHLLPKTKAYAEIWLDGEKVETTEDDEPILGKTYLPRKFKTTVVIPPQNDVDVHANDLNFVAIAENGKLIGFNVLVGGGLAMTHGDTSTYPRRADDFGYIPLEKTLDVAAAVVTTQRDWGNRSNRKNAKTKYTLDRVGTDVFKAEVEKRAGIKFEVSRPYEFTERGDRIGWVEGIDGKHHLTLFIENGRLLDYPGKPLKTGVAEIAKIHKGDFRMTANQNLIVAGVSKSNKAKIEKLAREHGLMDEGVSEQRKNSMACVAFPTCPLAMAEAERFLPQFVTDVEGILDKHGLDKEDNIILRVTGCPNGCGRAMLAEIGLVGKAPGRYNLHLGGNRGGTRVPKMYKENITEKQILEEIDQLVGRWANERLPNECFGDFTVRVGIIEEVIISKRDFYA

SEQ ID NO: 62373 - protein, 120 aa, Ipomoea trifida
MSILFLVSSVVLAAGAVLYSVAIDYLPASTYTLVNSTAIFSFFINAEIFTPCITNSAVLLTFAPMLLVFGKDNDNSTSSNSQDNYILGLLFALGASACLALLFSLTQLMFEKIIRRENLR

SEQ ID NO: 62374 - protein, 550 aa, Vibrio vulnificus YJ016
MLKTINPTQTQAWNALTAHFESAQDMDLKDLFAQDAARFDKFSARFGSDILVDYSKNLINEETLKHLFALAKETELSAAIKAMFSGEAINQTEGRAVLHTALRNRSNQPVLVDGEDVMPAVNAVLEKMKSFTDRVIGGEWKGYTGKAITDIVNIGIGGSDLGPYMVTEALAPYKNHLNLHFVSNVDGTHIVETLKKVDPETTLFLIASKTFTTQETMTNAHTARDWFLATAGDQAHVAKHFAALSTNAPAVSEFGIDTDNMFEFWDWVGGRYSLWSAIGLSIALAVGYDNFVELLEGAHEMDNHFVSTELESNIPVILALIGIWYNNFHGAESEAILPYDQYMHRFAAYFQQGNMESNGKYVDRNGNPVTYQTGPIIWGEPGTNGQHAFYQLIHQGTKLIPCDFIAPAVSHNPAGDHHQKLMSNFFAQTEALAFGKNEATVKAELVKAGKNAEEVAAIAPFKVFEGNRPTNSILVKQITPRTLGNLIAMYEHKIFVQGVIWNIFSFDQWGVELGKQLANQILPELADDSEISSHDSSTNGLINAFKAFKA

SEQ ID NO: 62375 - protein, 486 aa, Burkholderia pseudomallei K96243
MPRRPGARTGDAAARAPHEKENAVAKILENVEHIVVVMFENRSFDTMLGWLYSPDAPPAHVLPPQSSPQFDGLRPEMSNPSKAGKTIAVTREALNSVIPDPQETFVNVTSQILGPSDAGTPWPPMQGFVVNYETTQTTDPGHVMQCHSVAQLPTLTALARAYAVSDAWFASVPSQTWPNRAFAHAGTSNGHVNNGAIPDPLEWDVPTIFDVLSSIGASWAVYSDTTVTPSLTHTMFPSLWKDAYAERFRRFPDFVAACGNDALPQYAFIEPSFLFEPNDQHPPHDVRAGDKFLHDIWTAIRTSPGWPRTLLVVTYDEHGGCFDHVLPPANATPPDNASNPGDEAFGFYRFGVRVPAVVVSPYIEAGTVFRSPTNVPYDHTSILATLRDWLDIPPDRMLGSARIANAPTLAQLVTRDTPRTDLPTIAAPSTDFVHPPPDAPLNDVQKSLVTGTSRRDGHDPAAGVAPLATRQHALDFFKRRAAAKTA

SEQ ID NO: 62376 - protein, 356 aa, Cytophaga hutchinsonii ATCC 33406
MKPPKFLIPSTPFFSEMRKRINSHFIEVESKPTGGIRLYLKATIILSFFIGMYVHVVFFTSSYIFISLTECMLLGIATAAIGFNIMHDGAHGSFSKRAWINELAGLSLNVFGANVFMWKSKHNVIHHTFTNIEGVDDDIDAKPFLRLCDNQKKYQIHRFQHFYFWAVYAFLYMYWIFFTDYKKYFTGKVGEISIKKMIVLDHITFWGFKLAHIMLFVALPIYLVGFLPWFIGFMTYALCTGFIMSIVFQLAHTVEDAHFPMVDTATGMLEDEWALHQLKTTSNFATKNKMVSWLSGGLNFQIEHHLFPHISHIHYPAISKIVKQVCEEYDIRYNEYTGVRFAIVSHIVHLKQMGMR

SEQ ID NO: 62377 - protein, 263 aa, Oryza sativa
  misc_feature (112)..(112): Xaa can be any naturally occurring amino acid
CSVSPDIELWCEFIGIRSMYYCGPLTSFDWNDAYPCRIGTFSIDTTCTIWDVEREAVDTQFIAHDKEVYDIAWGGAGVFASVSADGSVRVFDLRDKEHSTSGYPGCTGGSSXSAGADGGAASPTPLVRLGWNKQDPRYMATIIMDSPKVVVLDIRYPTLPVVELHRHHSPVNAIAWAPHSSCHICTAGDDSQALIWDLSSMGTGSNNGGNGNGNAAAAAAAEGGLDPILAYTAGAEIEQLQWSATQPDWVAIAFSTKLQILRV

SEQ ID NO: 62378 - protein, 388 aa, Arabidopsis thaliana
MTIMSDLPRDLLAEILSRVPLTSLRAVRLTCKKWNDLSKDRSFLKKQIVETKKKQLESKEIEVIMMRNFRVYLTSIDIHNNVDPSFTPKGTLISLSDDANHHQVDNVSRVFHCDGLLLCITKDLHYRLVVWNPYFGQTRWIQPRNSYHRKDNYALGYDEKKNHKILRLKDNYYAPRERICEFELYSFESNSWKVVLDVSPDWYIPSYNRGLSLKGNTYWYATEKHVNVDFLICFDFTTEKFGPRLPLPFNATESPTYEDVVTLSSVGEEQLAVLFQSEYTLMMEIWVTSKVESTEVLWNKLFLEVDLIAISSHFQFLAEAGSFFIDQKKNVVVVFDKDMDEATDRDMAYVVGKNGYFKKVDIGEEAYTSCFPLVCSYVPSSEQIRQLT

SEQ ID NO: 62379 - protein, 595 aa, Lotus japonicus
MAVFFLTSGSLSLFLALTLLFTNIAARSEKISGPDFSCPVDSPPSCETYVTYTAQSPNLLSLTNISDIFDISPLSIARASNIDAGKDKLVPGQVLLVPVTCGCAGNHSSANTSYQIQLGDSYDFVATTLYENLTNWNIVQASNPGVNPYLLPERVKVVFPLFCRCPSKNQLNKGIQYLITYVWKPNDNVSLVSAKFGASPADILTENRYGQDFTAATNLPILIPVTQLPELTQPSSNGRKSSIHLLVILGITLGCTLLTAVLTGTLVYVYCRRKKALNRTASSAETADKLLSGVSGYVSKPNVYEIDEIMEATKDFSDECKVGESVYKANIEGRVVAVKKIKEGGANEELKILQKVNHGNLVKLMGVSSGYDGNCFLVYEYAENGSLAEWLFSKSSGTPNSLTWSQRISIAVDVAVGLQYMHEHTYPRIIHRDITTSNILLDSNFKAKIANFAMARTSTNPMMPKIDVFAFGVLLIELLTGRKAMTTKENGEVVMLWKDMWEIFDIEENREERIRKWMDPNLESFYHIDNALSLASLAVNCTADKSLSRPSMAEIVLSLSFLTQQSSNPTLERSLTSSGLDVEDDAHIVTSITAR

SEQ ID NO: 62380 - protein, 281 aa, Glycine max
MTGREILHMMKVKAGFGTPDTGNGKGKISKHITHGFHLMKGKSAHPMEDYLVSEFKQEKDRELGLFAIFDGHLGHDVASYLQNHLFQNILQQHDFWTETESAVKKAYVETDEKILEQELVLGRGGSTAVTAILIDGQKLVVANVGDSRAIICENGKARQLSVDHEPSKEKKSIERRGGFVSNIPGDVPRVDGQLAVARAFGDRSLKMHLSSEPDVIVQEVDQHTEFLILASDGIWKVMSNEEAVESIRQIKDAQAAAKQLIEEAVCKKSKDDISCIVVRFQ

SEQ ID NO: 62381 - protein, 229 aa, Glycine max
MLSFRLFVRALGYPRDKDGGCFQMRISYSPAAPLFLFLVQWTDYRLAGALGLLRILIYVTYGNGKNTMSIYERKASIRQFYSIIFPALLQLEKGITDLEERKQKEVYALRYQRKSEFNERRQSEIDIEREEECGVCLEVKAKVVLPNCCHYMCLKCYRDWCQRSQSCPFCRDSLKRTNSGDLWIYTDTSDIVDVGTIFKENCKMLFLYIEKLPLIVPDPRYVFYDPLLR

SEQ ID NO: 62382 - protein, 291 aa, Zymomonas mobilis subsp. mobilis ZM4
MFTGSIPALVTPFRNGKFDEVVFRAHVDRMIEGGSSALVPCGTTGESATMTIEEHNYVMAVCIDQTKGRVPVIAGCGSNDTKVSLAHLRHAAKAGAAAGLVVLPYYNKPSQEGLYAHYSYLAENSPIPILIYNVPGRTSSDISVETLARLSRLPAIVGMKDASGHIARVSAQRLACGSDFCQLSGNDDMALAFNAMGGVGCISVTANVAPKLSADFQKACAENRYQDALALQDRLYPLHSALFSDSSPAPVKYALSRLYSDFSPELRLPLVQPSDHSKALVDAALSHARLI

SEQ ID NO: 62383 - protein, 426 aa, Gibberella zeae PH-1
MSNQTQKLQPAGRVQGQKKDVWSMINEAAASSPIQPIVNLGQGFFGYNPPDFILNAAKEALDRVECNQYAPAKGRPRLRQALADAYSPSWGRQLDPETEIIITTGANEGMLSAFMGFIEAGDEVIVFEPFFDQYISNIQMPGGKVVYVPLHPPKTGATKNSSAADWTIDFEELEKAFTPRTKMIVINTPHNPVGKVFSKEELQGIADLAVKHQVIILSDEVYDKLYYVPFTRIANLSPEVEKLTLTVGSAGKNFYATGWRVGWLIGPQELIQYVTAAHTRICFSTPAPFQEASAIGFEQAGKNGFWDETIKEMKGKIDRLKEVFEELELPVTYPEGGYFLLVNMAKVKLPEDYPFPPHVASRPRDFKLAWFLIQEIGVAAIPPTEFYTPVNAHLAEDYIRFAVCKNDDILEQAKERLRGLKKYIPE

SEQ ID NO: 62384 - protein, 349 aa, Oryza sativa
PFSGPYDVRVRMKAVGICGSDVHYLREMRIAHFVVKEPMVIGHECAGVIEEVGSGVTHLAVGDRVALEPGISCWRCRHCKGGRYNLCEDMKFFATPPVHGSLANQASKQFSSISISLQEEDAILINIVHPGDLCFKLPENVSLEEGAMCEPLSVGVHACRRADVGPETGVLIMGAGPIGLVTLLAARAFGATRVVIVDVDEHRLSVARSLGADAAVRVSARAEDVGEEVERIRAAMGGDIDVSLDCAGFSKTVATALEATRGGGKVCLVGMGHNEMTVPLTSAAIREVDVVGIFRYKDTWPLCIEFLRSGKIDVKPLITHRFGFSQEDVEEAFEVSARGRDAIKVMFNL

SEQ ID NO: 62385 - protein, 575 aa, Corynebacterium glutamicum ATCC 13032
MLSTMQDVPLSLTRILEYGSTVHGDTLITTWGGADGIEQAQQTFSAVGARAAALAHALHDSLGITGDQRVASMLYNCAEHMETMFAVACMGAVFNPLNKQLMNDQIVFILNHSEAEVVIADPRMAEQLGEILKETPKVRAVVFIGPNDFSSAAAHMPEGMKLYSYEALLDGRSTVYNWPEQDERTAAAICYSTGTSGPPKGVVYSHRSLYLQSLSLRTTDSLAVEHGETFLCCVPIYHVLSWGVPIAAFMSGTPLVLPGPDLSAPTLAKIISTTLPRVAHGVPTLWIQLMVHYLKNPPERMSLRELYVGGSAVPPIVITMWEQRYGVDVVHVWGMTETSTVGTVSRPPSGVSGESRWNYRVSQGRFPASLQYRIVNDGQVMASTDRNEGEIQVRGPWVTASYFHPDVEKEGGTASTFRDHDVEEENDELFTADGWLRTGDVGSVTSDGFLTIQDRARDVIRSGGEWIYSAQLENLIVATEEVVECAVIGFPDDKWVERPLAVTMLYPGIERTRETAERLRDQLRDRLPNWMLPEYWTFVDEVDKTSVGKYDKKDLRNHLRNGDFEVIKLKGPGEK

SEQ ID NO: 62386 - protein, 382 aa, Magnetococcus sp. MC-1
MNRLVIIGTGLAGYGLAKELRKRQDKRPITLISSDDGASYSKPMLSSALAQNKDAAALVMASAEQMMAQLEAEIITHTQVEQLDTAARTLQLSSGQSIVYHTLVLAVGANPIQLPLQGSGAAEVMQVNSLADYARWRTRLQGVERVMVIGPGLIGCEFANDLLKVGKQVSLIGPDPWPISALIPEAAGRAVQQRLAEAGATWHLETFNGAIEKSAQGFVTELKNGQVVEGDLVLSAVGLRPNIALAQAAGLAVNRGIVTDAYLQTSDPHIYALGDCAEVEGRNLPYVQPLMVAGRALAATLSGEATAVVYPLMPVAIKTSLHPVVTLPVGKMEGRWALSQGEDGVLGRFFDQQERLQGFVLTGSNAALKGQLLKEMEERAAS

SEQ ID NO: 62387 - protein, 529 aa, Pseudomonas syringae pv. syringae B728a
MPFPCTLFISLSNQHRVGSMTATPKPLVLIILDGFGHSESHKGNAILAAKMPVMDRLYQTMPNGLISGSGMDVGLPDGQMGNSEVGHMNLGAGRVVYQDFTRVTKAIRDGEFFENPTICAAVDKAVSAGKAVHIMGLLSDGGVHSHQDHLVAMAELAVKRGAEKIYLHAFLDGRDTPPRSAKKSLELMDATFARLGKGRTATIVGRYFAMDRDNRWDRVSSAYNLIVDSTADFHADSAVAGLEAAYARDENDEFVKATRIGEAARVEDGDAVVFMNFRADRARELTRVFVEDDFKDFERARQPKVNYVMLTQYAASIPAPSAFAAGSLKNVLGEYLADNGKTQLRIAETEKYAHVTFFFSGGREEPFPGEERILIPSPKVATYDLQPEMSAPEVTDKIVDAIEHQRYDVIVVNYANGDMVGHSGIMEAAIKAVECLDVCVGRIAEALEKVGGEALITADHGNVEQMTDDSTGQAHTAHTSEPVPFVYVGKRQLKVRQGGVLADVAPTMLHLLGMEKPQEMTGHSILVAE

SEQ ID NO: 62388 - protein, 1072 aa, Coccidioides immitis RS
MAAPFVPTAPNLAGGLIDPTKQAEYPILLGDKLAGKPSSTDTQFINIAYNYKPKGATPRQKTTITSTDTPDIYKLTIQDKAGNAERSDLTYIYHGGVDPISSVPESESSNLVLVFDPKRKAFILEPVSTKVNFNLRSAPGKTEKQVLDQYGQLEVLPKNEGISGDDGDGNKDDDDTLEVADEDNPYDYRHFLPKKEAKSERRAEVPSPETTPDPVSEKHSTCPATPSVSSVKANPRPLPKTKPQTSPLRPQIKRVTKSAVAKAGGPAKAKSKPTPRVDAGNLVNESPPPEEEPKSASPTAPTAPNSNIVVDGDLIIDWGSPPPERPKIKLNPRDFASGNTSANEGGYGSGNNEGDEDIRSPSPPRLAVSRAWQKRPPQQQDEEDEEEEEEEVSDEDDNESEQEANDDEPDDDGLEAEMEAAFVREQEEEERARNLLLQQQQQQQQHHIVSDEESEVSEEEPLWSLSHIIYVIATSILRLSAPYFPSSGPKPARASTLANASTEEILALRVCPPSIAEVETKMPSISSNKKSSTPPVPSPSNPVLLATQSQWLFTDSELLRSPSVLDGMPIESEHTSRGKGVNFIMQVGILLKLPQLTLCTASVYLHRFFMRYSMVDLPQRPGMHPYSIAATALFLATKVEENCRKMRELIIACCRVALKQPNVVVDEQSKEFWKWRDTILHNEDLLLEALCFDLQLEQPYRLLYDFLCYLHQHDNKPLRNSAWAFINDSIFTVLCLQFTSRTIAASALYAAARHCDVSFDDDILGRPWWEQLDVELRDLKRACNRMAELYERSPLPKPGQRYPSIPGNEGDSTDKTRHVISRGNENGTEDGYTDERNGSLSPGEISERKRSREADNLPSPKQNPLQHTHSVSTNGRLNQEQEQRSLKRQRLDDNQTTAPNFRSPLTHSQTQSQFDSQPKSNQSSQPSLTNATSTLHISSNNNSTSPETATPTSTTNPPQPETTNLNGNSNPEHRAPPPTSLSAPTTPNDKPQSSRIPASYQRKKEAASPRPPVNLRIEIWHRGSQGRCMVAPELPPRDVRIEINQMGIENPSFELPLNDLGLESIPKVSCQV

SEQ ID NO: 62389 - protein, 704 aa, Coprinopsis cinerea okayama7#130
MNQAGNGHGHRRHPKRPASIAELADKALEHGWDDGRDLKHYLRMAEKYRKEGKDFAKQGDLESAFVLLAKAATLVLEKLPTHRDYQTLLNPAQRNNLALNGQDILDHLSELKPILVDRFDKWLKAHPDGLDHDQTPEPPKSAALQQDDARAQAQAQAQAQANAARFQEEERMRASQRDQQRRVQEEAALWRQQREEIIRRGDAETKERQKAAAVAAARQAANPGSYGSQHTAVVHIPPPPAAVRHQQQQDEFRRREEEINRRKRRQEQDAIAQRQQAADDAARAMRQTIPTAVTPAGVPVAPLYPQTTPTPNSARSYQNYPVSHPSSVVPPAPYSAPAYSTTPSHSEGPSIMPLENPLRYEGDSTDSESVHHDFHRRISKQRHHTASPRAPVPNSAAIPPITTTSPPPQLRIDYPRLMSPHQQKQGYYPSLNSMFMPEPSNNATPSLLFDSNGLYPQNMLPSHAQPYNQSRPPLPPPPPNQNQYPNYPGPTRPPPPVPTAPPTATQPQPSEPDRISRERSREPGSGRPPLKQVNFPRECLPRFLAIAKANTMNNKETCGLLLGKDKGHKYVVTTLLIPKQHSTSDTCTMDEEQLVLEFTEERSLITLGWIHTHPSQSCFMSSVDLHTHSGFQRMLPESFAVVCAPNSRPNFGIFRLTDPPGLDVVLNCTAKEAFHPHPDLPIYTDADKGHVQMKDGPLEIVDLR

SEQ ID NO: 62390 - protein, 216 aa, Magnaporthe grisea
MSSTDPTTTGQTAQDASRQQPTAAASSSSELASAKITLYKVLRRFADFPIEGIVFIDIMPIFIDPKAHLALLRALELQVLSSFAPATAKPDVVVGLDARGFLFGPSLALKLDASFVPVRKKGKLPGPCVTATYEKEYGQDFFQMQEGAIKPGQKVLLVDDIIATGGSAAAAGELVKKLGGELMGYLFLLEIAPLKGREKLGGVPVVTLLEEADYPH

SEQ ID NO: 62391 - protein, 518 aa, delta proteobacterium MLMS-1
YICVIENEGQYIYFLDGIATILTPIPDIPFVEEFVNVPLLTHRQPEKILILSGGAGGIINEALKHPSLAAVEYAEQDPLLFELLRKFPTELTESELDDPRVKIHHTDGRLLLQTTPRQYDLIFIGILEPSSLQTNRYFTREFFTLARERLNPGGILVFGLPGSMTYLNDELKNLNSSVFHTVKSVFPHVRVIPGDGHNLFLSSDAPDVAAVDAHQIMARLTEREIRAEAMLPWHIEKKLHPGWQEWFYEFIEESSRQLNRDFTPLGVFYSISHWNALYSPEFGRFFNKLERADLKGAALVPLLLLAAYLLLRAGVKRAVRPGIPLAIATTGFAGMISSLVLIFTFQAFYGYLFSWIGLLVAAFMAGAAAGAQLVTSALGRIQDHRQLFKRIELAIVVFSLLLPLGLLAANTWVASVAAFDLLRVLFLVVSLVAGFLLGAQFPLANKLYLGDNAHLSRTAALLYTADLLGGWLGGIVGAVVLLPVLGLVGTCLVMGLLKAVSFVIISFEFSDQQQEVAT

SEQ ID NO: 62392 - protein, 323 aa, Coprinopsis cinerea okayama7#130
MARNEEKAQSMLYRFREAQAAELGLGTRADRRPRVASTCKSLRECERWRGEILREISRKVSKIQDAGLTDYEVRDLNDEINKLLREKRHWENQIIALGGANYRRNVAMLDEDGKEVPGTKGYKYFGRAKDLPGVRELFQSRKTEEEEENRVFAHYKRFLNQGPAYYGDLDESNPKLLEYEQTAEEEDWEEACLNVYGALGLPAEDIPKLPRPEATAEHPESTSSSAASKRKADSQDSEDAEMDDASKRTKTENAPPSGTSSTASDNDVARAHAQAAASYIPFLQPENLLPPKLPSREEMEKVLLDLRKKALVEEYFGNEANGS

SEQ ID NO: 62393 - protein, 288 aa, Oryza sativa (indica cultivar-group)
MTLLCVPLVSRTVEAMQADAAAAAAAGADLVEIRLDFIEGFRPREHLPSLLRGCPIPALVTYRPNWEGGQYDGDDATRFEALRLAMELGVDYVDIELKVADKFISFISGSKPEKCKLIVSSHNYESTPSCEELADLVARIQAVGSDIVKIATTASDIADVSRMFQVMVHCQVPMIGLVMSEKGLMSRVLSPKFGGYLTFGTLDATKISAPGQPTVKELLDIYNIRRIGPDTKVLGLIANPVKQSKSPILHNKCLQSIGYNAVYLPLLADDLARFLSTYSSPDFSGFRY

SEQ ID NO: 62394 - protein, 167 aa, Aspergillus nidulans FGSC A4
MSAEGTAPQAEVASIATPINLILFSAFAFLVYTQFRPKPPAVLPKAPAPVVFRTFTPKTLLPFNGENDKPVYLAVRGRVFDVTPGRNFYGPGGPYENFAGRDASRGLAFQSFDKEMLTEDLSGPLDDLKDLNADQLENLQSWEERFLEKYLVVGKLVAEGDPEAPKS

SEQ ID NO: 62395 - protein, 225 aa, Oryza sativa (indica cultivar-group)
MRNCSLPFKVDAVQCCHEHDPVAKSIGAINTIIRRPDGKLVGYNTDYIGAISAIEDGIGGPGSKDAAISPLAGRLVVVVGAGGAGKAIAYGAKEKGARVVVANRTYEKAVSLAAAVGGHALRLAELETFRPEEGMILANATSLGMYPNVDGTPIPKKALSFYDVVFDAVYAPKVTRLLREAEECGIKVVSGVEMFVRQAMGQFEHFTGGIEAPESLMREIAAKYT

SEQ ID NO: 62396 - protein, 558 aa, Oryza sativa (japonica cultivar-group)
MELSSSLAAVLHSPLFLLAALLLLPVFTLLSFSSAKKPGDGGGWRLPLPPSPRGVPFLGHLPLLGSLPHRKLRSMAEAHGPVMLLWFGRVPTVVASSAASAQEAMRARDAAFASRARVRMAERLIYGRDMVFAPYGEFWRQARRVSVLHLLSPRRIASFRGVREQEVAALLDRVRRRCGVRGGGETVNLSDLLMSYANGVISRAAFGDGAYGLDGDEGGEKLRELFANFEALLGTATVGEFVPWLAWVDKLMGLDAKAARISAELDGLLERVIADHRERRRLSQPDGGDGDGDGDENVDHRDFVDVLLDVSEVEEGAGAGEVLLFDTVAIKAIILDMIAAATDTTFTTLEWAMAELINHPPVMRKLQCEIRAAVGVPGASGGAEVTEDHLGELRLLRAVVKETLRLHAPVPLLVPRETVEDTELLGYRVPARTRVIINVWAIGRDAAAWGDRAEEFVPERWLDGGGEEVEYAAQLGQDFRFVPFGAGRRGCPGAGFAAPSIELALTNLLYHFDWELPPHADGAAAATAARLDMGELFGLSMRMKTTLNLVAKPWSSDV

SEQ ID NO: 62397 - protein, 158 aa, Glycine max
MMLKEANAKGSLFQRFPSDLLTQLKTDCLVLHNHRYAISPRKLQYNTKLSDFFEILATSEDRDGKTFVSTARGRKYPVTVNLWQPEKNAFEWATSLKAPHTEDAIRVTQSTANFFISEARKSTNTPDAQKVRDNLIYNYKPTFGGTAGKGYDQVYLFE

SEQ ID NO: 62398 - protein, 125 aa, Thermoanaerobacter tengcongensis MB4
MKTIINTDAAPKAIGPYSQAVLVDGFLYTAGQIAIDPATGEMVEADIEKQTERVLENIRAILRAAGMDFNNVIKTTVFVTNMADFAKINEIYGRYFKDNPPARSLVEVKSLPKGALIEIEVVAHK

SEQ ID NO: 62399 - protein, 946 aa, Oryza sativa
MPPLLLLLPVVLALFAAADASPSACRNATCGDVPVAYPFWLIDNSSALGCGYPGLGLRCVDNTTLILPFRTHQYRVLDIEYGKHTISLTDADMQHSDTNNSCPHLHANLTIDDNSWLQLASSDSNITFLYNCKSNSSLLSSTSVVKLTGCGAGPEHIGSSYVFLDGWITGEAYDYECETVVVAPVIDAHKKAMVDAHGGLPPADGSFGDVLSAGFELTYSAHSDKCGKCERTKGWCGYRHNETSTTMDFTCFCDEGPTKSHCVAHRTKLVPRIKSRRSSKMRRLCLAAMAHLPLLLLSFLVLIGVHASVSHGSPPLPSTYDPSICSKSSECGGVNISYPFYLSNATDYYTRFSCGYTDLKISCSRDRDGRNETPTILLGGDNYTVLDIIYDSHTIVLADTDALRGGSCPRVRHNITFAQADEWLQYTGPRDNLTFFFGCKLNLPPPIDPGLVSLADKHQINCKDFSNWPDSGDSFVFTSAELEAPVESELARRCRQVIVVPVNGDILNSSNQSALPSGGYGQVLNKGFDLAWNSRKDEQCYQCEQSQGHCSYSQNRVFLDCLCSDGKVGNQDCRNSGASNSSTLRYSSLKGRMKLYIIAGISSVLLLCLLSFPCLFSLKKYRHRRISKGTPRIESFLQRNGTLHPKRYTYTEVKRMTKSFAEKLGHGGFGAVYRGNLSDGRQVAVKMLKDSKGDGEEFINEVASISRTSHVNVVTLLGFCLHRSKRALIYEYMPNGSLERYAFRNNSKGELSLTWEKLFDVAVGIARGLEYLHRGCSTRIVHFDIKPHNILLDQEFCPKISDFGMAKLCANKESIVSIAGARGTIGYIAPEVYSKQFGAISSKSDVYSYGMMILEMVGARERNIEANSESSSHYFPQWIYEHLDEYCISSSEIDGETTELVRKMVVVALWCIQVVPTNRPTMTRVVEMLEGSTSGLELPPKVLLSW

SEQ ID NO: 62400 - protein, 455 aa, Oryza sativa (indica cultivar-group)
MQCRPNWEGGQYEGDDATRFEALRLAMELGVNYVDIELKVADKFISFIYGSKPEKCKLIVSAHNYESTPSCEELADLVARIQAVGADIVKIATTANDIVDVSQMFQVMVHCQVPMIGLVMGEKGLMSRVLSPKFGGYLTFGSLDATKVSAPGQPTVEELLDIYNIRRIGPDTKVLGVIANPVKQSKSPVLHNTCLQSVGYNAVYLPLLADNIARFLSTYSSPDFSGFSCSLPFKVDAVQCCHKHDPVAKSIGAISTIIRRPDGKLVGYNNDYIGAISAIEDGIGGPGSKNAAVTPLAGRLLVVVGAGGAGKAIAYGAKEKGARIVVANRTYEKAVSLAAAVGGHALRLAELETFRPEEGMILANATSLGMYPNVDGTPIPKQALSFYDVVFDAVYAPKVTRLLREAEECGVKVVSGVEMFLRQALGPLERFTNGIEAPESLMREGCRRMGKRERL

SEQ ID NO: 62401 - protein, 176 aa, Oryza sativa
  misc_feature (129)..(129): Xaa can be any naturally occurring amino acid
MVYHSSFVDDTGITKACGCPLLPLKTHIRGPAPAFDQDKADIVDEAITFFRANVFFKNFNVKSPADKLLIYLTFYINIALKRLEGCRTLAVGTKAIINLGLEKVPVPGEPGFPFPGLFTLPQSQEEAGXLIKQNYLKQIREETSGRLLNCAYRANGTPNKWWLAFAKRKFMNIVIL

SEQ ID NO: 62402 - protein, 177 aa, Zea mays
  misc_feature (117)..(117): Xaa can be any naturally occurring amino acid
SVCPLHLPFFSGILAVLGCSHWSQAKSARILACSTKLKHRGPDWSGLYQHEGNFLAQQRIAVVSPLSGDQPLFNEDRTDEVVANGHIYNHKNVRKQFTGTHDFCTGSDCQALIPLYXKYGENFVDMLDGVFAFVLYDTRDRTYVAARDAISVNPLYIGWGSEGSVWIASDMKALNED

SEQ ID NO: 62403 - protein, 301 aa, Bordetella bronchiseptica RB50
MASSAPAATVQFQGSLVALVTPMQPDGGLDYDAYRSLIDWHVAEGTDGLVVVGTTGESPSVSMEEHAELIRVAVEHAAGRIPVIAGVGANSTDEAIHLARHAKAVGAQAGLSVVPYYNKPNQEGIYRHFRAVAEAVDLPTVLYNVPGRTVADMSNDTVLRLAEVPGIIGIKEATGDIARGALLLREAPAGFQVFSGDDPTAAALILLGARGNISVTANVAPRLMHELCTAARGGDVPRTRELNARLARLNKALFIEANPIPVKWALAQMGHTALGYRLPMVELSEQYHSLVRTALQEVGLL

SEQ ID NO: 62404 - protein, 241 aa, Streptomyces coelicolor A3(2)
MTGKPLVAILSGAGVSTDSGIPDYRGPNGLWRRDPEAEKLVTYEYYMGDPEIRRRSWLMRRDSAALHAEPNAAHRAVADLERRGVPVRVLTQNVDGLHQLAGVSARKVLELHGTARDCVCTGCGARGPMADVLARIEAGEDDPPCLDCGGVLKTATVMFGERLDPVVLGEAAAISKACQVFVAVGTSLQVEPAAGLARVAVEHGARLVVVNAEPTPYDELADEVIREPIGSALPALLRGLG

SEQ ID NO: 62405 - protein, 377 aa, Oryza sativa (japonica cultivar-group)
MRADRAELRELKPPYPLSAPGLPLLDPTICPRHASSRASRLACVRARRAAPSFWSLAPRYFPLVPNPESASASVLALLLWYLCSRLLCLATLLPPPHCLLPWFGSFCSWVDAGCVRACVRAEAMSSAVDAISCSKGIAAPPTEEATKERVAVVGKNGGVEHGGDAATMNGKQCGEAPHCRKESNEEEEDDEEKAPKAIDLGPRVSIKDQLEKDKDDESLRRWKEQLLGSVDLNSVGETLEPDVKIMSLAILSPGRPDIFLPLPVEPNAKGVWFTLKEGSLYKLKFTFSVSNNIVSGLRYTNAVWKTGIKVDSHKEMLGTFSPQPEPYTYVTPEETTPSGMFARGSYSARTKFLDDDRKCYLEINYTFDIRREWPALS

SEQ ID NO: 62406 - protein, 468 aa, Streptomyces coelicolor A3(2)
MTGTPQRSHPQPERTFVTIDFAALPDDFLWGTATSAYQIEGAVAEDGRSPSIWDTFSHTPGKIDNGDHGDVACDHYHRTHEDIELMRRLGTNAYRLSVAWPRVVPGGDGPVNAKGLAFYDRLVDDLLAAGITPSVTLYHWDLPQVLQDRGGWPERDTAEHFAAYAAVVAERLGDRVAHWATLNEPLCSAWIGHLEGKMAPGQTDLTAAVRASYHLLLGHGLAMQAIRAAAPDAQVGIVNNLSTIHAATDREEDLAAARRMDGHTNRWWLDPVHGRGFPQDMREVYGVELPERPGDMRLIGAELDWLGLNYYFPQTVAADPTGPAPQVRTVRRAGVPRTGMDWEIDAGGIEELLLRLTEEYGPRKLYVTENGSSFPDLVRPDGSVDDPERQEYLTAHLAACASAARKGAPLAGYFAWSLLDNFEWAYGYDKRFGLVHVDYATQVRTIKGSGHHYADIIGRARGRERKAA

SEQ ID NO: 62407 - protein, 394 aa, Magnetococcus sp. MC-1
MMAMQWAKKIAQIQPFYVMEMLAKAKALEAQGRHIVRMEAGEPDFTTPAPVLAAARLALDEDRTRYTPSLGIPELRAAIAQWYQTRYGVAVSPQRVVVTPGTSGAFQLIFGLLLDAGDRVALSDPGYPCYPNMVRFVNGEPVAIPVSPQSHYQLSAELLVEQLAPQHARGLKAAIVTSPSNPTGTLIPDAQMQTLLSAVEGQGGYVISDELYHGITYGCKARTALEFSENAIVINGFSKYFGMTGWRLGWMIVPPSAVRGIEMLSQNLFISAPTIAQYAALQAFDCAGAMDEQVARYDLNRRYLLTALPKLGFGIGVEPKGAFYIYADATQVLSKTGLANGEALCMAALEQAGCAFTPGLDFGRYRSHEHVRFCYAAELAQLKIAMERLAAWLG

SEQ ID NO: 62408 - protein, 317 aa, Pasteurella multocida subsp. multocida str. Pm70
MTTQLDSLRNMTVVVADTGDIEAIKKYQPEDATTNPSLILSASALPQYASLIDEAIAYAKSKSNCSKQQLIDAEDKLAVNIGLEILKIVPGRISTEVDARLSYDTQATIEKAKKLIALYNEAGISNDRILIKIASTWQGIRAAEELEKQGINCNLTLLFSEAQARACAEAGVYLISPFVGRILDWYKANSDKKDYAPAEDPGVISVTKIYNYYKQHGYNTIVMGASFRNVGEITELAGCDRLTIAPALLKELQENNAPLERKLSYTGEVKAKPQPLTEAEFYWQHNSDAMAVEKLADGIRKFAADQEKLEAMLLTKF

SEQ ID NO: 62409 - protein, 1457 aa, Gibberella zeae PH-1
MTNMEVSGNKSASATHNEIAGTNDKTKAPVHLLRLLKDANDRNGSTDSVLQKLGLHDHTLNPSSPTFDFHEWSRMLVKLRSHLNVPTPLRSGFAFKDLTVHGSSSGSKQQDTVWTLLTFPLNFRTWFRRKETKPILLGLDGVVHKGELLLVLGRPGSGCSTFLKTITGQMRGLEMDQCSSLHYSGVPHEIMAKEFQGELIYNGEVDENLPYLTVGQTLEFAAAMRTPRARLPGITRKDRVNHVVQVVLTIFGLSHTRNTIVGNDYVRGVSGGERKRVSIAETALSEAAISTWDNSTKGLDAESALQFVSRLRTLSDLTQSSNAAAIYQSSQAIFDLFDKILVLYKGRQIFFGSASSAPAYFERMGWYRHPRQTSGDYLTTITDPEQRVAKEGREDAVPRTPEEFSDYWVNSPEYAALMSEIDQCQKDFHLDRDTTRKQFQATRQSLKAKGMLTRATQTVSFPMQTSLCAKRATQQLWNDKGSTLTTLIGEIIIALVVGSIFYGTPDTTDAFFAYGSVLFFSVLLNVLMSVTDIHNLYRGRSVITKQVSYAFYRPSADALASVLVDIPVKFVVGVFFNVILYFLAGLALTASQFFIFFLFVFTTTLAMSMVFRTIAAATVTLPQAMALSGFLVLALVTYTGFVLPSPYMHPWFKWISYINPLSYAFEALLVNQAHGTNYPCSNIVPSYGNLLGDTFICPVPGSVAGQTYVNGDAWFETSYDYSYSHLWRNLGIILGFLFFFLFLYLLVSDLNVNSSAGADIMVFLGNHHATRKADTKLKGRVDVERPLVVNNTSHEISVSGGTVPPANHAVFAWRKLNFDVMIKGEQRRLLDNSCGWVKPGSMVALMGVSGAGKTTLLNALAQRMPAGQVSGEFFVNGRPLPPSFKSDVGYVQQQDVHLETSTVREALQFSAMLRQPRDVPVRQKLQFAEETIRLLGMDDFADAIIGLPGKGLNAEQRKRLSIGVELAGKPSLLLFLDEPTSGLDSQSSEAILSLLRRLAEGGLGILCTIHQPSAMLFQRFDRLLLMARGGKVAYFGDIGKDSEIVLGYFHSRIPRKCQKAENPAEYILGMLGNTENQEIDWPVLWNESTQATAVLSELETVSQPSSKTSLPDSSTQPHRPGSYPLPLWSQLPIVCRRVFQQYWRSTSYIASKFMLGICGTLFIGFSFFQPGRSILGTQNAIFSILMVCAMFSSLVQQIMPKFIMQRTIYEVREKHSNMYSWFVLIFANILVEIPYHIILGVTTFAIFNYTVFGIRSSQDQGLVLLFFTYFYMLIGTFAVMVTAPLPDATTAGRITTVLFSMMLLFAGVFQTPSALPGFWVFMYRVSPMTYLVGGIAVSGLAGNQVVCSQSELAIFQPPTGQTCGSYMQVYLEQGASGTLLNPDATTNCSYCSLVSADQVLARSEMYYSDRWMDWGLGFAYIAFNVFATFLLYSLSRLAIFSLGVKKVLQLFRRGRTD

SEQ ID NO: 62410 - protein, 574 aa, Lactobacillus sakei subsp. sakei 23K
MTKLRGIAASDGIATAKAYMLVQPDLSFSKSTISDSEKEINRLHKALQDSTSDLETIRKIAAESLGEEEAQVFDAHMMILADPEFTGAIEGKINDDKVNAEQALKEVADLFVATFESMTNNAYMQERAADIKDVTKRVLSHLLGVTLPNPALIDEEVIVIAHDLTPSDTAQLNGKFVKAFVTDVGGRTSHSAIMARSLEIPAIVGTETVTQDVKAGDLLIVDGINGDVVLDPTDADIAEYDVKAQAFADQKAEWEKLKNEKSVTKDGKTFTVAANIGTPKDLAGVLENGSEAIGLYRTEFLYMDSAELPSEDDQFEAYKSVLEGMDGKPVVVRTMDIGGDKKLPYLPLPEEMNPFLGYRAIRISLDRDDIFRTQLRALLRASNYGKLRIMFPMIATVAEFRQAKGILEDEKAKLIAAGQTVSDDLQVGMMVEIPASAVLANQFAKEVDFFSIGTNDLIQYTMAADRMNERVSYLYQPYNPAILRLIKNVIDASHKEGKWTGMCGEAAGDSIMAPLLVGMGLDEFSMSATSVLRVRSLMKRLDTTELTDLVETAVNVNTSNEENQKLVEDFMKDR

SEQ ID NO: 62411 - protein, 355 aa, Euphorbia esula
MEDSTQISLIFDGLYCEEQGIVEDFDDGNEDYVKKELSLSSVLLEQDLFWTDDELLNLISKEKESHFSFGNFSSDGSLMVARKEAIDWILRVKGFYGFNALSCVLAVNYFDRFISSLVFTRDKPWMGQLAAVACLSLAAKMEETQVPLLLDLQVEESKYVFEAKTIKRMELLVLSTLQWRMNPVTPICYFDHIIRRLGLKNHLHWEFLRRCELLLLSVISDSRFMSYAPSILATLIMIHVIKEVDPFSQMEYQNQLLDVIKINKEEVNQCYKLILELSGKQDQGFKRKYPSRPGSPNGVIDAYFSGDSSNDSWGVSSSISSSPSIPRFKRIKSQDQQMRLPSINRMFVDVLSSPH

SEQ ID NO: 62412 - protein, 323 aa, Crocosphaera watsonii WH 8501
MYNPKILCIGEILFDCLADQLGKELNEVTSWIAYPGGAPANVACGLIKLGISAAFIGCVGKDKPGDELVKILDKIGVNSTGIQRHTNAPTRQVYVTRSLTGERQFAGFGQIKTEDFADTRLNSQQLTSSLFTQAKYLVMGTLELAYTQSQQAIFKAIQLAKKYQLHILIDVNWRPVFWQNIETAKPLIIQVLQAADFIKCSEEEAHWLFKTEDPQEIAQQFPKIKGILVTLGEKGCHYYLGKNQGIVAGFSVKVMDTTGAGDSFVAGFLSQCCYYEEEILNNAARAKQTIIYSNAVGALTTTKPGAIAAQPSKEEVEIWLKNH

SEQ ID NO: 62413 - protein, 124 aa, Zymomonas mobilis
MQNDQDYGNKLNPAWDEKGLITAVLTDAKTGLLLMVAHMNKESFELSMATKEATFWSRSRKKIWRKGEESGHVMKIQEIRIDCDQDTLWLKVIPMGPACHTGAQSCFYRLVEDGHLVTIPKDQI

SEQ ID NO: 62414 - protein, 137 aa, Wolinella succinogenes DSM 1740
MEQTLSIIKPDAVAKNVVGKIIDRFESNGLKVAAAKRLQLSRADAEQFYAVHKERPFFKDLVDFMVSGPVVAMVLEGENAVLKNRDLMGATDPKKAAPGTIRADFADSIDANAVHGSDSLENAKIEIAFFFSGREIN

SEQ ID NO: 62415 - protein, 700 aa, Ralstonia solanacearum GMI1000
MTSNSRRGFLRSAAQLAGAAAAMGAMPAGIRQALAIPAYNARRSIEDVQHIVILMQENRAFDHYFGTLRGVRGYGDTRTITLPSGKPVWHQPLAGGVGEVLPFRPGAPDLGLQFLQDLPHGWNDTHAAVNGGRYDGWVPHKGTTTMAYLTRQDIPFHYALADAFTLCDAYHCSTPTSTDPNRYYMWTGYVGNDGAGGGPVIDNAELGYGWSTYPEVLERAGISWKIYQDVGTGLDANGAWGWTSDAYIGNYGDNSLLYFKQYQNAQPGNPLYDKARTGTNVSAGDGYFDILKRDVQNGALPQVSWIAAPEAFSEHPNWPANYGAWYIDQVLQILTSNPEVWSKTVLLVTYDENDGFFDHLVPPFAASGGNGLSTVDTGGESFPGSSQYVPGSYGLGQRVPMLVVSPWSKGGWVCSQTFDHTSIIRFIEQRFARTHDVVSPNISKWRRTVCGDLTAAFNFADPNGAVPALPGTSAYAPGDRQRHPDYIPLPPLVQSVPKQEAGVRPARALPYELFVRGRHDEAAGRFQIDFVNTGEAGAAFLVYVAGSPDAPRSYTVEAGKRLSDKLPVNAGGTYDFTVHGPNGFLRRFVGKLSLSGLLHPHGQALEVKESYDVANGNLELRLINHGRAPSTVTLKSAYTGAAVQRVVRGGDDASVYLDLRGEHGWYDLTVTASTDAGFRRRLAGHVETGRASMSDPALGA

SEQ ID NO: 62416 - protein, 243 aa, Ipomoea batatas
MGRGRVELKRIENKISRQVTFSKRRSGPLKKAHEISVLCDAEVGLIVFSTKGKLFEYSTDSSMENILDRYERYSYAEQRMTTNVSEQQQNWPCQYPKLVSRIELLQRSTRNFLGDDLEPLGLRELQSLEQQLDTGLKRIRTRKNQLMHESISELQKKERALQVQNNILAKQVELEQQKLVLNSASTSMPSQPLVSPLPLPNLTIGSIARATEAAKNSENRGQALPCSTSLVPPWMLRHPNNKD

SEQ ID NO: 62417 - protein, 66 aa, Brassica napus
  misc_feature (4)..(4): Xaa can be any naturally occurring amino acid
  misc_feature (17)..(17): Xaa can be any naturally occurring amino acid
  misc_feature (20)..(20): Xaa can be any naturally occurring amino acid
  misc_feature (43)..(43): Xaa can be any naturally occurring amino acid
  misc_feature (45)..(45): Xaa can be any naturally occurring amino acid
  misc_feature (48)..(48): Xaa can be any naturally occurring amino acid
  misc_feature (64)..(64): Xaa can be any naturally occurring amino acid
MWKXCFWLPFLLLDIGXGKXSASIYLPSQTGADGSSSPVCSSXDXNLXYRAVIGILSHPGDGAXGA

SEQ ID NO: 62418 - protein, 300 aa, Arabidopsis thaliana
MGFRGLHSSLSNRLSAGNAPDVSLDNSVTDEQVRDSSDSVAAKLCTKPLKLVSGSCYLPHPDKEATGGEDAHFICAEEQALGVADGVGGWAELGIDAGYYSRELMSNSVNAIQDEPKGSIDPARVLEKAHTCTKSQGSSTACIIALTNQGLHAINLGDSGFMVVREGHTVFRSPVQQHDFNFTYQLESGRNGDLPSSGQVFTVAVAPGDVIIAGTDGLFDNLYNNEITAIVVHAVRANIDPQVTAQKIAALARQRAQDKNRQTPFSTAAQDAGFRYYGGKLDDITVVVSYVAASKEEGKH

SEQ ID NO: 62419 - protein, 283 aa, Glycine max
MENHSDSIFSYHESCDELRQKLLATTLELKTMENVKRELLNLLKMAYQERDEAREELQKLEAREELQKLVTKLTPSILFEVPSMMMIHAQTKANSSITESNSTSHVSSSVDSLLEAFSPQEFSNMNNNNIVESHNLGGYYLKQPSVQNMNMSVLSQKRTCDAGDQVIEYMAKGKVLPQKGNLLKAVMDAGPVLQTLHVAGPLPTWRNPPPLQNIKIPPLNVQDFVASNNNNNVNTLRKPMLAPSHYFTQPSMLNNSFQMASNANCKNLAPSRIPQSNQHFLRN

SEQ ID NO: 62420 - protein, 227 aa, Methanosarcina mazei Go1
MPEIRQLSEGIFEVTKDKKQLSTLNLDPGKVVYGEKLISVEGDEYRTWDPRRSKLGAMVLKKFDIPLKRNSKVLYLGAASGTTVSHVSDIVSEGAVYSVEFAPRSMRDFIGLASRRKNIFPILADAGKPDSYAHIVEPVDVIFQDVAQPNQAEIAARNAVRFLKKDGYLLLSIKARSIDTAASPKEIFKEEVKKLEQAFEPGFEVLTARELMPYHEDHLGVMARLKK

SEQ ID NO: 62421 - protein, 485 aa, Azoarcus sp. BH72
MQLKDQSLLLDAAFIDGEWIAADDGARFDVRNPADGSLVATVPDMGAAETRRAIAAADAALPAWRARTAKDRALILRKWFDLILAHQEDLAQLMTAEQGKPLAEARGEVAYGASFIEWFAEEAKRIYGDVIPGHGPDKRIIVIKQPIGVVAAITPWNFPIAMITRKCGPALAAGCTVVVKPAEDTPLCALAIAELGRRAGLPAGVLNVVTTSRAPEVGTELATNPIVRKLSFTGSTAVGKLLMAQCAGTVKKVSLELGGNAPFIVFDDADLDAAVAGAIASKYRNAGQTCVCANRLLVQDGIYEAFAARLAEAVAKMKVGPGVEADVQQGPLINDKAVAKVEELLADATAKGAQVVLGGERHALGHGFFQPTVLTGVTPAMRLAREEIFGPVAPLFRFSTEDEAVRLANDTEYGLAAYFYAGNIARVWRVAERLDYGIVGINEGIISTEVAPFGGVKESGIGREGSKYGIEDYVEIKYLCLGGIR

SEQ ID NO: 62422 - protein, 304 aa, Colwellia psychrerythraea 34H
MNVNWQGVYPAVTTQYNEDLSINFEATTQMVDTIIKEGVNGIIALGTVGENASHTREEKVAILKAVKEVVAGRVPVLSGVAETSTQFAIEFSQACEAIGIDGLMVLPGMIYKSDESEAVNHYQQIARNCGLPIMIYNNPVTYGVDVGIEGMKILAQEDNIVSIKEATEDTRRISELYSAFDDRFVIFGGVDDIALESLMLGCTGWISGLTNVFPKESVAIYKLAEQGRYAEALEIWRWFLPLLRLDTVPKLVQCIKLCEQLAGRGSELTRAPRMPLVGDERANVERIYNEAVANRIDLSKFNLD

SEQ ID NO: 62423 - protein, 387 aa, Medicago truncatula
MEGKLSRAAKKLTSSPIQELSHLAQRCNAINLAEGFPDFPAPLHIKNAAVSAINSDLNQYRHVQGICEHLAKIVKEMHGLDIDSETDVAICCAIDPGDEVILFDPSYETYQGCVTMAGGVPIHVPLDPPQWTLDPRKLLTSITERTKAIILNSPHNPTGKVFTKDELETIAGACCSRNCLAITDEVYEHITYDNQKHISLASFPGMQERTIITSSLSKTFSVTGWRIGWAIAPASIASAIRNIHIIVTDSAPAPFQEAALTALRSPPEYFESLRRDYQSKRDYIIKLLAGVGFKIQFIPQGSFFLFAELPEDCPLSDVEFVKKLILEAGVVAVPGQGFFHTNLSTNETSSASCNYQKRYIRFAFCKSETTLAAVSEKLGDQTVEKQY

SEQ ID NO: 62424 - protein, 555 aa, Kluyveromyces lactis NRRL Y-1140
MSSSLQFKKVAGSDGSSAWNTNDQQYNAFVHEGDTDTPTYVKTFQNCVRILKKYARFVGPGLMVSVSYMDPGNFSTAVAAGSAHRYKLLFSVLVTNILAAFWQCLCAKLGAVTGLDLAQNCKKHLPPTLNLVLYVLAEVAIIATDLAEVVGTAISLNILFKIPLPLGVILTVVDVLVVLLAYKPNGSLKLVRWFEAFVSLLVFATVVCFAIELFSVHIDSVGEVFKGFLPSKAVFESDGLYLSLAILGATVMPHSLYLGSGVVQPRLRDYDIKQGHYIPSQNDEDNNHDNYKPSIDAIHDTLNYTMAELLVSLFTVALFVNCSILIVAGATLYGVTSNNAHEADLFSIYNLLSETLSKTAGTIFVLALLFSGQSAGIVCTLSGQMVSEGFLNWTVAPALRRALTRVVAITPCLILVLVAGRNGLSGALNASQVVLSLLLPFVSAPLIYFTSNKNIMRVPWAIDCSQEPSNLFALQNLSSSNLATDDATVIAHDTDDEVDAHLINSPEPLSDESVHYKDFSNSIFTTVVAVIVWIFISGLNFYLLISFANGQDVHL

SEQ ID NO: 62425 - protein, 306 aa, Oryza sativa (japonica cultivar-group)
MADAKQQQQQQTAAAATGVWKTVKPFVNGGASGMLATCVIQPIDMVKVKIQLGEGSAAQVTKNMLANEGIGSFYKGLSAGLLRQATYTTARLGSFRVLTNKAIEKNDGKPLPLVQKAFIGLTAGAIGACVGSPADLALIRMQADSTLPIAQRRNYKNAFHALYRIIADEGVLALWKGAGPTVVRAMALNMGMLASYDQSVELFRDKLGAGEVSTVLGASAVSGFFASACSLPFDYVKTQIQKMQPDASGKYPYTGSLDCAMKTFKSGGPFKFYTGFPVYCVRIAPHVMMTWIFLNQIQKFEKQIGI

SEQ ID NO: 62426 - protein, 363 aa, Mycobacterium smegmatis str. MC2 155
MPQTVRGVISRSKQQPVELVDIVIPDPGPGEVVVDIIACGVCHTDLTYREGGINDEFPFLLGHEAAGTVEAVGEGVTNVAPGDFVILNWRAVCGQCRACKRGRPHLCFDTFNATQKMTLTDGTELTPALGIGAFADKTLVHEGQCTKVDADADPAVAGLLGCGVMAGIGAAINTGAVTRDDTVAVIGCGGVGDAAIAGAALVGAKKIIAVDMDNKKLDWAREFGATHTVNAKDLDAVETIQDLTDGFGADVVIDAVGRPETWKQAFYARDLAGTVVLVGVPTPDMKLEMPLIDFFSRGGSLKSSWYGDCLPERDFPTLISLYLQGRLPLEKFVSERIGLDGIEDAFHKMHAGEVLRSVVVLDR

SEQ ID NO: 62427 - protein, 625 aa, Oryza sativa (japonica cultivar-group)
MASISGAAAPPSSSAACRLRLRRQLLLRPSHLRLRAPHSIADLSRSSSSSSEQQPSSTPAAPLASRPGQNGSTRGAVEKDPIKLWERYVEWLYQHKELGLFVDVSRMGFTEEFLRRMEPRMQRAFAAMRELEKGAIANPDEGRMVGHYWLRDPGLAPNSFLRTKIETTLDRILAFSQDVVSGKIKPPSSPAGRFTQILSIGIGGSALGPQFVSEALAPDNPPLKIRFIDNTDPAGIDHQIAQLGPELASTLVIVISKSGGTPETRNGLLEVQKAFRDAGLDFSKQGVAVTQENSLLDNTARIEGWLARFPMFDWVGGRTSEMSAVGLLPAALQGIDIKEMLVGAALMDEETRNTVVKENPAALLALCWYWASEGIGNKDMVVLPYKDSLLLLSRYLQQLVMESLGKEFDLDGNRVNQGLTVYGNKGSTDQHAYIQQLREGVHNFFVTFIEVLRDRPPGHDWELEPGVTCGDYLFGMLQGTRSALYSNDRESISVTVQEVTPRAVGALVALYERAVGIYASLVNINAYHQPGVEAGKKAAGEVLALQKRVLTVLNEASCKDPAEPLTLDQIAERCHCPEDIEMIYKIIQHMAANDRALIAEGSCGSPRSIKVYLGECNVDEDMLAA

SEQ ID NO: 62428 - protein, 326 aa, Aspergillus nidulans FGSC A4
MALPSYPGILHNYAPRLVAFEFRSSGTLKPHSLLFIGGLTDGLYTVPYVQGLANALEPTEWSLFHLHLSSSYGGWGIGSLDRDVEEIGQCIEYVRNLKQRTTSGAKVVIMGHSTGSQDVLHYLYSANPTPRNPDVDGVHSLTRPAVDGAIVQAPVSDREALLQCAKESPEAREAYEKLVTFAREQPARAICPIELSGLVGLDPVTPVSARRFWSLASPESPEKPSEDDLFSSDLTDERLGETFGRIAERGLLRTTLVALYSGSDEYCPNWVDKEALLERWKRATNARGEKKWDDEISGIIPGASHNVRDEGQAWMIERILSYLNRV

SEQ ID NO: 62429 - protein, 514 aa, Zea mays
  misc_feature (154)..(154): Xaa can be any naturally occurring amino acid
SVPLSSVKYCSFKCQIAHWRQGHKDECHPPTVNTRPDDEGKAEEGRAAQENVSVGVKQVSEMNKPANFESSNGKSKHTLSEAVCTSAKVPGGHQSNSTVEISENVPVSVDSSKMGSSMKHANANFGEDGSSTKDLNGVSPCKSQSSPSNINGQXSFVNDEFCNHSKEHQDCLQTSSTRELEDSSIPQAAAYAVLEPKSSRTPIHVELERSKTKSVGNDSIQSMKPVPSALTVDKATSVRGNCSITPNNSSKVADSLPDRNFEPSDRSGSTTNNLATSLKKMVRQQTAPKVVRHYPSESTLFPYELFVKLYSKVELHPFGLHNLGNSCYANAVFQCLMFTRPLTTYLLEGLHSKNCSQNGWCFMCEFEKLIVEGKRRKIALSPTGILSHLNDIGSSFGPGKQEDAHEFLRYAIDAMQSVCMKEARKGGVLQSAEETTLVQLIFGGYLRSKIKCSRCHVSSEQCEPMLDLTVEIDGDISSLGEALVRFTSTEVLDGENKYHCSRFCYGSWSSIFFI

SEQ ID NO: 62430 - protein, 571 aa, Triticum aestivum
  misc_feature (369)..(369): Xaa can be any naturally occurring amino acid
  misc_feature (378)..(378): Xaa can be any naturally occurring amino acid
LLFGALREHFDRFTASLISDRFWNKKVQINSSVFGAYEVINITYPGLGPAPPAMSSLTSGPPGNEEYPITADVHHQKKKLDSWIIVVVAGSSLVLIMGCIALIILIVKWKKFMRFHEAGNPVITPSVKRRHGGRSQSASLVSSASASMLSTVATCAASVKTFSLAQLEKATDGFSSRRVLGQGGFGRVYHGTMDDGNEIAVKMLTREDRSGDREFIAEVEMLSRLHHRNLVKLIGICTERAKRCLVYELIRNGSVESHLHGADKDKGMLNWDVRMKIALGAARGLAYLHEDSNPHVIHRDFKGSNILLEDDFTPKVTDFGLAREATNGINPISTRVMGTFGYVAPEYAMTGHLLVKSDVYSYGVGLLEXLLSGRKPLXFSDTMDPENLVTWARPLLGNREGLERLIDPSLNGNYNFDNVAKVASIASVCVHSDPSQRPFMGEVVQALKLIYNDAEEAVGDSYSHRESSCDPDDDLPAGFIFDSGSGSWWNSGASGCLDYRNPSPFINMEYSSGRIEARQEREGDPYSVVSTGGRVQKPAPQSRSAPLQIRKLSPSHWSRGSFSEHGRRPRH

SEQ ID NO: 62431 - protein, 422 aa, Streptomyces coelicolor A3(2)
MTALSPHLRQATPVVAVRGEGVHIEGEDGRRYLDFTAGIGVTSTGHCHPRVVAAAQEQVATLVHGQYTTVMHPPLRRLVDKLGEVLPQSLDSLFFTNSGSEAVEAALRLARQATGRPNVLVCHGGFHGRTVAAASMTTSGTRFRSGFSPLMSGVVVTPFPTAFRYGWDEETATRFALQELDYTLQTISSPADTAAVIVEPVLGEGGYVPANRAFVEGLRERADRHGFLLILDEVQTGVGRTGRFWGHEHFGVAPDILVTAKGLASGFPLSAIAAPEELMRKAWAGSQGGTYGANAVACAAACATLDVVRDEKLVENAEAMGARLRHGLEAVASRNPAVGDVRGMGLMLASEFVTADGEPDPETAARVQRAAVDEGLLLLLCGAWNQVVRMIPALVIDETAVDEGLRAWAAAVEAGTSGAAGR

SEQ ID NO: 62432 - protein, 173 aa, Brassica napus
  misc_feature (165)..(165): Xaa can be any naturally occurring amino acid
  misc_feature (171)..(171): Xaa can be any naturally occurring amino acid
MKGLFKSKPRTPPDIVRQTNDLLAYADRSVSIPDLRESKRQEKLSELSKNLRELKLILYGNSDAEPVAEACAQLTQEFFKGDTLRRLIISLQYLNLEARKDATQVVANLQRQQVNSRLIASDYLESNIDLMDFLVDGFENTDMALHYGTMFRECIRHQIVAKYVXLDSQHXKK

SEQ ID NO: 62433 - protein, 215 aa, Zea mays
CLVDYSRTSAREIEARLEAKCDALADLFAMDERDSSSLSQISSARLPERVKLIIEEIEKEEAHLLEDLASMDRKFAEHYNVLEQILAVLIQFVKDKKLEHQHQFDDLKKTWLIKRCRTMNAKLSYLEHHLLRDTYTKDTVPALHRIRKYLVEATKEASNSYNEAVSRLREYQGVDPRFDVIARQYHEIVKKLEGMQWTIHQVEMDLKPHHDHAAV

SEQ ID NO: 62434 - protein, 479 aa, Streptomyces coelicolor A3(2)
MTDTPTQLFLGGAWADAADGAVMPVDDPATGEILAHVADAGPKDARLAEEAAVQAQEEWARAAPRARSEILRRAYEIVLERTDALARLMTSEMGKPLAEARGEVAYAAEFFRWFSEEAVRIDGGHGVLPDGRNRMLLSRRPVGPCLLITPWNFPLAMGTRKIGPAVAAGCTMVLKPAPQTPLSSLALAAILKEAGLPDGVLNVVTTSRAGEVCEPLLRGGRIRKLSFTGSTAVGRLLLAQCADTVVRTSMELGGNAPFVVFDDADLDAAVDGAMVAKMRNMGEACTAANRFFVHRSVAGEFADRLARRMGALVVGPGTGDGVDVGPLIDAAGRAKVEELVADAVERGARVLVGGTTPEGPGCFYPPTVLTDVAPESRLMATEIFGPVAAILTFDDEDEVVRRANDTPWGLVGYVFTEGLDRALRVSERLDVGMVGLNTGLVSNPAAPFGGVKQSGLGREGGRVGIEEFLEYQYVALPTG

SEQ ID NO: 62435 - protein, 425 aa, Vibrio vulnificus YJ016
MSDDNSQQMTPEEVLRQQALDYHALPTAGKIAVALTKPAETAKDLALAYSPGVAEPVREIAQNPDNVYKYTSKGNMVAVISNGTAILGLGNLGPLASKPVMEGKALLFKRFAGLDSIDIEVKHRTIDEFVDTVANIADTFGGINLEDIKAPDCFEIEKRLIERCDVPVFHDDQHGTAIVTAAGMLNAIELQGKKLNECIIVCLGAGAAAVACMELLIKCGAMREKIYMLDRKGVIHTRRDDLNEYKQLFANNTDKRTLEDVISGADLFLGVSGPNLMPAEALKLMADKPVVFACSNPDPEIKPELAHEVRSDLIMGTGRSDYPNQVNNVLCFPFIFRGALDVRASEINDEMKLAAVEAIRQLAKEPVPEAVLKAAGVESLSFGPQYIIPKPMDSRLLPRVAKAVAQAAVDTGVARIPMPENYMAG

SEQ ID NO: 62436 - protein, 488 aa, Streptomyces coelicolor A3(2)
MSRAARCSLGDMNESPRTPFPTPSHWIDGRAVTGSGPLIDVVNPADESVIAHLHEATADDVDMAVDAAVAAIPGWAATPPRHRADVMRRLAEGLQKRSEELAATITLEMGAPIAFSRQAQVGFPVASTLAAIAAAERFEWSERIENSLVVREPVGVVGAITPWNFPLQQLVTKVVPAMLAGNTVVLKPSELSPLSARMFAEIATEAGLPNGVFNVVQGTGPVVGEALSRHPKIDMISFTGSTRAGKSVSSAASVTVKRVALELGGKAAHIVLPEADLDSAVARGLAFAWANAGQACGAYVRMLVPEDLQTAVVDRLRTAAQEYVVGDPADEATRIGPLASETQRRRVDDYIRRGIADGATLVTGGPGRPEGFETGAYVRPTIFSDVAPESVIAQEEIFGPVLVVIPYTDDEHAVEIANGTVYGLNAAVTGDEDHAMAIAVRLRVGQVDVNGGRHNFQAPFGGYKQSGNGREMGRAGLEEFLETKAITS

SEQ ID NO: 62437 - protein, 489 aa, Burkholderia pseudomallei K96243
MSVYGLQRLYIAGAHADATSGKTFDTFDPATGELLARVQQASADDVDRAVASAREGQREWAAMTAMQRSRILRRAVELLRERNDALAELEMRDTGKPIAETRAVDIVTGADVIEYYAGLATAIEGLQVPLRPESFVYTRREPLGVCAGIGAWNYPIQIACWKSAPALAAGNAMIFKPSEVTPLSALKLAEIYTEAGVPAGVFNVVQGDGSVGALLSAHPGIAKVSFTGGVETGKKVMSLAGASSLKEVTMELGGKSPLIVFDDADLDRAADIAVTANFFSAGQVCTNGTRVFVQQAVKDAFVERVLARVARIRVGKPSDPDTNFGPLASAAQLDKVLGYIDSGKAEGAKLLAGGARLVNDHFASGQYVAPTVFGDCRDDMRIVREEIFGPVMSILPFETEDEAIARANATDYGLAAGVVTENLSRAHRAIHRLEAGICWINTWGESPAEMPVGGYKQSGVGRENGITTLEHYTRIKSVQVELGRYQPVF

SEQ ID NO: 62438 - protein, 545 aa, Pseudomonas syringae pv. phaseolicola 1448A
MSELIRVPDIGNGEGEVIELMVKVGDRIEADQSILTLESDKASMEIPAPKAGVIKAMKVKLGDRLKEGDELFELEVEGEAAAAPAPAAESAAAPAAAEKPAEAAPAPAAAAPAPAASASVQDIHVPDIGSSGKAKIIELMVKVGDSIQADQSLITLESDKASMEIPSPAAGVVESIEVKLDQEVGTGDLILKLKVEGAAPAAAPAPAASAPAAAPAKAEAAAPAAAPAPKAEAAPAPAKDGAKVHAGPAVRQLAREFGVELSAVSATGPHGRVLKEDVQVYVKTMMQKAKEAPAGGASGGSGIPPIPEVDFSRFGEIEEVPMTRLMQLGASGLHRSWLNIPHVTQFDQADITDLEAFRVAQKGAAEKAGVKLTVLPLLLKSCAHLLKELPDFNASLAPSGKAVIRKKYVHIGFAVDTPDGLLVPVIRDVDQKSLLQLAAEAAALAEKARNKKLTANDMQGACFTISSLGHIGGTGFTPIVNAPEVAILGVSKATIQPVWDGKAFQPKLMLPLSLSYDHRVINGAAAARFTKRLSELLADIRTILL

SEQ ID NO: 62439 - protein, 463 aa, Pseudomonas syringae pv. syringae B728a
MSSTANSSELEQGLKPRHITMLSIAGVIGAGLFVGSGHAIAEAGPAVLLAYAAAGTLVVLVMRMLAEMAVASPDTGSFSTYADRAIGHWAGFTIGWLYWWFWVLVIPLEANAAATILHAWFPNIAIWVFTLVITLVLTATNLFSVKNYGEFEFWFALIKVVAIIAFVVLGVAAIFGLLPTSNVSGVSHLFDTGGFLPNGMGAVLAAMLTTMFSFMGTEIVTIAAAESKNPGKQITKATNSVIWRIFLFYLVSIFIVVSLVPWNDPRLAEVGSYQTVLDAMGIPNAKLIVDLVVLVAVTSCLNSALYTASRMLFSLGKRGDAPAVSKRTSKGGTPHWAVIMSTAAAFLTVFANYIAPAAVFDFLLASSGAIALLVYLVIAVSQLRMRQKRIAAGEAIDFKMWLFPWLTWAVIAFIVAVLTIMLLQEEHRLEIIATGVLSLLVIGAGMIVSRRRKDGRVGAAALG

SEQ ID NO: 62440 - protein, 375 aa, Bradyrhizobium sp. BTAi1
MSTKRCYYETLEVERDADETKLKAAFRKLAMKWHPDKNPGDASSEVKFKEINEAYEVLRDADKRAAYDRYGHAAFEQGAGGPHGFGAGFASSFSDIFEDLFGMAGQRRGGTGRERGADLRYNMEITLEEAFQGKTAQIEIPVSVTCESCSGTGAKAGTKPKTCAMCGGAGRVRQAQGFFTLERTCPGCHGRGQMIEDPCPSCSGSGRVTRDRTLSVNIPQGVEDGTRIRLAGEGEAGLRGGPPGDLYIFLSLSQHEFFQRDGADLHCRVPISMVTAALGGEFEVPTIDKGKTKVKIPAGAQSGRRFRIASKGMPVLRSRQTGDMYVQIVVETPQNLTKKQQELLAEFEKLSSGATQPEAAGFFTKVKDFFGKAAS

SEQ ID NO: 62441 - protein, 316 aa, Arabidopsis thaliana
  misc_feature (294)..(294): Xaa can be any naturally occurring amino acid
MTSIYHDDDDHLTASGKDLWSNFCVLVDAAVMLYEEEEEEQRRKIVSEEEEEFQKRIFCLFPRKTRSSLVKRQQNLIRVSTSSSLIDLNQFPTDSEIEDPQNHLQGLSSSCFIAANSETKTLQNPSSEPCSSLGLFGHKTAEYQKTETKDPPNPNFPCTMSLCLMENTSRKRRAVEQRKRSGGVKKANVAPFSQTARETPEWLVKVMTNMKEAKDAKLIFEKTLFVTDVNPTKNRLSMPFNNLLRNDFLTSVESIIINEDINNNNKIGVGAILVDQRCKKWGVMLKRWEMKKEXRCCGILCFAMEQSSSSLALCLC

SEQ ID NO: 62442 - protein, 475 aa, Listeria innocua Clip11262
MATEYDVVILGGGTGGYVAAIQAAKNGQKVAVVEKGKVGGTCLHRGCIPTKALLRSAEVLQTVKKASEFGISVEGTAGINFLQAQERKQQIVDQLEKGIHQLFKQGKIDLFAGTGTILGPSIFSPTAGTVSVEFEDGSENEMLIPKNLIIATGSKPRTLNGLTIDEENVLSSDGALNLETLPKSIIIVGGGVIGMEWASMMHDFGVEVTVLEYADRILPTEDKEVAKELARLYKKKKLTMHTSAEVQAASYKKTDSGVEIKAVIKGEEQTFTADKMLVSVGRSANTENIGLQNTDIATENGFIQVNDFYQTKESHIYAIGDCIPTIQLAHVAMEEGTIAANHIAGKETEKLGYDLVPRCIYTSTEIASVGITEEQAKERGHDVKKGKFFFRGIGKALVYGESDGFIKIIADKKTDDILGVSMIGPHVTDMISEAALAQVLNATPWEVGNTIHPHPTLSESFREAALAVDGNAIHG

SEQ ID NO: 62443 - protein, 207 aa, Bradyrhizobium sp. BTAi1
MSERLLVLVRHGQSEWNLKNLFTGWKDPDLTEQGVSEAKEAGRKLKAHGLTFDVAFTSELTRAQHTLKLILDELGQPGLPTSRNLALNERDYGDLSGLNKDDARAKWGEEQVHVWRRSYDVPPPGGESLKDTLARALPYYVQEILPGVLRGQRTLVAAHGNSLRALIMVLEKLTPEGILKRELATGVPIIYRLKADSTVESKLDLAG

SEQ ID NO: 62444 - protein, 327 aa, Listeria innocua Clip11262
MPVISYIDAITMALKEEMERDDKVFILGEDVGKKGGVFKATAGLYDEFGEDRVLDTPLAESAIAGVGIGAAMYGYRPVAEMQFADFIMPAVNQIISEASRIRYRSNNDWSCPMVIRAPFGGGVHGALYHSQSVEKVFFGQPGLKIVVPSSPYDAKGLLKAAIRDNDPVLFFEHKRAYRLLKGEVPETDYIVPIGEANVVREGDDITVITYGLAVQFAQQAAERLAAEGVEAHILDLRTIYPLDQEAIIEATKKTGKVLLVTEDNKQGSIISEVAAIISEHCLFDLDAPIARLAGPDTPAMPFAPTMEKHFMINPDKVADAMKELAEF

SEQ ID NO: 62445 - protein, 416 aa, Listeria innocua Clip11262
MAVEKITMPKLGESVTEGTISSWLVKPGDTVEKYDAIAEVLTDKVTAEIPSSFSGTIKEILAEEDETLEVGEVICTIETADAGSSEPAEEVEQTETKAPEKQETKQVKLAEAPASGRFSPAVLRIAGENNIDLSTVEGTGKGGRITRKDLLQVIENGPVATKTEEPTNRAQEKAPTPAPVRSAAGDKEIPINGVRKAIAKHMSVSKQEIPHAWMMVEVDATGLVRYRNTVKDSFKKEEGYSLTYFAFFIKAVAQALKEFPQLNSTWAGDKIIEHANINISIAIAAGDLLYVPVIKNADEKSIKGIAREISELAGKARNGKLSQADMEGGTFTVNSTGSFGSVQSMGIINHPQAAILQVESIVKRPVIIDDMIAVRDMVNLCLSIDHRILDGLLAGKFLQAIKANVEKISKENTALY

SEQ ID NO: 62446 - protein, 418 aa, Brassica napus
  misc_feature (81)..(81): Xaa can be any naturally occurring amino acid
  misc_feature (310)..(310): Xaa can be any naturally occurring amino acid
  misc_feature (356)..(356): Xaa can be any naturally occurring amino acid
MAPTATATATATSSSDASEGPVMGLINKRLRALRKKLNRITQMEESISQGKTLNKEQQEVLRSKPSVLVLIEELDKLRAPXLSAAVSEEITLATTHHLHHHNQAPPDQNEVADAPEEEEAKKLEDLVNLLYFGSLFDVKSQNELASIMLTRTHERGCCLVYDTVTDESTDLLCDKDLDLISELWTMMVSRPADSFLSHKNALERCVEHAKLWLANSNQPIASNCNVSYAGLREKLKKIMGSNYFTITPEMVAPVEAASAAAAGNYGAFQVAADTEQKEEDASNIKEQEPAVNDQSEQPKDESVTEGEVVXGQQEQGYTQVEGGRSKRDYQQQYVPRGTHQNQRGHRGARKRPFQRXRGGRGGGGGGYSNGKGMNPYDNSGGNGYQRSHYNNRGRGRGGGGGNGHSYNNNQDSNVTVAS

SEQ ID NO: 62447 - protein, 390 aa, Triticum aestivum
DKDNFILLTASSFFKRAQPPRRARPGSAKKHPRNPTADESWRLPSSVQQLAASIQEPPRQYLLREQEPLGGNLAGTEMPEPIPTIDLGLLSASNDAEEAAKLRSALQTWGFFKVSDHGMETSLMDSVMNASRDFFRLPLEEKRKYSNIIGGKHFQMEGYGTDQVKTQDQRLDWSDRLHLKVEPEDERNLAHWPIHPKSFRDDLHEYTSKSKRIKDDILRAVAKLLELDEDCLVNQFSNRALTYARFNYYPPCPRPDLVLGIKPHSDVYALTVLLMDKDVAGLQFLRDGTWYNVPSASNYTLLINVGVTMEIMTNGIFKGPVHRVVTNSEKERMSVAVFYGLDPEREIGPIAQMLTEDQPARYREMKVKDFLVAHLEHFSRGERVVDSLRI

SEQ ID NO: 62448 - protein, 377 aa, Bacillus cereus ATCC 10987
MKAVTYQGPNQVQVKQVDDAKLEKKDDIIVKITSTAICGSDLHLYQGNMPLPQGYIIGHEPMGIVEEVGPDVTKVKKGDRVVIPFNVACGHCFYCQHEMESQCDNSNPHYDSGGYFGYTEKFGNHPGGQAEYLKVPFGNFTPFVIPESCELEDESLLFLSDVLPTAYWSVINAGVKRGDTVIVLGCGPVGLMTQKFAWMQGAKRVIAVDYLDYRINYAKKINNVEVFEFTKFPDMGEHLKEITHGGADVVIDCVGMDGKKSPLEFLEQKLKLQGGTLGPIQIATKAVRKYGTVQMTGVYGGNYNAFPLGAFWVRNINLKMGQAPVIHFMPELFEKITNKEFDPKEIITHKIPLEEASYGYQIFNNREDDCIKVILKP

SEQ ID NO: 62449 - protein, 373 aa, Propionibacterium freudenreichii subsp. shermanii
MSMRVGILTSGGDSPGLNAAIRGFGKAAVSTYGMELIGFRDGMRGLAENRFMQLDSHALSGILTTGGTILGTSRDKVHKMLVDGKVQNMIPVIKKNYEKNKLDALVCLGGGGTAKNAKRLSDAGMNVITLPKTIDNDLVGTDQTFGFATALEIATDAVDRLHSTAHSHHRIILTEIMGHRAGWLALGAGIAGGADVILLPEVPYNVESIAAAISRRSAHGSNFSVVAVAEGARNERDAAELAAADALVREADSPVARDAAKTHRANVEASHRAHTFTLATELEKATGLESRVTILGYVQRGGTPCGRDRVLATVLGTAGADLVAKGVFGVMVAAKGDGAEPVPLEEVAGKIRRVPVDHPWIRAAKEVGTGFGD

SEQ ID NO: 62450 - protein, 188 aa, Brassica napus
  misc_feature (165)..(165): Xaa can be any naturally occurring amino acid
  misc_feature (174)..(174): Xaa can be any naturally occurring amino acid
IGASAGYGLSLSSQQLAISKVLKRQTFSEVMDLIIYVNLVASCVSVVGLFASGEWKTLSSEMNSYKLGKVSYVMNLVWTAVIWQVFNVGGTGLIFELSSLFSNAISALGLPVAPVLAVIIFHDKMNGSKVISMILAIWGFMSYVYQHYLDDKNLKKSLGIPTTGXSDSPEAKGXSAQKIQTPASRPYE

SEQ ID NO: 62451 - protein, 609 aa, Zea mays
MAQLVETYACSPATERGRGILLAGDPKTDTIAYCTGRSVIIRRLDAPLDTWVYPDHAYPTTVARFSPNGEWVASADASGCVRVWGRYGDRALKAEFRPLSGRVDDLRWSPDGLRIVVSGDGKGKSFVRAFVWDSGSTVGEFDGHSKRVLSCDFKPTRPFRIVTCGEDFLANFYEGPPFKFKHSIRDHSNFVNCIRYAPDGSKFITVSSDKKGLIYDGKTGEKIGELSTEGGHTGSIYAVSWNPDSKQVLTVSADKSAKVWDIFEDASGKLNRTLVCPGIGGVDDMLVGCLWQNDHLVTVSLGGTFNVFSASNPDQEPVTFAGHLKTVSSLVFFPQSSPRTILSTSYDGVIMRWILGVGFGGRLMRKNNTQIKCFAAVEEELVTSGYDNKIFRIPLNGNQCGDAESVDVGGQPNALNLALQKPEFALVTTDSGIVLLHNSKVISTTKVNYTITSSSVSPDGTEAVVGAQDGKLRIYSISGDTLTEEALLEKHRGAITSIHYSPDVSMFASADANREAVVWDRASREIKLKNMLYHTARINSLAWSPDSRLVATGSLDTCAIVYEIDKPVASRVTIKGAHLGGVHGLTFLENDTLVTAGEDACIRVWKVVE

SEQ ID NO: 62452 - protein, 425 aa, Fusobacterium nucleatum subsp. vincentii ATCC 49256
MSKETLNPLASGQQQVKKACDALGLDPAVYELLKEPQRIIEITIPVRMDDGSIKTFKGYRSAHNDAVGPFKGGIRFHQNVNADEVKALSLWMSIKCQVTGIPYGGGKGGITVDPSELSQRELEQLSRGWVRGLWKYLGEKVDVPAPDVNTNGQIMAWMQDEYNKLSGEQTIGVFTGKPLSYGGSQGRNEATGFGVAVTMREIFKALGKELKGATVAVQGFGNVGKYSVKNIMKLGGKVVAVAEFEKSKGAFAVYKEAGFTFEELEAAKAAGSLTKVAGSKEISMDDFWALNVEAIAPCALENAIKEHEANLIKAGIICEGANGPITPEADEILYKKGTVVTPDVLTNAGGVTVSYFEWVQNIYGYYWTEKEVEEKEERAMVDAFNPIWALKKEFDGKGQPISFRQATYMKSIKRIAEAMKIRGWY

SEQ ID NO: 62453 - protein, 103 aa, Arabidopsis thaliana
MEVPGSSKKMIATQEEMSAAKIALGSRDMCAHLLIPLNKCRQAEFYLPWKCEDERHVYGKCEYELVMERMLAMKKIREEEALAKQNKLQGNAAVPLIPKAANA

SEQ ID NO: 62454 - protein, 830 aa, Streptomyces coelicolor A3(2)
MEDATDRIARPWGARVPYGRHETWPARVDTFLAEGVEPEAVQRWVQSASILHSDGDAMDIAVADGRMVGVRGRDVDRVNRGRLGPKDLFGWQANASRDRLTRPLVRRDGQLVETDWDTAMDLVAARSRELLDSRGPGSIGFYTSGQLFLEEYYTLAVLARAGIGTNHLDGNTRLCTSTAAEALKESFGCDGQPGSYDDFDHADVIALFGHNIAETQPVQWMRLLDRLEGADPPRLLCVDPRPTRVAEHAAVHLAPRSGTNVALLNALLHETIRHERIDRDFIDAHTVGFGELAARVADCTPKWAAEICDVPAARIEEAAELVGTAEALVSTVLQGVYQSHQATAAAVQVNNLHLIRGMLGRPGAGLLQMNGQPTAQNTRECGANGDLPGFRNWQNDAHVADLARVWNVEPETIPHFAPPTHAMQIFRYAEQGSLRMLWISGTNPAVSMPELPRIRSILSQERLFTVVQDLYLTETARLADVVLPAATWGEKTGALTNADRTVHLSRKAVEPPGEARPDLDIFLDYARRMDFRDKDGGPLIPWDGPESAFEAWKRCSAGRPCDYTGLSYAKLRDTSGIQWPCDDRAPEGTARLYTDGFGWAHPDVCESYGKDLETGASQEVVEYRSLNPDGRAMLKAAAYLPPHEEPDEEYPFQLTTGRTLYHFHTRTKTGRAPQLNDAAPDVWVEVSAGDAERLGLGEGDLVEVTSRRGSLRGRLRVTGIRTGLLFVPFHYGYWDTAGGSGPGPDTPGRAANETTVTDWDPASKQPLFKTAAAALTLVERGGGRPSPAPTTTASAPVTAGAAPPTSGGPAARTTEREPTEFPHGREEGAR

SEQ ID NO: 62455 - protein, 478 aa, Burkholderia pseudomallei K96243
MPAAPAVPSRAARASAAARLERLPFSGYHKLIFVIIAIAFFFDSVDLGTMTFVLGSIKREFGLSTATAGLVASASFFGMVLGAAVAGLLADRFGRRPVFQWSMVLWGAASYLCSTAQSVDALIVYRVLLGIGMGMEFPVAQTLLSEFVPAAKRGRLIALMDGFWPLGFITAGIVSYFVLPLFGWRTVFALLALPAVFVLVVRRLVPESPRWLEHRGRLAEAGRVLAHVEAKVMKSARVASLPAPSRLAESACAQGRGAFGEIWSAAYRRRTTMVWLLWFFALLGFYGLTSWLGALLQQAGFAVTQSVFYTVLISLGGIPGFLCAAWLVERWGRKPTCIASLVGGGAMAYVYGQSALFGGSVTLLVGTGLAMQFFLFGMWAVLYTYTPELYGTGARATGSGFASAIGRVGSLIGPYAVGIVLPVFGQGGVFTLGALSFVVAALAVGVLGIETQGLALEALASTHAADDDARDPAGAAAN

SEQ ID NO: 62456 - protein, 358 aa, Laminaria digitata
ASIPTVEYLLSKGARVALSSHLGRPKDDGDKFSLGPVAERLTELIGKECKMAPDCIGDEVAAIANGLGDGEVMLLENVRFYPAETKNDPAFAKKLAAPFDLFVNDAFGTAHRAHGSTEGVTKFLSPSVAGFLLQKELDYLEGAVKVPASPFAAIVGGSKVSSKIGVIESLLAKCDKLIIGGGMVFTFLKARGQGVGSSLVEEDKLELAKELEVKAAAAGVQIILPSDLIVADAFAADAKTQVVRADAIPDGWMGLDNGPEATKEIQAALKECKTVVWNGPMGVFEYEAFARGTFAIAETLAEITSEGCTTIVGGGDSVAAVEKAGLAPKMSHISTGGGASLELLEGKVLPGVAALNDA

SEQ ID NO: 62457 - protein, 432 aa, Streptomyces coelicolor A3(2)
MRVCVIGAGLSGLAMGHALKERGISFVCLEKAPDVGGIWRQPGAGERGPGYQSLHLNTARQLTGYADFPMPSDYPLYPRHDQVAAYLRSFAEWAGLLDHVELRTEVLSVRQDSDGSWTVVSRDADGAQSARRFEQVVVASGHHTDPALPDPLPAGADSFAGTILHSLDYRDGGDFAGRRVVVVGLGASAVDIAADLSRHAERTLLSVRRGLHIVPKQVFGMSLDEIAEAPWWNEMPFAERRRWVEQALLVARGRLSDYGLPEPDHPILSSATTLSDEILSRIRHGAVTPKPAIASFESDRVVFTDGSSEAADTVVYCTGFHMTFPFLPPGCPVAADGAVELYRRIVPADRPGLYFVGLVRPAGALTRLVEAQAQWVARLVDGAAALPGTEEMREEISTYLAGIVERYGRTRGASIQVDVSPYLAEFREPLPV

SEQ ID NO: 62458 - protein, 737 aa, Burkholderia pseudomallei K96243
MQTAFWQRHLGGGEMASGIGRFGKRASRLIDFGLWAAAALLLLTAGVGALGTARLSDNEADIHRASEVISGLERLLALARDMETSQRGYILTGKPDYLQPYKAALPEIRKQFDALTTLVQDDAVQQQRLATLRMLLEKKQHELAATIELRKTEGFDAAQAIVSSDAGKIFMDRARVMVNEMEATVQQQLRTLRDRARATRDIAIGVGLASGLLTLAVCVSFGYVMRRLLLVEAAAAHDLFEQRELLHVTLASIGDGVIATDVGGRITFFNRVAEEMTALCADAVVGQPIERVLTFRHAATQRVIDNPARVAVERRRTASLPAHTRFVGRSGGELPVDGNAAPTFDANGKLVGAVLVVRDVSERERAEERFRLAVEAAPTAMIMVGRDGRIVLVNSQAEKLFGYARGDMIGHGIDMLVPERFRAGHWAHRDAFFGNPDARPMGEGRDLFGLRRDGSEFPVEIGLNPITTSEGAFVLCSIADITARKRAELELRRRSEELARSNQDLEQFAYVASHDLQEPLRAVAGPLQLLQRRYQGQLDARADEFIGHAVDGATRMQSLIDDLLSYSRVGRLEDARRPVDCEHVLDEALRNLSAAIRESGAQVTHDPLPTVHGIEAQLVLLFQNLIGNAIKFRGKDRVARIHLEAHTRDDAWLLRVRDNGIGIDPQYFERIFLIFQRLHTRREYPGTGLGLALCKRIVEHHGGRIFVESEPGQGTTFSFTLSRPGADETRWPRDPRE

SEQ ID NO: 62459 - protein, 547 aa, Acinetobacter junii
MTQNSYKIPIQGMTCTGCEEHVTEALEQAGAKDVSADFRRGEAIFELSDDQIEKAKQNISAAGYQPGEEESQPSENSVDFNRDGDYDLLIIGSGGAAFSAAIKANENGAKVAMVERGTVGGTCVNIGCVPSKTMLRAGEINGLAQNNPFTGLQTSTGAADLAQLTEQKDGLVSQMRQEKYIDLIEEYGFDLIRGEASFIDDKTIQVNGQNITSKSFLIATGASPAVPEIPGMNEVDYLTSTSALELKEVPQRLAVIGSGYIAAELGQMFHNLGTEVTLMQRSERLFKTYDPEISEAIDESLTEQGLNLITGVTYQKVEQNGKSTSIYIEVNGQEQVIEADQVLVATGRKPNTETLNLESAGVKTGKKGDVLTNEYLQTSNNRIYAAGDVTLGPQFVYVAAYEGGIVANNALGLAKRKIDLRFVPGVTFTNPSIATVGLTEQQAKEKGYDVKTSVLPLDAVPRALVNHETTGVYKLVVNAQTQKLIGAHIVSENAGDVIYAATLAVQFGLTIEDLTDSFVPYLTMAEGLKLAALTFDKDVSKLSCCAG

SEQ ID NO: 62460 - protein, 335 aa, Oryza sativa (japonica cultivar-group)
MSSRMAGATLLRHLGPRLFAAEPVYSGLAASARGVMPAAARIFPARMASTSSAGADVKEGAAEKLPEPAATAAAAATDPQNKKAVVSYWGIQPPKLVKEDGTEWKWLSFRPWDTYTSDTSIDVTKHHEPKGLPDKLAYWTVRSLAVPRDLFFQRRHASHALLLETVAGVPGMVGGMLLHLRSLRRFEQSGGWIRALLEEAENERMHLMTFLEVMQPRWWERALVLAAQGVFFNAYFVGYLVSPKFAHRFVGYLEEEAVSSYTEYLKDLEAGKIENTPAPAIAIDYWRLPADATLKDVVTVIRADEAHHRDLNHFASDIQQQGMKLKDTPAPIGYH

SEQ ID NO: 62461 - protein, 519 aa, Magnetococcus sp. MC-1
MQPLLTAEQMRRVDQDTIERFGLPGMVLMENAGRACVDLLYARLPDLARRRVLILCGGGNNGGDGLVIARWLRDAGVDTRVVLFTPADRLTGDAATNQRLYTRLGGELREALHEEDLAKLPSWLGHAGVVVDALLGTGLERAVEGHFALAIEQLNASRKPVLAVDLPSGIHADTGQILGCAVRATWCVTFAAAKIAHYTHPGAEHCGEITVAPIGIPRPMLERPEHTVSLNSPARWHPPARSPASHKGNHGHLLILGGSRGKGGAPALAAMAAQRMGSGLITCAVPRSVQPQVASLCPEAMTFAMDEESDGGILPEHRGPCKQLGFNPSVVAVGPGLGTGGGAAELIAQLMITPLPMVMDADALNLLALQPGLLRAHRAPELVLTPHPGEFSRLCGHRVEEIQADRVTIARNFARSWRVWLVLKGAGTVIASPDNRVWINPTGNHGLATGGSGDLLTGCIAGLMAQGWSLQDATLAGVWMHGRAAELSAAEQGGAAGMQSRDLLPYLRRLRNQLPQTTP

SEQ ID NO: 62462 - protein, 462 aa, Cytophaga hutchinsonii ATCC 33406
MILSEPKASLEKDASTLYAYKKQLDASFVWGVSASAYQTEGAYNIDGKGPSIWDTFTNENKNKIKDRKNANIACDFYSRYEDDLKLMQSLGINHFRFSISWSRILPSGTGEINPAGIAFYDRLIDTCLRYGITPWVTLYHWDLPQALEKRGGWTNREVVNWFTGYVAICVKHFGDRVQHWMVMNEPMVFVGAGYFLGLHAPGRRGMKNFLPAIHHAVLSMCEGARAIKSIYPNATVGTTFSCSHIEPYRNIEKDHLAAYKVDALLNRMFIEPTLGMGYPIDTLKPLQNIHQYILPGDEYKMKYDFDFIGVQNYTREFVKHSWFTPYLNARLITAPNRKVPHTLMNWEVYPESIYHMIRKFDAYPGIKKILITENGAAFEDTHHESLISDHLRTTYLQDHIEQVLRARAEGSKVDGYFVWTWTDNFEWAEGYHPRFGLIYTDFKNQNRIVKESGLWYGSFIRE

SEQ ID NO: 62463 - protein, 511 aa, Zea mays
MEMVPWLLGFLGRYPELMVSLACFLLLFRRLNQRDGLPTNWPVVGALPAITVNAGRMHEWVTEFLRAAGLSYVMKGPWGSPVDVIMTADPANVAHVFTSNFGNYPKGQEFAALFDVLGDGIFNADGESWAFQRRKAHALLSDARFRAGVAASTARKLRDALVPLLDGIAASGAVVDLQDVFVRLTFDLTAMFVFGIDPGCLAPDFPYVPFAAAMDTVEEVLFYRHVAPVPWLMLQKYLRTGHSKKMWNARRVLDASIAEFISLRRERAAEAEAEADLLTSYLACHDEIGKSGAELERFLRDTTLNLMVAGRDTTSSALTWFFWLLTKHPDVEAKVLEELRAHPPLSGAGGHRTAAELKQLVYLHAALSESLRLYPPVPFEHKAAARTDTLPSGARVGPSRRVIVSFYSMGRMEAVWGKDCSEFRPERWLTAAGRFRHEPSYKFVAFNVGPRTCLGRDLAYSQMKAVVAAVLPRFRVEVDAGAVVRPKLSIILHMKDGLKVRVPKREEDGLC

SEQ ID NO: 62464 - protein, 234 aa, Oryza sativa (japonica cultivar-group)
MAAAAAAAASATAAISGALLPHAVACHRLPPRPQLLAVSSSFRRLSLTASPRRASRLVPRADASAEAGEPEPAAEAEAEAVAASTDAEVEEGEAEAAVAVAEEEQEEEDEPPPPSKPPVKFGEIIGILNKQFIEEAEKVKTLPDLRPGDIIELRMQRPNKRRLSLFKGIIIAKHKSGVHTTIRVRRIIAGVGVEITFPIYSPRIKEIKVIRHKKVRRAKLYYLKHKLPRFSTFK

SEQ ID NO: 62465 - protein, 146 aa, Zea mays
IGYKIGTMIEIPRAALVADEIAEQAEFFSFGTNDLTQMTFGYSRDDVGKFIPIYLAQGILQHDPFEAILASPSFTDVLDQRGVGELVKLATERGRKARPNLKVGICGEHGGEPSSVAFFAKTGLDYVSCSPFRVPIARLAAAQVLV

SEQ ID NO: 62466 - protein, 461 aa, Burkholderia sp. 383
MVSGNESDGLKRGLKNRHIQLIALGGALGTGLFLGIAQTIKMAGPSVLLGYGVAGIIAFFIMRQLGEMVVDEPVAGSFSYFADKYVGHFTGFLSGWNYWVLYILVSMAELSAVGIYVQYWWPGVPTWVSALVFFVAINLLNLASVKSYGETEFWFSIIKVAAIVGMIGFGGWLLASGHAGPEASVRNLWQHGGFFPNGVSGLVMSMAAIMFSFGGLELIGITAAEADDPKRSIPRATNQVIYRILIFYIGALAVLLSLYPWEKVVTGGSPFVLIFHALSSNLVANVLNVVVLTAALSVYNSGVYSNSRMLFGLAKQGNAPKVLCSVNKRGIPLAALGASALATGVCVLVNYFMPGKAFEVLMGLVVSALIINWAMITLIHLKFRQAKRAAGEETSFRSLGYPFTNYLCLAFMAGILVVMYLTPDLRLSVYLIPVWLAVLAVGYRFRQKNAGYAVHDSASAR

SEQ ID NO: 62467 - protein, 255 aa, Mycobacterium smegmatis str. MC2 155
MDVRSAFDLSGRTALVTGGNQGLGKAFAIALAQAGARVSFSGRNAERNEKTAAEAAAAGHQLHAITADITRAEDVERMTAEAIEALGHIDILVNNAGTCHHGESWTVTEEQWDDVFDLNVKALWACSLAVGAHMRERGSGSVVNIGSMSGIIVNRPQMQPAYNASKAAVHHLTKSLAAEWAPLGIRVNALAPGYVKTDMAPVDRPEFKRYWIDDTPQLRYAVPEEIAPSVVFLASDAASFITGSVLVADGGYTAW

SEQ ID NO: 62468 - protein, 370 aa, Aspergillus oryzae
MSPNLEITIPTTSLSPTSPPYTVYNLTLRLPLRSFTISKRYSDFLNFHKTLLTQTNIPPPAPLPQKTWFKNTVSNASLREDRRQALEAYLQAINDADDPRWRNSPAWRAFLNLPSAANASHTSTRLHAAITDPGSGADNPISDPTLWLDVYRDMKSHLHDARLHLTRRDQETTPQKQHESSARAKSSLVRAGSLVAALEEGLKVMGEAANRAQSPSGKGRGGSLGDGELRRRKDLLINARKEKDGLEDLLNAMAAKSRVDHAVASVQDKEALVGSASRKPARSGRVLGKETERTRELDNQGLLQLQRQTMEDQDQSVEELLKIIRRQKELGIAINEEVEIQNALLSIANEDAERVHRKIDIGKKRIGKIS

SEQ ID NO: 62469 - protein, 120 aa, Oryza sativa
MKAQQQPARGTSALLSATMFVITFSVMQVSKEFLRQSPAFITLGGFLGSLLFFFTMVILGSLRRESGWFDVILSMIVAMACASTVHRISVTTCFLFSGAVLFWMNIVAGRVNKQVPTGRK

SEQ ID NO: 62470 - protein, 586 aa, Ralstonia solanacearum GMI1000
MPFTLHGIPVSRGIAIGRAHMLARAALDVSHYLVDEDKLDAEVERLRAARTAVRAELVLLKRELPTDAPEEMGAFLDVHRMILDDALLAQAPETLIHQRRYNAEWALTTQLEELMRQFGEIEDEYLRERKADIEQVVERILKALAGTPVLAPAPVAAGGDPDAGMIVVAHDIAPADMLQFRGQTFAGFVTDLGGRTSHTAIVARSLDIPAAVGVHNASTLIRQDDRIIIDGDNGIVIVDPSLAILEEYRHRRSESELQKKRLERLRHTPTVTLDGTQIDLLANIEMPEDAAAALAAGAVGVGLFRSEFLFMNRRGALPDEEEQFAAYRTAVESMNGLPVTIRTIDIGADKPLDVRDGRDDLFETAPNPALGLRAIRWSLSEPAMFLTQLRALLRASAFGPVRMLVPMLAHAREIDQTLELIERAKASLDADGMAYDPTIKVGAMIEIPAAVLILPVFLRRMDFLSIGTNDLIQYTLAIDRADNAVAHLYDPLHPAVLQLIARTIQEGQRAGRPVSVCGEMAGDATMTRLLLGMGLTEFSMHPSQLLSVKQQILRADRPRLMREVDRLLHACEPTEVQDVLGALARA

SEQ ID NO: 62471 - protein, 306 aa, Photobacterium profundum SS9
MNKLVVLGSVNADHVLQVASFPRPGETLHGHSYCVIPGGKGANQAVAAARLGADIAFIASVGDDSFGHQMLEAFANEGMNTEAVMVEENMPTGIAMIQVAATGENSICISAEANACLTAERIKPHHALIANANTLLMQLETPIETIEAAATIAKQSGTKVVLNPAPAQPLTDDLLQLVDMITPNETEAELLTGIKVEDMASAQQAADTLHAKGIKCVMITLGSKGVWISQDGKGQQVEGFRVDATDTTGAGDTFNGALLTGLQAGRKMDDAIRFAHAAAAISVTRMGAQTSIPHLSEVERFLTEHS

SEQ ID NO: 62472 - protein, 318 aa, Triticum aestivum
  misc_feature (70)..(70): Xaa can be any naturally occurring amino acid
MGTKKQVGTGPEFPGYRRPTRPPESKSYPSMASQDHHHHRGGHSHNDDDHHHHHHHGDAAGKGGGGGGGXSWVGDDGRVWHSHDGLAPHSHEPIYSAGDFSKRAPPLDSRSFADRAFTVGIGRPVGTGKTALMLALCTSLRDKYSLAAVTNDIFTKEDGEFLVKHGALPEERIRAVETGGCPHAAIREDISINLGPLEELSNLYKADLLLCESGGDNLAANFSRELADYIIYIIDVSGGDKIPRKGGPGITQADLLVINKTDLASAVGADLAVMERDALRMREGGPFVFAQVKHGVGVEEIVDHVLRAWEIATGNRRR

SEQ ID NO: 62473 - protein, 201 aa, Glycine max
MSNMKLLNSVLQVNQFAIDVEVVGQGKPQNGLKGGNEALDFLDVEKLHSLSQNELLECFHSLGDQLIYLWKIFLKFHRDNKSRILGFLRDAWVKDRKAEWSIWMLYSKVEMPHHYINSKSEESSHRGVHRRVSSLWKLPDDPLQTAATRAELHRRSIEQMRINNRSVQDMQIFGDLLHTPIVIVEHVMNVPRRCPSANSLL

SEQ ID NO: 62474 - protein, 458 aa, Zea mays
MECARELRVRSTFTAAAMASKKQVGPGGAVPAQEQMNGGDAARLVRKPMDTFPQPAAARGRRALVDVGNLMNGRPSLVNHQKQAVAAAATSHKPLNVGNKKPLVPQAAARGLRPLADVTNLMINDRAAPANRQKPLDAVFNRNGKAVKLKECKVKPEVIVSIPDSEKEKKSKFPGGQKVCRRVPTLFDNLTKCSRASDGITTPKKKNPYDIDAPDSCNELAVVEYVEDIYRFYKSTEGTCLPLSSYMSSQAEISERMRAILIDWIIEYLSMESVPRKELQLVGISAMLIASKYEEIWAPLVKDLMCLCDNAFTRDQILTKEKAILDMLHWNLTVPTMYMFIVRYLKAAMCDAELENMAFFYSELALVQYAMLVYPPSVTAAAAVYAARSTLGMNPPWTDILEHHTGLAEPQLLDCARRLISFHALAPESKQKAVYRKYSKPKLGSVALQSPDKKLLSG

SEQ ID NO: 62475 - protein, 432 aa, Rhizobium leguminosarum bv. viciae 3841
MASALLRVLATVRGRNEWTNTMTTHLVGGISSAGRALPPMDGKPFVARRSQGAYIWDDRQCQYIDTALGFGATVIGHANPLVVEAVTAALRNGPMPAFAHDGEEEAAGVLTAATQHLSRAIFTNTGSEAVHLACRLARAATGRSYIAKMAAGYDGWYDDVTLGQAGSADAAMLTNARPVHERTTLLRFNDFDDVDQLFAENSGIAAVILEPMLANAGCIPAAPGYLAHVEATARRHGALVILDEVLMGFRTRFGLTGHSMEVEADLATVGKAIGSGVAVAAVVGRPDLMALAEEGTVNRAGTYSGNPVATAAVTATFQVLKDLDYAALLARGERLRHGISSAFAKCGRTVTTSGEGSVFTIWFADSPPSNYAETLSRANAVMTLKLHEALRRRGLLIMPFAFGRLYLSDAHTDGVIDEMIGIFENAARDMAA

SEQ ID NO: 62476 - protein, 643 aa, Candida albicans SC5314
MNNFSDDLYPLALLMDELKHDDVSNRVEAMQKLDTIAIALGPERTRKELLPFLNDVAQDDEEEVFAVLANKLGEFIPLIGGHQYSEPLISILTILASMEEPLVRDKAIDSLNKISLELSDEEINGIFLTLIQNLSQGNWFSKKIAACGLYQSVIIRVDATTRQNLLKLYFKLVTDDYPMVRRASATNLPRLIDLLTEFTEHNPNDVNKITNEDWEIISKMFQHLITDDQDSVKFLSVDVLISILEFFGKIHEYSFNADFLSSALKLIQDESWRVRYTAADRFSKIARNFTNNESDLFQLIDPFISLMKDHEGEVRKAIAKQLPVFCQLLVKFPSTKATVLNKIVPVANELSQDPQENVRASLASTITELSPILEKQATIDKLLPVFLIMLKDEFPDVRLNIISNLSVVNETIGINLLSTNLLPAITELAQDHKWRVRLAIIEYIPKLAKQLGESFFNEELLSLCMSWLWDPVYAIREAAVNNLKELTVIFGSEWAQVEIINRLLNQGDKIDNDDGNGDNNDNNDKVDYSNFIIRITCLFAITSLIPVIDYKVLIDKVLPFINGLINDSVPNIRFNVAKSYLILVESLINKKKSGQLSETNDQELKKFIDSQVLSNLQKLENDDDVDVRFYSIKSIKGINEILT

SEQ ID NO: 62477 - protein, 172 aa, Phaseolus vulgaris
HVYKGYIDGGSTPVAIKRLKPESQQGAHEFMNEIEMLSQLRHLHLVSLIGYCNEMNEMILVYDFMERGTLRDHLYNTDNPAITWKQRLQICIGAARGLHYLHSGAKHTIIHRDVKSTNILLDDKWVAKVSDFGLSRFGPTGMDKSHVSTHVKGSFGYIDPEYYKRHRVTEKS

SEQ ID NO: 62478 - protein, 172 aa, Phaseolus vulgaris
KVYKGVIDNGLKVAVKRSNPQSEQGVNEFQTEIEMLSKLRHKHLVSLIGFCEEENEMCLVYDYMALGTMREHLYKGSKPLDMLTWKQRLEICIGAARGLHYLHTGAKYTIIHRDVRTTNILLDENWVAKVSDFGLSKTGPNMNQGHVSTVVKGSFGYLDPEYFRRQQLTEKS

SEQ ID NO: 62479 - protein, 196 aa, Methanothermobacter thermautotrophicus str. Delta H
MIEMLDKLKESLRNSPVIKKGEYDYFVNPVTDGIPLTEPELLEEVAEEIVRRFRPEADKIICIEAMGIHHATVLSLKTGIPFVVVRKRRYGLPGEVAVHQMTGYSEGELYINGVDSGDRVVVIDDVVSTGGTLLAVLEALREMDVDVRDVITVIDKGEGSRVVRERTGFTVKSLVKVDVIDGRVKVEDIPAGGPHD

SEQ ID NO: 62480 - protein, 557 aa, Sphingomonas paucimobilis
MAQGSDIEIAREERMQNIAEVGAKVGIPQDALLNYGPYKAKLSWDFINSVQGNQDGKLILVTAINPTPAGEGKTTTTVGLADGLNRIGKKTVAALREPSLGPCFGVKGGAAGGGYAQVVPMEDINLHFTGDFHAITSANNLLAALIDNHIYWGNKLGLDPRRIAWRRVLDMNDRVRSIVNSLGGVSNGYPREDGFDITVASEVMAILCLSSDLKDLERRLGNIHAGYTRERKAVLASELNASGAMTVLLKDALQPNMVQTLENNPVLIHGGPFANIAHGCNSVLATKTALKIADYVVTEAGFGADLGAEKFFDIKCRKAGLKPSAAVIVATIRALKMHGGVDKADLGTANPEAVRKGGVNLARHIENVRQFGVPVVVAINQFITDTDEEMAMVKEIAEAAGAEAVLCSHWANGSAGTEELARKVVAHAESGSSNFAPLYEDSMPLFEKIDTIAKRIYRATEATADSSVRNKLKGWEADGFGHLPVCMAKTQYSFSTDPALRGAPTDHVVPVRDVILSAGAEFIVAVCGDIMRMPGLPKVPSADFIKLDEQGQIQGLF

SEQ ID NO: 62481 - protein, 353 aa, Arabidopsis thaliana
MAIASSSPSSSSNVSVIPTGPQVFISFRGKELRKGFISFLVPALKKKNINVFIDEHEVRGKDLISLFRRIGESKIALVIFSEGYTESKWCLDELVQIKKCVDQKKIIAIPIFYKLDPAVVKGLKGKFGDKFRDLIERYHHEPERYQKWTEALTSVSRTFALCLPEHSDKSEKDFIRSIIKEVKKALSNISRERNGDREEIDDCFVVSERKLTTDMYDTPEVSTSTMRKVSSNNGVGVGTFKSQKPNFDDEDDDGDSLLKALVAKLVASTTSIVAAYAELQRAHSDAIQAAETVVVDVKTLSELIRSSNGGGGGSGSGSGSSLENQPRRSKVRKQVWAEVLGISSDSTIILECI

SEQ ID NO: 62482 - protein, 556 aa, Clostridium thermocellum ATCC 27405
MLTDIQIAQSCKMKPITQVAAELGIDEEELELYGKYKAKLSDKLWERVKDRPDGKLVLVTAINPTPAGEGKTTTTVGLGQAMARIGKKAVIALREPSLGPVMGIKGGAAGGGYSQVVPMEDINLHFTGDMHAITAANNLLSAAIDNHIQQGNELNIDVRQIIWKRAMDMNDRALRNIVVGLGGKANGVPREDGFQITVASEVMAVLCLSTGLMDLKERLGRILIGYTYDGKPVFAKDLKVNGAMALLLKDAIKPNLVQTLENTPAIVHGGPFANIAHGCNSIVATRLGLKLADYCITEAGFGADLGAEKFFNIKCRYAGLKPDLVVLVATIRALKYNGGVKKENLGIENLPALEKGFVNLEKHIENIRKFQVPLLVAINHFDTDSEAEIEYVKNRCKALNVEVAFSDVFSKGSEGGIELAEKVVKLTETQKSNFKPLYDVNLSIREKIEIIAREIYGADSVNILPAAERAIKKIEELKMDKLPICVAKTQYSLSDDPTLLGRPQGFVITVREIKLSSGAGFIVAITGDIMTMPGLPKVPAAEKIDIDENGVITGLF

SEQ ID NO: 62483 - protein, 267 aa, Ralstonia solanacearum GMI1000
MTQRVPATAQVFSLLIMAVMHKLVLIRHGESTWNLENRFTGWVDVDLTDTGIAQARQGGRLLREAGFTFDLAYTSVLKRAIRTLWHVQDEMDLMWIPTRTEWRLNERHYGGLSGLNKAETAAQYGDQQVLVWRRSYDTPPPALEAGDERDAYGNPRYAGLPREQVPLTECLKDTVARVLPLWETSIAPDIKSGKRVVIAAHGNSIRALVKYLDNISDDDIVGLNIPNGTPLVYELDANLKPIRHYYLGDQEAIAASLAAVAGQGKAK

SEQ ID NO: 62484 - protein, 410 aa, Photobacterium profundum SS9
MSKIVVVGGGAAGLELVTRLGRSFGRRDTHEIILVEPSTHHYWKPRLHEIAAGTFDTELDAVSYLQHARCNDYQYVQAAMSSLDRTTKTLQLRNENGAESSLDYDYLVIAVGAVSNDFKTPGVSEHCLFLDSSLQAQLAWEQINPLLRAEGKHHLSIVGAGATGVELAAELAKVSAKLQCYRHGSELAITLIEASDRVLPAGPECMSEKVQKALEKQGITVRTNTRVQRAEAGKLVTAEGEIIVADLQMWAAGIKCAEWLTQLDGLETNRLNQLKVDANLQSTLDDAIFVLGDSAECPQPDGSFVPPLAQAANQAAGHLARQFKRLLKGKALKPFIYNDGGMVIAVGHDYAVGSLMNNKLILRGRFVRNLYDTIFRLHQQILFGWGRVTALVLLKRIKCALNPYYKGNIS

SEQ ID NO: 62485 - protein, 432 aa, Burkholderia sp. 383
MSRDLLGTLAGWQRTYGDVVHLRVRPEHAVVVTDPALVRELLVTHHDALGRWERAIRVFAQVHGHSVLVAEGDAWRDKRQALQPNFMPKPVQAFVPSIAATAGHALAQWPARDPDWPIESALTSLAMDVIMRTMFSDAIGDDARAAEEAVRTVSAAANADFYWPASTPDWVPWKRGKARAMAVLNGLIDRQLHARLDLPARAWPDDLLSRLLRLHRDDARRWPLQAVHDECMTAFLAGHETTAGALTWWAWCMATNPAAQAAARDEVSRVLGGCAPSAETRSSLRYLTHTLEETLRLYPSAPILISRRASRPIVLGPWQFPARTLFMLPLQLMQRDARWFAEPDVFRPERFADGAPAAPRGTYMPFGTGPRVCLGQHLAMTEMTVVAAMILQRYELSAQPGMMPPRPVLNVTLRPERLLHLAIAPAADGGTV

SEQ ID NO: 62486 - protein, 102 aa, Bacillus cereus ATCC 10987
MSSQRQGYAGWWQGGHGGWPGGHGGWPGGHGGWQGGHGGWQGGHGGWQGGHGGWQGGHGGWQGGHGGWQGGHGGWQGGHGGWPGGHSGWQGGHGGWQSGHGY

SEQ ID NO: 62487 - protein, 296 aa, Rhizobium leguminosarum bv. viciae 3841
MQKTFRGVYTVMITPLDPSGAVDLKGLAAFTDWQVKEGIHGLIPLGSTGEFLSLSEEERDSVARTVIETVAGRVPVLIGTGAEDTRESIRLSVKAEAMGADGVMIIPPFYSTPTDDELVHHYKSIASAVTIPIMVYNNPATANVDLTPELVKRIAEIDGCDYIKESTLEVTRVRDIIRLAGDDMTVFGGILGFESFVMGAQGWVAVASNVAPGPMARIFELVANEKKFDEARELYLKWLPVIQAVGGQAYVAGTKSLLTHMGFGAGLPRPPRLPLPPEQDAAMKRLVADFGLTFGA

SEQ ID NO: 62488 - protein, 97 aa, Triticum aestivum
  misc_feature (6)..(7): Xaa can be any naturally occurring amino acid
  misc_feature (21)..(21): Xaa can be any naturally occurring amino acid
  misc_feature (23)..(23): Xaa can be any naturally occurring amino acid
  misc_feature (30)..(30): Xaa can be any naturally occurring amino acid
  misc_feature (36)..(36): Xaa can be any naturally occurring amino acid
  misc_feature (39)..(39): Xaa can be any naturally occurring amino acid
  misc_feature (41)..(42): Xaa can be any naturally occurring amino acid
  misc_feature (44)..(44): Xaa can be any naturally occurring amino acid
  misc_feature (54)..(55): Xaa can be any naturally occurring amino acid
  misc_feature (71)..(71): Xaa can be any naturally occurring amino acid
  misc_feature (74)..(74): Xaa can be any naturally occurring amino acid
  misc_feature (83)..(83): Xaa can be any naturally occurring amino acid
RAPGSXXSPACSPRSSGDYGXGXWPYCMYXGFVMSXSVXGXXRXSKPTVEVSVXXVNCTEDAAAFVALAAXVDXSVDACRLFXQRLRKELCQLDLLG

SEQ ID NO: 62489 - protein, 335 aa, Candida albicans SC5314
MAIKIGINGFGRIGRLVLRVALGRKDIEVVAVNDPFIAPDYAAYMFKYDSTHGRYKGEVTASGDDLVIDGHKIKVFQERDPANIPWGKSGVDYVIESTGVFTKLEGAQKHIDAGAKKVIITAPSADAPMFVVGVNEDKYTPDLKIISNASCTTNCLAPLAKVVNDTFGIEEGLMTTVHSITATQKTVDGPSHKDWRGGRTASGNIIPSSTGAAKAVGKVIPELNGKLTGMSLRVPTTDVSVVDLTVRLKKAASYEEIAQAIKKASEGPLKGVLGYTEDAVVSTDFLGSSYSSIFDEKAGILLSPTFVKLISWYDNEYGYSTRVVDLLEHVAKASA

SEQ ID NO: 62490 - protein, 310 aa, Phaseolus vulgaris
PGSGQGLPEFQTEIMVLSKIRHRHLVSLIGYCDERFEMILVYEYMEKGTLRDHLYNTKFPTLSWKVRLQICIDSARGLHYLHKGAAGGIIHRDVKSTNILLDENHVAKVADFGLSRSGPLDTQPYVSTGVKGTFGYLDPEYFRSQQLTEKSDVYSFGVVLLEVLCARAVIDPSLSRDQIIADGLLCKNKGTLQEIIDPSIKDQIDQNSLRKFSETVEKCLQADGPDRPTMGDVLWDLEYAVQLQRGANAIQREPYEDSSSNVSASFQLPNVRRLPSLSTLSEADDTIVRHDESDSAVDYVFSQLKIDDAR

SEQ ID NO: 62491 - protein, 231 aa, Phaseolus vulgaris
PGSGQGLPEFQTEIMVLSKIRHRHLVSLIGYCDERFEMILVYEYMEKGTLRDHLYNTKFPTLSWKVRLQICIDSARGLHYLHKGAAGGIIHRDVKSTNILLDENHVAKVADFGLSRSGPLDTQPYVSTGVKGTFGYLDPEYFRSQQLTEKSDVYSFGVVLLEVLCARAVIDPSLPRDQINLAGWGLLCKNKGTLQEIIDPSIKDQIDQNSLRKFSETVEKCLQEDGLTNHG

SEQ ID NO: 62492 - protein, 442 aa, Arabidopsis thaliana
  misc_feature (247)..(247): Xaa can be any naturally occurring amino acid
  misc_feature (398)..(398): Xaa can be any naturally occurring amino acid
  misc_feature (406)..(406): Xaa can be any naturally occurring amino acid
MNCDRICELPDSLLTQVLSYLPTIDSVKTSVLSKRWEFLWLRVPVLDLKVSDFPDENYASFIDNFLEFNRKSRMRKFKLKYDEYTYDDDRLAGWVVTTVDRGIQHLDAKGFETNMCVREFMPQNIYKCNTLVSLMLVTVGIENPEFVVSLPSLKIMHLEDVWYYDDPLIMEKIISGCPVLEDFVLIRPIDFCNLDVLQFLRVRSLSLRSFRLTFEYSVSCTYFSVEIDAPRLEYLNFNDDQSDTIVXKNMTSLSMIDIDSEFNVKFGGSRLEPGDLRKRDIIRDFLTAISCVRHMIISRRTLEVLDRYSKLVPIPKFDNLYRLQAAVSRSMLQLLLVFLESCPNLENLILDFTVSTEPEQDGLTYVPQCLLSSLECVEIRELIMGEETGEKLVRYFLXNSVVLKKXILRLEDSSIANQDSDIFKELSTFTKRSRSCEVIIIH

SEQ ID NO: 62493 - protein, 174 aa, Zea mays
RDRSTSVGQVVFTAEDAEAWHSQGKAAILVRAETSPEDVGGMHAAVGILTERGGMTSHAAVVARWWGKCCVSGCSGIRVNDAEKLVTIGSHVLREGEWLSLNGSTGEVILGKQPLSPPALSGDLGTFMAWVDDVRKLKVLANADTPDDALTARNNGAQGIGLCRTEHMFFASDE

SEQ ID NO: 62494 - protein, 312 aa, Phaseolus vulgaris
PGSGQGLPEFQTEIMVLSKIRHRHLVSLIGYCDERFEMILVYEYMEKGTLRDHLYNTKFPTLSWKVRLQICIDSARGLHYLHKGAAGGIIHRDVKSTNILLDENHVAKVADFGLSRSGPLDTQPYVSTGVKGTFGYLDPEYFRSQQLTEKSDVYSFGVVLLEVLCARAVIDPSLPRDQINLAGWGLLCKNKGTLQEIIDPSIKDQNDHNSLRKFSVTVEKCLQEDGSDRPTMGDVLWDLEYAVQLQRGANAIQREPYEDSSSNVSASFQLPNVRRLPSLSTLSEADDTIVRHDESDSAVDYVFSQLKIDDAR

SEQ ID NO: 62495 - protein, 219 aa, Ustilago maydis 521
MRKFKLVFLGEQSVGKTSLITRFMYDTFDNTYQATIGIDFLSKTMYLEDRTVRLQLWDTAGQERFRSLIPSYIRDSSVAVVVYDITNRASFQNTSKWVDDVRAERGNDVIIVLVGNKTDLSDKRQVTTEEAEKKAQEFNVMFIETSAKAGHNVKVLFKKIAQALPGMDKDADAATGGAAANKSEYRSQAWHLHYASRMTDLLVCCASAFTPIALEQIST

SEQ ID NO: 62496 - protein, 410 aa, Ustilago maydis 521
MVAARSAFASLARVHVASRSGLRSVSTTAAAKQPSRLLEKATSSSSSLSPIASSSRLTTNPAALTAFIPSSTRNASTDGKPQEITVRDALNSAMEEEMLRDDKVFILGEEVARYNGAYKITRGLLDKFGEKRVIDTPITESGFAGLAVGAALSGLRPICEFMTFNFAMQAIDQIINSGAKTYYMSGGNVPCPVVFRGPNGAAAGVGAQHSQDYAAWYGQIPGLKTISPWSAEDCRGLLKSAIRDPNAVVFLENEILYGQSFPISQEALSDDFTIPIGKAKIERAGKDITIVSHSIGMNYAMEAAEILKKEEGVEAEVINLRTIAPMDVDTIIDSVKKTNRIVTVESGFPQFSVGAEIAATVNDFAFDHLDAPVERVTGAAVPTPYAQNLEKLSFPDTAIVVRAAKRALYK

SEQ ID NO: 62497 - protein, 156 aa, Triticum aestivum
MANAGLKPVAGLLLMLNFCMYLIVAAVGGWAINFAINNGFFIGSGLELPSHFSPIYFPIGNAATGFFVIFAVIASVVGMGAALAGFHHVRAWSHESLPAAASSAFIAWMLTLLAMGLAVKEIDLNGRNARLITMEAFTIILSGTQLFYILAIHGGR

SEQ ID NO: 62498 - protein, 303 aa, Arabidopsis thaliana
  misc_feature (64)..(64): Xaa can be any naturally occurring amino acid
MAIPVTRMMVPHAIPSLRLSHPNPSRVDFLCRCAPSEIQPLRPELSLSVGIHAIPHPDKCRNYXVEKGGEDAFFVSSYRGGVMAVADGVSGWAEQDVDPSLFSKELMANASRLVDDQEVRYDPGFLIDKAHTATTSRGSATIILAMLEEVGILKIGNVGDCGLKLLREGQIIFATAPQEHYFDCPYQLSSEGSAQTYLDASFSIVEVQKGDVIVMGSDGLFDNVFDHEIVSIVTKHTDVAESSRLLAEVASSHSRDTEFESPYALEARAKGFDVPLWKKVLGKKLTGGKLDDVTVIVAKVVSS

SEQ ID NO: 62499 - protein, 428 aa, Methanothermobacter thermautotrophicus str. Delta H
MFPDIEVNDKGHLLIGGADAVELADEYGTPLYVIDEMRIRENYRRLYRAFSGEYSRFQVFYACKANTNLAVMRILEEEGSGIDAVSPGEIYTALMAGFDPDRILYTGNNVRDDELQFALDSGVRINVDSRSQLLRLSEIAPEGLRISFRVNPLVGAGHHEHCITGGEMSKFGVMEREAPEVYRMAMDLGFEPVGIHAHIGSGILDPEPFMLAVETLMDIAGRVHEATGVEFEFIDFGGGLGIPYTPEEEPLDIDEFASKITGLFKDKLSEYGLGRPMMCLEPGRYIVGDASYLLTRVNTIKESYRKFAGVDAGFNTLLRPAMYGSYHHILVAERPLDEPSEKMDVAGNVCESGDLFARDRQLPEINEGDVLAIMNAGAYSFSMSSQYNSRPRPAEVLVREGKVDVVRERETFSDLLRGQNVPARLLKR

SEQ ID NO: 62500 - protein, 143 aa, Oryza sativa (japonica cultivar-group)
MALKNFLVLGVFLAALLMFSLDDVAHARELTEANESEGKNVKPTGGPGVEDQKWGGGYYPGGGYGYGGGYGGEYGRPGYGGGYGGGYGHPGYGGGYGGGYGRGYGGGYGGSGGGYGGGYGGGYGGGYGGGGGYGGGYGGGGWY

SEQ ID NO: 62501 - protein, 556 aa, Streptococcus thermophilus CNRZ1066
MKTDIEIAQSVELKPITEVVEKVGIGFDDLELYGKYKAKLSFDKINEVKDDKPGKLILVTAINPTPAGEGKSTMSIGLADALNKIGKKTMIALREPSLGPVMGIKGGAAGGGYAQVLPMEDINLHFTGDMHAITTANNALSALLDNHIHQGNALGIDQRRIIWKRVVDLNDRALRHVTVGLGGPLNGIPREDGFDITVASEIMAILCLATDINDLKERLANIVVAYRYDRTPVYVRDLEIEGALTLILKDAIKPNLVQTIYGTPALVHGGPFANIAHGCNSVLATSTALRLADYTVTEAGFGADLGAEKFLDIKTPNLPTTPDAVVIVATLRALKMHGGVAKTDLSEENVQAVRDGFSNLKRHVENIRKFGIPVVVAINEFVADTEAEIAALKELCSEIKVPVELASVWANGADGGIDLANTVVDVVENGNADYKRLYSDDDSLEEKITKIVTEIYGGKSVVFEKKAKNQLKQFAEFGWDKLPVCMAKTQYSFSDNQFLLGAPEGFDITIREFVPKTGAGFIVALTGDVMTMPGLPKAPAALKMDVTEDGTAVGLF

SEQ ID NO: 62502 - protein, 336 aa, Arabidopsis thaliana
MASQPPFKTNFCSIFGSSFPNSTSESNTNTSTIQTSGIKLPVIDLSHLTSGEEVKRKRCVKQMVAAAKEWGFFQIVNHGIPKDVFEMMLLEEKKLFDQPFSVKVRERFSDLSKNSYRWGNPSATSPAQYSVSEAFHIILSEVSRISDDRNNLRTIVETYVQEIARVAQMICEILGKQVNVSSEYFENIFELENSFLRLNKYHPSVFGSEVFGLVPHTDTSFLTILSQDQIGGLELENNGQWISVKPCLEALTVNIGDMFQALSNGVYQSVRHRVISPANIERMSIAFFVCPYLETEIDCFGYPKKYRRFSFREYKEQSEHDVKETGDKVGLSRFLI

SEQ ID NO: 62503 - protein, 451 aa, Burkholderia sp. 383
MTDITTAQQDETNLRTDAAWLDAHWMPFTANRQFKADPRMIVSGKGAYYTDGEGRKIFDGLSGLWCTGLGHGRTEIVEAVSRQVAQLDYAPAFQFGHPKSFELANKIKDLTPAGLDYVFFTGSGSEAADTSLKLARAYWRAKGKGTKTRLIGREKGYHGVNFGGISVGGIGPNRKLFGQGLDADFLPHTQLAENKFSRGMPEHGAELADRLLELIALHDASNIAAVIVEPFSGSAGVVVPPKGYLKRLRDICTAHDILLIFDEVITGFGRAGAMTGADAFGVVPDIMNFAKQVTNGVQPLGGVIATKEIYDTFMAAGGPEYMLEFPHGYTYSAHPVACAAGVAALDLLVKEDAVARVRDLAPHFEAAVHGLKGQRHITDIRNYGLAAGLTIAALPGEPARRPYEIAMRCWAKGFYVRYGGDTIQLAPPFISEKREIDNLVNALSDALNEVD

SEQ ID NO: 62504 - protein, 214 aa, Arabidopsis thaliana
MPSYMLDPVQVSSGPDFSPGQPIQPGQSSSSLGVIGRRSNSELGAIGDPSAVGPMHDQMHNLQMLEAAFYKRPQPSDSERPRPYSPRNPAITPQTFPQTQAPIINNPLLWERLGSDACGTGTLFFAFYYQQNSYQQYLAAKELKKQSWRYHRKFNTWFQRHKEPKIATDEYEQGAYVYFDFQTPKDENQEGGWCQRIKNEFTFEYSYLEDELVV

SEQ ID NO: 62505 - protein, 383 aa, Clostridium thermocellum ATCC 27405
MNVLFLSISLGSGHIRAAEALQKFVVQKYPKSKTLIVDTFKYINPLIHTVVVDGYLNIVKYVPEIYGGLYRMSEHIKNIDRMSRGFSNLLTPKIHRLIQSFKPSIIVCTHPFPLQMIAHLKKHYNLDVPSIAIVTDFVNHPFWFQNNIEAYIVAHDYIKRDMIECGISEDRIFTYGLPVAPEFLKSIPKEQARKELSLENTLTVLLMGGSLGIGDIENTFKSFAKCKRDIQIIAVAGKNTALKKRLDSLAASFPMPVKIFGYTDSIPMLMDASDFIVTKPGAMTISEALVKRLPALIISPIPGQEERNEQFLVNSGTAVRIYKNTKIDSVLCQVYDNKLRYKQMKEIAGNLANPDSGRNILSLIEKLVNDNEKGLFKYSFNAF

SEQ ID NO: 62506 - protein, 312 aa, Phaseolus vulgaris
PGSGQGLPEFQTEIMVLSKIRHRHLVSLIGYCDERLEMILVYEYMEKGTLRDHLYNTKFPTLSWKARLQICIDSARGLHYLHKGAAGGIIHRDVKSTNILLDENHVAKVADFGLSRSGPLGTESYVTTGVKGTFGYLDPEYFRSQQLTEKSDVYSFGVVLLEVLCARAAIDPSLPRDQINLVEWGLLCKNKGTLQEIIDPSIKDQIDQNSLRKFSETIEKCLQEDGSDRPTMGDVLWDLEYAVQLQRGANAIQREPYEDSSSSVSASFQLPNVRRLPSLSTLSEADDTIVRNDESDSAVDYVLSQLKIDDAR

SEQ ID NO: 62507 - protein, 536 aa, Zea mays
MCRRTSKGPLPRAVQCQQAMVDTVAGATDYRGQPASRAATGGWKPSVFVMAMEIAERFAYKGVAANLITYLTGPLGQPMARAAASIDAWKGVSQMLPLPLACVADAWLGRYRAIVLASLIFAVSMGALSLSSALPALRGGHVAIFYVALYLVALGEGAHKPCAQAFAADQFDEKDPRESVARSSFFNWWYFGMCAGTAVTTMVSSYVQDNVGWGLGFGIPCIVIVASLVLFLLGTRSYRFYTTAAASPFSRVGKALLALVQSWAPKHRTRKLGDSDGDAVAVEEVKSVLRLLPIWASCIIYAIIFSQTSTFFTKQAATLDRRIGARFKVPAAALQTFISVSIVVFIPVYDRLFVPLARRYTGRPTGITMLQRVGAGLALALVAVALSALVEMKRLRVAAEAGLVNTPKAQLPMALWWMVPQYVLIGVADVFAMIGLQEFFYDQVPNAVRSLGLALFLSIFGIGHLLSSFLISVIDKTTAKSGTSWFSNNLNRAHLDYFYWLLTGLCAVELVAFVIFSRVYVYKRKVGNDGGNGDFV

SEQ ID NO: 62508 - protein, 312 aa, Phaseolus vulgaris
PGSGQGLPEFQTEIMVLSKIRHRHLVSLIGYCDERLEMILVYEYMEKGTLRDHLYNTKFPTLSWKARLQICIDSARGLHYLHKGAAGGIIHRDVKSTNILLDENHVAKVADFGLSRSGPLGTESYVTTGVKGTFGYLDPEYFRSQQLTEKSDVYSFGVVLLEVLCARAAIDPSLPRDQINLVEWGLLCKNKGTLQEIIDPSIKDQIDQNSLRKSSETIEKCLQEDGSDRPTMGDVLWDLEYGVQLQRGANAIQREPYEDSSSSVSASFHLPNVRRLPSLSTLSEADDTIVRNDESDSAVDYVFSQLKIDDAR

SEQ ID NO: 62509 - protein, 312 aa, Phaseolus vulgaris
PGSGQGLPEFQTEIMVLSKIRHRHLVSLTGYCDERLEMILVYEYMEKGTLRDHLYNTKFPTLSWKARLQICIDSARGLHYLHKGAAGGIIHRDVKSTNILLDENHVAKVADFGLSRSGPLGTESYVTTGVKGTFGYLDPEYFRSQQLTEKSDVYSFGVVLWQVLCARAAIDPSLPRDQINLVWWGLLCKNKGTLQEIIDPSIKDQIDQNSLRKFSETIEKCLQEDGSDRPTMGDVLWDLEYAVQLQRGANAIQREPYEGSSSSVSASFQLPNVRRLPSLSTLSEADDTIVRNDESDSAVDYVFSQLKIDDAR

SEQ ID NO: 62510 - protein, 312 aa, Phaseolus vulgaris
PGSGQGLPEFQTEIMVLSKIRHRHLVSLTGYCDERLEMILVYEYMEKGTLRDHLYNTKFPTLSWKARLQICIDSARGLHYLHKGAAGGIIHRDVKSTNILLDENHVAKVADFGLSRSGPLGTESYVTTGVKGTFGYLDPEYFRSQQLTEKSDVYSFGVVLLEVLCARAVIEPSLPRDQINFAGWGLLCKNKGTLHEIIDPYIKDQIDPNSLRKFSETIEKSLQEDGLDRPTMGDVLWDLEYAVQLQRGANAIQREPYEDSSSNVSASFQLPNVRRLPSLSTLSEADDTIVRHDESDSAVDYVFSQLKIDDAR

SEQ ID NO: 62511 - protein, 251 aa, Zea mays
  misc_feature (197)..(197): Xaa can be any naturally occurring amino acid
  misc_feature (217)..(217): Xaa can be any naturally occurring amino acid
  misc_feature (228)..(228): Xaa can be any naturally occurring amino acid
  misc_feature (237)..(237): Xaa can be any naturally occurring amino acid
  misc_feature (243)..(243): Xaa can be any naturally occurring amino acid
MGSSRPAGRSLPDFRWNPQSFSRLLLPHPFSLLFFLFIHLVLTSLNQTFHDTNDLILFIMSSALNQLKATGTTVVSDSGDFASIGKYKPQDATTNPSLILAASKKEEYAKLIDVAIDYAKQKGGSVDQQVDDALDRLLVEFGKEILKIIPGKVSTEVDARYSFDTEASVNKALHLIELYGEQGISKDRILIKIAATXEGIKAAEILQRDHGINTNLXTLMFSLVQAIXAAEAGAYLXSPFVGXILDWVQAL

SEQ ID NO: 62512 - protein, 270 aa, Arabidopsis thaliana
MSQSRAVQRSSSPNEDRGENQLVVYDLKGNDDTEEEVLPVQSQPLSSRTQCPSIGAFTVQCASCFKWRLMPSMQKYEEIREQLLENPFFCDTAREWKPDISCDVPADIYQDGTRLWAIDKPNISRPPAGWQRLLRIRGEGGTRFADVYYVAPSGKKLRSTVEVQKYLNDNSEYIGEGVKLSQFSFQIPKPLQDDYVRKRPARLLDSIDNTNTPVAKEANPLAWISPDDHISLQLGTPTESGLNNSHYQPSKKKKTSTLSIFGSNDELADR

SEQ ID NO: 62513 - protein, 403 aa, Bradyrhizobium sp. BTAi1
MARTAGLREPAAPLEKTPLETYVPPAKPSLIGLSRAELAARLGDVGVPERQQKMRVQQLWHWIYFRGARSFDEMSSVSKDTRTALAERFTVDRPEVVAEQISNDGTRKWLLRLPSGDDLQKAHEVECVYIPETDRGTLCVSSQVGCTLNCAFCHTGTQRLVRNLTAGEIVGQVMVARDRLNDWADRETPHGNRLITNIVMMGMGEPLYNFDAVRDALLIVSDNEGIGISRRRITLSTSGVVPNIKRAGEEIGVMLAISLHAVRDELRDELVPLNRKYPIAELLQACRDYPGASNARRITFEYVMLKGVNDSLDDARLLVKLLKGIPAKINLIPFNPWPGSAYECSDWEQIEKFSEYVFNAGYSSPVRTPRGRDILAACGQLKSETEKLSARERQALRAMAMTD

SEQ ID NO: 62514 - protein, 1247 aa, Oceanospirillum sp. MED92
MKHRLVIIGNGMATGRLLQLIADSAADRFDISVFGEEPGGSYNRVLLSPLLGEEISLEQVMTLDLDWYKNNNVTLYSGDPVVHIDASLKQVISHKNLRVSYDSLIIATGSNPSAVPVEGSSLPGVMNFRTLQDVETMQQVAATKKNAVVIGGGFLGLEAAEGLRLQGMNVTLLHRSDYLLNKQLDKPAAQMLLNNLQKRGIDFRLNANTQAFLGDTQVEAVELDSGEVIPADLVITAIGVSPNSQLAEASGLTVKRGILVDKQMRTSDLNIYAFGECCQFEEYTYGLVAPIWQQAEVVLSSLIGETSNYREEPVATQLKISGVELFSCGELIDADDRDTLIYQDFKKNEYRKLWLKENRLVGAVLYGDVREGQWYFEQLKENNDLSACRQQLLFGSPLCAQDTQTENMGITSMTTESNKRQLVVIGNGMVGHHFVENFVNSNVAGDYEIHILAEESRAAYDRVHLSEYFSGSSYEDLCLVEENLYEKHGVHLHLSEGATQIDRDAKQVITEQAVYSYDTLVMATGSYPFVPPIPGNDGEACFVYRTLEDLDKIQACAEDAKVGVVVGGGLLGLEAANALKSLGLKSHVVEFAPRLMPVQLDEDGGELLKKKIEALDVDVHCEKATTEIVAGEEHTYRMNFSDGSFLETDLILFSAGIRPQDTLARSSELEIGERGGILVNDQCLTSDENIYAIGECALWNNQIFGLVAPGYTMAKTAVAAIAGDEAAFTGADMSTKLKLLGVDVGSIGDAHGKTPGSISYRYLDEDEQTYYRIIVSEDKKKLLGAVLVGDNSKYDTLLQYALNGIDLPEKPQGLILPSMDGSAAPALGPDALPDEATICSCLNVTKGQICCSIDEGATSVADVKDATKAASGCGGCAAMLKSVVDNELSKRGVEVNTDLCEHFAYTREELYHIIRVEGIRSFSELLEKHGKGLGCEICKPAAGSILASCWNEHIQEKPLVSLQDTNDTFMANMQKNGTYSIVPRVPGGEITPDKLIVIGQVAKKYNLYTKITGGQRVDLFGAQLHELPLIWEELVNAGFETGHAYGKSLRTVKSCVGSTWCRFGVNDSVGMAINLENRYKGLRAPHKIKFAVSGCTRECAEAQCKDIGVIATENGWNLYVCGNGGMKPRHADLFATDLDDETLVKYIDRVLMFYIKTADRLQRTSVWMENLEGGLDYLKEVVIDDKLEIGEELEAQMAHIVSTYECEWKATLEDEEKLKRFRTFVNTEDQVDPQIVHILERDQVRPV

SEQ ID NO: 62515 - protein, 718 aa, Mycobacterium smegmatis str. MC2 155
MSDPTASPPAPMNMVWPGEAYPLGATYDGAGTNFSLFSEVAERVELCLIAKDGTETRINLDEIDGYVWHAYLPTISPGQRYGFRVYGPWDPSKGLRCDPSKLLLDPYGKSFHGDFDFSQALYSYDLEADPPGSGTPPRVDSLGHTMTSVVINPFFQWGSDRAPKTPYHDTVIYEAHVKGMTQTHPGVPEALRGTYAGLSHPVIIEHLQSLNVTAIELMPVHQFMHDHRLLDLGLRNYWGYNTVGFFAPHFQYAATRNAGGAVAEFKTMVKAFHDAGIEVILDVVYNHTAEGNHLGPTINFRGIDNAAYYRLLDGQPEFYKDFTGTGNSLNARHPHTLQLIMDSLRYWVLDMHVDGFRFDLASTLAREFYDVDRLSAFFDLVQQDPVVSQVKLIAEPWDVGEGGYQVGNFPGLWTEWNGKYRDTVRDYWRGEPATLGEFASRLTGSSDLYEATGRRPSASINFVTCHDGFTLNDLVSYNEKHNEANGEDNRDGESHNRSWNCGVEGPTDDPEILALRAKQMRNIMATLMLSQGTPMIAHGDEIGRTQLGNNNVYCQDSELSWMDWSLCETNADHLEFTRKVVAFRKQHPVFRRRRFFEGKPIRSGDQVRDIAWLTRAGTEMTPEDWGAGLGTCVAVFLNGEAIPTPDARGERVVDDSFLLCFNSNDHPEDFVTPNGDYAAEWTADLDTADPVGNSDLVVKAGEKISIQPRSVLVLRKTA

SEQ ID NO: 62516 - protein, 407 aa, Brassica napus
MESRVLLRATATVTGVPQLRRPIRAINRQFSTASSSFTAFAKPIGSIGEGGNLISGRQLRPLLLLDSSPEKREILKPVRAAAAEGGDSAGETKVGFLGKYPWLVTGFFFFMWYFLNVIFNILNKKIYNYFPYPYFVSAIHLFVGVVYCLLSWSVGLPKRAPINSDILKVLIPVAVCHAIGHVTSNVSFAAVAVSFTHTIKALEPFFNASASQFLLGQPIPITLWLSLAPVVLGVAMASLTELSFNWLGFISAMISNISFTYRSIFSKKAMTDMDSTNVYAYISIIALFVCLPPAIIVEGPQLLKHGFNDAIAKVGMTKFISDLFWVGMFYHLYNQLATNTLERVAPLTHAVGNVLKRVFVIGFSIVIFGNKISTQTGIGTGIAIAGVALYSVIKAKIEEEKRQGKTA

SEQ ID NO: 62517 - protein, 200 aa, Coccidioides immitis RS
MAHHQPENVLRRKLVIIGDGACGKTSLLSVFTLGYFPTHYVPTVFENYVTDCRVDGRSVQLALWDTAGQEDYERLRPLAYSKAHVLLIAFSVDTPDSLENVKHKWIEEANERCPNVPIILVGLKKDLREDPLAIEEMRRRSLRFVSPKDGSETATQIGARKYLECSSLTGEGVDDVFEAATRAALLTFDEDNRGSCCVIL

SEQ ID NO: 62518 - protein, 266 aa, Burkholderia sp. 383
MTQAHRGTALITGASSGIGAVYADRLARRGYDLILVARNRDRLVALAERITNETRRSVEIIGADLNDRAALATVEAKLKQDASITLLVNNAGIGTHAPLLDSDVDAMTRMIDLNVTALTRLTYAAVPGFVARGRGSVINISSIVAISPETLNGVYGGSKAFVLAFSQSLHHELAGKGVQVQAVLPGATATDFWQTGGLPLEHLPKEIVMSANDMVDAALVGFDRGELVTIPSLHAGDEWTAYEAARRTMAPHLSADTPAPRYATAG

SEQ ID NO: 62519 - protein, 437 aa, Bacillus licheniformis ATCC 14580
MSRNTKAFTTEDWQAKRDQFVARGVSNGNRHLAAKGEGAVLYDIDGRRFIDFAGAIGTLNVGHSHPKVVEAVKRQAEQLIHPGFNVMMYPAYLELAEKLCRLAPGAHEKKAIFLNSGAEAVENAVKIARKYTKRQAVVSFTRGFHGRTNMTMSMTSKVKPYKFGFGPFAPEVYQAPFPYYYRKPEGMTDESYDDMVIQAFDDFFVSSVAPETVACVVMEPVQGEGGFIIPSKRFVQHVAAFCQKHGIVFVADEIQTGFARTGKYFAIEHFDVVPDLVTVSKSLAAGVPLSGVIGRAEMLDAADPGELGGTYAGSPLGCVAALAVLDIIESEQLNKRSEEIGKAIEERALEWKMKYPQIGEVRRLGAMAAIEIVRDEKTREPDKAAAAKIAKYANEHGLLLLTAGINGNIIRFLSPLVITDELLEEGFGIIEEALEQL

SEQ ID NO: 62520 - protein, 463 aa, Bacillus licheniformis ATCC 14580
MGKQQMKKTMSQTDVLFLAIGAMLGWGWVVLSGDWISTAGFLGSTIAFIIGGILVILIGLTYAELSSAIPETGGGLIFVYRAFGRKTAFVAAWGVLFGYVSVITFEAVALPTVIDYVLPVEHQGFLWSLSGWDVYVTWVLIGSGGAVVLTALNYFGVKPAAIFQSVFTIAIIATGFLLLGGALVNGDFEHVQPLFKDGFSGMMSVLVMIPFLFVGFDVIPQVAAEINAPKKIIGKILIISIISAVVFYLLIVFGVTMGLSESELATTSLATADAMVNLLGNQLFGTVLVLGGVAGIITSWNAFIIGASRILFAMSEKGMVPKWFGFIHPKYKTPTNAILFLGALAFFAPLLGRPALVWIVNAGGTGIIVGYLIVSIAFMKLRKTEPDLHRPYKINKWKTTGISAILLSVIFLAFYLPGMPAALTWPYEWLILAGWTLIGFLLYNSSSKRKGEEIQHDQHARSI

SEQ ID NO: 62521 - protein, 464 aa, Bacillus licheniformis ATCC 14580
MTSMLEVYNPATGEKIKSVPQQSAKEVEEAVVRSHEAFQKWSKTSAAERAGLLKKWFDLIVEQKDELAKLITLENGKPYAEAQGEVLYSAGYIEWYAEEAKRIYGRTVPASVTNKRIIVTRQGVGPVAAITPWNFPAAMITRKAGPALAAGCTFIIKPAPDTPLTALELVRLGHEAGIPKDVLQCVIGDGQEIGSIFTSHPLIRKITFTGSTPVGKHLMKNSAETVKHVSMELGGHAPLIVDEDANIDLAVKQTMLSKYRNAGQTCVCANRLIVHESVKDEFAEKLRAEVAKLKVGNGLEEGVSIGPIINKNGFQKIVDQINDAVNKGAKVLIGAEYESDDEKSCYFVHPTVLTDVDPSMTIMHEETFGPVAPITSFKTLDEAVKLANDTPYGLAAYFFTENYRRGIYLSENLDYGILGWNDGGPSTVQAPFGGMKESGIGREGGLEGIEPYLETKYLSIGLDE

SEQ ID NO: 62522 - protein, 606 aa, Rhizobium leguminosarum bv. viciae 3841
MALRNIAIIAHVDHGKTTLVDELLKQSGSFRENQRVAERVMDSNDLEKERGITILAKATSVEWKGVRINIVDTPGHADFGGEVERILSMVDGAIVLVDSSEGPMPQTKFVVSKALKVGLRPIVAINKIDRPDGRHEEVINEVFDLFANLDATDEQLDFPILYGSGRDGWMNVNPEGPKDQGLTPLLDLVLKHVPEPTVHEGPFTMIGTILEANPFLGRIITGRINSGSIKPNQAVKVLHADGKTIETGRISKILAFRGIERTAIDEAHQGDIIAIAGLSKGTVADTFCDPSITIPLPAQPIDPPTVTMSFIVNDSPLAGTEGDKVTSRVIRDRLFKEAEGNVALKIEEAEGKDSFYVSGRGELQLAVLIETMRREGFELAVSRPRVVMHKDESGQLLEPVEEVVIDVDEEHSGVVVQKMSERKAEMVELRPSGGNRLRLRFYAPTRGLIGYQSELLTDTRGTAIMNRLFHDYQPYKGVIGGRVNGVLLANAPGEAVAYAMFNLEDRGPMIIEPGEKVYAGMIIGIHSRDNDLEVNVLKGKQLTNIRAAGKDEAVKLTPPIRMTLDRALSWIQDDELMEVTPKNIRLRKMYLDANDRKRFEKTKAAL

SEQ ID NO: 62523 - protein, 750 aa, Candida albicans
MRFATAQLAALAYYILSTEATFPLLGDIFNCIPHNTPPVCTDLGLYHDSSISLSGSKNKREAEIVNEDGTIEKRTFGSAGVNAGFNAAFVVSNAKKLSDGSYGIDCNFKSDSSVQLNSAFGKKVKQLSITGTGYSDISLLGNVANPFEWSASLKVKAEIVKGKCCLPSGFRIVTDFESNCPEFDAIKQFFGSSQIIYKVNAVSNAIGTFDASALFNAQVKAFPAKRELDEFEELSNDGVTHSKRTLGLLLGLLKKVTGGCDTLQQFCWDCQCDTPSPSTTTVSTSSAPSTSPESSAPSTTTVTTSSSPVTSPESSVPETTTVTTSSVPETTPESSAPETTTVTTSSVPSTTPESSAPETTPESSAPESSVPESSAPETTPESSAPESSVPESSAPETETETTPTAHLTTTTAQTTTVITVTSCSNNACSKTEVTTGVVVVTSEDTIYTTFCPLTETTPVPSSVDSTSVTSAPETTPESTAPESSAPESSAPESSAPVTETPTGPVSTVTEQSKTIVTITSCSNNACSESKVTTGVVVVTSEDTVYTTFCPLTETTPATESAPESSAPATESVPATESAPVAPESSAPGTETAPATESAPATESSPVAPGTESSPVAPESSAPATESAPATESSPVAPGTETTPATPGAESTPVAPVAPESSAPAVESSPVAPGVETTPVAPVAPSTTAKTSALVSTTEGTIPTTLESVPAIQPSANSSYTIASVSSFEGAGNNMRLTYGAAIIGLAAFLI

SEQ ID NO: 62524 - protein, 764 aa, Bacillus licheniformis ATCC 14580
MGKQRLVLIGNGMAGVRTAEEISLHGGSRFEIVIIGSEPHPGYNRILLSSVLQGETDWNDVMTKSRSWYEENGITLYTGETAVAIDTVNQTVATDQNREIAYDKLIIATGSSPFILPVHGADKEGVYGFRTIDDCRAFINASKRFKKAAVIGGGILGLEAARGLANLGMKVDVVHHSSSIMQTQLDPPASAMLQKELERQGIHFLLEKDTEAILGTSRAEGVRFKDGTKISADLVVMAAGVRPNIELAKASGISTNRAIIVSDYMETNVPNVYAVGECAEHNGTVYGLVKPLYEQGKVLAKHICGLECSGYQGSVQSAALKMSGIDVFSAGKITEDDSTTAIKLLDEAAGVYKKAVFQGDKMAGVILYGDTSGSQRLLESIIKQRDITVVKKELFQSEEDSSVASMAVRETICQCNAVSKGMIMEAIQTHGLKTAEEVKRCTKASGSCGGCRPLVEELLLHTAEHDGHISAAEQPMCACTSFTEDEVVNEIQMRNLSSVHEVISALGWKNSSGCRICVPALHYYLKMIRPDIAYEEHEEETDAIIPQMYGGRTNAEELKRIAGVIEKYQIQEVYMTHHQRLKLAGIKPEHIERVKEELGMPYCLPQQQRIAAVKTCPCGSPQIQTLAADLEKAAESLLIPAKVSIGVSGCLDDCVYASVHDIGLLKVNGGWEIYAGGQGGQHASPGELLSVADSAEEAGELMKGLLQYYRETANYLEKIGHWIERAGIIHIREVLFDNGLRGQLFERLEKEKRLAQQEMIKGLM

SEQ ID NO: 62525 - protein, 235 aa, Oryza sativa
MAAAANGGGAALFSEEELRDVSGVRRCEDFVEVTCGCTSHRYGDAVGRLRVYASGDLEVSCECTPGCREDKLTPSAFEKHSGRQTAGKWRNTVWVMVQGEKVPLSKTALLKYYSLSHKSANGSNKGRNGRLSHRDEFIHCTECGKERRFRLRSKEECRIYHDALAKPNWTCADLTTDRVTCGDEEERASRKVLRGCSRSTSCTGCVKCVCFGCEICRFTDCGCQTCVDFYHNSKE

SEQ ID NO: 62526 - protein, 719 aa, Bacillus licheniformis ATCC 14580
MTERLLKYFRTKQKEVQSEKTYDTQCPFCSMQCKMQLIEQTIVTRKKYTAVGKDNPTTKGRLCMKGMNAHQHAFHSERITHPLIKKNGEFVRVSWEEALQYIKEQVTAIQHEDGRDALSVYGSASITNEEAYLLGKFARVALKTKHIDYNGRLCMSAAATAANQTFGMDRGLTNALSEIPHARVIILAGTNIAECQPTIMPYFEEAKQNRAYIIVIDPRETATAKIADLHLKIKPGTDAALANGMLKIIIEEQLTDGAFIRDRAEGFEEVKRHVASLSLEDISAKTGIQIEQIKKAAVKFAREETGMLFTARGVEQQTDGTAAVRNLLNILISTGKIGKYACGYGAVTGQGNGQGAREHGQKADQLPGYRSIENEADRAYIADVWGIKAEDLPGKGVSAYEMMKKVHEGEITGMFLMCSNPVVSSPTAGFVKSALGKLKFFAAVDLFLSETAILADVVLPASSYLEDEGTMTNLEGRVTLREASKPCPGEARHDWQIICDIAKALGKGRYFSYRSAEDVFNELRKASRGGIADYSGITYERLRKEGGILWPCPEEGHPGTQRLFESSFSHPDKKARMCVVPNEPKVKKDVPTEEYPLILTTGRVMSHYLTGVQTRRSAALKARHFESFMEIHPKTAEKYNIGDRVLVRVESKRGSIIVRSKWSEAIRPDTVFVPIHWADSQNVNDLIAETLDPSCSMPGFKVCSVKIRPSVDNFVNKLS

SEQ ID NO: 62527 - protein, 875 aa, Oceanospirillum sp. MED92
MHKLTTCPYCGVGCGVDAELGEGVVAKVQGDKEHPSNYGRLCVKGSSLHEVLGTNGRLLSPLVDGQRVSWADALDRVAEELLCTIKEHGPDSVAFYLSGQLLTEDYYVANKLIKGFIGTANVDTNSRLCMSSAVAGYKRAFGSDTVPCCYDDLEQTDLLVLVGSNTAWNHPILFQRMQAAKRKNPDLKVVVVDPRRTATCDLADLHLAIKPGTDSELFSGLLSYISSEDLVNRAYVTQFTEGFNEAISAASEQFNSRAELAEYCGIDLATLEQFYQLFSATDKVISFYSQGVNQSSSGTDNSNAIINCHLATGRIGYPGAGPFSITGQPNAMGGREVGGLANQLAAHMDFSSAEAIDRVGRFWDAPNIAQANGLTAVNLFQAVEKGEIKAVWVMGTNPAVSLPNTNQVSRALEECPLVVVSDCMASTETIRYADICLPATGWSEKNGTVTNAERRISRQRGLLPPSGEAKHDWWIISEVAKRMGYAEAFDYQHPYQIFAEHAELSGFENDGKRDFDISLFSDITETAYDALKPVQWPVTNDAPYGTARMFADGRFYTPSGKARFIPVTANKPKQLPTPELPYVMNTGRLRDQWHTMAMTGRTSRLFSHRDEPFVELCQADAQKEGIVEGELVKLSHPQGEYIGRARITDDQRPGELFVPMHWNGEFSAKARMGVLLEPVTDPISGQPESKHGRVAIEALNPKWQGWFICQAEMKPDFPVTYWTRVPKKETEFYYLADTAELDDPLQWCRDKFGEVDIWLEDKAEQSFRAAGLQGEKLQWAFFIMPYGQIPSTGWLEEMFAETELSLDQRRFLLSVTGCEIEDPGSIICSCYQVGSNAIEDAISQGCCSAEALGEKLKCGTNCGSCIPELNALIAK

SEQ ID NO: 62528 - protein, 1227 aa, Coccidioides immitis RS
MAPPTNVSKQISATSTSKKAPTKPTTQNSIAGAKSTGSPETRTSSPEHMESPETPTATTTVNRKKQKRRQKQAARLAAERQSSNMPAQNGDGGHDIVADFSRAATQGQHAAFDNDDLDYTDDETHYSTQGQRGLQHDKNGVLHQSQEPSKRKGKKKKNRKSRSQSHQAEGSSTSMSTPSASLARPVTLPPLSSSAYRSAHKVTKDRIWNTSTHEERERIKEFWLQLGEEERRSLVKVEKEAVLRKMKEQQKHSCSCTVCGRKRTAIEEELEVLYDAYYEELEQYANHKQGSFENGAPIGAPPRLYQPPLRTLDRHSHHPVAQHPSRGRVQELPDDDEDLDDDYDEDDEDDEPYSEDELEDAARTTRADFFAFGNSLTVKDGILTVADDLLKNDGKHFIDMMEQLAERRMQREEDTQYAAASAAHQSMHAGHNHGPPLDEEEYDDEEEEDYDSQDDEEYEEDEMDAMTEEQRMEEGRRMFQIFAARMFEQRVLTAYREKIARERQERLIEELEEENRLDVEREAKKAREAQKRKDKKKLQKQAKEEERAKREAERAAEEAAQKALEEKRLEEQRRKKEEQRKKREAEKKAQEEERQRKEAERQKRLKEERERQAEFERKQREQKEREKKKREEAKKREREEKEAKERELREKKIKEERERREREEKARQEKEAAAKAERESREKAKREEQAAQQAAAQAAAVQAAKRASQSGPTHLPPGLQHPQGPSALQSPHFQVATPVVPKAPTPIRPRQPSQQGSHASSPRSQPAHVDISQTSSLSPGSVSTTIPGKGVSQAPLLHHPQPSAPLSPLGGVGRGSHTLGFSPMQSLNGLPTNPGTIPAMGPRMPMAHDMSMYTNHSGPLGGQYRGFASPDSIPLPPGITGPRHLGQGRGFQMEVGHTSLPFHPQPNAAGPISAAAPQSSQNSGASLTHTRQPSISFERNQHETQPQSQPISRPAPIQRPASTVPHDQHKDESKTNQQEIDELSTQLGSSALLDDSDIPLTAPPSQPLSSALPPGLPGAGRIGFAGPSLFSDHLGSSKPHFSLGAPGSGAGWAHNPFGSPGFPAAPSWGPSSGAGWPTNAFGILGGSHRAHTSRPVAIRLSVIQACKQLNTTSGTDSSGYHNVNQILRQVEQLNSPNESQIGLDEMLDICDTEGNPQNGGGSFIIKNEGPKGTFVKFEPDNNSISSSTRGSVVPGDIGSPVPGSSLPTPGSGSRQFATTNISPTTGF

SEQ ID NO: 62529 - protein, 450 aa, Methanothermobacter thermautotrophicus str. Delta H
MRVVIVGGGAGGLSTASNIRKHDKDADIKVITRDKHVAYSPCAIPYVMCGEVECFDDIVMHRPEDYRERNIDILTETEVEAIDPQKKTVTYRGKDGLREIPYDVLVLATGGSPFIPPVEGTDLEGVFTIRTLTDGERITEWASKSKRAVVVGAGLIGLEIAYGLLRMGLEVTVTEMLPQIVPRSLDPDMAAIVQGYLEEKGIRVILGKALDRIVGDERVEGVVVGDECLEADLVVLATGVRPETKLARMAGCEIGQWAVKVNDRMQTSVPDIYAVGDCVEVYDAVTGFRTQSPLGSTAVRQARVAAKNIVGMDARFRPVLNAMVSKIGELEFGAVGLTEVMALQNGIKVVSGKKRALTKARYYPGAERIDVKMICDLRGRIIGCQMVAKERVAERVDTMSLAISQGLTCSELSETEFSYAPPVSMVIDPIILAAEDACEKLKRVNGRPQD

SEQ ID NO: 62530 - protein, 54 aa, Triticum aestivum
VRQEPYTYKAEEDSTPSGIFARGSYSARLKFVDDDGKVYLDMRYSFEIRKDWPA

SEQ ID NO: 62531 - protein, 464 aa, Mycobacterium smegmatis str. MC2 155
MTHFDVVVLGAGPGGYVAAIRAAQLGLNTAIVEPKYWGGVCLNVGCIPSKALLRNAEIAHMFNKEAKTFGISGEATFDYGAAFDRSRKVADGRVAGVHFLMKKNKITEIHGYGKFTGPNSLEVALNDGGTEKVEFSNAIIATGSSTRLVPGTSLSENVVTYETQILSRELPGSIIIAGAGAIGMEFAYVLKNYGVDVTIVEFLPRALPNEDAEVSKEIEKQYKKLGVKILTGTKVEGIADDGSTVKVTVSKDGKTEELKADKVLQAIGFAPNVEGYGLEAAGVELTDRKAIGIDDYMRTNVGHIYAIGDVTGKLQLAHVAEAMAVVAAETIAGAETLPLGDYRMMPRATFCQPQVASFGLTEEQARDEGYDVKVAKFPFTANGKAHGLADPTGFVKLIADAKYGELLGGHLIGPDVSELLPELTLAQKWDLTVNELARNVHTHPTLSEALQECFHGLAGHMINF

SEQ ID NO: 62532 - protein, 806 aa, Bacillus licheniformis ATCC 14580
MKKKQLVLVGNGMAGVRAIEEILKISNEEFQITIFGSEPHPNYNRILLSKVLQGDTDVKDITLNDWDWYEENGIQLYTGEEVVKVDPESKTVITDTGRVQPYDELILATGSLPFILPLPGADKEGVTAFRDIKDTDIMLEASKTYKKAAVIGGGLLGLEAARGLLNLGMDVTVVHLAPYLMERQLDAAAGRLLQKELEKQGMKFLLEKQTEEIYGETRVEGLKFKDGSTLEADLVVMAVGIKPNVQLGKDCGLPVNRGIVVNDYMETEVPNIYAVGECAEHRGIAYGLVAPLYEQAKVLAKKICGVETAPYEGSVLSTQLKVSGVEVFSAGDFNEDDGEDKKALKVFDEQDGIYKKIVLRGNQVIGAVLFGDSSEGNRLFSMIQKGADISDTSKISILQPLNQEEGMSLTAAMSDDEIVCGCNGVSKGMIIQAIKEQGCTSTDEIKACTGASRSCGGCKPLVAEILQHTLGSEFDASAQKEAICGCTDLSRDELVAEIREKGLTHTKEVMNVLGWKTAEGCSKCRPALNYYLGMINPKEYEDERESRFVNERMHANIQKDGTYSVVPRMYGGVTNSNDLRRIADVVDKYEIPLVKMTGGQRIDLIGVKKEDLPKVWADLDMPSGFAYGKTLRTVKTCVGEQFCRFGTQDSMALGIDLEKKFEGLYTPHKIKMAVSACPRNCAESGIKDIGVVGIDGGWEIYVGGNGGTHLRAGDLLMKVKTAEEVIEITGAYLQYYRETANYLERTSAWIERVGLSHVQSVLNDKEKRKELNDRINQALSVHKDPWKDFLEDGKTTRQLFENVVTS

SEQ ID NO: 62533 - protein, 695 aa, Streptomyces coelicolor A3(2)
MSTKPTTTDLEWTELDQRAVDTARVLAADAVQKVGNGHPGTAMSLAPAAYTLFQKVMRHDPADANWVGRDRFVLSAGHSSLTLYTQLYLAGFGLELADLESFRTWGSKTPGHPEYGHTTGVETTTGPLGQGVANAVGMAMAARYERGLFDPEAAEGESPFDHFVYCIAGDGCLQEGISSEASSTAGHQKLGNLVLLWDDNHISIEGDTETAVSEDTCKRYEAYGWHVQRVAPKPDGDLDPNAIYDAIEAAKKVTDRPSFIAMRSIIAWPAPNAQNTEAAHGSALGDDEVAATKRVLGFDPEKSFEVSDEVIEHTRKALEKGQAARAVWEKSFQQWRDNNPERAAEYDRVAKGELPAGWEEKIPVFEAGKGLATRAASGKVLQALGAVIPELWGGSADLAGSNNTTIDKTSSFLPAGNPLPEADPYGRTIHFGIREHAMAAEMNGIALHGNTRIYGGTFLVFSDYMRNAVRLSALMHLPVTYVWTHDSIGLGEDGPTHQPVEHLASLRAIPGLNVVRPADANETAIAWREILRRWTKEFGKGQPHGLALTRQGVPTYEPNEDAAKGGYVLFEAEGGDAEVVLIATGSEVHVAVGARERLQADGVPTRVVSMPSVEWFEQQDQGYRDSVLPPSVKARVAVEAGIGLTWHKYVGDAGRIVSLEHFGASADAKVLFKEFGFTAENVASAARESLAAAQR

SEQ ID NO: 62534 - protein, 386 aa, Triticum aestivum
MEVEIPTEHRAPKVEASAWRWRDLPGAAAKPLRDPLLAVNFLLLAVGAACGPLLLRLYFLRGGSRKWLSSLLQTAGWPLLLVPLCFSFSSRRRRSRRSRQGEDATASGGVFLMTPRLLAASAVVGLMTGADNFLYAYGQAYLPVSTSSILISTQLAFTAAFALLLVRQRFTGSTVNAIVLLSVGAAMLGMGSGGDRPAGVSGAQYAAGFGMALGAAALYGLVLPVMELSQAWHAARAGAAALTYTLVVEIQVIIGVTATAFCAVGMLANNDFQAIPGEARQSELGQAGYYLLLVGTAAVYQCFCLGIIGAIYYGSALLAGVIITVLLPVTEVLAVVFFHEPFSGTKGVALGLSLWGLASYFYGEVRNKAPEAEHRTSLCVDRDCEN

SEQ ID NO: 62535 - protein, 470 aa, Bordetella parapertussis 12822
MPCAPMPNPELAVRPHRYLVHLRRLARRKLRQMRRVSHRTLSVSLLLGGAALVALVSLGFTQLADLALHWNRQWTAAHGWLALIVTPCALAVLCWLTLRLAPYASGSGIPQVIAGLSLPPGGAQQRLVSLVQALWKIPLTFLAMLAGASVGREGPSVQVGAALMLAWGQLWRRLGVPLRGFHSQELIAAGAAGGLAAAFNAPLAGVIFAIEELGRGTVLRWQRLVLIGVLAAGFLVAAIAGNNPYLGTFAGQALAHNMLWWTLVCCVVNGILGGVFARLLGKGAAGAAPQRWRERVRRHPVATAFGLGLALACLGLLTGGAVYGTGYGQAAALLSGHDGVPDGFGLAKLAATVASYWADIPGGIFTPALTTGAGIGEQISHWAGPGVDTRVLVLVSMAAFLAAATQAPLTASVVVMEMTGSQPMLFWLLVGALGASVVSRQFCPRPFYHLAAGRFRRTAVVEAGRKASTE

SEQ ID NO: 62536 - protein, 551 aa, Streptomyces coelicolor A3(2)
MNADGRTRLHQTPEWAALVKHREQLGEVRLREMFAADPGRGTGWTLRVGDLHVDYSKHLVTDETLALLQELAAATGVSGLRDAMFRGERINITEDRAVLHTALRAPRDAVIEVDGENVVPQVHAVLDKMAGFADRVRTGEWTGHTGRRIRNVVNIGIGGSDLGPAMAYEALRAFTDRSLTLRFVSNVDGADLHEAVRDLDPAETLFIIASKTFTTIETITNATSARSWLLAGLGGDEKAVAKHFVALSTNAEKVADFGIDTANMFEFWDWVGGRYSFDSAIGLSLMIAIGPDRFREMLDGFHLVDEHFRTAPAESNVPLLMGLLGVWYGSFLGAQSHAVLPYSHYLSKFTAYLQQLDMESNGKSVDREGKPVQWQTGPVVWGTPGTNGQHAYYQLIHQGTKLIPADFIGFARPVDELSEELKSQHDLLMANFFAQTQALAFGKTPDEVRAEGVPEELVPHKTFPGDHPTTTILARELTPSVLGQLVALYEHKVFVQGAIWNIDSFDQWGVELGKVLAKRVEPALTEGADVPGLDPSTGALVAAYRELRGRR

SEQ ID NO: 62537 - protein, 408 aa, Rhizobium leguminosarum bv. viciae 3841
MSVMDEIVVTKPQARTSASLEKPSLIGMSREEMGAALREKGVAEKQIKMRVSQLWNWIYVRGVSDFDHMTNVAKDMREMLKQHFTIARPEIVEEQVSNDGTRKWLLRFPPRGAGRPVEIEAVYIPEEGRGTLCISSQVGCTLTCSFCHTGTQRLVRNLTAEEILSQLLLARDRLGDFPDREAPQGTIMPAEGRKVSNIVMMGMGEPLYNFDAVKQALLIATDGDGLSLSRRRVTLSTSGVVPEIFRTGEEIGVMLAISLHAVRDDLRDLLVPINKKYPLKELIEACRTYPGLSNARRITFEYVMLKDVNDSLEDAKGLIKLLKGVPAKINLIPFNPWPGTNYQCSDWEQIEKFADFINSAGYASPIRTPRGRDILAACGQLKSESERMRKTERLAFEAMMIANHGADD

SEQ ID NO: 62538 - protein, 614 aa, Erythrobacter sp. NAP1
MSKAPSSLRNVAIIAHVDHGKTTLVDQLFRQSGTFRENQRVEERAMDSGDLEKERGITILAKCTSVEWEAPDGEVTRINIVDTPGHADFGAEVERILSMVDGVILLVDSAEGAMPQTKFVTGKALALGLKPIVVVNKIDRPDGRPQEVLDEVFDLFASLDANDEQLDFPSLWASGRDGYASNDETAREGDLQPLFQLIVDHVPEPGLEEDAPFSFLATLLDRDNFMGRVITGRVQSGTLKINDPIHAIDIAGNVVETGRATKLLSFRGLERVPVESAKAGDIIALAGLEKATVANTICDPSVTEPIAAQEIDPPTLAMQFSVNDSPLAGREGDKVTSRMIRDRLLREAETNVAIRVTESDQKDAFEVAGRGELQLGVLIETMRREGFELGISRPKVLFREEDGQRTEPYETVVIDVDDEHSGTVVEKMQKRKADLTEMRPSGIGKTRITFSAPSRGLIGYHGEFLSDTRGTGIMNRLFEKYGPYKGQIDGRNNGVLISNGDGESNAYALNMLEERGELFVAPQMKLYEGMIIGENAKPDDLEVNPMKAKQLTNIRSSGKDDSIRLTPPRRMTLEQSIAYIDDDEMVEVTPKSIRLRKTLLCPHERKKAKRSKAG

SEQ ID NO: 62539 - protein, 577 aa, Streptococcus agalactiae NEM316
MTEMLKGIAASDGVAVARAYLLVQPDLSFETVTVEDTNAEEARLDVALQASQDELSVIREKAVESLGEEAAAVFDAHLMVLSDPEMINQIKETIRAKQVNAETGLKEVTDMFITIFEGMEDNPYMQERAADIRDVAKRVLAHLLGVKLPNPATINEESIVIAHDLTPSDTAQLNKQFVKAFVTNIGGRTSHSAIMARTLEIAAVLGTNDITERVQDGQLIAVNGITGEVIIEPTEAQISAFKAAGEAYAKQKAEWALLKDAQTVTADGKHFELAANIGTPKDVEGVNENGAEAVGLYRTEFLYMDSQDFPTEDEQYEAYKAVLEGMNGKPVVVRTMDIGGDKELPYFDLPKEMNPFLGFRALRISISETGDAMFRTQIRALLRASVHGQLRIMFPMVALLKEFRAAKAIFEEEKANLLADGVAVAEGIEVGIMIEIPAAAMLADQFAKEVDFFSIGTNDLIQYTMAADRMNEQVSYLYQPYNPSILRLINNVIKAAHAEGKWAGMCGEMAGDQTAVPLLVGMGLDEFSMSATSVLRTRSLMKKLDTAKMEEYANRALSECSTMEEVIELQKEYVDFD

SEQ ID NO: 62540 - protein, 475 aa, Streptococcus agalactiae NEM316
MTKEYQNYVNGEWKSSVNQIEILSPIDDSSLGFVPAMTREEVDHAMKAGREALPAWAALTVYERAQYLHKAADIIERDKEEIATVLAKEISKAYNASVTEVVRTADLIRYAAEEGIRLSTSADEGGKMDASTGHKLAVIRRQPVGIVLAIAPYNYPVNLSGSKIAPALIGGNVVMFKPPTQGSVSGLVLAKAFAEAGLPAGVFNTITGRGSEIGDYIVEHEEVNFINFTGSTPVGQRIGKLAGMRPIMLELGGKDAGIVLADADLDNAAKQIVAGAYDYSGQRCTAIKRVLVVEEVANELAEKISENVAKLSVGDPFDNATVTPVIDDNSADFIESLVVDARQKGAKELNEFKRDGRLLTPGLFDHVTLDMKLAWEEPFGPILPIIRVKDADEAVAIANKSDFGLQSSVFTRDFQKAFDIANKLEVGTVHINNKTGRGPDNFPFLGLKGSGAGVQGIRYSIEAMTNVKSIVFDMK

SEQ ID NO: 62541 - protein, 478 aa, Mesorhizobium loti MAFF303099
MMPPAKKEVRPSSRGGRARTPAFVKNLRGVKNWKEVSEWLEWRGIEDIECITPDQAGVARGKMMPSKKFTSNTSLALPSAVFMTTISGGYPEDGNGFHYPEDDGDLKLMPDLSTLTVVPWEEDPTAAVICDLVHQDGRSVEFTPRNVLKRVLAAYDKLGLRPVVAPEIEFYLVRKNPDPDYPLTPPVGRSGRAIGGGAGYSIAGVNEFDELIDDIYHFSESQGLEIDTLIHEEGAGQLEINLRHGDPIELADQVFMFKRTIREAALKHEIYATFMAKPIQGQPGSAMHIHQSIIDKKTGKNIFSAEDGSETEAFFHFIGGMQKHVPNALVMFAPYVNSYRRLTQAASAPVNNKWGYDNRTTAFRVPRSDPAARRVENRIPSSDANPYLALAASLACGLIGITRKIKAEPPVLTTANADEIDLPRSLLEAVDLFEGDEELCALLGKSFAATYAAIKRAEFETFMEVISPWEREYLLLNV

SEQ ID NO: 62542 - protein, 479 aa, Oryza sativa (japonica cultivar-group)
MNVLASKIFPSRSNVASEQQQSKREKATIDDAKNSSKNKNLDRSVDESVLGIILGGGAGTRLYPLTKKRAKPAVPLGANYRLIDIPVSNCLNSNISKIYVLTQFNSASLNRHLSRAYGNNIGGYKNEGFVEVLAAQQSPDNPNWFQGTADAVRQYLWLFEEHNVMEFLILAGDHLYRMDYEKFIQAHRETDSDITVAALPMDEKRATAFGLMKIDEEGRIVEFAEKPKGEQLKAMMVDTTILGLDDVRAKEMPYIASMGIYVISKNVMLQLLREQFPGANDFGSEVIPGATNIGMRVQAYLYDGYWEDIGTIEAFYNANLGITKKPVPDFSFYDRSAPIYTQPRHLPPSKVLDADVTDSVIGEGCVIKNCKIHHSVVGLRSCISEGAIIEDSLLMGADYYETEADKKLLGEKGGIPIGIGKNCHIRRAIIDKNARIGDNVKIINVDNVQEAARETDGYFIKSGIVTVIKDALLPSGTVI

SEQ ID NO: 62543 - protein, 608 aa, Bradyrhizobium sp. BTAi1
MNLRNIAIIAHVDHGKTTLVDRLLQQSGTFRENQKVAERAMDSNDLERERGITILAKAASVQWKDTRINIVDTPGHADFGGEVERILNMVDGALVLVDAAEGPLPQTKFVVSKALKVGLKPIVVINKVDRPDARPTEVINEVFDLFAALDASEEQLDFPILYGSAKQGWMADSPEGPQDRGMEPLFELVLRHVPPPKTEEGPFRMIGTIIEANPYLGRIITGRITSGTLKPNQQVKVLAADGKMIEQGRITKILAFRGLERTPLDDAEAGDIVAIAGLTKGTVADTFCDPSVETPLPAQPIDPPTVSMSFIVNNSPLAGTEGDKVTSRMIRDRLLREAEGNVALRVREADDKDAMEVSGRGELQLAILIETMRREGFELSVSRPRVVFQKDPATGQTLEPIEEVVIDVDEEHSGVVVQKMSERRAELIEMKPSGGNRQRLVFYAPTRGLIGYQGELLTDTRGTAIMNRLFHNYAPYKGEIQGRRNGVLISNDQGEAVAYAMFKLEDRGPMMIEPGWKVYRGMIVGEHTRDNDLEINVLKGKQLTNIRTTSKDEAVRLTPPIKMTLEKALAYIEDDELVEVTPKSIRLRKKHLDPNERKRAEKQKEAVA

SEQ ID NO: 62544 - protein, 343 aa, Coccidioides immitis RS
MDQQPTPSPRLGILHHYLDKLCAFEHGGSTPELKPHTLLFIAGLSDGLGTVPFINDIAKALEPTKWSVFSVLLSSSYSGWGMSTLDRDIEEIGSCVAYVRRYKGGRGHDKPGMIALMGHSTGSQDVLHYLYSPNPLQAGSGLKRQPVDGAILQAPVSDREYLLQTLGTGSATSEALTKVYNELVALAKANVAAGNMDTALPLAATAQLGYPHDVPLSSHRFLSITSPDSPESPLEDDLFSSDLNDDRLLQTFGAIGSRGMLKGSLLVLPGEEDEYVPMWVNKEMLLERWENATKQGAGGRDIWDTTSGLVAGAFHSPSGRTQEEPRKELVSRVERYLNKMEKL

SEQ ID NO: 62545 - protein, 136 aa, Bradyrhizobium sp. BTAi1
MMTTWPDDDVILYDGICVFCSRWVQFVIARDAAKRFRFTPIQSPYGTRLAQAFGIDPKEPDTNAVVHGGRAHLKSDAALTVLSNLPGWGWTRALFAVPKPLRNAVYSVVARNRYRIFGKYDSCFVPDAELRRRVLE

SEQ ID NO: 62546 - protein, 289 aa, Coxiella burnetii RSA 493
MFNGSLVALVTPMQENGEIDYSNLKELVEWHLENDTDGLVILGTTGESPTITAEERHKIIRQVVDQVNKKIPIIVGTGANSTVHTIEMTQQAMELGADAALIVTPYYNKPTQEGLFQYFKTIAEAVPIAQILYNVPSRTACDLLPETVIRIAKCSNVVGLKEATGDIQRVKQLKAEDLDLLSGDDKTAMDFMLAGGKGVISVVANVVPKPYHAFCITAVSGNVELAKKENDQLSPLYDSLFVESNPIPVKWALSQMGVIPKGIRLPLTPLSERYHAKVRESLQQVGIKC

SEQ ID NO: 62547 - protein, 556 aa, Burkholderia sp. 383
MTQMFEAGLGRRDANYVPLTPIDFLVRTAEVYGDRLAIVHGDVRRTWGETCTRAKQLASALARLGIERGDTVAAMLPNIPAMVEAHFGVPMAGAVLNTINTRLDVSSVLFMLRHGEAKVLIVDTEYAEFAHRAALEVPGLKIVSVADAMPADPARFAGATDYEALVASGDAGYAWTPPADEWEAIALNYTSGTTGDPKGVVYHHRGAYLAAISNILEWDMPKHAVYLWTLPMFHCNGWCFPWAVAARAGVNVCLRKFDAKTVFDLIRRERITHYCGAPIVQSAIANAPAEFREGIDHTVHAMVAGAAPAPAVIAKMKEIGFDLLHVYGLTEVYGPATVCAKQSHWEELSDEDRARLNARQGVRYHLEAGATVLDPDTMAPVPADGETLGEIMFRGNICMKGYLKNPKATDEAFHGGWFHTGDLAVLMPDGYIRIKDRKKDIIISGGENISSIEVEDALYRHPAVAVAAVVAMPDPKWGEVPCAFVELREGASVTEEEIVAHCKALLAGFKVPKAVRFGELPKTSTGKIQKFQLRNAVGSDKAIDLAGDNVPGKKAQ

SEQ ID NO: 62548 - protein, 355 aa, Oryza sativa (japonica cultivar-group)
MAALAQLAGAAVRVALAALLALLLPAYRVYRLTASFLGALLAAAADDDVAGKVVLITGASSGIGEHLAYEYARRGAYLALVARREESLREVGDAALAAGSPGVLVVAGDVSSPDDCRKFVDDTIRYFGRLDHLVNNASIWQVGKFEELTDVNHFRKLMDINFWGHVYPTRHAIPHLKKTRGRIVGVTSNSSYIFMPRNTFYNASKAAAANLYETLRMELAGDGIAITEVIPGVVESEITKGKMLTKEGDMRVDQDERDAILGAAPVERAGEFARAAVRGVCGGERYVFEPRWYRAAYTLRVCFPEALEWCARLLTVWRLGPATTDTVGRWLLLGVPGQRWLSQPASLRSPEIKAR

SEQ ID NO: 62549 - protein, 168 aa, Glycine max
  misc_feature (156)..(156): Xaa can be any naturally occurring amino acid
  misc_feature (162)..(162): Xaa can be any naturally occurring amino acid
MGKGSFQDSVKALEADIQYANTLALGYPRDKDGGCFQMRISYSPAAPLFLFLVQWTDYRLAGALGLLRILIYVTYGNGKNTMSIYERKASIRQFYSIIFPALLQLEKGITDLEERKQKEVYALRYQRKSEFNERRQSEIDIEREEECGVCLEVKAXVVLPNXCHYMCL

SEQ ID NO: 62550 - protein, 488 aa, Artemisia annua
MALSLTTSIALATILLFVYKFATRSKSTKKSLPEPWRLPIIGHMHHLIGTTPHRGVRDLARKYGSLMHLQLGEVPTIVVSSPKWAKEILTTYDISFANRPETLTGEIVLYHNTDVVLAPYGEYWRQLRKICTLELLSVKKVKSFQSLREEECWNLVQEIKASGSGRPVNLSENVFKLIATILSRAAFGKGIKDQKELTEIVKEILRQTGGFDVADIFPSKKFLHHLSGKRARLTSLRKKIDNLIDNLVAEHTVNTSSKTNETLLDVLLRLKDSAEFPLTSDNIKAIILDMFGAGTDTSSSTIEWAISELIKCPKAMEKVQAELRKALNGKEKIHEEDIQELSYLNMVIKETLRLHPPLPLVLPRECRQPVNLAGYNIPNKTKLIVNVFAINRDPEYWKDAEAFIPERFENSSATVMGAEYEYLPFGAGRRMCPGAALGLANVQLPLANILYHFNWKLPNDVSYDQIDMTESSGATMQRKTELLLVPSF

SEQ ID NO: 62551 - protein, 258 aa, Streptomyces coelicolor A3(2)
MTTRTPLMAGNWKMNLNHLEAIAHVQKLAFALADKDYDAVEVAVLAPFTDLRSVQTLVDGDKLKIKYGAQDISAHDGGAYTGEISGPMLAKLKCTYVAVGHSERRQYHAETDEIVNAKVKAAYKHGLTPILCVGEELDVREAGNHVEHTLAQVEGGLKDLAAEQAESVVIAYEPVWAIGTGKVCGADDAQEVCAAIRGKLAELYSQELADKVRIQYGGSVKSGNVAEIMAKPDIDGALVGGASLDSDEFVKIVRFRDQ

SEQ ID NO: 62552 - protein, 403 aa, Streptomyces coelicolor A3(2)
MKTIDELLSEGVAGKRVFVRADLNVPLDGTTITDDGRIRAVVPTVKALADAGARVIVASHLGRPKGAPDPAFSLAPAAARLGELLGADVAFAEDTVGSSAEAVVTGLADGGVAVIENLRFNAGETSKDDAERAAFADKLAGLADVYVGDGFGAVHRKHASVFDLPKRLPHYAGYLIATEVGVLKKLTDEVKRPYVVALGGAKVSDKLAVIDQLLGKADRLLIGGGMAYTFLKAKGYEVGISLLQEDQIPAVKEYIERAEKNGVELVLPVDVLVAPEFPDLKTKAPANPTTVAADAIPADQEGLDIGPETRKLYASKLADAGTVFWNGPMGVFEHPDYAEGTKAVAQALVDAPGFTVVGGGDSAAAVRTLGFDENAFGHISTGGGASLEYLEGKTLPGLAALED

SEQ ID NO: 62553 - protein, 336 aa, Streptomyces coelicolor A3(2)
MTIRVGINGFGRIGRNYFRALLEQGADIEIVAVNDLGDTATTAHLLKYDTILGRLKAEVSHTEDTITVDGKTIKVLSERNPADIPWGELGVDIVIESTGIFTKKADAEKHIAGGAKKVLISAPAKDEDITIVMGVNQDKYDPANHHVISNASCTTNCVAPMAKVLDENFGIVKGLMTTVHAYTNDQRILDFPHKDLRRARAAAENIIPTTTGAAKATALVLPQLKGKLDGIAMRVPVPTGSATDLVVELQREVTKDEVNAAFKKAADDGDLKGILFYTEDAIVSSDITGDPASCTFDSSLTMVQEGKSVKILGWYDNEWGYSNRLVDLTVFVGNQL

SEQ ID NO: 62554 - protein, 435 aa, Rickettsia sibirica 246
MTNENNNDSEFAELKIRGKIFKLPILKASIGEDVIDISRVSAEADCFTYDPGFMSTASCQSTITYIDGDKGILRHRGYDIKDLAEKSDFLEVAYLLIYGELPSGEQYNNFTKQVAHHSLVNERLHYLFQTFCSSSHPMAIMLAAVGSLSAFYPDLLNFKEADYELTAIRMIAKIPTIAAMSYKYSIGQPFIYPDNSLDFTENFLHMMFATPCTKYTVNPIIKNALNKIFILHADHEQNASTSTVRIAGSSGANPFACISTGIASLWGPAHGGANEAVINMLKEIGSSEYIPKYIAKAKDKNDPFRLMGFGHRVYKNYDPRAAVLKETCKEVLKELGQLDNNPLLQIAIELEAIALKDEYFIERKLYPNVDFYSGIIYKAMGIPSQMFTVLFAIARTVGWMAQWKEMHEDPEQKISRPRQLYTGYVHREYKGIRER

SEQ ID NO: 62555 - protein, 1273 aa, Bordetella parapertussis 12822
MASTTLGVKVDDALRDRLKAAAQKLNCTPHWLHKQAILSYLDRIERGHLPAEMAHLGSDERGEDEDAGASADAMPPFFEFGQDVQPQSVLRAAITAAYRRPEPECVPLLLGQARVAGPEKVHAMASKLVHALRAKRSGGGVEGLIQEFSLSSQEGVALMCLAEALLRIPDRATRDALIRDKIAHGDWRSHMGGSQSLFVNAATWGLMITGKLVAVSSEQSLSKALTRLIGKGGEPLVRKGVNMAMRMMGEQFVSGQTISEALANNRKMEARGFRYSYDMLGEAATTAADAERYYAAYEQAIHAIGKAAAGRGIYEGPGISIKLSALHPRYARAQRDRVMAELLPRVKALTLLARQYDIGLNIDAEEADRLEISLDLLEALCFVPELDGWNGIGFVIQAYQKRAPFVIDYVIDLAKRSRHRLMVRLVKGAYWDTEIKRAQVDGLEGYPVYTRKVYTDVAYLACARRLLAAPEATYPQFATHNAYTLSAIYQMAGQNYYPGQYEFQCLHGMGEPLYEEVVGPLAQGKLNRPCRIYAPVGTHETLLAYLVRRLLENGANTSFVNLIGDDSITVEQLVADPIEAASRIVPLGAPHEKIPLPRELYGSVQQGARANSAGLDLTNEHRLGSLSAALLASAAIDWRAWPMLGEGDPGWDPAGAVEVANPANLRDIVGHVMQATPQHVEQALRDAANAAPIWQSTPVPERAQCLRRAAQLLEEQMQTLLGLIVREAGKSLPNAIAEVREAVDFLRYYADQAEREFDNDTHRPLGQVLCISPWNFPLAIFTGQVAAALAAGNTVLAKPAEQTSLIAGQAVAILRAAGVPAGAVQLLPGRGETVGAQLVASPQVRGVMFTGSTEVARIIAGALAERLDDQGHTIPLIAETGGQNAMVIDSSALAEQVVFDVLTSAFDSAGQRCSALRVLCLQEDSADHVLAMLRGAMRELRVGNPDRLSVDVGPVIDAEARNGIQGHIEAMRSSGRPVDQVELAGECRYGTFVPPTLIEIDHIGELTREVFGPVLHVLRYRRDDLDGLIEQINATGYGLTFGVHTRIDETIARVTEQVHAGNLYVNRNIVGAVVGVQPFGGEGLSGTGPKAGGPLYMYRLLATRPAGLPPALDPAAPMPQALALPGPTGETNTYRVEPRGAVYCVAATEAGARAQWAVVSQTGNHAWFADTPAARAWIDGLDARLREQAALLEDSELDEADFQAVLFEGDGDALRALNMRIAQRPGPLVSVHGLSADALAAGASYAPDRLLAERSISVNTAAAGGNASLMTIG

SEQ ID NO: 62556 - protein, 230 aa, Xanthomonas axonopodis pv. citri str. 306
MTNLDSPITNPELLPMSEAKRLAAEKAIDYVEDGMIVGVGTGSTVAYFIDALGRIGHRIKGAVSSSEQSTARLRQHGIEVLDLNHTGNLSLYVDGADECDPNRCLIKGGGAALTREKIIAEASERFICIVDPSKQVPVLGKFPLPVEVIPMARSLVARQILALTGGQPVWRDGVVTDNGNVVLDVHHLQVTDPVGLERSLNQIPGVVCVGLFARRPADVVIVGGEPPQVI

SEQ ID NO: 62557 - protein, 325 aa, Zea mays
  misc_feature (130)..(130): Xaa can be any naturally occurring amino acid
LDAPVRLHPSLPPPSSFLRLFRLLHAAYATSPSPPAVRPDPSPRPHLAEDWIAGGVSPEEEESGGSDSDSGHAAFLEDFSSRIWITYRKGFDAIPGSKLTSDVNWGCMVRSSQMLVAQALIFHHLEASWXVVCIDVAAQLCSDFNKGPSTWSPILLLVPLVLGLDKINPRYIPLLKETFMFPQSLGILGGKPGTSTYIAGVQDDRALYLDPHEVQMTVDIALDNLEADTSSYHCSVVRALALEQIDPSLAIGFYCRDKDDFDDFCSRASELAEKANGAPLFTVVQSIEPSKQMYKQDDGLGCSGSSMANDDDLDGSGEAEEWQIL

SEQ ID NO: 62558 - protein, 604 aa, Salinibacter ruber DSM 13855
MPDLSTIRNFCIIAHIDHGKSTLADRLLERTGTITEREMKEQTLDDMDLERERGITIKSHAVRMAHTAPDGQEYTLNLIDTPGHVDFTYEVSRALKACEGAILLVDAAQGIEAQTISNLWLALEQDLEIIPVINKIDLPVARPDEVAQALEDLIGEPAEDILQISAKTGEGVDEMLDLMIDRVPPPSGDPDAPLRALIFDSIYDSYRGSVVYARVFDGTLEAGDTMEFMSNKKQYDAEEMGILRMGRQKVDTFTAGDVGYIIGSIKDIQDARVGDTITTAHDPAEEPIPGFEEVKPMVFSGIYPTETDDFEELRGALEKLQLNDASLTYQAESSSALGYGFRVGFLGLLHMEIIQERLEREFDLDIITTVPNVEYEVEVEEKGEPKTVTVDKPEDMPHYGDIEAVHEPYVKADIITPSDYIGNVIELCEKRRGEYGSQRWLDGQTVKLEYELPLAEIVFDFYDNLKSASRGYASFDYELLEYRESDLVKLTILIDEKPAEPLSTIVHRDSAHEVGRKLAKKLKDVIPRQLYEVPVQASIGSRIVARETIKAQRKDVTAKCYGGDVSRKKKLLEEQKEGKKRMKQMGEIDVPQEAFLAILSVDED

SEQ ID NO: 62559 - protein, 511 aa, Torenia hybrid cultivar
MTVATTLVVVLSRELLLYVLVVYILVSKSLSTIIVVSRKRLPPGPTGFPVVGALPLLGSMPHVALAKMAKKYGPVMYLKTGTLGMVVASTPSSARAFLKTLDSNFSNRPANAGATHLAYGAQDMVFAPYGPRWRLLRRLSNLHMLGGKALDGWANVRASELGHMLEAMNRASREGEVVVVPEMLVYAMANMIGQVILSRRVFVTKGEEVNEFKDMVVELMTSAGYFNIGDFVPILAWMDLQGIERGMKALHKKFDKLITRMLEQHEASAHKPDFLDAIIAASLDDYSSEEERLSTSNIKALLLNLFTAGTDTSSSTIEWALSEMLKKGKILKRAQEEMDRVVGRERRLVESDIEKLGYLKAICKETFRKHPSTPLNLPRISSEACVVNGHYIPKGTRLSVNIWAIGRDPEVWEDPLEFNPDRFLHSKMDPRGNDFELMPFGAGRRICAGTRMGIVLVEYILATLVHSFDWKAADQDNNIMNMEEAFGIALQKATPLKALVTPRLPLHCYLP

SEQ ID NO: 62560 - protein, 460 aa, Bradyrhizobium sp. BTAi1
MSTAEIHYLPQARAPLVPPMPPRAPDSMGAFRRVLLMGENAIATWSQRAYEDEIVRGRFFGSSSYILNTPDTIKHVLVDNWENYVRTDGAIRVLRPVLGEGLLIAEGRAWKHQRRTLAPAFTPRAVAGLIPHMIAVTDDTVTRLKQQCDAPVDLREIMQRMTLDIAGRTMFSFEMGRHGATLRDFVFEYGARLASPHLLDIVLPLSWPTPRDIARRRFRKRWTAFVTLLMAERRAAGKLDDAPPRDLFDLMGAARDPETGAAFTDAQLADEVATMILAGHETTATALFWALYLIALDPASQSKLAQEAGAASDLGDPDRLPFTRAVIDETLRLYPPAFLIARAASGPDRLADFPVKRGDVVLISPWLLHRHEKLWRAPNAFMPERFLPGAAPPERFAYLPFGAGARVCIGAHFALVEAVLALARLVGAFKIELIDRAPVMPIGVVTTQPDRSPLFRITPR

SEQ ID NO: 62561 - protein, 375 aa, Linum usitatissimum
MERKFSPFVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYMFTTTAEREIVRDMKEKLAYVALDYEQELETAKSSSSVEKNYELPDGQVITIGAERFRCPEVLFQPSLIGMEAAGIHETTYNSIIKCDVDIRKDLYGNIVLSGGSTMFPGIADRMSKEITALAPSSMKIKVVAPPERKYSVWIGGSILASLSTFQQMWISKSEYDESGPSIVHRKCF

SEQ ID NO: 62562 - protein, 186 aa, Xanthomonas campestris pv. vesicatoria str. 85-10
MTDCSRCAGTTTSGPNHWSERIRDIADFPKQGIVFKDITPLLSDGPDFASALDEMAQPWRTTPLDAVLGIEARGFILGAALARELRTGFVPVRKPGKLPGRTLIQEYALEYGTDRIEMHEDALPRGARVLIVDDVLATGGTLRAALGLAAQLELEVVGAAVLVELQVLQGRQKWANDVPLLATLSY

SEQ ID NO: 62563 - protein, 521 aa, Stylosanthes guianensis
MDFLSLPTIFLVTLALVLIYNTWKINKSVDESNKNLQQAPKLPESLPLIGHLLLLGAKTPLAKILASFADNHGPIFRIRLGAYPALVISNKKAIKKCFTTNDVVLASRPKSSHGIHLGYNFAGFGFAPYGPYWTKLRKLAMLELLSPRRIESLRDVYESEIDTMINDLLSYLGGDSGVKVVISEWLERLTFNIIIKMIAGKRYFSYLKDADDEESNRIVKLIKEFMHISGELVPSDLIPIVGWVPIQGQVLKNMKRIAKDLDAIVGSWVEEHDVKSDEDQKNKNNSSSSEKQYFIDFMLSVIEDDPTSGHTRDNIIKANIMNLMLAGSDTTSTTMTWILSMLLTNKHALKRAQEEIDLRVGKDKSVKASDIKNLVYLQAIFKETLRLYPPGPLLVPHEAREDCYIQGYYVPKGTRVFANVWKLHRDPSIWSEPEKFSPERFINGNGELNEDHNFEYLPFGSGRRACPESTFAIQVSFITLALLLQKFDLDVPMCETVDLREGLGITLPKLTPLQITLTSRI

SEQ ID NO: 62564 - protein, 121 aa, Legionella pneumophila subsp. pneumophila str. Philadelphia 1
MTNIIDQINAEQMQGKEIPDFNPGDTVLVQVKVIEGNRERLQAFEGVVIAKRNRGLNSAFTVRKISHNVGVERVFQTYSPIVDSITVKRRGDVRRAKLYYLRNLAGRAARIKEKLSGKKGD

SEQ ID NO: 62565 - protein, 433 aa, Mucor circinelloides f. lusitanicus
MLTDLETVVINPPYNVGALFKSAPSSPDISVHNRSVSEVFQQRLESITNQKWESDQENAFFVGDLGEVVRQHIRWKSLLPRIEPFYAIKCNPDPMVVQLLASLGCGFDCASKQEIQQVLDVGVDPSRIIYANPCKQASFIRYSAQQNVSRMTFDNAEELFKIKKYYPDAELVLRILTDDSMSLCQLGLKFGAPLHTVQHLLQLAKELNLNVIGVSFHVGSGCLDENAFGDAVVRAKNVFDQAKAMGYDFKFLDVGGGFPGADVKNGITFEKVAAVLGPIVDRLFPKDVRVIAEPGRYYVASAFNLAVNVIGRRTNMAHQDQTDASPEYMYYVNDGMYGSVNCIIFDHQVVHPKVLMKNELFAYGQDLPEAQYESSVWGPTCDSIDCLNKSARLPKLEPGDWLYFENMGAHTICAASQFNGFRKSEVLYTNTFC

SEQ ID NO: 62566 - protein, 373 aa, Xanthomonas campestris pv. vesicatoria str. 85-10
MGEAASGAACVPYLHSLGVCRAGSSCTCLRRAIAANGRRLPIRCEPDRGERCRDATLWSALARLLRSCLVPTTLPAPVPILPMPSRASRWFRPALLLLGSLTMTACSSVFFGGINAASSRSGIVEHRDQVFDSAHGLALDVYQPRGASDAPVVVFFYGGTWKRGSRANYRWVGRALARQGVVAMVADYRKYPQVGLHGFMSDAAGATAWSYRHAHEYGGNPNRLAVMGHSAGAHMAALLGTDARWLQAQGLKPHQLCGVVGLAGPYDFMPMTDPELVEIFGDAPAAQRQSQPVRYVGGDEPPMLLLHGDADRVVELQNSISLQQALKREGGSAELKVYPGMGHLGILLALRKSPERSQVLNDTLRFVRQCRVP

SEQ ID NO: 62567 - protein, 440 aa, Streptococcus pyogenes MGAS10394
MADNWKKSTRGKALLVIEAIFDQGAYTNIALNQQLSNKALSAKDRALLTEIVYGTVSRKISLEWYLAHYVKDRDKLDKWVYYLLMLSLYQLTYLDKLPAHAIVNDAVGIAKNRGNKKGAEKFVNAILRQFTNHPLPDMETIKRRNKYYSVKYSLPVWLVKKLEDQFGSDRSVAIMESLFVRSKASIRVTDPLKLEEVAEALDAERSLLSATGLTKASGHFAASDYFTNGDITIQDESSQLVAPTLNIDGDDIILDACSAPGGKTSHIASYLKTGKVIALDLYDHKLELVKENANRLGVADNIETRKLDAREVHRHFEKDSFDKILVDAPCSGIGLIRRKPDIKYNKESQDFNALQAIQLEILSSVCQTLRKGGIITYSTCTIFDEENRQVIEAFLQSHPNFEQVKLNHTQADIVKDGYLIITPEQYQTDGFFIGQVRRVL

SEQ ID NO: 62568 - protein, 488 aa, Artemisia annua
MALSLTTSIALATILFFVYKFATRSKSNKNSLPEPWRLPIIGHMHHLIGTIPHRGVMDLARKYGSLMHLQLGEVSTIVVSSPKWAKEILTTYDITFANRPETLTGEIVAYHNTDIVLAPYGEYWRQLRKLCTLELLSVKKVKSFQSLREEECWNLVQEIKAAGSGRPVNLSENIFKLIATILSRAAFGKGIKDQKEFTEIVKEILRQTGGFDVADIFPSKKFLHHLSGKRARLTSIHMKLDNLINNLVAEHTVNTSSKTNETLLDVLLRLKDSAEFPLTADNVKAIILDMFGAGTDTSSATIEWAISELIKCPRAMEKVQAELRKALKGKEKIHEEDIQELSYLNLVIKETLRLHPPLPLVMPRECRQPVNLAGYNIPNKTKLIVNVFAINRDPEYWKDAETFIPERFENSSTTVMGAEYEYLPFGAGRRMCPGSALGLANVQLPLANILYHFNWKLPNGASYDQIDMAESFGATVQRKTELLLVPSF

SEQ ID NO: 62569 - protein, 294 aa, Staphylococcus arlettae
VLGVSKSASKDEIKKAYRKLSKKYHPDINQEEGSDEKFKEISEAYEVLSDENKRANYDQFGHNGPQGGFGGQGFGGQDFSGFGGGGFEDIFSSFFGGGRQRDPNAPRKGDDLQYTMTVTFDEAVFGTEKEISIRKDVTCHTCDGEGAKPGTSKKTCHYCNGAGHVSVEQNTILGRVRTEKACPSCNGSGQEFEEPCETCHGKGTENKTVKIKVTVPEGVDNEQQIRLAGEGAPGENGGPHGDLYVVFRVKPSNTFERMGDDVAYNLDISFSQAALGDEIKIPTLNSSVMLTVPA

SEQ ID NO: 62570 - protein, 296 aa, Staphylococcus aureus subsp. anaerobius
SLGISKDASKDEIKKAYRKLSKKYHPDIDKEEGADEKFKEISEAYEVLSDDNKRASYDQFGHDGPQGFGGQGFNGSDFGGFSGFGGGGFEDIFSSFFGGGRQRDPNAPQKGDDLQYTMTLTFEEAVFGTTKEISIRKDVTCETCHGDGAKPGASKKTCSYCNGAGHVAVEQNTILGRVRTEQVCPKCNGSGQEFEEACPTCHGKGTENKTVKLEVKVPEGVDNEQQIRLAGEGSPGVNGGPAGDLYVVFRVKPSETFKRDGDDIYYKLNVSFPQAALGDEIKIPTLNNEVMLTIPA

SEQ ID NO: 62571 - protein, 76 aa, Zea mays
DPGRLWLGPNVMLEYPSNKANPLFKKTLENAKASLKALVGDLQFLRDHQTITRVTIAGVFNWDVPPRKSKQPVKDP

SEQ ID NO: 62572 - protein, 296 aa, Staphylococcus aureus subsp. aureus
VLGISKDASKDEIKKAYRKLSKKYHPDINKEEGADEKFKEISEAYEVLSDDNKRASYDQFGHDGPQGFGGQGFNGSDFGGFSGFGGGGFEDIFSSFFGGGRQRDPNAPQKGDDLQYTMTLTFEEAVFGTTKEISIRKDVTCETCHGDGAKPGTSKKTCSYCNGAGHVAVEQNTILGRVRTEQVCPKCNGSGQEFEEACPTCHGKGTENKTVKLEVKVPEGVDNEQQIRLAGEGSPGVNGGPAGDLYVVFRVKPSETFKRDGDDIYYKLNVSFPQAALGDEIKIPTLNNEVMLTIPA

SEQ ID NO: 62573 - protein, 836 aa, Helicobacter hepaticus ATCC 51449
MTKEYFIILKGKDKSAEIEYCCLENENLKVVFKNNPQTYTYQKENFALVKRATSYKFFNYLKELCALSEMQTPEDNLNVLLKEYERIQTIPKQSALSIYLNPSSFKQDSINESPLIFPFGANKSQYEAVQNAMGSQISVIEGPPGTGKTQTILNIIANLICQNKTIAVLSNNNSATQNVFEKLEGYGFGFVCATLGKKDNKESFIANQSGTYPSFDIPATDATKLKAELVCLNQKALESFHLTNELAKQKTFLNALRLEYEYFKAQENISPLAIKNFTKLTSDKILKAKVQIEQIQKLSFWLKLKLVFLDKVGDFRFYKSPKKEILHTLDSYYYILKDMELSKSIEKLQSDLPSLQQENPVQKLKVCSLLLFKSYLRAKYQNKQQRVRFELFDLNQNAPAILQEYPVILSTTHSIKSSLNLKDTLFDYVIIEEASQVDLVTGFLALSSAKNAIIVGDTKQLPNVIAQDKKPLIETLTRKYCIPLHYDFLEQSLLSSVIATLPNVPKVMLKEHYRCHPKIIGFCNKRFYNNELIILSEDKGENDVIQTFVTQKGNHARGHYNQREIDVIVKEVLPPLQANLTKEQIGIISPFRKQKAHLQHNVSGIEIDTIHKYQGREKEAIILSTVENEISDFIDNPNLLNVAISRAKRFLRVVISAQIYQSKSHLKDLIAYMQYHNFEITQSKVKSIFDLLYKANAEARRKYLKGKKKISAYDSENLAYHALKNCISSYGNLDIATHIPLYRILSSTQGLNAQEIKFIQSSSHIDLLIFNTMDKLPVLAIEIDGFAYHKEDSRQSKRDELKNAILQKCSITLLRLNTIESDEIVRVKAYLDKLQG

SEQ ID NO: 62574 - protein, 289 aa, Bacillus licheniformis ATCC 14580
MDLRNQQTNGQPAQTQDRQPGIESVMNPRPIYEDENYKGTDKLKGKVALITGGDSGIGRAVAVAYAKEGADISIVYLNEHEDAQETKARVEKEGVKCLLLPGDVRDEAFCNDAVEQTVKELGRLDILVNNAAEQHPKDSIKEISSEQLEKTFKTNFFSYFYFTKKAIDYLEPGSAIINTTSINPYRGNPQLIDYTATKGAINAFTRSMSQALVKDGIRVNAVAPGPIWTPLIPSTFSGEEVAKFGTDTPMGRPGQPVDHVGCYVLLASDDSSYMTGQTLHVNGGDFITT

SEQ ID NO: 62575 - protein, 316 aa, Prosthecochloris aestuarii DSM 271
MGFLSKLFGKKEVELKRPQVREDENLIRTLEGHQDRVLGVRFSPDGKKLVSGSFDEKVMLWDVATGAPLHTMSGHDTWVECVDYSPNGDRVASGSTDSTVRIWDPAPGKCVHLCKGHDTAVRMVAFSPDGKTLASCSRDTLIKLWDVETGRELKTLSGHISYIECVAWSNDGKRLVSCGEETVIRIWDVASGKNTASYATGDSLSHTACFSPDDSLIALCGRDAKVKILDAASGEIKHTLEGHDDGARSVCFSPDGTKAASVANDEKVILWDVVTGRLIHTYRGHVLEVQSVDISPDGTTIVSSSDDRKIKLWKLV

SEQ ID NO: 62576 - protein, 302 aa, Streptomyces coelicolor A3(2)
MIVVAGEALIDLVPQGTGALAALRPALGGGPYNTAVALGRLGSPVAFCSRVSYDGFGEALLDRLRETGVDVSPVQRGAEPTTLAVASLDADGSAAYSFYVEGTADRMFALPAALPSGTRAVSFGTCSLVLEPGASAYEELLRETAARGVFTALDPNIRAGLIPDPDAYRARFKSWLPSVSLLKLSAEDAEWLGGTPREWLAAGPAAVVVTRGGDGLTAFTRDGGEYTVPGERVEVVDTIGAGDTVNAALLHGLAARGALRDADLAALGPDGWAGLLGFAARAAAVTCSRAGAEPPYAHEVAA

SEQ ID NO: 62577 - protein, 195 aa, Prosthecochloris aestuarii DSM 271
MVCRGISVERLFISVQGRLLFFCRFFRTGTGRSISMCLFVVWTLLLVQKGFFAADDDQAVKTMTRTGDKRELLRGTLYFVVVATICGTVFYKQFAGVMAMAVLGWGDGLAPIFGMKLGKMKYRVFCEKTIEGSLAFFVGSALAGLFFVWLIVPSAYNPPVILSIALVATILEGMSPKEVDNILIPVAVVFLAMFV

SEQ ID NO: 62578 - protein, 434 aa, Bacillus licheniformis ATCC 14580
MSQKKVNLGVREVPKPLNWISFSLQHLFAMFGATILVPKLVGLSPGVALITSGLGTLAYLLITKGQIPAYLGSSFAFIAPIIAAKAAGGPGAAMIGAFMAGIAYGLIALLIQQLGTDWLMRLLPPVVVGPVIIVIGLGLASTAVNMAMYEDSGAKVLVYSAKHFGVAGFTLALTIICAIFLRGFFSLIPVLIGIIGGYLFALTQGIVDFQMVLDAKWFAVPDFVLPFVDYTPSAAAVGIGIAMVPVAFVTMSEHIGHQMVLSKVVGQDFIKKPGLHRSIFGDSVATMLASCIGGPPTTTYGENIGVLAITRVFSVFVIGGAAVIALCFGFIGKISALISSVPSAVMGGVSFLLFGIIASSGLRMLIDNKIDLENKRNLIISSVILVIGVGGAFIKISGFELSSMALAAIVGVVLNLVLPESKGDQDGIEIEEHI

SEQ ID NO: 62579 - protein, 187 aa, Zea mays
  misc_feature (143)..(143): Xaa can be any naturally occurring amino acid
  misc_feature (164)..(164): Xaa can be any naturally occurring amino acid
MSGAVLVAIAASIGNLLQGWDNATIAGAVLYIKKEFSLETQPLIEGLIVAMSLIGATVITTFSGAVADAVGRRPLLIASSVLYFVSGLVMLWAPNVYVLLLARLIDGFGIGLAVTLVPLYISETAPTDIRGLLNTLPQFSGSXEGMFLSYCMVFTMSLMPQPDXRVMALGVLSIPSLMTFALTVFYL

SEQ ID NO: 62580 - protein, 1070 aa, Bacillus licheniformis ATCC 14580
MPKRVDIKKILVIGSGPIIIGQAAEFDYAGTQACLALKEEGYEVILVNSNPATIMTDTEMADRVYIEPLTLEFLTRIIRKERPDAILPTLGGQTGLNLAVELSEHGILAECGVEVLGTKLSAIQKAEDRDLFRSLMNELNEPVPESEIIHSLGEAREFVERIGFPVIVRPAYTLGGTGGGICSNEDELKEIVENGLKMSPVHQCLLEKSIAGYKEIEYEVMRDSSDHAIVVCNMENIDPVGIHTGDSIVVAPSQTLSDREYQMLRNVSLKIIRALEIEGGCNVQLALDPDSFQYYIIEVNPRVSRSSALASKATGYPIAKLAAKIAVGLSLDEMMNPVTGKTYASFEPALDYVVSKIPRWPFDKFESANRRLGTQMKATGEVMAIGRTWEESLLKAVRSLEADVYHLELKDAGEISNEVLEKRIKKAGDERLFYLAEAFRRGYTVSDLHEFSAIDLFFLHKLEGIIRFEEKLKAGRGDLGLLKEAKELGFSDRFISLLWEMPERKLYDLRKEAGITPVYKMVDTCAAEFESETPYFYSTYEEENESVRTDKNSVIVLGSGPIRIGQGVEFDYATVHSVWAIKEAGYEAIIINNNPETVSTDFSISDKLYFEPLTVEDVMHIIDLEQPKGVVVQFGGQTAINLADELAERGVAILGTSLEDLDRAEDRDKFEQTLEMLQVPQPLGKTATSVEGAVEIAANIGYPVLVRPSYVLGGRAMEIVYHEAELLHYMENAVKINPQHPVLIDKYLTGKEIEVDAISDGETVVIPGIMEHIERAGVHSGDSIAVYPPQSLSEDIKKKLEAYTIKLAKGLNIVGLLNIQFVLSKDEVYVLEVNPRSSRTVPFLSKITGIPMANLATKVILGGKLADMGYTEGLQKEQEGVYVKVPVFSFAKLRRVDITLGPEMKSTGEVMGKDSTLEKALYKGLIASGIQIPNYGSVLLTVADKDKEEGLLIAKRFHAIGYKILATEGTAGYLRDASVPVKTVGKIGEEGTNLLDVIRNGEAQFVVNTLTKGKQPARDGFRIRRESVENGVACLTSLDTAEAILRVLESMSFRADHMPAIKIAQKAAVR

SEQ ID NO: 62581 - protein, 263 aa, Triticum aestivum
  misc_feature (138)..(138): Xaa can be any naturally occurring amino acid
  misc_feature (178)..(178): Xaa can be any naturally occurring amino acid
MSTAEATREENVYMAKLAEQAERYEEMVEFMEKVAKTADVGELTVEERNLLSVAYKNVIGARRASWRIISSIEQKEESRGNEAYVASIKEYRTRIETELSKICDGILKLLDSHLVPSATAAESKVFYLKMKGDYHRYXLAEFKAGAERKEAAENTLVAYKSAQDIALADLPTTHPIRXLGLALNFSVFYYEILNSPDRACNLAKQAFDEAIAELDSLGEESYKDSTLIMQLLRDNLTLWTSDNAEEGGDEIKEAASKPEGEGH

SEQ ID NO: 62582 - protein, 197 aa, Oryza sativa (japonica cultivar-group)
THAFARVQLHVGDAVDFLRNAPEGKYDAIIVDSSDPIGPAQELVEKPFFQTIARALKPAGVLCNQAESMWLHTHLIQDMLSICRETFKGAVHYAWTSVPTYPSGVIGFLLCAKEGPAVNFLSPVNPIEKLEGAMEAGREIRFYNSEVHRAAFVLPTFVRRELESHNTCAEKDKSETKPVAKPKKMKIMPNSAIPTAS

SEQ ID NO: 62583 - protein, 446 aa, Ricinus communis
MAETKKYITKEDLEKHNNPGDLWISIQGKIYNVTDWSKDHPGGVSPLLHLAGQDVTDAFVAYHPGTAWQYLDKFFTGYHLKDYSVSETSKDYRRLVAEFSKLGFEKKGHIAFITLVSMVMLLALSVYGVLCSNSTWVHLISGGLMGFMWIQSGWIGHDSGHYQVMMSRRFNRLAQILSGNCLAGISIAWWKWNHNTHHIACNSLDFDPDLQHMPFFAVSSKFFSSITSYFYERKMNFDCAARFLVSYQHLTFYPVMCFARINLFAQSISLLLSKRRVANRGQEILGVLVFWIWYPFLVSCLPNWGERVMFVAASFSVTRIQHVQFCLNHFSSSVYLGLLIANDWFENQTKGTLDITCSSWMDWFHGGLQFQMEHHLFPRLPRVKLRKVSPFVRELCKKHNLPYDSASFWNANELTFKTLRAAALQARDLSNPIPKNLVWEAVNTHG

SEQ ID NO: 62584 - protein, 363 aa, Bradyrhizobium sp. BTAi1
MGNDSTTLVLGIETTCDETAAAVVARDSDGKGRILSNVVRSQTDEHALYGGVVPEIAARAHVDMLDHLIDAAMREAGIDYADLNGVAAAAGPGLIGGVIVGLTTAKAIALVHDTPLIAVNHLEAHALTPRLTDAIDFPYCLFLASGGHTQIVAVAGVGDYVRLGTTVDDAMGEAFDKVAKMLGLPYPGGPQVEEAAQRGDAARFAFPRPMLGRSDANFSLSGLKTAVRNEIGRIAHVSAQDIADLCASFQAAVLESTADRLRVGLDLFKQRFGAPTALVAAGGVAANQAIRAALDDVAQQAGTRLIMPPPALCTDNGAMIAWAGLERLALGMIDGMDAAPRARWLLDANASVPGKFANTRAGF

SEQ ID NO: 62585 - protein, 329 aa, Methanothermobacter thermautotrophicus str. Delta H
MKSMKIAVIPGDGIGVEVMEAALHILNTLDLDLEFIHADAGDACLKRTGTALPEETLEAVGEARATLFGAAGESAADVIVRLRREFDLFANLRPVKSLPGVPCLYPDLDFVIVRENTEDLYVGDEEYTPEGAVAKRIITRTASRRISQFAFQYAQKEGMQKVTAVHKANVLKKTDGIFRDEFYKVASEYPQMEATDYYVDATAMYLITQPQEFQTIVTTNLFGDILSDEAAGLIGGLGLAPSANIGEKNALFEPVHGSAPQIAGKNIANPTAMILTTTLMLKHLNKKQEAQKIEKALQKTLAEGLVTPDLGGKLGTMEMAAEIARHLED

SEQ ID NO: 62586 - protein, 293 aa, Staphylococcus auricularis
VLGVSKDASKDEIKKAYRKLSKKYHPDINKEEGADEKFKEISEAYEVLSDPDKRANYDQFGHDGPQGGFGGQGFGGQDFSGFGGGFEDIFSSFFGDGRSSDPNAPRKGDDLQYNMTITFDEAVFGAKKDITIRKDVKCHTCNGNGAKPGTKKKTCHYCNGSGHTTVEQNTILGRVRTQKVCPVCDGTGEEFEEPCPTCHGKGTENKNVKINVKVPEGINNDQQIRLAGEGAPGENGGPQGDLYVVFRVKPSDKFERDGDDLFYDLNVSFAQAALGDEVKVPTLKGSVMLTIPA

SEQ ID NO: 62587 - protein, 210 aa, Zea mays
MTSVWKTKVLPGLNKIFDKDGKKAAAAGFLKSFNKEEIDKEIEDKKTELEPKVVEAYEASPPEVKALFKDKKPVKVSKKNSAAVTKFLDELAKIDFPGAKVVSEAVAKSGTSPLLPAITFILDKVAPFIPKEEPKAEPAAEATSREVAVEEKKEEAEPAAATEAAPAPAETPSEEAVVEEKKEEEKKEEEDKPAAEEAAPPAAAAAAEEK

SEQ ID NO: 62588 - protein, 714 aa, Arabidopsis thaliana
MVRISLLLLCLLVSTCLFTSSSAQAPGFVSLDCGGAEPFTDELGLKWSPDNHLIYGETANISSVNETRTQYTTLRHFPADSRKYCYTLNVTSRNRYLIRATFLYGNFDNSNNVYPKFDISLGATHWATIVISETYIIETAELVFLASSPTVSVCLSNATTGQPFISTLELRQLSGSMYGSMLSEDRFYLSVAARINFGAESEASVRYPDDPYDRIWESDLQKKPNYLVDVAAGTVRVSTTLPIESRVDDRPPQKVMQTAVVGTNGSLTYRMNLDGFPGFGWAFTYFAEIEDLAEDESRKFRLVLPEQPEYSKSVVNIKENTQRPYRVYAPGYPNITLPFVLNFRFAKTADSSRGPILNAMEISKYLRKSDGSVDATVMANVASLYSSTEWAQEGGDPCSPSPWSWVQCNSDPQPRVVAIKLSSMNLTGNIPSDLVKLTGLVELWLDGNSFTGPIPDFSRCPNLEIIHLENNRLTGKIPSSLTKLPNLKELYLQNNVLTGTIPSDLAKDVISNFSGNLNLEKSGDKGKKLGVIIGASVGAFVLLIATIISCIVMCKSKKNNKLGKTSELTNRPLPIQRVSSTLSEAHGDAAHCFTLYEIEEATKKFEKRIGSGGFGIVYYGKTREGKEIAVKVLANNSYQGKREFANEVTLLSRIHHRNLVQFLGYCQEEGKNMLVYEFMHNGTLKEHLYGVVPRDRRISWIKRLEIAEDAARGP

SEQ ID NO: 62589 - protein, 295 aa, Staphylococcus capitis subsp. capitis
VLGVSKSASKDEIKKAYRKLSKKYHPDINKEEGADEKFKEISEAYEVLSDDNKRANYDQFGHEGPQGGFGSQGFGGGDFGGFSGGGFEDIFSSFFGGGSRQRDPNAPRKGDDLQYTMTVTFEEAVFGTKKEISIRKDVTCHTCDGEGAKPGTSKKTCSYCNGAGHVSVEQNTILGRVRTEQVCPKCEGSGQEFEEPCPTCHGKGTENKTVKLEVTVPEGVDTEQQIRLAGEGSPGVNGGPHGDLYVVFRVQPSDTFERDGDDIYYNLNVSFPQAALGDEIKIPTLNSNVVLTIPA

SEQ ID NO: 62590 - protein, 270 aa, Beta vulgaris
  misc_feature (249)..(249): Xaa can be any naturally occurring amino acid
  misc_feature (258)..(258): Xaa can be any naturally occurring amino acid
  misc_feature (270)..(270): Xaa can be any naturally occurring amino acid
AMGGLIFGYDIGISGGVTSMPDFLKKFFPSVYRKEALDKSVNQYCKFDSVTLTLFTSSLYVAALVASLVASVVTRKLGRKLSMLFGGLLFCVGAIINALAKDVAMLIVGRILLGFGVGFANQSVPLYLSEMAPYKYRGSLNIGFQLSITIGILIANVLNYFFAKIHDWGWRLSLGGAMVPAIIISIGSLLLPDTPNSMIERGKRDEALLKLKRVRGVDDVEDEFNDLVVASENSKKVEHPWRNLLQRKXRPHLTMGFXIPFFHNLLGLMX

SEQ ID NO: 62591 - protein, 295 aa, Staphylococcus caprae
VLGVSKSASKDEIKKAYRKLSKKYHPDINKEEGADEKFKEISEAYEVLSDDNKRANYDQFGHEGPQGGFGSQGFGGADFGGFSGGGFEDIFSSFFGGGSRQRDPNAPRKGDDLQYTMTVTFEEAVFGTKKEISIRKDVTCHTCDGEGAKPGTSKKTCSYCNGAGHVSVEQNTILGRVRTEQVCPKCEGSGQEFEEPCPTCHGKGTENKTVKLEVTVPEGVDTEQQIRLAGEGSPGINGGPHGDLYVVFRVQPSDTFERDGDDIYYNLNVSFPQAALGDEIKIPTLKSNVVLTIPA

SEQ ID NO: 62592 - protein, 1076 aa, Bacteroides fragilis YCH46
MKENNIKKVLLLGSGALKIGEAGEFDYSGSQALKALKEEGIETILINPNIATVQTSEGVADQIYFLPVTPYFVEKVIRKERPEGIMLAFGGQTALNCGVALYREGILEKYNVKVLGTPVQAIIDTEDRELFVDKLNEIDVKTIKSEAVENAEDARRAARELGYPVIVRAAYALGGLGSGFCDNEEELDLLVEKAFSFSPQVLVEKSLRGWKEVEYEVVRDRFDNCITVCNMENFDPLGIHTGESIVIAPSQTLTNKEYHKLRELAIRIIRHIGIVGECNVQYAFDPESEDYRVIEVNARLSRSSALASKATGYPLAFVAAKLGLGYGLFDLKNSVTKTTSAFFEPALDYVVCKIPRWDLGKFHGVDKELGSSMKSVGEVMAIGRTFEEAIQKGLRMIGQGMHGFVENKELVIPDIDKALHEPTDKRIFVISKAFRAGYTIDQVHELTKIDKWFLQKLMNIMNTSEELHQWGNNHKQIADLPADLLKQAKRQGFSDFQIARAIGYEGDMEDGSLYVRNYRKSLGIVPVVKQIDTLAAEYPAQTNYLYLTYSGTANDVTYLGDHRSIVVLGSGAYRIGSSVEFDWCGVQALNTIRKEGWRSVMINYNPETVSTDYDMCDRLYFDELTFERVMDVLELENPHGVIVSTGGQIPNNLALRLDAQNIHILGTSAQSIDNAEDRDKFSAMLDRIGVDQPEWRALTSLEDINSFVDKVGFPVLVRPSYVLSGAAMNVCSNQEELERFLQLAANVSKKHPVVVSQFIEHAKEVEMDAVAQNGEIIAYAISEHIEFAGVHSGDATIQFPPQKLYVETVRRIKRISREIAKALNISGPFNIQYLAKDNDIKVIECNLRASRSFPFVSKVLKINFIELATKVMLGLPVEKPEKNLFELDYVGIKASQFSFNRLQKADPVLGVDMASTGEVGCIGSDTSCAVLKAMLSVGYRIPKKKILLSTGTPKQKVDMLEAARMLQKKGYDIFATGGSSKFLTENGVENTRVYWPSEEGHPQALEMLHKKEIDMVVNIPKNLTAGELDNGYKIRRAAIDLNIPLITNARLASAFINAFCTMDIDDIAIKSWEEYK

SEQ ID NO: 62593 - protein, 294 aa, Staphylococcus carnosus subsp. carnosus
VLGVSKDASKDEIKKAYRKLSKKYHPDINQEEGAEEKFKEISEAYEVLSDENKRANYDQFGHDGPQGGFGGQGFGGGQDFGGFGGGFEDIFSSFFGGGAQRDPNVPRKGDDLQYTMTVTFEEAAFGTEKEISIRKQVKCETCDGSGAKPGSKKKTCHYCNGSGHVSVEQNTILGRVRTEKVCPVCNGTGEEIEEPCPTCHGKGTETKNVKIKVKVPEGVDNDQQIRLAGEGAPGHNGGPQGDLYVVFRVEPSDTFEREGDDIFYNLNVSFPQAALGDEIKVPTLKGHVMLSVPE

SEQ ID NO: 62594 - protein, 107 aa, Glycine max
MSAVITKFAVTSMVMWMAPVAIMYGFIYQIFPGVGQLSPSAQTMASGFLAVISVNLVIGFYIYMAMKETPHQEPQPDPTFLANAKASINQPTSSQVSDDSHGKGKVE

SEQ ID NO: 62595 - protein, 636 aa, Fusobacterium nucleatum subsp. vincentii ATCC 49256
MKKNFFVSTPIYYVNGDPHVGSAYTTIAADVINRYNKAMGMDTHFMTGLDEHGQKVEQAAEQNGYTPQAWTDKMTPNFKNMWAALDIKYDDFIRTTEDRHKKAVKRILDMVNAKGDIYKGEYEGKYCISCETFFPENQLNGSNKCPDCGKELRVLKEESYFFKMSKYADALLKHIEEHPDFILPHSRRNEVISFIKQGLQDLSISRNTFTWGIPIDFAPGHITYVWFDALTNYLTSAGFENDDKKFDKFWNNARVVHLIGKDIIRFHAIIWPCMLLSAGIKLPDSIVAHGWWTSEGEKMSKSRGNVVNPYDEIKKYGVDAFRYYLLREANFGTDGDYSTKGIVGRLNSDLANDLGNLLNRTLGMYKKYFNGVIVASSTSEPIDDEIKTMFDDIIKDVEKYMYLFEFSRALETIWKFISRLNKYIDETMPWSLAKDEAKKGRLATVMNILCEGLYKIAFLIAPYMPESAQKISNQLGIDKDITNVKFDDIKEWNIFKEGHKLGEASPVFPRIEIEKKEVVESKKELKVENPIDIKEFNKVEIKVVEILDVDKVKDTDKLLKFKVFDGEFERQIISGLAKFYPDFKKLIGEKVLAVANLKFTKLKGEISQGMLLTTEDKNGVSLIKIDKSIEAGAIIS

SEQ ID NO: 62596 - protein, 759 aa, Bacillus cereus ATCC 10987
MNTPTQTPSLSETMKEWHYALAYEIKHWKTIGGSKISIMNGRFLYTDYESTVYVFQLISEVSLPEGSPIRIEFDGEEATGEVLSVHGLEIELKLNDYIQGEIREAVLYSEPWQLLEQLQERLKEARKDKLKRNRIKRLVDGTSSPKHIEKMKNPKNELAYRSFYNPTTYVWGPPGTGKSYNLSRIISAHYQKGKSVLVLAHSNAAVDVLMSEVTKQIEKKKKWTPGEIVRYGYSQHEHIRNHETLLASKLVETTNGSWGEERLYLEETRQDLREKILSYKATSADKKRIQEIESDLRKQKAKIKEVEKEYIENAKVIGATLSKCAIDSLIYERTFDLVVVDEVSMAYVPQIALAASLGKRIVVCGDFLQLPPIAMANHELVRKWLGEDMFYHAGIVESVNKSEAHPNLFMLQEQRRMHADISKFTNSFIYKNRVYDHPSVSERKELAKLQPFANEASVLFDMSLMGAFSLKDAASGSRFNIMSGLVAMQMMLIGLLDGVQSIGVVTPYRAQSRFLSTCMREMLQKTKYRHIPVLAATVHKFQGSERDMMIFDTVDSYPQERPGVLFFDHKNHRLVNVAVTRARGKFIQLSDCHYMRKNLSRKQALSQLTAHIERHGDVYDRTTSRQLWERKISKRLRWFMEMNLEEPKGLLKDILAAKRKIIISLPSTKQVDKRVWQALMRTNAQITVYSDGPVPLKNVKLQRQNKAFPFIVIDDEIFWAGAPLTSQMMFEGSTEFPYVCARLQAPETIGVLKGFLDIR

SEQ ID NO: 62597 - protein, 463 aa, Aspergillus oryzae
MTASSEASKCALEEAQRLLISAEKAFIEHNPKSKAQHKVASEVLPGGNTRSILHTDPFPICMERGEGIKLVDVDGHEYLDLVGEMTAGLFGHTNPIIRDTIISTVSKTGLNLGATTRTESLFAKAICQRITSIEQLRFCNSGTEANLHALSIARGATGRSKVIVFEGGYHGGVLTFAHGVAENNVDKEDWIIGKYNDVEGTRKLISENKGIAAAVLVEGMQGAGGCIPGTAEFLHTIQNETRANGMIFILDEVMTSRLAPGGLQSVIRNPYDGAPLKPDMTTLGKWIAGGMTIGAFGGRKDLLAAYDPRPSSGSSERKTQISHSGTFNNNTLAMNVGLAALERVFTPEACMELNNIGGWFHRGLEERCRGTKMTVTGIGAVCNIHFTSNVGNAGITSVDDLATESNGVEPILKDLFWYYAIRHGYWIARRGMLSLILGTSKGDLQGFLDVVEGFVREHREFLE

SEQ ID NO: 62598 - protein, 141 aa, Prosthecochloris aestuarii DSM 271
MERTLTILKPDCVRKQLIGAVIDKIERAGFRVVAMKKTKLTAQTAGEFYAVHSQRPFYGELVEFMSSGPCVPMILEKENAVADFRTLIGATDPAEAAEGTIRNLFADSKGENIIHGSDSAENAQIEAGFFFSTEEAVRVNN

SEQ ID NO: 62599 - protein, 308 aa, Yersinia pseudotuberculosis IP 32953
METGKLVVLGSINADHILNIEQFPRPGETVIGQQYNVAFGGKGANQAVAAGRSGADIAFIACVGDDDIGERVRQQLTADKIDTQPIEAIKGATTGVALIFVNSDGENVIGINAGANSAVTPEYLRRYQQQVIDADALLMQLESPLDTVIAAAKLAKQHQTQVILNPAPARKLPDELLTLVDMITPNETEAERLTGIHIEQDDDAAKAAQILHDKGIATVIITLGSRGVWLSEQGKGKLVAGFKVNAVDTIAAGDTFNGALLTALLEGQSMDAAVRFAHAAAAIAVTRPGAQPSIPWRAEIDSFLQERV

SEQ ID NO: 62600 - protein, 676 aa, Oryza sativa
MLAVVVVVVAVLLPLAAAQQTMQFSSCASGAYAANSTYEANLAVLAAALPGNASTAAAAGYATATVGAVPDQVSALALCRGDANATACRACVAASFRVARRDCPSSKDATTYQDGCIVRFSDQRFLDFVGVNSPVSELYSDADSNITAVPVAWFNAAVVALMNATVDTAVAAGSGSNNTKKYFATAVEDFDPKHYPKIYGMAQCAPVMTAAQCRSCLGGFVSSIPWFLNGKPGGRVLGIWCNLRYSVKPFYQGQPMLQISAPPEPPPPAMPSLAAPPTRTARRRRVAGISAGVACFVVLMLILSAYAFIRFKRKKAAKKDNLLKKMARGKCTIFDLATLKEATENFSEKHKLGEGGFGTVYKVLFLMRKSLFQGKLPDGQEIAVKKLIESCGHGLNQLHNEVLVLAELQHKNLVRLQGFCVHKDEMLLVYEYIKNGSLDNFLFAHASRGNALSWDQQYNIIFGIAKGIMYLHEDSSIRIIHRDLKANNILLDEDMDPKIADFGLARLIGGGHTHTKTTRIVGTYGYMAPEYAIHGNVSPKIDIFSFGVLVLEIVTKRKNCSYGDGTTDTVNLLSDVIDQSLEGHFRNQALRCIHIGLLCVQSDPDDRPDIPSVIFMLTRDNMELQPPTEPAFFFNGNSNSASQTSDQRVYVYDRSGKIYEEDISANGITLTDIYPR

SEQ ID NO: 62601 - protein, 82 aa, Arabidopsis thaliana
MASSRLSSADVVTSPAQATMVAPFTGLKSSAAFPVTRKTNRDITSIAGNGGRVTCMNVWPSVGQKKFETLSHVPDLSDGRIG

SEQ ID NO: 62602 - protein, 179 aa, Rhizobium leguminosarum bv. viciae 3841
MNIIQQLEAEQAAKIEAKRTLPEFSPGDTVRVNVKVTEGTRTRVQAYEGVCIARSGGGLQENFTVRKISYGEGVERVFPIYSPMIESVDVVRRGKVRRAKLYYLRDRRGKSARIVEDTGVRARKLNDAERAAIAEEKARIEAEKVAAAQALAAEKAAADAAEAKAAAEAAAAAAEPAAE

SEQ ID NO: 62603 - protein, 480 aa, Halobacterium sp. NRC-1
MEQNAIQRRERPFVAGEWVSDGEPLPVSDLADGGTFASVAAADTSDAERALSAATGVHADLRETTVPERVEWLESIADGIRRREDELAEVIVREAGKPISSARGEVQSAAERFDRAVGELRHLTGEYRTGTTAGHEDWQAIVKHEPMGTVLCITPYNYPLSTMALQVAPAIAAGNAVIVKPASKTPISGAILADIAADAGLPDGAYNFVPGESSVIGDPLASDARVDAIAMTGSSGAGEHVARQSGITRLHMELGGNAPAIVFEDADLDAAADAATAGSLKYAGQRCSAVSRVLAHESVHDELVSRIDDAMAEWSIGDLFDTDTTLGPLVSADQADWVAELVDDAVDRGATVVRGGERHVEDGVHYYEPTLLADVPRDARIVDEEQFGPVCAVTTVTDEDDAVRTANGSELALDAAVFTADHDRAMRVAERVNAGAVRINGAPSHGLGDVPFGGNDASGIGREGLDSTIHEFVREKSIIL

SEQ ID NO: 62604 - protein, 495 aa, Xanthomonas campestris pv. vesicatoria str. 85-10
MYAPLDLYDTTAARTLDAQATTLLGGDGYTLMQRAGQAAWQWLLERWPKARRIVVVCGTGNNGGDGYVLARLAHRAGRQVRVVHLPEHGPGSDLAQRACTDYLAVGGAIELFPCPLAQADVIVDALFGIGLNRAPDDATAALIDAINAAGVPVFALDVPSGIDADHGVAFGAAVRAALTLQFIVPHVGLYTGDALEHAGKRQIAALEVPVSAFDGLTPAAHSWNGEALAAQLRPRRRNTHKGESGRVLCVGGNLGSGGAIMLTAEAALRSGAGLVQVATRAEHVTPLLARCPEAMVRAVQADDDIATLAEAADVVALGPGLGQDAWAQALWRAALGAAKAVVIDADGLNLLASTDVAAHGPRILTPHPGEAGRLLGLSTRQIQRDRPAAAAALAKRYDAVVVLKGAGTVVASPGHLPRIIDAGNPGMAVGGMGDLLTGVIAALLAQGFSPFDAASLGALLHACAGDAAAHAGERGLLPTDLLAELRRLANAGAIA

SEQ ID NO: 62605 - protein, 268 aa, Medicago truncatula
MGHLYALDFDGVLCDTCGETAISALKAAKLRWPDLFGSVDSSTEDWIVEQMIKVRPVVETGYETLLLVRLLLETRVPSIRKSSVAEGLTVEGILEDWFKLKPIVMEEWNENRDDLIDLFGKVRDDWLENDFAGWIQGNRFYPGVADALRFASSKVYIVTTKQGRFADALLRELAGITIPPERIYGLGTGPKVETLKKLQKMPEHQGLTLHFVEDRIAALKNVIKEPELDNWNLYLVNWGFNTQKERDEAAANPRIQLIDLSDFSSKLK

SEQ ID NO: 62606 - protein, 285 aa, Medicago truncatula
MGELYALDFDGVICDSCGESSLSALKAAKVRWPVLFDGVDSTIEDWIVDQMHTVRPVVETGYENLLLVRLLLETRTPSIRKSSVGKIPIPHFLSLITMQPRLEGLAVEGILESWSTLKPIIMEEWGENREALIDLFGKVRDEWLEQDFAAWIGANRIYPGVSDALKFASSKVFIVTTKQSRFADALLRELAGVTIPSERIYGLGTGPKVEILKQLQKRPEHQGLTLHFVEDRLATLKNVIKEPELDKWNLYLGNWGYNTAQEKEEAAAIPRIRVLQLSDFSKKLK

SEQ ID NO: 62607 - protein, 259 aa, Helianthus annuus
ANYRGDKQYGRETRHTGDYENPIHSTGGQYEQEVLQTDEYGNPVRRTGQTDEYGNPVRRTDEYGNPAHSTTGGTMGDYGSTGLGQGTGTGGIGTGGYGTTGHHGLGTGVGHTTGGTGTDYTSGGRSTGQTGYQGLGTESEFGGKTGTFQNQPSATPVGGVGLSSGTGAGVGGTGTGTGILHRSGSSSSSSSEDGGQGGRRKKKGVMQKIKEKLPGGHRQEEQYQSQTTTTTTGGGAGYGETHEKKGMMEKIKEKLPGHH

SEQ ID NO: 62608 - protein, 294 aa, Staphylococcus carnosus subsp. utilis
SLGVSKDASKDEIKKAYRKLSKKYHPDINQEEGAEEKFKEISEAYEVLSDENKRANYDQFGHDGPQGGFGGQGFGGGQDFGGFGGGFEDIFSSFFGGGAQRDPNAPRKGDDLQYTMTVTFEEAAFGTEKEISIRKQVKCETCDGSGAKPGSKKKTCHYCNGSGHVSVEQNTILGRVRTEKVCPVCNGTGEEIEEPCPTCHGKGTETKNVKIKVKVPEGVDNDQQIRLAGEGAPGHNGGPQGDLYVVFRVEPSDTFEREGDDIFYNLNVSFPQAALGDEIKVPTLKGHVMLSVPE

SEQ ID NO: 62609 - protein, 370 aa, Coxiella burnetii RSA 493
MTEKINLLNLSEPELQGFIASQGQPLYRATQLLQWIHQRGVTDFSLMTDLSKPFRQQLSEASFVRVPELALERVSADGTHKWLFRLADNNKIETVFIPDRKRGTLCVSSQVGCALNCSFCATGKEGFNRNLTLAEIIGQVWLAARLLKSPYKITNVVMMGMGEPLLNYEAVVAAMHLMMHDHAYGLSKYRVTLSTSGVIPAMRRLREESPVSLAVSLHAPNDALRNVLIPLNKKYSLDQLIPLCRDYYSRGSKRCVTFEYVMIEGMNDRLIDAKQLIRLLADVPCKINLIPFNSFQGTAYRCSTESAISVFQKCLMDAGFNTRVRRTRGDDIAGACGQLAGQFHDRTGRHQRWVQKQGHDFNRPIPAIDH

SEQ ID NO: 62610 - protein, 558 aa, Bacteroides fragilis YCH46
MCGIAGIFNIKIQSRELRNKALRMARKIRHRGPDWSGMYCGGSAILAHERLSIVDPQSGGQPLYSSDRKQVLAVNGEIYNHRDIRAQYAGRYEFRTGSDCEVILALYRDKGIHFLEELNGIFAFALYDEEKDEYLIARDPIGVIPLYIGKDAEGHVYFGSELKALEGFCDEYEPFLPGHYYHSKERTMKRWYTRDWMEYKEENDKQADSRSPTRQIQDALENAVHRQLMSDVPYGVLLSGGLDSSVISAIAKKYAAKRIETDGASDAWWPQLHSFAIGLKGAPDLIKAREVAEYIGTVHHEINYTLQEGLDAIRDVIYFIETYDVTTVRASTPMYLLARVIKSMGIKMVLSGEGADEIFGGYLYFHKAPDARAFHEETVRKLSKLHLYDCLRANKSLAAWGVEGRVPFLDKEFLDVAMQLDPEIKMAPGKVIEKKVLREAFADMLPSGIAWRQKEQFSDGVGYSWIDTLKEITATAVSDEQMAHAAERFPIHTPMNKEEYYYRSIFEEHFPSESAARSVPSIPSVACSTAEALAWDTTFKNLNDPSGRAVKGVHEEAY

SEQ ID NO: 62611 - protein, 259 aa, Helianthus annuus
ANYRGDKQYGRETRHTGDYESPIHSTGGQYEQEVLQTDEYGNPVRRTGQTDEYGNPVRRTDEYGNPVHSTTGGTMGDYGSTGLGQGTGTGGIGTGGYGTTGHHGLGTGVGHTTGGTGTDYTSGGRSTGQTGYQGLGTESEFGGRTGTFQNQPSATPVGGVGLSSGTGAGVGGTGTGTGILHRSGSSSSSSSEDDGQGGRRKKKGVMQKIKEKLPGGHRQEEQYQSQTTTTTTGGGAGYGETHEKKGMMEKIKEKLPGHH

SEQ ID NO: 62612 - protein, 293 aa, Staphylococcus chromogenes
VLGVDKNASKDEIKKAYRKLSKKYHPDINKEEGSDAKFKEISEAYEVLSDEQKRKQYDQFGHAGAQGGFNQGFGGQDFSGFGGAGFEDIFSSFFGGQRQRDPNAPRKGDDLQYSMTVTFEEAVFGTNKEITVRKDVTCHTCDGDGAKPGTKKKTCSYCKGSGHVSVEQNTILGRVRTEKVCPQCNGSGEEFEEACPTCHGRGTETKNVKIQVTVPEGVDNDQQIRLAGEGAPGENGGPAGDLFVVFRVKPSDKFTRDGDDILYKQSISFAQAALGDEIKVPTLNGQIMLTVPA

SEQ ID NO: 62613 - protein, 335 aa, Legionella pneumophila subsp. pneumophila str. Philadelphia 1
MNFFMMPHDLAQYAIVADIGGTFARFSRVNLVNLQMDKIEISPCAEFISLESALLTYKNRHSLQEIKHIAIAIACPVIDDLVSMTNCHWQFSITELKQRLGLEVLEVMNDFTAIAMSLPVLSTQDLVQIGNGYLDASKVRVVLGAGTGLGVAYLIPHQHHYSAFAGEGGHADWGAKTEQEWFIYRYLKSKYSHVSYERLLSGQGLENLYQALAAYHSKKVEFLSAAQIISLALNQECFIAHKAVAQFFSSLGSFAGDLALTYGAFGGVYIAGGIMPRLLSLVHQSDFRIQFEDKGRFSDFNALIPTYVIAAAQPGILGASVSLKQILTGASHVLF

SEQ ID NO: 62614 - protein, 544 aa, Triticum aestivum
  misc_feature (162)..(162): Xaa can be any naturally occurring amino acid
  misc_feature (168)..(168): Xaa can be any naturally occurring amino acid
  misc_feature (174)..(174): Xaa can be any naturally occurring amino acid
MALLLRHSRKLRRVHGVLDCERGSIARHFSVAAAKEDAVSSSSVHGEYGKKVGRSSIFLDRQSEKDLRAFKVSSREARGSYSSKRMPIAATGVNSLFSCGQVVSARHFSSGADLPPHEAIGMPSLSPTMTEGNIAKWVKKEGDKVSPGEVLCEVETDKATVXEMECMXEEGYLXAKIVCGDGAKEIKVGEIIAITVEEEGDIEKFKDYKASSSAAAPAESKPQSEPVEPKEEKKEVSKAPEPTATKTEESSQSGDRLFSSPIARKLAEDNNVPLSSLKGTGPDGRILKADIEDYLSSAAKGSKKEAAAAPGLGYVDLPNTQIRKVTANRLLQSKQTIPHYYLTVDSRVDKLIKLRSELNPMQDASGGKKISINDLVIKAAALALRKVPACNSSWMNDFIRQYHNVNINVAVQTEHGLFVPVVRDADKKGLATIADEVKQLALRAKDNSLKPEDYEGGTFTVSNLGGPFGIKQFCAIVNPPQSAILAIGSAEKRVVPGAAEGQYEIGSFMSATLSCDHRVIDGAMGAEWLKAFKGYLEDPTTMLL

SEQ ID NO: 62615 - protein, 293 aa, Staphylococcus cohnii subsp. cohnii
ILGVSKDASKDEIKKAYRKLSKKYHPDINKEEGADEKFKEISEAYETLSDENKRANYDQFGHDGPQGGFGGQGFGGQDFSGFGGGFEDIFSSFFGGGRQRDPNAPRKGDDLQYTMTVTFEEAVFGTSKEISIRKDVTCHTCDGEGAKPGTKKKTCHYCNGSGHVAVEQNTILGRVRTEKVCPVCSGSGQEFEEPCPTCHGKGTENKTVKINVTVPEGVDNEQQIRLAGEGAPGENGGPQGDLYVVFRVKPSETFEREGDDIYFSQDISIAQATLGDEIKVPTFKGHVMLTIPG

SEQ ID NO: 62616 - protein, 473 aa, Legionella pneumophila subsp. pneumophila str. Philadelphia 1
MAWIVAIIGSIAGFLFGYDEGIIAGSLGLVKNHFNLNATHIGVMASALPFGALFGSLLIGAFMASKCVKRFGRRSLLSFAGFLFFVGALGAGFAETVSVLILSRLILGLAIGMASVLTPLYLAETAAVQSRGAVVAIYQLALTVGIVCSYSVNYLLIEQQAWRAMFASSAIPALLLTLGILFMPESPRWLCSVGRHGAAANSLRKLRGKQSVEQELKDIEATLANEPKQGNWLLLFQKPLLPVLMLGTILFCLQQLSGINVVIYFAPEIFKNLGLGSTTGQILATMGIGLVNLLVTIIAILYVDKLGRRKLLLLGFAGTSLSLFALSLFSLNHVAWLSYLSVICLMVYIFSFAISVGPIPHIAMAEIFPLHVRGAGMGMSSMSNWLFNTIVIFSFPVLHQMFGIEMTFVLYAVICFLGFIYAYIYMPETRNISLEQIETYIMSGKPLRFLGREDEEVNAVSTKSESSLLASTN

SEQ ID NO: 62617 - protein, 293 aa, Staphylococcus cohnii subsp. urealyticus
ILGVSKDASKDEIKKAYRKLSKKYHPDINKEEGADEKFKEISEAYETLSDENKRANYDQFGHDGPQGGFGGQGFGGQDFSGFGGGFEDIFSSFFGGGRQRDPNAPRKGDDLQYTMTVTFEEAVFGTNKEISIRKDVTCHTCDGEGAKPGTKKKTCHYCNGSGHVAVEQNTILGRVRTEKVCPVCSGSGQEFEEPCPTCHGKGTENKTVKINVTVPEGVDNEQQIRLAGEGAPGENGGPQGDLYVVFRVKPSETFEEMATIFTFHKILVLRKQRLGDEVKVPTLKGHVMLTIPW

SEQ ID NO: 62618 - protein, 338 aa, Brassica napus
MAGGKIKIGINGFGRIGRLVARVVLQRDDVELVAVNDPFITTEYMTYMFKYDSVHGQWKHHELKVKDEKTLLFGEKPVTVFGIRNPEDIPWAEAGADFVVESTGVFTDKDKAAAHLKGGAKKVVISAPSKDAPMFVVGVNEHEYKSDLDIVSNASCTTNCLAPLAKVINDRFGIVEGLMTTVHSITATQKTVDGPSMKDWRGGRAASFNIIPSSTGAAKAVGKVLPQLNGKLTGMSFRVPTVDVSVVDLTVRLEKAATYDEIKKAIKEESEGKLKGILGYTEDDVVSTDFVGDSRSSIFDAKAGIALSDNFVKLVSWYDNEWGYSTRVVDLIVHMSKC

SEQ ID NO: 62619 - protein, 297 aa, Staphylococcus condimenti
VLGVSKDASKDEIKKAYRKLSKKYHPDINQEEGAEEKFKEITEAYEVLSDENKRANYDQFGHDGPQGGFGGQGFGGGQDFGGFGGGFEDIFSSFFGGGAQRDPNAPRKGDDLQYTMTVTFEEAAFGTEKEISIRKQVKCETCEGSGAKPGSKKKTCHYCNGSGHVSVEQNTILGRVRTEKVCPVCNGTGEEIEEPCPTCHGKGTETKNVKIKVKVPEGVDNDQQTPFSRGKRSRTQWRTSRRLIRCIPCRTFFYFSTEGDDIFYNLTVSFPQAALGDEIKVLPLKGHVMLSVPEGPN

SEQ ID NO: 62620 - protein, 426 aa, Bacillus licheniformis ATCC 14580
MVSHDLSKHSQISKEAQDALDGKSKGFKRLLPFLGPAFIAAIAYIDPGNFATNIAAGSKYGYLLLWVILFSNIMALLIQSLSAKLGIATGKNLPEVAREEFPKPVSIGLWIQGELVVIATDLAEFIGAALGLYLLFGIPMLEASIIAAAGSFAILELQRRGVRPLEAAITGMLFIVVIAFAFQTFFAKPDIGSVLEGMFVPRFDGADSILLAAGILGATVMPHAIYLHSALTQRRVVGKTEAEKKKIFRFEFIDILIAMLIAGAINASMLIVAAALFYKNGIFVEDLDVAFSHFSSMVSPLSAVLFGVGLLTAGLSSSSVGTLSGDIIMQGFINFRIPLYLRRFITILPPIAIIASGVNPTTALVLSQVVLSFGIAFALIPLILFTSNKRIMGSLKNAKWITAVSWLIAALIVALNIFLIYDTFSG

SEQ ID NO: 62621 - protein, 248 aa, Oryza sativa (indica cultivar-group)
MGKGKVHPSPSPARAAAAGAGGETAEAVLMRLLPAAVVAMAVGLGAEGKEVLAYLVLASMRSSSSAAAARWGEAEVGKKGGGGGGGGSGRVGHHAPELGCGCFGCYTAYWSRWDGSPERDRDAIHRAIEAFEDHLARKEEEEEEVGGGKGASSRRRKKRGGKDKVKAKAPPPPPPDQEETSAAAAAAASPPKSALGGEEEKEEEEETKTTTATAAVAAAGDGGVVEEERRRRGWGVLSWKVWNLWGSH

SEQ ID NO: 62622 - protein, 540 aa, Burkholderia xenovorans LB400
MTQNSLPSWSSLQTHYEKIRDAHMRDWFAPENDPAPTRAERFAFAGGGLAADFSKNRITDETLKLLVQLAREAGVEKRRDAMFAGAVVNPTEGRAALHTALRATDPKAPFYDQVQAERARMAAFADQVRSGEWKGYTGKRIRYVVNIGIGGSDLGPKMVVHALHHLATPEITTHFVSNVDGADLYNVMQQIDPEETLAIIVSKTFTTLETMTNARSLRDWFVEKGCPESALAKHFVGVSANPAEVVKFGIAKENVFEMWDWVGGRYSLWSAVGLSIMIAVGPQQFGELLAGANEMDQHFRDAPLEKNLPVLLGMIGIWYRNFFGSQSYLVAPYSEALHFLPSYLQQLEMESNGKSARLDGVMVDYPTAAVTWGEPGTNGQHAFFQMLHQGPTIVPIDFIAVLTPEHPLVSHHPKLLANCFAQSEALMLGRTLEEAKKVAGADKPELAPHLVFPGNRPTSTLLVDALTARSLGALIALYEHKVLVQASVWDINPFDQWGVELGKILGKVVEADLTAPSVDEKKHDSSTSALIARARAALKK

SEQ ID NO: 62623 - protein, 533 aa, Burkholderia xenovorans LB400
MTEADPTPPTLISPHNRALPLLTLTDLRIAESQAQATLPKHTLMSRAGKSAASFLQEQITRDISIEKSRHKVWLIAGPGNNGGDALVLATELHRAGIAVELCMPVEVKPDDARWALETARAAGVAIGAAVPASLDDYTWLVDGMFGIGLTRPLEGVFADVARRLSQRTQARPRKGGVLALDVPSGLDSDTGTAVGNGNVIGEGAAVHATHTITFIGAKPGLFTAQGRDLAGAVTVAPIGVDTRGRTAVQLNAPELFAAFLPPRDFATNKGSFGSLAVVGGDTGMCGAPILASRAALYTGAGKVHVALLGEGAPPYDPPHPELMLHAIDDLPLDHMDALAVGCGMGHRERATRVMHDVLHLYVPKLFDADALNLISKDPALAAEVTARGVQGDPCILTPHPLEAARLLGTDAPGVQRDRLTAARALAARFASVVVLKGTGTVVAAPDGRLAINPTGNAALATGGTGDVLGGIIGALLAQRLPRYEAALAGVYLHGLAADTLSAQGHGPAGLTAGELAPMVRTLLNRLFYPAADC

SEQ ID NO: 62624 - protein, 567 aa, Candida glabrata CBS 138
MQNSGRDLWQNQSGYMSSLQQGLNKSNMVGASTSHGKTPMLMANNDVFTIAPYRTRKDNARVSVLDKYEIIGYIAAGTYGKVYKAKSRQSSKSSSSTGSDSLAQDTKPTTEFSNTSSLQNAGTYGDMMGAHGPNSNNISAGGNTNPELSTRNNPNNPRVPTSTIISGDKRNSENTDNRRKAETTMYYAIKKFKTEKDGIEQLHYTGISQSACREMALCRELDNNHLTKLVEIFLQKKSIYMVYEFAEHDLLQIIHFHSHPEKRMIPPRMIRSIMWQILDGVSYLHQNWVLHRDLKPANIMVTMDGVVKIGDLGLARKFSNMLQTMYTGDKVVVTIWYRAPELLLGARHYTPAIDLWAVGCIFAELIGLQPIFKGEEAKMDSKKTVPFQANQLQRILKILGTPTPKSWPHLQKYPEYEQLSKFPKYRDNLPGWFHSAGGRDKHALSLLYHLLNYNPIERIDAINALDHSYFTHGDMPVCENVFEGLNYKYPARRIHTNDNDILNLGLHKPKVPAKVVQPTMNNSTATLGGLGVNKRILAAAAAAAAAVSGNSSSQSSRNMEPMKKKRK

SEQ ID NO: 62625 - protein, 232 aa, Erythrobacter sp. NAP1
MQQFDTRPLVRQVNYDADVTSHVAPQSKSDHVAFAFVKLLRFFADTFFARRYGHRAVVLETVAAVPGMVGGLLQHLRALRRMRDDEGWIRTLLDEAENERMHLMTFIEIAKPNAFERFLILSVQLVFYNFYFFLYLLAPRTAHRVVGYFEEEAVISYTAYLKEVESGRHENVPAPQIAIDYWQLHSDARLSDVIIAVRADEAEHRDVNHCFVDRIDERRDGTRAKRRKLGEA

SEQ ID NO: 62626 - protein, 523 aa, Mycobacterium avium subsp. paratuberculosis K-10
MSTVEVSAPEAAPPSPGRWRALLLAAVAACAACGIIYELALLTLSASLDGGGIVATSLIVAGYIAALGVGALLAKPLLARAALGFITVEALLGVVGGLSAAALYVVFAFLDGSVGSTWVLAVSTALIGGLVGAEVPLLMTLLQRGRTAGPADAGRTLANLDAADYLGALLGGLVWPFLLLPHLGMIRGAAATGMINLAAAAVVAIFLLRQVVSARQLALALCALAAALALLAGLLLRSADVETTSRQRLYADPIIAYRHTPYQEIVVTRRGDDTRLYLDGGLQFSTRDEYRYTESLVYPALGNGARSVLVLGGGDGLAARELLRQPGISRIVQVELDPAVIEIARSTLRAANGGSLDNPRVRVLTGDAMAWLRGPNPDRFDAVIVDLPDPDTPVLGRLYSTEFYALAAHALAPGGLLVVQAGSPFSTPTAYWRTVSTIRAAGYAVTPYHVHVPTFGDWGFVLAQRGDTPPAPKVPPDAPPLRFLDQRVLQAAVVFSGDVGPRPLEPSTLDNPRIVGDMRHGYD

SEQ ID NO: 62627 - protein, 483 aa, Erythrobacter sp. NAP1
MTAYPQVKMLIAGNWVAEGGDGEMPIVNPANEERIGSAPKASKAQLDAALAAADAGFQLWSNTPAIERFRVIRRAAELLRERAEGIARVMTLEMGKPHAQALGETTGAADLIDFLGEEAKRQGGRLVPVRSHNLLEQRVTQEPVGPAVLLTPWNFPINLPAKKIAGALAAGCSAILKPAETTPACAQMLTECFMDAGLPEGVLNLVCGDPAMISEHLIASPITRKVSFTGSTAVGKQLGALAAQGMKRFTPELGGHAPVVIGESADFDRTVAACAATKFRNAGQVCVSPTRFLVARGIYDKFVAEFSARSQKLKIGDASQDDSVEMGPLAHAGRVAAMQDLMGSMGGDQGEIVSGGTALDRPGHFFEPTIIASPSPESRLMTEEPFGPVAGIVPYDDIEEAVRIANSLRYGLAAYAFTASLDESHYLGKSLRAGMVAINHFAVGSPETPFGGIGDSGFGSESGVEGYLGYTETKLVTVAKSAP

SEQ ID NO: 62628 - protein, 324 aa, Thermus thermophilus
MALMTMVQALNRALDEEMAKDPRVVVLGEDVGKRGGVFLVTEGLLQKYGPDRVMDTPLSEAAIVGAALGMAAHGLRPVAEIQFADYIFPGFDQLVSQVAKLRYRSGGQFTAPLVVRMPSGGGVRGGHHHSQSPEAHFVHTAGLKVVAVSTPYDAKGLLKAAIRDEDPVVFLEPKRLYRSVKEEVPEEDYTLPIGKAALRREGKDLTLICYGTVMPEVLQAAAELAKAGVSAEVLDLRTLMPWDYEAVMNSVAKTGRVVLVSDAPRHASFVSEVAATIAEDLLDMLLAPPIRVTGFDTPYPYAQDKLYLPTVTRILNAAKRALDY

SEQ ID NO: 62629 - protein, 427 aa, Salinibacter ruber DSM 13855
MSTSLDNSILTVILGGGKGTRLYPLTKLRAKPAVPLAGRYRLIDVPVSTSINSGITRIFVLTQYNSASLNRHLARAYQFDRFSNGFVSILAAEQTPSSKDWFQGTADAVRRSLPHIEGHRHRHVLILSGDQLYSMDYRKMLAHHRETDADVTLGTIPVAADDATSFGILKTDDEHIITEFHEKPDRDELDGLESPVGPGLEDEGRVYHASMGMYIFDREPLHELLNANPNDHDFGNQIIPKAIDKMRVASYPFSDYWSDIGTIRSFYEANLMLAEPEPPFSLYDPNRPLYTRARMLPPAKVQNSTVQDSLITEGSLVENSQISKSVVGIRSYVGPDTTLKNTVMMGADHFRWHDMEERGFVEGPANPGIGENSYVEGAIIDKNVSIGKRCIIKNRDNVQEAEEDLYHIRDGIVVIPKNTRIPDDTII

SEQ ID NO: 62630 - protein, 427 aa, Arabidopsis thaliana
MDCLPDDLLVQILYLLPTKEAVSTSVLSKRWRTLFTRSDNLDFHDPISGRPEDILKSFNDFVDSSLAFQGGKHIKKFSLHTKIKTFEYHVLDRWICNALEHGVSELHLHLMHESWPWLFSIPSKVFNSSTLVKLSLGSRLYCPSFPPDTSLPALKVLLLDSILFRDDQLSNVFLAACPALEDLTIHHTYHPCVISSKSIKKLSLSVNSGYYGAGYILTLDTPSVVDLYYSDSPRHNAPLFHLDSLAKVTLDLHFIENNNREVQNDADVKNLIREICNVKTLHLTCSTVEVISVYCKGGLPMFNNLVELVFSSKKEGWRVLLPLLLENSPNLETLVLSDLHRYTFGRRHRFVGIPIPPNNQIKVLRIMQYQGSATVLKHISHFLLNMDCLEVMKVNVAAALDDPKKMQLTEDLLKLPTASCKLKIQVL

SEQ ID NO: 62631 - protein, 186 aa, Brassica napus
MSVFDAAIVNTELSKPTSIFGLRLWVVIGILLGSLIVIALFLLSLCLTSRRKNRKPRADFASAAVATPPISKEIKEIVPAPAEIQVDIGKMEHRVVFSDRVSSGESRGTASASETASYSGSGNVGPEVSHLGWGRWYTLRELEAATNGLCEENVIGRSGYGIVYRGVLTDGTKVAVKNLLNNRGQA

SEQ ID NO: 62632 - protein, 829 aa, Porphyra purpurea
ALVYGNGSSYVEQLTRLDDKLHVLEYRLVSSKDPLPAQNVYTSVELVAAGSRATRVTWSSAFQPTRDSVAPVIRERQMEAYAAGIKALQAKVTSGPSVRPLRVSVTKASMVSSSLVAQLVIAINGTAVHKVGLTPSGTPMTHDLVTLQLKSVDDTLELALEKEDGSVVAKGTIAASALLPTAEGPSQVTLDVDLGPGGGEDGKPVATYTLSVINASPPSPIEAAMQLLMAVGSELKEHLMQTAFLIGVDDAKWRYASYPQAVDTASLPKFSAVLPPSQVIQPTRVGHLFGRNTEFLYAQTRLLKLLVDSSEKGNIPEPRRSILAKLQEEVKAIVRENRFLAVFNGAVPEPKLVVERCTRDEEVAGQMIRGVNPMKIMRLTDKDDPARVVAKPLLGLVAPDGRNVTQLWKDNALFYADYPELMVGTLDAVSGAYTHQAVSSLLHAEVGAQKYWYAPRLVVYKKASGKLSILGFTLTRKDDGSDEVYTAATHPPSTYVLAKVHLTCADNQAHQFVSHLGMTHLLAEPFIVAAHNALPPDHILSVLLEPHFVDTIGINFLARQTLVSSVAPFTDATFSVGTANALDIFSAEYGKWDFLGDNFVNGLAKRGFGTDASVDGLDGFHYRDDGFKVWKALTRHVSRVLHAHYGVGGQDADAALAADADVAEWCAEMRDPKRAAIPSFPKAFTTVDALTEALVSLIFMCSAQHAAVNFPQAEYVTYVPNRPDSMRAPMPPTPAKGDLSRADFDAALPDTPVSLFQALFGHLLSAPTDAPASSYAAVKDRHPAAFGAFTADLQRITQEINERNQVLVANGEMPYPYLSPENMPLSIDI

SEQ ID NO: 62633 - protein, 144 aa, Coxiella burnetii RSA 493
MAIERTLSIIKPDAVAKNVIGQIYSRFEKAGLKIIAAKMCHLSKPQAEKFYAVHKDRPFYPDLVKFMTQGPVMIQVLEGENAIVKNREIMGATNPKEALPGTIRADFADSIDANAVHGSDGPETAKEEIAFFFKPDESFNSIGV

SEQ ID NO: 62634 - protein, 193 aa, Brassica napus
  misc_feature (130)..(130): Xaa can be any naturally occurring amino acid
  misc_feature (142)..(143): Xaa can be any naturally occurring amino acid
  misc_feature (161)..(161): Xaa can be any naturally occurring amino acid
MQSKIVGGGLPPAFSLFPSLNKTFTFHQILVLIITFLAYASFHASRKPPSIVKSVLGPSVNEQSNSPIDNGWAPFNGTEGTQRLGELDLAFLSSYALGMYFAGHLGDRIDLRLFLVFGMMGSGILTVVFXGLGYWMNVHLLXXFYMTVQIVWGVVQSMGWXCVVSGVGNWCGKEKRGLIMGVWNSHTSVGNMW

SEQ ID NO: 62635 - protein, 289 aa, Staphylococcus epidermidis
VLGVNKSASKDEIKKAYRKLSKKYHPDINKEEGADEKFKEISEAYEVLSDENKRANYDQFGHDGPQGGFGSQGFGGSDFGGFEDIFSSFFGGGSRQRDPNAPRKGDDLQYTMTITFEEAVFGTKKEISIKKDVTCHTCNGDGAKPGTSKKTCSYCNGAGRVSVEQNTILGRVRTEQVCPKCEGSGQEFEEPCPTCKGKGTENKTVKLEVTVPEGVDNEQQVRLAGEGSPGVNGGPHGDLYVVFRVKPSNTFERDGDDIYYNLDISFSQAALGDEIKIPTLKSNVVLTIP

SEQ ID NO: 62636 - protein, 120 aa, Ceratopteris richardii
  misc_feature (47)..(47): Xaa can be any naturally occurring amino acid
  misc_feature (50)..(50): Xaa can be any naturally occurring amino acid
  misc_feature (53)..(54): Xaa can be any naturally occurring amino acid
  misc_feature (86)..(86): Xaa can be any naturally occurring amino acid
  misc_feature (89)..(89): Xaa can be any naturally occurring amino acid
  misc_feature (95)..(95): Xaa can be any naturally occurring amino acid
MKKGSCIINTTSINAYKGNPTLLDYTPTKGAIVAFTKGLPLHLFGQXIQXNGXXPGPIWTPLIPSSFPPEKVKSFGEQFPIKKAGXPSXIGPSYXFLASKDSSYYSGQFLHPNGGLVVNG

SEQ ID NO: 62637 - protein, 305 aa, Arabidopsis thaliana
MDTRAPTIGGMRFASTITLGEKTPMKEEDANQKKTENESTGGDAAGGNNKGDKGIASYWGVEPNKITKEDGSEWKWNCFRPWETYKADITIDLKKHHVPTTFLDRIAYWTVKSLRWPTDLFFQRRYGCRAMMLETVAAVPGMVGGMLLHCKSLRRFEQSGGWIKALLEEAENERMHLMTFMEVAKPKWYERALVITVQGVFFNAYFLGYLISPKFAHRMVGYLEEEAIHSYTEFLKELDKGNIENVPAPAIAIDYWRLPADATLRDVVMVVRADEAHHRDVNHFASDIHYQGRELKEAPAPIGYH

SEQ ID NO: 62638 - protein, 295 aa, Staphylococcus equorum
VLGVSKGASKDEIKKAYRKLSKKYHPDINQEEGSDEKFKEISEAYETLSDENKRANYDQFGHDGPQGGFGGQGFGGQDFSGFGGGGFEDIFSSFFGGGRQQRDPNAPRKGDDLQYTMTVTFDEAVFGSEKEISIRKDVSCHTCDGAGAKPGTKKKTCQYCSGAGHVSVEQNTILGRVRTEKVCPVCSGSGQEFEEPCPTCKGKGTENKNVKISVTIPEGVDNEQQIRLAGEGAPGENGGPQGDLYIVFRVKPSEKFERDGDDIYYSLDISIAQASLGDEVKVPTLNSSVMLTIPA

SEQ ID NO: 62639 - protein, 172 aa, Ceratopteris richardii
  misc_feature (116)..(116): Xaa can be any naturally occurring amino acid
MDAFGPIDIVVNNAAEQYMVPGIEGINTDQIERVFRTNIFSHFYLTKHAVNHMKEGSCIINTTSINAYKGNPTLLDYTATKGAIVAFTRGLALHLVGRGIRVNGVAPGPIWTPLMXSSFPPEKVESFGEQVPMKRAGQPSEIGPSYVFLASEDSSYYSGQVLHPNGGVVVNG

SEQ ID NO: 62640 - protein, 145 aa, Brassica napus
  misc_feature (100)..(100): Xaa can be any naturally occurring amino acid
  misc_feature (142)..(142): Xaa can be any naturally occurring amino acid
NPSRLPLLLQSSSPPATATLDHAVRRGKVSRVRVSVLNDALKSMYGAEKIGKRQVMIRPSSKVIIKFLTVMQRHGYIGEFEYVDDHRSGKIVVELNGRLXKCGVISPRFDIGVKDIEGWTARLLPSRQFGYIVLTTSAGIMXHEE

SEQ ID NO: 62641 - protein, 295 aa, Staphylococcus felis
VLGVNKGASKDEIKKAYRKLSKKYHPDINKEEGADEKFKEISEAYEVLSDDNKRANYDQFGHAGAQNGGFGQGFGGQDFSGFGGGGFEDIFSSFFGGAQRQRDPNAPRRGDDLQYTMTVTFEEAVFGTEKEISIRKDVTCHTCDGDGAKPGTKKKTCSYCNGAGHVSVEQNTILGRVRTEKVCPQCNGSGQEFEEACPTCHGKGTETKNVKLQVTVPEGVDNDQQIRLANQGSPGENGGPSGDLFIIFRVKPSDKFIREGDDILYKHKISFSQAALGDEVKIPTLNSHVMLTIPS

SEQ ID NO: 62642 - protein, 294 aa, Staphylococcus fleurettii
VLGVSKDASKDEIKKAYRKLSKKFHPDINQEEGADAKFKEISEAYEILSDENKRAQYDRFGHNGPQQGFGGSQGFGGQDFSGFGGFEDIFGSFFGGGGARRDPNAPRQGDDLQYSMTLTFEEAVFGTEKDITVRKDVECDTCHGKGAKPGTKKKTCTYCNGQGHVTVEQNTILGRMQTQKVCPECEGSGEIFEEKCSDCHGKGTQNKKVTIKVKVPEGVDNDQQIRLAGKGGPGVNGGPAGDLYVVFRVKPHNKFRREGDDIFYDLNLSFPQAALGDEITVPTLTGNVSLSVPA

SEQ ID NO: 62643 - protein, 294 aa, Staphylococcus gallinarum
VLGVSKSASKDEIKKAYRKLSKKYHPDINKEEGSDEKFKEISEAYEVLSDENKRANYDQFGHDGPQGGFGGQGFGGQDFSGFGGGGFEDIFSSFFGGGRQRDPNAPRKGDDLQYTMTVTFDEAVFGAEKEISIRKDVTCHTCDGEGAKPGTNKKTCSYCNGAGHVSVEQNTILGRVRTEKVCPVCSGSGQEFEEPCPTCNGKGTENKNVKISVKIPEGVDNEQQIRLAGEGAPGENGGPHGDLYVVFRVKPSEIFERDGDDIYHSLNVSFAQAALGDEVKVPTLNGHVMLTIPA

SEQ ID NO: 62644 - protein, 208 aa, Prosthecochloris aestuarii DSM 271
MPAGLSSMSACGQSPAMKIDSATFYKSCSELKGLPVSSLPEIVFVGRSNVGKSTLLNTLTGRKALAKTSSTPGKTQLINYFTINDRLYFVDLPGYGYAKVAKGQRYEWGRLLGGYISEREEISLVVLLIDSRHPDMESDQQMIEFLEYYQRPYGIVLTKYDKLKQKEKSRVRKALKSFSLKTKFIVNYSALSGEGKESLLEQLENYTG

SEQ ID NO: 62645 - protein, 449 aa, Mycobacterium avium subsp. paratuberculosis K-10
MARLEQTRRLVTEIPGPASLELSKRRAAAVSHAVNVSVPVFVARAGGGIVEDVDGNRLIDLGSGIAVTTIGNSAPRVVDAVRAQVAEFTHTCFMVTPYESYVAVAEMLNRITPGAGDKRSVLFNSGAEAVENAVKVARAYTRKPAVVAFDHAYHGRTNLAMALTAKSMPYKGGFGPFAPEIYRAPLSYPYRDGLLDKELATDGEKAAARAINIIDGQIGADSLAAVIIEPIQGEGGFIVPVEGFLPTLLDWCRRNDVLFIADEVQTGFARSGAMFACEHEGPNGLEPDLICTAKAIADGLPLSAVTGRAQIMDAPHVGGLGGTFGGNPLACAAALATIETIESDGLIERARQLERLITEPLLRLQARDDRIGDVRGRGAMIAIELVKSGTAEPDKDLTQRLSVAAHAAGVIVLTCGMFGNIIRLLPPLTISDELLAEGIDILGGLLADL

SEQ ID NO: 62646 - protein, 805 aa, Oryza sativa (japonica cultivar-group)
MDVNEEAMAAHKRAFLDFLDQDVGKGVYMQAVRDMVQNKRHRLIIGMDDLRNHSLDLARRVIRSPAEYMQPASDAVTEVARNLDPKFLKEGQRVLVGFSGPFGFHRVTPRDLMSSFIGTMKFKLSYNVLQLILLVEKVYITVQSVSSDGSLVRPKVVKSVHYCPATGGTLSREYRDITSFVGLPTGSVYPTRDENGNLLVTEYGMCEYKDHQTLSMQEVPENSAPGQLPRTVDIIVEDDLVDSCKPGDRVSIVGVYKALPGKSKGSVSGVFRTVLIANNVSLMNKEANAPVYTREDLKRMKEISRRNDTFDLLGNSLAPSIYGHLWIKKAVVLLMLGGVEKNLKNGTHLRGDINMMMVGDPSVAKSQLLRAVMNIAPLAISTTGRGSSGVGLTAAVTSDQETGLSDFLWLGERRLEAGAMVLADRGVVCIDEFDKMNDQDRVAIHEVMEQQTVTIAKAGIHASLNARCSVIAAANPIYGTYDRSLTPTKNIGLPDSLLSRFDLLFIVLDQMDPEIDRQISEHVARMHRYCTDDGGIFVFYYNKEQDLLIKQDMLKKMMVMLMQPYLLNMIECSMGRTEGEARIKQDRLTVKFLKKYIHYAKNLIQPRLTDEASDHIATSYAELRDGGANAKSGGGTLPITARTLETIIRLSTAHAKMKLRHEVLKTDVEAALQVLNFAIYHKELTEMEEREQREMEMKQQADHDAGASGGNADEHRSSGNDPMDVDVGNASNDQDVPAERIEAFEAILGQHVLANHLDQISIDEIEQTVNREAAAPYNRRQVEFILERMQDANRIMIRDGIVRII

SEQ ID NO: 62647 - protein, 199 aa, Candida glabrata CBS 138
MFHLVKGLYNNWNKREQYSILILGLDNAGKTTFLETLKKEYSMHSKPLDKIAPTVGQNVATIPVDNNRSILKFWDVGGQASLRAMWSEYYPQCHGIIFVVDSTDRSRIDECSETLRTIVMDDEIEGIPILMLANKQDKPERMEVQDIKEIFNRIAEHMSARDSRVLPVCALTGEGIKDSIEWMILRLQRNKNDRPPVYK

SEQ ID NO: 62648 - protein, 331 aa, Zea mays
  misc_feature (100)..(100): Xaa can be any naturally occurring amino acid
  misc_feature (145)..(145): Xaa can be any naturally occurring amino acid
MAASLQAAATLMQPAKIGGRAPFASLPSRPSSQLACRAFGVDAGAARITCSLQDVASRCVDAAKLAGFALATSALLVSGASAEGTPKRLTYDEIQSKTYXMEVKGTGTANQCPTIDGGVESFPFKAGKYQMKKLCLEPTSFTVKXAEGIAKNAPPEFQKTKLMTRLTYTLDEIEGPLEVGSDGTLKFEEKDGIDYAAVTVQLPGGERVPFLFTVKQLVATGKPESFGGPFLVPSYRGSSFLDPKGRGGSTGYDNAVALPAGGRGDEEELQKENIKNAASSTGNITLSVTKSNPETGEVIGVFESVQPSDTDLGAKAPKDVKIQGVWYAQLE

SEQ ID NO: 62649 - protein, 130 aa, Salinibacter ruber DSM 13855
MQDRPLDSAHGLWTDPMSEKTIFQRIIDGEEDADILHEDDRCVAFRDINPEAPTHILIVPRKPIPSLDDLDTEDKDLVGHLFVVARELAQEEGLRDGYRTVINCGDDGGQSVWHLHLHLLGGRRMSWPPG

SEQ ID NO: 62650 - protein, 434 aa, Shigella flexneri 2a str. 2457T
MTTPLKKIVIVGGGAGGLEMATQLGHKLGRKKKAKITLVDRNHSHLWKPLLHEVATGSLDEGVDALSYLAHARNHGFQFQLGSVIDIDREAKTITIAELRDEKGELLVPERKIAYDTLVMALGSTSNDFNTPGVKENCIFLDNPHQARRFHQEMLNLFLKYSANLGANGKVNIAIVGGGATGVELSAELHNAIKQLHSYGYKGLTNEALNVTLVEAGERILPALPPRISAAAHNELTKLGVRVLTQTMVTSADEGGLHTKDGEYIEADLMVWAAGIKAPDFLKDIGGLETNRINQLVVEPTLQTTRDPDIYAIGDCASCPRPEGGFVPPRAQAAHQMATCAMNNILAQMNGKPLKNYQYKDHGSLVSLSNFSTVGSLMGNLTRGSMMIEGRIARFVYISLYRMHQIALHGYFKTGLMMLVGSINRVIRPRLKLH

SEQ ID NO: 62651 - protein, 294 aa, Staphylococcus haemolyticus
VLGVSKDASKDEIKKAYRKLSKKYHPDINKEEGADEKFKEISEAYEVLSDDNKKANYDQFGHDGPQGGFGGQGFSGQDFSGFGGGGFEDIFSSFFGGSRQRDPNAPRKGDDLQYTMTLEFEEAVFGTKKEISIRKDVTCHTCNGDGAKPGTSKKTCSYCNGAGHVSVEQNTILGRVRTQQTCPKCDGTGQEFEEPCPTCHGKGTENKTVKLEVTVPEGVDNDQQIRLAGEGTPGENGGPHGDLYVVFRVKPSDKFERDGDDLYYNLDVSFPQASLGDEIKVPTLNGNVMLTIPS

SEQ ID NO: 62652 - protein, 420 aa, Coxiella burnetii RSA 493
MSKKNVFYAQSGGATAVINATACGVIQTAAQYPTKIGKVLAGRNGIIGALKEELIDTSLESLENIAALRHTPSSAFGSCRYKLNNIHHDRRQYERLIEVFKAHDIGYVFYNGGGDSQDTTHKISQLSQLMDYPLVCIGLPKTIDNDLPFTDNCPGFGSVAKYIAVSTQEAALDVRGMCATSTKIFILEVMGRHAGWIAASSALGKSQPDDAPHLILFPEVPFQTEQFLTKVSRSVEKNGYCVIVASEGIRHPDGRFVAESGLHDAFGHEQLGGVAPILARLIKKRLNFKYHWAVADYLQRAARHIASQTDLDQAYALGKTAVEFALAGKSDVMLTIQREMGSDYKWRIGTAPLCEVANVEHKMPSHYISEDGFGITEACYTYLKPLIEGESYPPYKNGVPDYVTLKNQLVAKKLKEAFAV

SEQ ID NO: 62653 - protein, 729 aa, Streptococcus pyogenes MGAS10394
MATVSTGSLIFIVKKNSPMMSKLVFFWQNREKEFRDFGGFSEKSVYFCDTIDNRKRLILVVINREVLLMTFDAIDQLAVNTVRTLSMDAIQAANSGHPGLPMGAAPMAYVLWNHFMNINPKTSRNWSNRDRFILSAGHGSAMLYSLLHLAGYDLSVEDLKNFRQWGSKTPGHPEVNHTDGVEATTGPLGQGIANAVGMAMAEAHLAAKFNKPGFDIVDHYTFALNGDGDLMEGVSQEAASMAGHLKLGKLVLLYDSNDISLDGPTSMAFTEDVKGRFEAYGWQHILVKDGNDLEEIAAAIEAAKAETEKPTIIEVKTIIGFGAEKQGTSAVHGAPLGAEGIAFAKKAYQWTHQDFEVPAEVTERFAQGLQARGEKAEQAWNDLFAAYEAEYPELAAEYQKAFANEAAQVELEAHELGSSMASRVSSQQAIQQISEQVASFWGGSADLSASNNTMVKAETDFQPGHYEGRNVWFGVREFAMAAAMNGIALHGGTRVYGGTFFVFSNYLLPAVRMAALQNLPTVYVMTHDSIAVGEDGPTHEPIEQLASVRSMPNLNVIRPADGNETNAAWKRAIAETDRPTMLVLTRQNLPVLEGTKELAEDGLNKGAYILSEAKGDLEGILIATGSEVKLAMDTQEALEAEGIHVRVVSMPSQNIFDEQSAEYKESILPAAVTKRLAIEAGSSFGWAKYVGLAGKTLTIDTWGASAPGNRIFEEYGFTVANATELYKSL

SEQ ID NO: 62654 - protein, 277 aa, Beta vulgaris
  misc_feature (15)..(15): Xaa can be any naturally occurring amino acid
EDLQLLPKILTWCRXIHLFVGVVYCLISWTVGLPKRAPIDGTLLKLLIPVAVCHALGHVTSNVSFAAVAVSFTHTVKALEPFFNAAASQFILGQPIPITLWLSLAPVVIGVSMASLTELSFNWLGFISAMISNISFTYRSIYSKKAMTDMDSTNIYAYISIIALFVCLPPAIIVEGPQLIKHGFNDAITKVGLTKFVSDLFWVGMFYHLYNQLATNTLERVAPLTHAVGNVLKRVFVIGFSIIIFGNKISTQTAIGTSIAIAGVAIYSFIKAKMEEE

SEQ ID NO: 62655 - protein, 293 aa, Staphylococcus hominis subsp. hominis
VLGVSKDASKDEIKKAYRKLSKKYHPDINKEEGADEKFKEISEAYEVLSDDNKRANYDQFGHSGAQGGFGSQGFGGQDFSGFGGGFEDIFSSFFGGSRQRDPNAPRKGDDLQYTMTLEFDEAVFGTKKEISIRKDVTCHTCHGDGAKPGTSKKTCSYCHGSGHVSVEQNTILGRVRTEQTCPKCEGSGQEFEEPCPTCHGKGTENKTVKLEVTVPEGVDNEQQIRLAGEGAPGENGGPHGDLYVVFRVKPSDKFRRDGDDLFYELNISFPQASLGDEIKVPTLNSNVMLTIPA

SEQ ID NO: 62656 - protein, 358 aa, Torenia fournieri
AEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPILLTEAPLNPKANREKMTQIMFETFNTPAMYVAIQAVLSLYASGRTTGIVLDSGDGVSHTVPIYEGYALPHAILRLDLAGRDLTDYLMKILTERGYSFTTSAEREIVRDIKEKLAYIALDYEQELETSKTSSAVEKNYELPDGQVITIGAERFRCPEVLFQPSLVGMEAAGIHETTYNSIMKCDVDIRKDLYGNIVLSGGTTMFPGIADRMSKEITALAPSSMKIKVVAPPERKYSVWIGGSILASLSTFQQMWIAK

SEQ ID NO: 62657 - protein, 377 aa, Torenia fournieri
MAEAEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPILLTEAPLNPKANREKMTQIMFETFNTPAMYVAIQAVLSLYASGRTTGIVLDSGDGVSHTVPIYEGYALPHAILRLDLAGRDLTDYLMKILTERGYSFTTSAEREIVRDIKEKLAYIALDYEQEMETTKTSSAVEKNYGLPDGQVITIGAERFRCPEVLFQPSLVGMEAAGIHETTYNSIMKCDVDIRKDLYGNIVLSGGTTMFPGIADRMSKEITALAPSSMKIKVVAPPERKYSVWIGGSILASLSTFQQMWIAKAEYDESGPSIVHRKCF

SEQ ID NO: 62658 - protein, 292 aa, Staphylococcus hyicus
VLASKSASKDEIKKAYRKLSKKYHPDINKEEGSDAKFKEISEAYEILSDDQKRQQYDQFGHAGAQGGFSQGFGGQDFSGFGGSGFEDIYSSFFGGQRQRDPNAPRKGDDLQYTMTITFEEAVFGTKKEISIRKEVTCHTCNGNGAKPGTKKKTCSYCKGSGHVSVEQNTILGRVRTEKVCPQCNGSGEEFEESCPTCHGRGTQTKNVKLEVTVPEGVDNDQQIRLAGEGAPGENGGPAGDLFVVFRVKPSDKFTRDGDDILFKQNISIAQAALGDEIKVPTLNGQVMLTIPA

SEQ ID NO: 62659 - protein, 562 aa, Burkholderia xenovorans LB400
MTTPLAGQMMDVPLTVPSLLAHAARHFGSTEIVSRRIEGDLHRYTYRDCEKRAKQLAQALIALGVEPGERVATLAWNGYRHLEAYYGTTGFGAVCHTINPRLFPDQIAYIINHADDAYVLFDTTFAPLVDVLAPQCPKVRGWIALADEAHLPAMQTPVLSYETLVTAQDGNYEWPPLDERQASYLCYTSGTTGNPKGALYSHRSTVLHAFGAALPDAMSLSARDCVLPVVPMFHVNAWGIPHSAPLTGAKLVFPGKDLDGKSLYELMESERVTYSAGVPTVWLGLLNYLREAKVRFSSLNRTVIGGSACPPAMLRTFEDDYGVQVIHAWGMTEMSPLGTLSRLTWEQSQRPLEEQRKLLEKQGHVLYGVDMKIVGEDGRELPWDGVAFGDLHVRGPWVIDRYFRKDDSPLVDGWFPTGDVATIDRDSFLHITDRSKDVIKSGGEWISSIDIENVAIAHPAVAEAACIACAHPKWTERPLLVVVKRPGFEVTRDELIAFYEGKVARWWIPDDVAFVDELPHTATGKLQKLKLRDIFRDHVLPSALEDEKDCPLTPLARGNPVS

SEQ ID NO: 62660 - protein, 317 aa, Solanum lycopersicum
MPVFKTPFNGYSVKFSPFYENKLAVATAQNFGILGNGRVHILQLNPNGPVSELAAFDTADGVYDVCWSEAHDSLVIAGSGDGSVKLYDLSLPPTNNPIRSFKEHTREVHSVDYNTVRKDSFLSASWDDTVKLWTVDRNASVRTFKEHAYCVYSAAWNPRHADIFASASGDCTTRIWDVREPGSTMILPAHEFEILTCDWSKYDDCIIATASVDKSIKVWDVRNYRVPISVLNGHGYAVRKVRFSPHRASAMVSCSYDMTVCMWDYMVEDALIGRYDHHTEFAVGVDMMSVLVEGLLASTGWDELVYVWQHGMDPRAS

SEQ ID NO: 62661 - protein, 740 aa, Oryza sativa (japonica cultivar-group)
MAGAVLVAIAASIGNLLQGWDNATIAGAVLYIKKEFNLQSEPLIEGLIVAMSLIGATIITTFSGAVADSFGRRPMLIASAVLYFVSGLVMLWAPNVYVLLLARLIDGFGIGLAVTLVPLYISETAPTDIRGLLNTLPQFSGSGGMFLSYCMVFGMSLMPQPDWRIMLGVLSIPSLIYFALTIFYLPESPRWLVSKGRMAEAKRVLQGLRGREDVSGEMALLVEGLGVGKDTKIEEYIIGPDDELADEGLAPDPEKIKLYGPEEGLSWVARPVHGQSALGSALGLISRHGSMVSQGKPLVDPVVTLFGSVHEKMPEIMGSMRSTLFPNFGSMFSVAEQQQAKGDWDAESQREGEDYGSDHGGDDIEDSLQSPLISRQATSVEGKEIAAPHGSIMGAVGRSSSLMQGGEAVSSMGIGGGWQLAWKWTEREGADGEKEGGFQRIYLHEEGVTGDRRGSILSLPGGDVPPGGEFVQAAALVSQPALYSKELMEQRLAGPAMVHPSQAVAKGPKWADLFEPGVKHALFVGIGIQILQQFAGINGVLYYTPQILEQAGVGVLLANIGLSSSSASILISGLTTLLMLPSIGIAMRLMDMSGRRFLLLATIPILIVALAILILVNILDVGTMVHASLSTVSVILYFCFFVMGFGPIPNILCAEIFPTTVRGICIAICALTFWIGDIIVTYTLPVMLNAIGLAGVFGIYAVVCILAFLFVFMKVPETKGMPLEVITEFFSVGAKQAKED

SEQ ID NO: 62662 - protein, 294 aa, Staphylococcus intermedius
VLGVSKSASKDEIKKAYRKLSKKYHPDINKEEGSDEKFKEISEAYEVLSDENKRAQYDQFGHSGPQGGFGQGFGGQDFSGFGGGGFEDIFSQFFGGAQRQRDPNAPRRGDDLQYTMTVTFDEAVFGTKKEISIRKEVTCHTCDGEGAKPGTKKKTCSYCHGAGHVSVEQNTILGRVRTEKVCPECNGTGEEFEEPCPTCHGKGTELKNVKLEVTVPEGVDNDQQIRLAGQGGPGENGGPAGDLFVIFRVQPSDKFTREGDDILYNHNISFAQAALGDEVKIPTLNGHVMLTVPE

SEQ ID NO: 62663 - protein, 376 aa, Saccharophagus degradans 2-40
MTDTFIKSRAAVAWAAGEPLSIEEVDVMMPKAGEVLVKIVATGVCHTDAFTLSGEDPEGIFPAILGHEGGGIVEALGEGVTSVAVGDHVIPLYTPECGECKFCLSGKTNLCQKIRATQGKGLMPDGTTRFYKDGQPIYHYMGTSTFSEYTVLPEISLAKVNQKAPLEEVCLLGCGVTTGMGAVMNTAKVKEGDTVAIFGLGGIGLSAVIGATMAKASRIIAIDINESKFELAKKLGATDCINPKLYDKPIQDVIVELTDGGVDFSFECIGNVNVMRSALECCHKGWGESIIIGVAGAGQEISTRPFQLVTGRVWRGTAFGGVKGRSELPGIVEQYLAGDFKLDDFITHTMGLEDINTAFDLMHHGKSIRSVIHFNK

SEQ ID NO: 62664 - protein, 332 aa, Burkholderia xenovorans LB400
MSQINRQLVLASRPQGAVTPDNFRLVEAPLAPLADGELRVRNHYLSLDPYMRGRMNDSKSYAPPQPLNEVMIGGTVGEVVESKNPKFAVGDKVVAMFGWQEYGTSNGTGLQKVDDTHVPLSAYLGPVGMPGVTAWYGLNRIIAPKAGETVVVSAASGAVGSVVGQLAKLAGARAVGIAGGADKCRYVTGTLGFDACVDYKAGNLYQDLKAATPNGVDGYFENVGGEVLDATLARMNPFGRIALCGFIAGYDGQPVPLRHPSLMLTQRLLVQGFIVSEHMDVWPEALKRLGTLVAQKKLHYRETIAQGLDAAPEAFMGLLKGKNFGKQLVKLI

SEQ ID NO: 62665 - protein, 180 aa, Mycobacterium avium subsp. paratuberculosis K-10
MTDAGEATPVAELIASLTRQVPDFPKPGIQFKDLTPLFAEATAMTAVTGALARHASGADLVAGIDSRGFLVAAAVADRLHTGVLAIRKGGKLPPPVHAERYDLEYGSATLEIPADGIDLRGRRIVIIDDVLATGGTLAAAARLLRRTGATVTAAAVVFELGALGGRAALAPLPVHSLTCQ

SEQ ID NO: 62666 - protein, 356 aa, Triticum aestivum
FRAAARAGAVVSTQSPDNPDWFQGTADAVRQYLWLFEEHNVMEYLILAGDHLYRMDYEKFIQAHRETDADITVAALPMDEERATAFGLMKIDEEGRIIEFAEKPKGEQLKAMMVDTTILGLDDARAKEMPYIASMGIYVISKHVMLQLLREQFPGANDFGSEVIPGATSTGMRVQAYLYDGYWEDIGTIEAFYNANLGITKKPIPRFSFYDRSAPIYTQPRHLPPSKVLDADVTDSVIGEGCVIKNCKIHHSVVGLRSCISEGAIIEDTLLMGADYYETEADKKLLAEKGGIPIGIGKNSHIKRAIIDKNARIGDNVMIINVDNVQEAARETDGYFIKSGIVTVIKDALLPSGTVI

SEQ ID NO: 62667 - protein, 321 aa, Burkholderia xenovorans LB400
MPLNPKIEQVLDMIERARRPKFHEMTAQDARASYEKSAPILEIASAPMFAIEDLRIPTRDGATIRARLYHPVEPGWAEPAPALVYYHGGGFTVGSVNTHDALCRMFARDGKCTVLSVDYRLAPEYKFPTAVEDAFDALTWLHAHAAEYGVDASRIAVGGDSAGGTLATVCAVLAREHGIEPVLQLLIYPGTTGHQQTDSHSRFANGFLLSGDTIQWFFEHYVRDRSDRDDWRFAPLDGRHGAPDFRGVAPAWIATAEYDPLSDEGDAYAEKLRALGNRVTLKRYPGMIHEFFKMGGFVPEVGEAHADAAAALRAAFGVDAH

SEQ ID NO: 62668 - protein, 281 aa, Burkholderia xenovorans LB400
MCLIVFDWRPDAVDGPLFTLAANRDEFFRRTAEPVSWWHDAPTVLAGRDLQGGGTWLGSSRDGRFAALTNYRAPHEMRADAPTRGTLVSDWLTSATRDSNGSPHATPLAYLQHVAQTGDIYNGFNLLVGDWTRRELAWYCNRSDRAPTLLAAGTHGISNAVLDTAWPKLVKKRAELGTLLARTAMPPLERLIELMRDPRLARDDELPSTGIPLERERALSAAFIETPDYGTRGTTALRVAVHGEVINVAVAERSDDNGSHRIARPGDFERSFAFNIERERV

SEQ ID NO: 62669 - protein, 307 aa, Pseudomonas putida GB-1
MGKAIRAQVRIILPDIGAFDPMPQTKHPSNAPQLLSSVTVAHLPARHALAHKGDFGHVLVVGGDLGTGGAVLLSAEAALRCGAGLVSVATRPEHVAASLARLPEVMCLGASSANQLMGVLERASVLVVGPGLGQAAWGRSLLSAVANAERPQVWDADALNLLARTPLALPSGSILTPHPGEAARLLGISTEAVQADRPGAARKLARRYNSVCVLKGAGTLVAAPAGQLALCERGHPAMAGAGLGDVLTGVLAALLAQGLDAWSAGCLGTWLHACAGERLGVKGRGLAASDLAPVIRELLEEHSACLA

SEQ ID NO: 62670 - protein, 1073 aa, Coxiella burnetii RSA 493
MPKRNDIKSILIIGAGPIIIGQACEFDYSGTQACRALREEGYRVILVNSNPATIMTDPDLADATYIEPVHWEVIAKIIEKEKPDALLPTMGGQTGLNCALDLVREGILEKYGVELIGASREAIDKAEDRSLFQKAMLKIGLQTPRSGLAHSMEDAWKILEQVGFPAIIRPSFTLGGSGGGIAYNRDEFLAICTRGLELSPTTEILIDESIAGWKEFELEVVRDKNDNCIIVCSIENFDPMGIHTGDSITVAPAQTLTDKEYQRMRDAAIAILREIGVETGGSNVQFGINPDDGRMIVIEMNPRVSRSSALASKATGFPIAKIAAKLAVGYTLDELKNEITGGRTPASFEPTIDYVVTKIPRFNFEKFPQAEPRLTTQMKSVGEVMAIGRTFQESLQKAIRGLEVGVYGLEPKIKIEEELSADDVKIREKIKKELRFAGPERLWYLADSFRIGLSCEEVYDYSKIDRWFLVQIEELVQLEKSIANKSLKKLSRDELFYLKRKGFSDQRLAQLLQTTEDRVRRYRHKLKIRPVYKRVDTCAAEFATDTAYLYSTYEEENECAPTKRNKIMVLGSGPNRIGQGIEFDYCCVHAALAMRELGYESIMVNCNPETVSTDFDISDRLYFEPLTLEDVLEIVAIEKPRGIIVQFGGQTPLKLASALAKAGVPIVGTTPDAIDRAEDRERFQALIQGVGLRQPPNGTVRSVEEGLRLAKVFAYPLIVRPSYVLGGRAMKVIYSEKELTRYMTKDVIVSEGEPLLLDRFLDDAIEVDVDAICDGENVLIGGILEHIEQAGVHSGDSSCAFPPHSLSPEIQEQLREQVRLIAKELGVVGLINTQFAIQENEIYVLEVNPRASRTVPFLAKATGMPLAKIAARTMVGVSLTEQKLMGEFRPRYFAVKKPVFPFNKFLGVDPILGPEMRSTGEAMGIAENFGQAFAKGQLAGGDVMPTSGRAFVSVRDADKKRVLNVARSLADLGFEIVSTRGTAKALQVAGIPCTVVNKVNEGRPHIIDMIKNDQISFIINTTEGEQAIEDSHTIRTSAVQHKVCYTTTLAGGEAAVSALQSTHSGEIHRLQDL

SEQ ID NO: 62671 - protein, 264 aa, Triticum aestivum
  misc_feature (223)..(223): Xaa can be any naturally occurring amino acid
MATARALRLFASSSPATRRGLLGAHGRALSASSQASGAGDPAVHSGDPPSDDYAERPPKFSGAEEATEGRGHDKHQPSSAKTTRPTEASAREQRVPRRSRPSGKLGSQELADPAAGSTFTQKRRWSSNSKPAGSDPLGDATPGDEEAAARKVREEDREYYRTHKPSPLAEVEFADTRKPVTRATDGGAEDRLEQNVPGTMVEDTADASLARAEAMFREAASRXTPRGRTPARSPPCWPGKAGRAVMAPGVPRHGEARLIRVRIA

SEQ ID NO: 62672 - protein, 294 aa, Staphylococcus kloosii
VLGVSKDASKDEIKKAYRKLSKKYHPDINKEEGADEKFKEISEAYEVLGDENKRANYDQFGHSGPQGGFGGQGFGGQDFSGFGGGGFEDIFSSFFGGGRQRDPNAPRKGDDLQYTMTVTFDEAVFGTEKEISIRKDVTCHTCDGEGAKPGSKKKTCHYCNGAGHVSVEQNTILGRVRTEKVCPVCEGSGQEFEEPCETCHGKGTENKTVKIKVTVPEGVDNEQQIRLAGEGTPGENGGPHGDLYVVFRVKPSEKFERMGDDIYYSLDITFPQAALGDEIKVPTLKSSVMLTVPA

SEQ ID NO: 62673 - protein, 303 aa, Oryza sativa (japonica cultivar-group)
MPFWQNRSSSCIQQQSLIVNTHLLFPHDHSLSIVRLKQVYKILQYIEAYQEEHKLGPMPIILCGDWNGSKRGQVYKFLRSQGFVSSYDTAHQYSDSEEDAHKWVSHRNHRGNICGVDFIWLLNPNKSRKPLKTSWNEAVFGIIKYLLLQVASLSEENAFALLKADSPDDQITYSSFCQALCQLGMVHPDRLNSEEIKDLWSEADHDGDDIVDYKEFQRCIWSPTCCSQEEEDDTEIDISDGSLVTFEANDEAFGFTVKEAVLFPPEVEKGMWPENYSLSDHAPLTVVFSPVRMPCSPRTPRTP

SEQ ID NO: 62674 - protein, 442 aa, Oryza sativa (japonica cultivar-group)
MRELVLGRVVVVVLSVGVLILFVLGVVVGWRAMQAKKQRREAAARRRREQQQQGREQRHHHHHRRRPLLLQPRDERCVSCTTFNILAPIYKRMDSENCRESQYRAYWFSRNEKIIDRLLADCSSIICLQEVWLGNDELVDMYEKRLGDANYSLFKLARTNNRGDGLLTAVNKNYFHVLNYRELLFNDFGDRVAQLLHVESAMPFWQNRSSSCIQQQSLIVNTHLLFPHDHSLSIVRLKQVYKILQYIEAYQEEHKLGPMPIILCGDWNGSKRGQVYKFLRSQGFVSSYDTAHQYSDSEEDAHKWVSHRNHRGNICGVDFIWLLNPNKSRKPLKTSWNEAVFGIIKYLLLQVASLSEENAFALLKADSPDDQITYSSFCQALCQLGMVHPDRLNSEEIKDLWSEADHDGDDIVDYKEFQVIPCVIFCWRFCLELNNNMVPIIR

SEQ ID NO: 62675 - protein, 294 aa, Staphylococcus lentus
VLGVSKDASQDEIKKAYRKLSKKYHPDINHEEGADAKFKELSEAYEILSDENKRAQYDRFGHNASQQGFGGGSQGFGGQDFSGFGGFEDIFGSFFGGGARRDPNAPRQGDDLQYSMTLSFEEAVFGTEKDITVRKDVECDTCHGNGAKPGTKKKTCSYCNGQGHVTVEQNTILGRMQTQKVCPECNGTGQEFEEKCPDCQGKGTQNKKVTIKVKVPAGVDNDQQIRLAGKGGPGVNGGPAGDLYVVFRVRPHDKFKRDGDDIFYDLNLSFPQAALGDEVTVPTLNGSVALTVPA

SEQ ID NO: 62676 - protein, 211 aa, Sporosarcina pasteurii
MKTIHLGIGGPVGSGKTTLVKTLSEALKEEYSIAVITNDIYTREDANFLINENILEKDRIIGVETGGCPHTAIREDASMNFEAIEELKNRFDDLEIILLESGGDNLSATFSPELVDAFIYVIDVSEGGDIPRKGGPGVTRSDFLMVNKTELAPYVGVDLDTMKNDTIKARNGRPFTFANIKTKKGLDEIIAWIKSDLLLEGKTNESASESK

SEQ ID NO: 62677 - protein, 293 aa, Staphylococcus lugdunensis
VLGVSKDASKDEIKKAYRKLSKKYHPDINKEEGADEKFKEISEAYEILSDDNKRANYDQFGHSGPQGGFGNQGFGGQDFSGFGGGFEDIFSSFFGGSRQRDPNAPRKGDDLQYTMTIDFEEAVFGATKEISIRKDVKCHTCNGEGAKPGTSKKTCSYCKGSGRTSVEQNTILGRVRTEQTCPKCQGTGQEFEEPCPTCHGKGTENKVVKLEVNVPEGVDNEQQIRLGGEGSPGENGGPNGDLYVVFRVRPSKKFERDGDDIYYNLNISFPQAALGDEIKVPTLKGNVMLTIPS

SEQ ID NO: 62678 - protein, 374 aa, Coxiella burnetii RSA 493
MAKRDYYEVLGVNLNATEAEVKKAFRRLAMKYHPDRNPGDKDAEVKFKEAREAYEVLCDSRKRASYDQFGHAGVEQTFGGAGAGGFGFGDLGDIFGDIFGDIFGGARGGQAREQRGADLAYELVLSLEEAVHGLSRTIKVPTWINCKTCNGSGAKGSSPATCPRCNGSGQMRMQHGFLQVQQTCSVCRGRGQVIKDPCTDCHGQGRQQQTKTLSVKIPPGIDTGDRIRLAGEGEAGLFGAPPGDLYVQVRVKPHPLFHREGNDLHSEVPIDFTTAALGGEMEIPTLDGSVRLTIPPETQGGKQFRLRGKGVKALRSGAVGDLICHIVVETPVKLSPEQKDYLKQFAELLKKDEKNHSPRTRNWFDSVKDFFTSK

SEQ ID NO: 62679 - protein, 294 aa, Staphylococcus lutrae
VLGVSKGASKDEIKKAYRNLSKKYHPDINKEEGSDEKFKEISEAYEVLSDDNKRAQYDQFGHSGPQGGFGQGFGGQDFSGFGGAGFEDIFSSFFGGAQRQRDPNAPRRGDDLQYTMTVTFEEAVFGTKKEISIRKEVTCHTCDGEGAKPGTKKKTCSYCNGAGHVSVEQNTILGRVRTEQVCPECNGSGETFDEPCPTCHGKGTEMKNVKLEVTVPEGVDNDQQIRLSGQGGPGENGGPAGDLFVVFRVKPSDKFKRDGDDIIYHHDIGFAQAALGDEVKIPTLNGHVMLTIPE

SEQ ID NO: 62680 - protein, 420 aa, Oryza sativa
MPLIQQLLPDTGMSISHCEDNDSDRISNLPDKLLHHVMSYLTAQEAVRTCVLSRRWQNVWSSMMFLHANAAKSSSITSFKKFLDNVLLYRNPVPLKGLWVSAACDNSDDSLDYSDIHRWVHHVLRSNAREVGIFVRCGSKLLSIDGYPFAFNSVHLSKLVLFKFTVNDCFAKKFSSGCPVLKDLVLISCGIDVTMFSSTTLKSFVIHNAEDIEHLPKQIEYLVIEMPNLVTLHIEEIPRRNIHLVDLSSVKEATIYFFEHSFRNSAVDCNILSALSNATSLKLICDSVYDEVSKVLMRDLPRCKAFDNLKRLKLGEWFLRNGCYPLLFLLRYSPHIEKLRLQLTKLGAEEYEKFPTAAAAIDPPCKEAARTFHCEKLTEIEIVYPQGDKRVHIIVRILIANISPLPEIKIKPFPKSGLSW

SEQ ID NO: 62681 - protein, 295 aa, Staphylococcus muscae
VLGLSKSASKDEIKRAYRKLSKKYHPDINKEEGADEKFKEISEAYEVLSDENKRANYDQFGHAGAQGGFGQGGFSGQDFSGFGGGGFEDIFSSFFGGAQRQRDPNAPRKGDDLQYTMTVTFEEAVFGTKKEISVRKEVVCHTCNGEGAKPGTKKHTCSYCNGTGHVSVEQNTILGRVRTQQVCPECNGSGQEFEEPCPTCHGKGTEVKTVKLEVTVPEGVDNDQQIRLSGQGSPGENGGPAGDLYVVFRVQPSDKFERDGDDVYYHHSISFAQAALGDEIKIPTLNGQGILTIPA

SEQ ID NO: 62682 - protein, 386 aa, Geobacillus kaustophilus HTA426
MSALFPTYNRWKIAVQAAEGTVVTDVNGKQYLDFVSGIAVCNLGHRHPHVQKAIEKQLNQYWHVSNLFTIPIQEEVASLLVAHSAGDCVFFCNSGAEANEAALKLARKHTGRHKVITFHQSFHGRTFATMAATGQEKVHSGFGPLLPEFIHLPLNDVDALKQAMSEEVAAVMLEVVQGEGGVRPVDPAFLQTASELCQQHGALLIIDEVQTGIGRTGKPFAYQHFDVEPDIITAAKGLGSGIPVGAMIGKAFLKESFGPGVHGSTFGGNPIAMAAAKATLEVVFDPAFLQDVQEKGRYLLARLHDALASLDIVKDVRGLGLLVGIECQTDVAPLLPLIHESGLLVLSAGPNVIRLLPPLVVTKAEIDEAVDILTNVLNNANASAVL

SEQ ID NO: 62683 - protein, 536 aa, Mycobacterium avium subsp. paratuberculosis K-10
MSDEPTQPPNPAGADAPGVTRRRLLTTGAVSAALGVGIGDGATLLWSQSARKRGPWPWLQPNRNDAPPVAGLHLQFGKNAGTEVVVSWHSTDAVRNPRVVFGTPASGFGRTVAADTRTYRDAKSGIEVRVNHARLTGLTPDTDYVYAALHDGAQPQQGTVRTAPMGRKPLRFTSFGDQSTPALAKMPNGRYATDNIGSPAAADTTMAIERIGPLFNLVNGDLCYANLAQNRIRTWSDWFENNSRSARFRPWMPAAGNHENELGNGPIGYGAYQTYFALPDSGSSPQTRGLWYSFTAGSVRVISLNNDDVAFQDGGNSYVHGYSGGEQKRWLATELAAARRDPDVDWLVVCMHQTAISTADRTNGADLGIREEWLPLFDQYQVDLVVCGHEHHYERSHPLRGALGTDTRTPIPVDTRSDLIDATRGTVHLVIGGGGTSAPSNAMFFPEPRCRVLTGVGAFDPGLGRKAPIYVIEDAPWSAFRDRDNPYGFVAFDVDPGPAGGNTSISATHYALTGPLGEMSVIDRFTLTKPRGDGAR

SEQ ID NO: 62684 - protein, 459 aa, Aspergillus oryzae
MADVAIPIFRPQLPAFAALSRYYASKSFPPHTIISMPALSPTMLAGNIGAWQKKPGDSLQPGDVLVEIETDKAQMDFEFQEEGVLAKVLKETGEKEVAVGSPIAVLVEEGTDVSSFESFTAEDAGGDKGAAPAQESKEESKGAADAAPASTPAPEPAAQEPETSGEKLQPSLDREPTISPAAKALALEKGVPIKALKGTGRGGQITKEDVEKYKPSASAAAGPTYEDIPLTSMRKTIASRLQQSTRENPHFFVSTTLSVTKLLKLRQALNASADGKYKLSVNDFLVKACAAALQKVPAVNSSWHEENGQVVIRQHKNADISVAVATPAGLITPVVKNVQGLGLSSISNSIKDLGKRARDNKLKPEEYQGGTFTISNMGMNPAVERFTAVINPPQAGILAVGTTRKVAVPVETENGTEVEWDDQIIVTGSFDHKVVDGAVGAEWIKELKKVVENPLELLL

SEQ ID NO: 62685 - protein, 331 aa, Vibrio cholerae O1 biovar eltor str. N16961
MTIKVGINGFGRIGRFVFRAAQERNDIEIVGINDLIDVDYMAYMLKYDSTHGRFNGTVEVKDGNLIVNGKTVRVTAERNPADLKWGEIGVDVVAEATGLFLTDETARKHIEAGAKKVVLTGPSKDKTPMFVMGVNHKTYAGQDIVSNASCTTNCLAPIAKVLNDNFGIESGLMTTVHATTATQKTVDGPSAKDWRGGRGASQNIIPSSTGAAKAVGVVLPELNGKLTGMAFRVPTANVSVVDLTVNLQKAASYDDIKAAMKAASEGELAGILGYTEDAVVSTDFNGDTRTSIFDADAGIALTDKFVKVVSWYDNEIGYSNKVLDLIAHISK

SEQ ID NO: 62686 - protein, 296 aa, Vibrio cholerae O1 biovar eltor str. N16961
MDLLSLKTVTTLSDCVTIAEQDQVKIVRVIHDKASAAISLHGGHVLSFQPKGQADLLWMSSQAIYDGKAALRGGIPVCWPWFGRIAAPAHGFARNQEWKLIEHREIEQGVIVTLGLQATPESLAIWPYQFDVRLHVEIRESLTVTLDVTNTDSKAWTFSGALHTYLHVGDIRETQTSGVGTEYIDSLQNSRLCTQHGLLTLTDTIDRVYTQPEPLITVQDPALARTLTVENQGHNSAVLWNPWQQGAQSMADMNDEGYLHFLCVESTLHAPSLAEGITLQPGQNHQLVTQITSQAQ

SEQ ID NO: 62687 - protein, 996 aa, Ustilago maydis 521
MEYPTNDGTDFDDCRALNPQYNSSTWSACSNNRRQSSRRTTSTLSAALSAIRLGSSLNVPFLLLGSFAFFLAFCASSAQARVLPAALDQSQPLGDSRASFQAYSDIAHHDRFIALARRGSVPNASPSHFDSTSPASASSHDILQWIRDELHETDSESSQAFLNQLYQRLSVQQRSVADVVPSHVAPTSSRFRFWKRATSGGSESQCHETELSEAQKAVYGILIPILVVLSGLFAGLTLGYMSLDETQLQVLALQGTPKQKQYAEKIMPIRKDGHLLLTTLLIANMITNETLPIIADPLLGGGVQAVIVSIVLVVIFAELIPQSVCSRYGLAIGAKLAPLTRVVIILLWPIAFPVSRVLHWTLGPHHGIVYRRSELKELVNMHAATAGRGDLNNDTVTIVGGALDLQEKVVKQAMTPIDQVFMISIESKLGYETLQQIVSSGHSRIPVYQEIEIPVNRARGGSGTLTPNRGSGLLNALSRKASNTQTKASSDDQRTLDGSVTTDKELLPVNAESQVTTVSASVATNEKSGTTTIKRKKIIGALLVKQCVLLDPEDETPVRDMVINALPTVPADEPLLNLLNVFQEGRSHLAIVSSRTRRSSPGSFVDLGNENDPRKTQAVTRSGTAARVEDLGDIDEEKQLDDSTIKKSGFWSRHLRRHHRHATKTSSQDLPPEALGEDVDAGAVATEMAQRDVPIGIITLEDVLEELIGEEILDEYDSEVEQNFAQISPPPSPGHKEMMDKKVEAPKDADEVQLPSSILKLPTSPKITLPRFKLGRSASQKDTDIGDLAPTKSLSVPPTPVLESSGAELPSIKETQPKSGNAGVHFPFEVAESRCRTDGALSRPGSRPVSPGPGAVLASTDEQPTHAVPRANKPVVIRHQAPDGTIATAIVAESLLRGRTNALNTERSASGDASRSNTPSGTRVSRFKSTPLPVSVPSTPVTAAPPRGRPFGKSEIGSTFAEGETATAPVASPEELDSDERYKQLGNGDTDETDTL

SEQ ID NO: 62688 - protein, 314 aa, Oryza sativa (japonica cultivar-group)
MARRSRRRTAVPHALAAEILRCCDRALAALRAGGDAESSSADTKRKPATAQPSTRRRRRYIYMYVSSRSCDGARDRAATQQEIFCRATASGGGAAAAAEPARVEKARTSEDGFLWRKYGQKEIKNSKHPRLYYRCSYKDDHGCTATKQVQQSEEDPSLYVITYFGDHTCSCQTAAAAAMDDDDDDENSQHFVINFGPATASRSGSPPLLYDDGDDGDVWRETAATPPSSRQSRCSPEGDGEESGVKMSKEEPVDSCPGPSAVSSPADVVSCSSPAMEPDLLGCLNWDDDFGDSSFVDADEFMNFDEIDLFQIYS

SEQ ID NO: 62689 - protein, 243 aa, Zea mays
MEGSTTTTEGHVVGIPVSTRAYGIEEPDFPAEETQTPDHGEFPSSFQYNDSHDATSSTTTTDRPTSDQQGTTCRKGGSIAQGIKEHVTLGPNLSDTVKGKFSLVAKIVRAGGVEKVFRRWFSADKNEKLLRASQCHLSTTAGPIAGVLFVSTARVAFRSDRALAVPVPVPTPRGGTARVPYKVAIPLRKVRAVRPSENKHRPEQKYVRLATTDGFEFWFMGFVSYDKSLQHLERAVAYAQQAQ

SEQ ID NO: 62690 - protein, 459 aa, Rickettsia sibirica 246
MEQYDVAVIGGGPGGYVAAIRAAQLKKKVVLVEKEHLGGVCLNWGCIPTKSLLKSAEVFEYIKHAKDYGIDAKGAEINIKKIVERSREISNKLAGGVKLLLKKNKVTVIDGVASLAGNKVININDKPTVKAGNIIIATGARSRVLKGFKPDGKQIWTSKEAMIPQHVPKSMIIVGSGAIGIEFASFYNSIGVDVTVIEAHNRILPAEDMEISGIAHKNFEKKGIKIITNAKLIKQTKSKDKIEVELELADKTQKLQAEILLMAVGITANTENLGLEKTKIKVENGYITTNGLMQTAASGIYAIGDVAGVPCLAHKASHEGIIAAESIAGLKPHTINKHNIPGCTYSSPQIASVGLTEEEATTLGYELKIGRFPFIANGKALVSGDSDGLIKTIFDAKTGELLGAHMIGSEVTELIQGYVVSKNLEGTELDLINTIFPHPTLSEMMHESVFSAYDRAIHI

SEQ ID NO: 62691 - protein, 223 aa, Candida glabrata CBS 138
MSEYINENPDVLDESDLPKRAEDASNQLLLNGISNKTTLERKKMLLQIENSTDSSLQKNIELFDKLLSLNQVPDLVSDSGDDCVSNEEDGEDYDPVDEQEIYDLIAYIQDPEHPLTLAQLSIVNLQDIKVVDSGNPADIAEVLIKITPTITHCSLATLIGLGIRVRLERSLPPRFRITIMVKEGTHNSENQVNKQLNDKERVAAACENEQLLSVVSKMLLTCK

SEQ ID NO: 62692 - protein, 356 aa, Bacillus subtilis subsp. subtilis str. 168
MNKLIEREKTVYYKEKPDPSSLGFGQYFTDYMFVMDYEEGIGWHHPRIAPYAPLTLDPSSSVFHYGQAVFEGLKAYRTDDGRVLLFRPDQNIKRLNRSCERMSMPPLDEELVLEALTQLVELEKDWVPKEKGTSLYIRPFVIATEPSLGVKASRSYTFMIVLSPVGSYYGDDQLKPVRIYVEDEYVRAVNGGVGFAKTAGNYAASLQAQRKANELGYDQVLWLDAIEKKYVEEVGSMNIFFVINGEAVTPALSGSILSGVTRASAIELIRSWGIPVREERISIDEVYAASARGELTEVFGTGTAAVVTPVGELNIHGKTVIVGDGQIGDLSKKLYETITDIQLGKVKGPFNWTVEV

SEQ ID NO: 62693 - protein, 1042 aa, Geobacillus kaustophilus HTA426
MPKDSSLQSILLIGSGPIVIGQAAEFDYSGTQACIALKEEGYRVILVNNNPATIMTDDVHADAVYFEPLTVEAVEAIIAKERPDGLLATFGGQTGLNLAFQLHEAGVLEKYGVRLLGTPIEAIKRGEDREAFRALMHELGEPVPESEIVTSVEEAVAFAEQIGFPIIIRPAYTLGGTGGGIAENMEQFLALVEKGLNESPIHQCLIERSVAGFKEIEYEVMRDQSNTCITVCNMENVDPVGIHTGDSIVVAPSQTLTDEEYQMLRSSAVKIISALGIIGGCNIQFALDPNSKQYYLIEVNPRVSRSSALASKATGYPIARIAAKLAVGYTLAELVNPVTKTTYASFEPALDYVVVKFPRLPFDKFPHADRKLGTQMKATGEVMAIDRNMERAFQKAVQSLEGKNNGLLLPELSAKTDDELKQLLVDKDDRRFFAMLELLRRGVSVEAIHKWTKIDRFFLCSFERLVALEKQAAAATLDTIEEQTFRFLKEKGCSDAFLAETWGVTELDVRNKRKELGIVPSYKMVDTCAAEFHSETDYYYSTYFGEDERKQPSGKEKVLIIGAGPIRIGQGIEFDYSSVHSVFALQKEGYETVMINNNPETVSTDFAVADRLYFEPLTLESVLDVIEAEQIKHVIVQFGGQTAINLVKGLEEAGVPLLGVTYDMIDQLEDRDRFYQLLEELDIPHVPGLVANNAEELAAKAAEIGCPVLLRPSYVIGGRGMFIVHSEAQLAALIEQGELTYPILIDAYLDGKEAEADIVTDGTDIVLPVIIEHVEKAGIHSGDSYAWLPAQTLTGEEKAKIIDYAGRIAKKLGFKGIMNIQYVIADGNVYVLEVNPRASRTVPIVSKTTGVPLAQIATKLLLGKSLVDIVDEKARGLAVMPYAVLKYPVFSTHKLPGVDPVVGPEMKSTGEGISIAATKEEAAYKAFYPYLQKKANANEVYVIGNIDAELEAEMTAKQLTIVADVPFADWVKRDTALAVIDLGKEEGEANKRMTALSRQLLVFTERETLKLFLQALDVDHLDVQPIHGWLEKKKQAEQAVIA

SEQ ID NO: 62694 - protein, 128 aa, Azoarcus sp. EbN1
MNLIQQLEQEEIARLTQNKTIPAFAPGDTVIVQVKVKEGTRERLQAYEGVVIAKRNRGLNSNFIVRKISSGEGVERTFQTYSPLVDSIEVKRRGDVRRAKLYYLRERSGKSARIKEKLNYKAPAAKKA

SEQ ID NO: 62695 - protein, 470 aa, Bacillus subtilis subsp. subtilis str. 168
MNSAHNKNETTFQRSMKSRHLFMLSLGGVIGTGLFLSSGYTIQQAGPAGTILAYLVGAGIVYLVMLCLGELSVAMPVTGAFHTYAAKYIGPGTGFTVAWLYWLTWTVALGSEFTAAGLLMQRWFPHTSVWMWSAVFALFIFLLNAFSVKFFAESEFWFSSIKVLAIVLFILLGGSAMFGIIPIKGGEAAPMLSNFTAEGGLFPNGFVPILMTMLSVNFAFSGTELIGIAAGESVDPDKTIPKAIKTTVWRLSLFFVGTIFVLSGLIPIQDAGVIKSPFVAVFDRVGVPYAADIMNFVILTAILSAANSGLYASSRMLWSLSKEKTLHPTFAKLTSKGTPFNALVFSMIGGILSLLSSVFAPDTVYVVLVSISGFAVVVVWMGIAASQFMFRKRYIEAGNKVTDLKYRTPLYPFVPIAAFLLCLASVVGIAFDPNQRIALYCGVPFMAICYAIYYVKNRKSQPAADMTHSK

SEQ ID NO: 62696 - protein, 512 aa, Glycine max
SSRIGSRQTVEFLNLLFREEGIEPSVCYGDMDQDARKIHVSRFRSRKTMLLIVTDVAARGIDIPLLDNVINWDFPPKPKIFVHRVGRAARAGRTGTAYSFVTPEDMAYLLDLHLFLSKPIKPAPTEEEFLQDMDGVLSRCEQAMANRETIYGRFPQKVIDLVSDRVREIIDTSAELELLQRTCKNAFRLYSKTKPLPAKESIRRVKDLPHEGLHPMFMNVLETGELTALAFSEHLKKFRPKQTILEAEGEAAKLKHQQGPSGQWADVMKRKRAIHENIINLVHEQQQSKSNKEKEEIQLEISPSMEKGRKARGSKRKPQSFKDEDHYISSIPKNQHMEAGLTVKANEDFASNRLEAAVLDLVADDGTGIQKQRSMYHWDKRGKKYIKLNNGDRVAANGKIKTESGAKTKANKTGIYKKWKERSHVRISLKGTNNGDPQESTSLAGSYQRGRSNFKGSKKQHSMPNAHVRSELKDMDQIRKERQTKANRVSYIKSKSTKGKRFGKNGKKRKGK

SEQ ID NO: 62697 - protein, 511 aa, Oryza sativa
  misc_feature (58)..(58): Xaa can be any naturally occurring amino acid
MAAMDLRVAAPASVAAAARCGTSLARPWPARAVGGGGGGGGRGRRLSVRTSVATTEVXAAAVGASEDAALEARDSKTVVAVILGGGAGTRLFPLTKRRAKPAVPIGGAYRLIDVPMSNCINSGINKVYILTQFNSASLNRHLSRAYNFSNGVAFGDGFVEVLAATQTPGSEGKRWFQGTADAVRQFDWLFDDAKAKDIDDVLILSGDHLYRMDYMDFVQSHRQRGADISICCLPIDDSRASDFGLMKIDDTGRVIAFSEKPKGDDLKAMQVDTTVLGLPQDEAKEKPYIASMGVYIFKKEILLNLLRWRFPTANDFGSEIIPASAKEINVKAYLFNDYWEDIGTIKSFFEANLSLAEQPPRFSFYDANKPMYTSRRNLPPSMINNSKITDSIISHGCFLDSCRIEHSVVGIRSRIGSNVHLKDTVMLGADFYETDLERGELLAEGKVPIGIGENTKIQNCIIDKNARIGKNVTISNSEGVQEADRTSEGFYIRSGITIVLKNSIIADGLVI

SEQ ID NO: 62698 - protein, 199 aa, Triticum aestivum
VQSKSLNEDPLEGKSGASSRGNSSSNVGKSSLLNSLVRRKRLALTSKKPGKTQCINHFKINDSWYLVDLPGYGYASAPQVARKDWDEFTRNYFLSRDNLVSVFLLIDASIPAKKIDLDYASWLGQNKVPMTLVFTKCDKRKKKKNGGKRPEENVECFQNLIREYFEAAPPWIMTSSVTNQGRDEILLHMSQLRNYWRKH

SEQ ID NO: 62699 - protein, 495 aa, Oryza sativa (japonica cultivar-group)
CTPCVILLLSSLYLLRLFVDARRNLPPGPRPQPLIGNILDLGSQPHRSLARLAGRYGPLMTLRLGTVTTVVASSPGAARDILQRHDAAFSARSVPDAARACGHDGFSMGMLPPSSALWRALRRVCAAELFAPRSLDAHQRLRRDKVRQLVSHVARLARDGAAVDVGRAAFTASLNLLSSTIFSADLADFGDARAESSVGDLRDLISEFTIVVGVPNVSDFFPAVAPLDPQRLRRRVARVFERLQAVFDGHIERRLRDRAAGEPPKNDFLDALLDYRSPEDGRGFDRPTLQFLFTDLFSAGSDTSAVTVEWAMAQLLQNPPAMAKAREELARVIGSKQEIEESDISQLKYLEAVVKETLRLHPPAPFLLPHQAETTTQVGGYTVPKGTRVLVNVWAIGRDSKVWSDPDKFMPERFLQSEVDLRGRDFELIPFGSGRRICPGLPLAVRMVYLMLASLLHRFEWRLLPEVEKNGVDMAEKFGMILELATPLRAVAIPV

SEQ ID NO: 62700 - protein, 213 aa, Saccharophagus degradans 2-40
MAKIHFRTAQFLISAPSIRQCPTEEGTEVAFAGRSNAGKSSAINTLTGNGKLARTSKTPGRTQLINFFNFPAAPDQRIVDLPGYGYAKVPMAVKKKWQADLSEYLQQRDALRGLVIVMDIRHPLQDFDTMMINWAVEGEMPVHLLLTKADKLKPGAAKSTLLAVQKHMRDAQVDDLVSAQMFSALKKQGINQLEDVLNGWLLPQHDEPEAAQE

SEQ ID NO: 62701 - protein, 152 aa, Oryza sativa (indica cultivar-group)
MGKLWTILTHLHSLAGPTVMLLYPLYASVQAMESPSKLDDEQWLAYWILYSFITLVEMLLESLIYWIPIWYELKLLFIAWLALPNFRGAAFIYNRFVREQLRKHGLAGAGAGAAASVGKKDKSSPSSSPKDKEKTKSKFLSFVTPKKDHEAY

SEQ ID NO: 62702 - protein, 461 aa, Photorhabdus luminescens subsp. laumondii TTO1
MQNNETQLKRGLTGRHIRFMALGSAIGTGLFYGSAAAIQQAGPAVLLAYLIGGAAVFMVMRALGEMAVHHPVAGSFSHYASHYLGPLAGFLTGWNYIFEMLIVCLADVTAFGFYMKLWFPHVEQWIWVLSIVCFIGAINLCHVKIFGEMEFWLSIVKVTAIIAMIIGGMIIMIYGFGQETDHATGIASLWEYGGFMPNGISGVIASLAIVMFAFGGIEVIGITASETKNPEKTIPKAINAVPFRILLFYVLTLFILMCIYPWNQIGQEGSPFVQIFSSLGINSAANILNIVVITAAISAINSDIFGAGRMMYGMAQEGQAPKSFTKLSRNGVPWMTVIVMSAVLLIGVILNYMIPEEIFVIIASIATFATVWVWLMILLSQVAMRRKMSKEEVKTLKFPVPMWPIAPALTIIFMVFVIVLLGYFEKTRIALIVGITWVILLSITYFFSKKKNISQIHQINK

SEQ ID NO: 62703 - protein, 143 aa, Rickettsia sibirica 246
MALTLKYFFKPKVTINYPYEKSPISPRFKGEHALRRYENGEERCIACKLCEAICPAQAIVIEADEREDGSRRTTRYDIDMTKCIYCGLCQEACPVDAIVEGPNFEFASLTHTALIYDKERLLQNGDRWEQALASKLHKDYEYR

SEQ ID NO: 62704 - protein, 576 aa, Photorhabdus luminescens subsp. laumondii TTO1
MNDKQHGPFIVEGKLADSERMKQESNFLRGTISEDLTNGLTGGFEGDNFLLIRFHGMYQQDDRDIRAERAEQKLEPRHAIMLRCRLPGGVITPQQWLGIDKFAEENTLYGSIRLTNRQTFQFHGILKGKVKLAHQLLNQVGLDSLATANDVNRNVLCTSNPIQSELHQQAYEWAKKISEHLLPRTRAYAELWLDKEKVATTDEEPILGSTYLPRKFKTTVVIPPQNDVDLHANDLNFIAIAEGSKLVGFNVLVGGGLAMTHGDKNTYPSMASEFGYIPLEHTLAIAEAVVTTQRDWGNRTERKNAKTKYTLERVGVETFKAEVERRAGVKFEAIRPYEFTGRGDQIGWLKGIDDKWHLTLFIENGRLLDYPGKPLKSGVAEIAKIHKGDFRLTANQNLIIAGIPESEKQRIETIACRHGLIDDKTTVQRKNSMACVSFPTCPLAMAEAERFLPEFVTHVEQLMNKHGIGDEHIVLRVTGCPNGCARAMLAEVGLVGKALDRYNLHLGGNRIGTRIPRMYKENISSQAILSIMDELIGRWATGRQPNEGFGDFLIRTDIIKPVLDSARDFYDWQEAV

SEQ ID NO: 62705 - protein, 575 aa, Lactococcus lactis subsp. lactis Il1403
MTTMLKGIAASSGVAVAKAYLLVQPDLSFETKTIADTANEEARLDAALATSQSELQLIKDKAVTTLGEEAASVFDAHMMVLADPDMTAQIKAVINDKKVNAESALKEVTDMFIGIFEGMTDNAYMQERAADIKDVTKRVLAHLLGVKLPSPALIDEEVIIVAEDLTPSDTAQLDKKFVKAFVTNIGGRTSHSAIMARTLEIPAVLGTNNITELVSEGQLLAVSGLTGEVILDPSTEQQSEFHKAGEAYAAQKAEWAALKDAETVTADGRHYELAANIGTPKDVEGVNDNGAEAIGLYRTEFLYMDAQDFPTEDDQYEAYKAVLEGMNGKPVVVRTMDIGGDKTLPYFDLPKEMNPFLGWRALRISLSTAGDGMFRTQLRALLRASVHGQLRIMFPMVALVTEFRAAKKIYDEEKAKLIAEGVPVADGIEVGIMIEIPAAAMLADQFAKEVDFFSIGTNDLIQYTMAADRMNEQVSYLYQPYNPSILRLINNVIKAAHAEGKWAGMCGEMAGDQTAVPLLMGMGLDEFSMSATSVLQTRSLMKRLDSKKMEELSSKALSECATMEEVIALVEEYTK

SEQ ID NO: 62706 - protein, 327 aa, Bacillus subtilis subsp. subtilis str. 168
MKELIKEHQKDINPALQLHDWVEYYRPFAANGQSANYIPALGKVNDSQLGICVLEPDGTMIHAGDWNVSFTMQSISKVISFIAACMSRGIPYVLDRVDVEPTGDAFNSIIRLEINKPGKPFNPMINAGALTIASILPGESAYEKLEFLYSVMETLIGKRPRIHEEVFRSEWETAHRNRALAYYLKETNFLEAEVEETLEVYLKQCAMESTTEDIALIGLILAHDGYHPIRHEQVIPKDVAKLAKALMLTCGMYNASGKYAAFVGVPAKSGVSGGIMALVPPSARREQPFQSGCGIGIYGPAIDEYGNSLTGGMLLKHMAQEWELSIF

SEQ ID NO: 62707 - protein, 545 aa, Zea mays
MGSTAAASVLPVSAGSGENLVLILDYGSQYTHLITRRVRQLGVLSLCVSGTAPLASLEGLRPRAVILSGGPHSVHAPGAPAFPEGFLGFAAAAGAHVLGVCYGMQLLVQSLGGAVVSGERQEYGKMDVEVTAASSALYGQAETGKRQTVWMSHGDEVVRLPEGFEVVARSVQGAVAAIENRENRFYGLQYHPEVTHSAQGMETLRRFLFDVCGIKADWKMQDVLDEEIKTIQSTVGPDEHVICALSGGVDSTVAATLVHKAIGDRLHCVFVDNGLLRYKEGERVMTTFESDLHLPVTCVDASEQFLSKLKGVEDPEKKRKIIGREFIAVFDDFAHKLEQKIGKRPEYLVQGTLYPDVIESCPPPGSGRTHSHTIKSHHNVGGLPKDMKLKLIEPLKLLFKDEVRKLGGILNVPDSFLKRHPFPGPGLAVRVLGDVTQGNALEVLRQVDEIFVQSIKDAGLYDKIWQAFAVFLPVQTVGVQGDQRTHSNAVVLRAITSEDGMTADWYYFEHAFLVDVVNKICNNVRGINRVCQDITSKPPATVEWE

SEQ ID NO: 62708 - protein, 445 aa, Oryza sativa (japonica cultivar-group)
MAATIQSVKARQIFDSRGNPTVEVDICCSDGTFARAAVPSGASTGVYEALELRDGGSDYLGKGVLKAVDNVNSIIGPALIGKDPTEQTVIDNFMVQQLDGTKNEWGWCKQKLGANAILAVSLALCKAGAIIKKIPLYQHIANLAGNKQLVLPVPAFNVINGGSHAGNKLAMQEFMILPTGASSFKEAMKMGVEVYHNLKSVIKKKYGQDATNVGDEGGFAPNIQENKEGLELLKTAIEKAGYTGKVVIGMDVAASEFYTEDQTYDLNFKEENNDGSQKISGDSLKNVYKSFVSEYPIVSIEDPFDQDDWVHYAKMTEEIGDQVQIVGDDLLVTNPTRVAKAIKDKACNALLLKVNQIGSVTESIEAVKMSKRAGWGVMTSHRSGETEDTFIADLAVGLSTGQIKTGAPCRSERLAKYNQLLRIEEELGAAAVYAGAKFRAPVEPY

SEQ ID NO: 62709 - protein, 252 aa, Oryza sativa (indica cultivar-group)
MEKKHRHARSRSFSGGAIVSFLKSTAASFTATTTTASAPPPPHGRSSFNHRNAFSGPIVSIVPPEARGGGGGSRREHRSGYRTPEPSSPKVSCIGQIKKANAKKVKASCKNGACPLPPRPPADAAAARRQKSSLVRRMLFRRSRSRKASSSSSRDGGFFKGRTAGRAGAAVAAAPAPAGLGQMKRFTSGRAAFEDFDWREAERMASDDDDDVLVAHSAPLVLGGGLVASEPRKEVNLWSRRPMAPPTPLRLP

SEQ ID NO: 62710 - protein, 466 aa, Sinorhizobium fredii
MSKRFRSRSAARAARHRLRRGEQDMSNRLNTTPNDLSAFWMPFTANRQFKKEPRLFVGAKDMYYTTHDGRTVLDGTAGLWCVNAGHCRPKITEAIREQAGELDYAPAFQLGHPKAFELANRLVDIAPEGLNHVLYTNSGSESVDTALKVALAYHRAKGNGSRFRLIGRERGYHGVNFGGISVGGIVANRKMFGTLLTGVDHLPHTHLPAKNAFTRGEPEHGGDLASELERIVTLHDASTIAAVIVEPVAGSTGVLIPPKGYLQKLREICTKHGILLIFDEVITGYGRLGTPFAAQYFDVKPDIITTAKGLTNGVIPMGAVFVTSEIHDAFMTGPEHLIEFFHGYTYSGNPIASAAALGTLDTYKEEGLLTRAAELASYWEEALHSLKDCPHVIDIRNIGLIGAVELEPIAGEPTKRAFSAFLKAYEKGLLIRTTGDIIALSPPLIIEKKQIDELIDKLRDVLKNNI

SEQ ID NO: 62711 - protein, 405 aa, Sinorhizobium meliloti 1021
MSGRLVVVGGGQAAFALVAKLRALKDMRPITVVAAEASLPYQRPPLSKKYLLREMTLDRLLYRPEAWYAEHEIDIRLSTTVTRVDRLAKQVALSDGSMLTYETLAFATGATPRRLPAAVGGDLAGVFVVRDFRDADRLAEEMQPGRRVLVVGGGYIGLEAAAVARTSGLEVTVIEMADRILQRVASAATSAIVREIHRSHGVDIRERTGLHRLIGDNGRVTAAELSDGSVIPVDIVIVGIGVAANDALAHEAGIETANGIVVDSHGRTSDPTIVAMGDCAVLPWDGMRIRLESVQNAVDQAEAVAAVLAGGTDPYDPKPWFWSDQYDVKLQIAGFGLGHDETLVRQGQRQGSVSVWYFRQGKLIAVDAINDAKAYVTGKKLLEAGATPDRLLLADPQVDLKALLV

SEQ ID NO: 62712 - protein, 456 aa, Aspergillus oryzae
MSAKTADATQPRAGDIKKVHIADTAITRSNWHKHVNWLNVFLIIGIPMYGCVQALWVPLQLKTAIWAVIYYFFTGLGITAGYHRLWAHCSYSARLPLRIWLAAVGGGAVEGSIRWWARDHRAHHRYTDTEKDPYSVRKGLLYSHLGWMVMKQNPKRIGRTDISDLNEDPVVVWQHRNYLKVVFTMGLFVPMLVAGLGWGDWWGGFVYAGILRIFFVQQATFCVNSLAHWLGDQPFDDRNSPRDHVITALVTLGEGYHNFHHEFPSDYRNAIEWHQYDPTKWSIWIWKQLGLAYDLKQFRANEIEKGRVQQLQKKIDQKRAKLDWGVPLDQLPVMEWDDYVEQAKNGRGLIAIAGVVHDVTDFIKDHPGGKAMINSGIGKDATAMFNGGVYYHSNAAHNLLSTMRVGVIRGGCEVEIWKRSQKESTDYVRDSSGQRVIRAGEQVTKIPEPIPTADAA

SEQ ID NO: 62713 - protein, 831 aa, Saccharophagus degradans 2-40
MTVTRRDFVRHQALATAAAAAGVAVPAAATNIVTTAADNKLVWSKAPCRFCGTGCSVNVATKEGRVVATHGDIKSPVNRGLNCVKGYFLSKVMYGEDRLTQPLLRKKNGVYAKDGEFEPVTWEEAFTIMAEKFKKTLKEKGPEGIGMFGSGQWTVWEGYAASKLMKAGFRSNNIDPNARHCMASAVGGFMRTFGIDEPMGCYDDFEHADAFVLWGSNMAEMHPILWTRIADRRLSYPHVQVAVMSTYEHRSFDLADLGVVFTPQSDLAIANFIANYIIQNKKVNWDFVKKHTNFRVGTTDIGYGLRPEHPLQKAAKNADSAGASEPIDFETYAKFVADYTVEKASEISGVSEDKLIKLAKLYADPNIKVMSLWTMGVNQHTRGVWMNNLIYNIHLLTGKISEPGNSPFSLTGQPSACGTAREVGTFSHRLPADMVVTNPKHRAYAEKIWKLPEGSIPEKVGAHAVLQSRKLKDGEINAYWVQVNNNVQAGPNINEEVLPGYRNPQNFIVVSDAYPTVTAQAADLILPSAMWVEKEGAYGNAERRTQFWHQLVNAPGDARSDLWQLVEFSKYFKVEEVWPADLIAKMPEAKGKTLFDILYKNGKVNKFPLAQVSKDYENKEADAFGFYIQKGLFEEYAEFGRGHGHDLADFDRYHEERGLRWPVVNGEETLWRYREGSDPYVEKGKGVQFYGKPDGKAIIFALPYEPPAESPNKEYPFWLCTGRVIEHWHSGSMTQRVPELYKAFPDAVCFMHPEDARSAGLRRGDKVKLQSIRGHIITRIETRGRNKPPKGLVFVPWFDARQLINKVTLDATDPISKQTDFKKCAVKVERV

SEQ ID NO: 62714 - protein, 276 aa, Mycobacterium avium subsp. paratuberculosis K-10
MSSTAPPASAGPRRAAVLGKPIGHSKSPQLHLAAYRALGLHDWTYERIECDADQLPGVVGGFGPEWVGVSVTMPGKFAALRFADERTEQARRVGSANTLVRTATGWRADNTDIDGVAGALGAASGWALVCGSGGTAPAAVAGLAQLGVAGITVVARNPDKAARLVRLGDELGVPTRFCALDGAGLADEVAAAEVLVSTLPAEVAERYAGTLARVGVLLDAVYDPWPTPLAAAVSAAGGRVISGMQMLLHQAFAQVEQFTGLPAPREAMTCAAADAD

SEQ ID NO: 62715 - protein, 282 aa, Candida glabrata CBS 138
MTPSTPPRSRQRRHDSGSLEMHGYGDSVMGTPQRSQLLAPVTPSTVQKFKSVPALQPQKTTFNGLKSPERSPFPLQGRRGSVKRTFGDDAGAGCDSGCDSLLGDASGKYKSITKTLFAEETEPLFPPETSTSPSRSSSPLQLPKLQLSHIRDAENDEQIRKMAKQVPGTPSDKVITFEMAQDWNNVSSKDGTTNSDTEDDLLVTKKPLKNPFASDDVIDETERRRRHNQLLKENPELESTISYVNKNGEVVKQRHLSLEDQIRYKPRALFTKEIEELKRDKK

SEQ ID NO: 62716 - protein, 672 aa, Oceanicola granulosus HTCC2516
MDIAALRKAHPDHWKMAAAIRALALDAVAAANSGHTGMPLGMADIATVLYRNHLRFDPKSPDWADRDRFILSNGHGSMLLYALLHLTGYEEMTLEEIKNFRQWGSITAGHPENVLAKGIETTTGPLGQGFANSVGFAIAEESLRARFGAKLVDHRTWVFAGDGCLMEGVSQEALSLAGHLKLSRLVVFFDHNSITIDGPTDLADSTDQTERFAASGWHVQRVDGHDPEAIDAAIEAAKADDRPSLIACETHIALGHAAQDTSKGHGALTDPEQLQAAKEAYGWTGGPFEVPADIKAMWEQTGERGGAARAEWQSRLDALPQGKRQKFEAAMSGEIPNKLVSTVRALKKQMSESAPKMATRAASEKALEVINPVVRETLGGSADLTGSNNTLTSDLGIFTADDRKGRYVYYGIREHGMAAAMNGMALHGGIRPYGGTFMTFSDYARGAMRLSGLSHAPVVYVMTHDSIGLGEDGPTHQPIEHLAMLRATPNYVVLRPADAVETAEAWEVALLRKDGPTVLALSRQGLPTVRKDHKSKNLTAQGGYVLADAEGKRQALLMASGSEVAVALAARDLLQAEGIGTRVVSMPSMELFAAQEESYRKRVLPGGAAVRVAIEAASRQPWDRWLCGERGREAKAAFIGMEGFGASAPQDVLYKQFGITAEATAEKVKALL

SEQ ID NO: 62717 - protein, 343 aa, Oryza sativa (indica cultivar-group)
MAAAPGEVSGGQGNGGVTAIAELTISSLPLETRCAPFPLRQHGGFWLPETFLPGLEAAHARFEPRPSDVLLASFPKSGTTWLKALAFATLNRAAYPPSGEGHPLRRRGPHDCVQFLESALVVSDDMFASLPSPRLLSTHLPYSLLPEGVKADSSGCRIVYICRDPKDVLVSWWLFTKKALGTQDGPTNGGNKPTLSTLEEELDLFCAGRSANGPYWRHVLEYWAESKRRPHKVLFLRYEEMTRETTSNVRKLAEFMGCPFSGEEEADGVPDAIVGLCSFDHLRSLEVNRNGANDFNIKNDSFYRKGVAGDWANYLSPEMAAQLDLVIDDELRSSGFSFATGGR

SEQ ID NO: 62718 - protein, 337 aa, Oceanicola granulosus HTCC2516
MAVKVAINGFGRIGRNVLRGIIESGRTDIEVIAINDLGPVETNAHLLRYDSVHGRFPAEVKTTEDTIDVGQGPIKVTALRDPKELPWSDVDIVLECTGIFTSPEKAGLHLENGAKRVLVSAPLSNPTQGEKTIVYGVNHETLTADDKIVSNASCTTNCLSPVAKVLNDAIGIKKGFMTTIHSYTGDQPTLDTMHKDLYRARAAALSMIPTSTGAAKAVGLVLPELNGKLDGVAIRVPTPNVSVVDLTFEASRETSVEEINDAIRAAAGSGPLKGILTYTDEKLVSSDFNHDPSSSIFHMDQTKVMEGTMCRILTWYDNEWGFSNRMADTAVAMSKYI

SEQ ID NO: 62719 - protein, 169 aa, Zea mays
MAKFGEGDARWIVQERADGANVHNWHWAERDCLDWSRALLSKLLAGLPVLSGEGGLTLRTTTLDKLDGEAYVNIRKGKVIPGYELSLTLAWEADATTESGVVKVTGTAEVPYLADENADEDPELRITVRGDDGPLARRAKDAFIAHGKPLVITKIRDYVAAMANGGPAK

SEQ ID NO: 62720 - protein, 473 aa, Synechococcus sp. CC9311
MAKTAQDVLRQIKDEGIELIDLKFSDLHGKWQHLTVCSDMVDEDAFKEGLAFDGSSIRGWKAINASDMSMVPDPATAWVDPFYRHKTLSLICSIQDPRTGDPYERCPRALAQKALAYLSNTGLADKAFFGPEPEFFLFDDVRYNSSEGGCFYSVDTIEAGWNSGRMEEGGNLAYKIQLKEGYFPVAPNDTAQDIRSEMLLMMAQLGIPIEKHHHEVAGAGQHELGMKFDELIQAADNVMTYKYVVRNVAKKYGKTATFMPKPVFNDNGTGMHVHQSLWKGDQPLFFGEGTYANLSQTARWYIGGILKHAPSFLAFTNPTTNSYKRLVPGFEAPVNLVYSEGNRSAAVRIPLTGPSPKAKRLEFRSGDALANPYLAFAAMMMAGIDGIKNQIDPGDGFDGDLFELPADQLKDIATVPASLNGALEALNADHHYLMEGGVFTKDFIDNWINLKYEEVQQLRQRPHPHEFTMYYDA

SEQ ID NO: 62721 - protein, 660 aa, Bacillus cereus E33L
MTEENKSFYITTPIYYPSGKLHIGHAYTTVAGDAMARYKRMQGYNVHYLTGTDEHGQKIQKKAEELNVTPQAYVDNIVAGIKELWEKMDISYDDFIRTTEDRHKDVVEKIFKQLVDQGDIYLDEYEGWYSVQDETFYTEHQLVDPIMEGDKVVGGKSPDSGHDVELVREESYFFRMGKYVDRLLKFYEDNPHFIQPESRKNEMINNFIKPGLEDLAVSRTSFDWGVRVPGNPKHVIYVWVDALSNYITALGYGTENEEMYKKFWPADVHLVGKEIVRFHTIYWPIILMALDLPLPKKVFAHGWILMKDGKMSKSKGNVVDPVTLIDRYGLDALRYYLLREVPFGSDGVFTPEGFVERINFDLANDLGNLLNRTVAMIDKYFNGEIPAFKANVTEFDETLVTFAKDTLKKVEEAMENMEFSVALSSIWQLVSRTNKYIDETQPWVLAKDENDREKLASVMAHLAEVLRQTGIMLMPFLTVAPSKMFAQLGLTDEAHTSWGSLSTIGCIPAGTKVEKGQPIFPRLEMDVEVAYIKEQMKASAPKVEEKKEEEPKAEEITIDDFFKVELRVAEVLFAEPVKKADKLLKIQLDLGTEKRQVVSGIAKFYSPEDLKGKKVICVTNLKPVKLRGELSQGMILAGEENGVLSLASIDQNLPNGTKIK

SEQ ID NO: 62722 - protein, 149 aa, Streptococcus pneumoniae
QPNWINRDRFILSAGHGSMLLYALLHLSGFEDVSMDEIKSFRQWGSKTPGHPEFGHTAGIDATTGPLGQGISTATGFAQAERFLAAEYNREGYNIFDHYTYVICGDGDLMEGVSSEAASYAGLQKLDKLVVLYDSNDINLDGETKDSFT

SEQ ID NO: 62723 - protein, 247 aa, Thermobifida fusca YX
MSTLVLLRHGESVWNAEGLFTGWVDVDLSPKGEEEARRGGRLLAEAGIRPDVVHTSLLKRAIRTANIALEEAGLHWIPVKRSWRLNERHYGALQGKNKAQTRAEFGDEQFMIWRRSYDTPPPPLAEDSEFSQHNDPRYATLPPELMPRTECLADVVRRMLPYWYDAIIPDLAAGRTVLVAAHGNSLRALVKHLDNIDDKSIAGLNIPTGIPLVYELNDDFTPRKTGGEYLDPEAAKEAIEAVKNQGK

SEQ ID NO: 62724 - protein, 1274 aa, Arabidopsis thaliana
MASQMPFTTISRKISCMKLLPLCPLQLSTTQTPTTIPMSLSFYKNELSDDTPCQSGYTDYISFQVPDETFPEISNCIGIAKGYKQNSNNEKNGYTSLEAVLLSVPNGYTCVDLSLYKDKELVLLLNKTNTDSEGSGEACMMVVQTGDLAFISISGSSSLNQWELEDLKVLLISSINIDGSIVNLEMENEKVRKVPHSVIAPLAVSASRGVACVFAERRRALVYILEEDEDEEISDENSTKEARRNSLSFSKLYATVTEVVLFCLMENDQFMCPTDIITGIVFIDGELAMLTLTADGELRWTEYGLRQYLSMKKDVLGFIVEGKQIRVKAVVEKEAGGICCGQFGGDFVRKDFVFEPLIDQNGWCYKLRQYLDSLGRPKRLLVFVNPFGGKKSAREIFVKEVKPLFEDADVQLEIQETKYQLHAKEFVKSMDVSKYDGIVCVSGDGILVEVVNGLLERADWRNALKLPIGMVPAGTGNGMIKSLLDTVGLRCCANSATISIIRGHKRSVDVATIAQGNTKFFSVLMLAWGLIADIDIESEKFRWMGSARIDFYVCLVDKFDNYCIAVVKLLALQRIICLRRYNGRILFLPAPGFEGYGQPASCSLYQEPHVSDKEVGYQGPETKFEDLEWREMKGPFVTIWLHNVPWGSENTLTAPAAKFSDGYLDLIVLKNCPKLVLLSLMRQTSSGTHVESPYIVYIKLTVEKVKAFVLEPGALVDEPDKEGIIDSDGEVLARGKRTYKCDQKALMSYDKLQVTVDQERLFCKFCISQRELVLAKLSPTTKLVSLHLAMDRQPERENDELPSPAIISDRVLVNGVVTPLTLTAEGELRSTESGRRKSTLAKEILSFVVEGNKVRVKTLVEKGGGICCRGSAGDYARNDFVFEPLSDESRKLWSDKFHQHLVSLGRPKKLLVFVNPFGGKKTARKIFQEEVKPLFEDANIQLEIQETKYQLHAKEIVRSMDVSKYDGIVCVSGDGILVEVVNGLLEREDWKTAIKLPIGMVPAGSGNGMIKSLLEPVGLPCSATSATISIIRGRTRSLDVATISQGTTKFFSVLMLAWGLVADIDIESEKFRWMGSARFDIYGLQRIICLRQYHGRILFVPAPGFESYGQRASCSIDKEPSGSDKTLVYQGPDSKLENLDWREMKGPFVSVWLHNVPWGAENTLAAPDAKFSDGFLDLIVMKDCPKLALLSLMTKLSDGTHVQSPYASYLKVKAFVLEPGARIDEPDKEGIIDSDGEVLARGRKSYKCDQKALMSYDKLQISVDQGLATLFSPE

SEQ ID NO: 62725 - protein, 522 aa, Candida tropicalis
MSIQDIVETYSTKWYVVVSVALIVYKVFDFFYARYLMYKLGAKPFLQSQTDGYLGFRVPFELMGKKSEGTLIDFTYQRTLELDNPDIPTFTFPIFSVSIISTLEPDNIKAILATQFNDFSLGTRHSHFAPLLGDGIFTLDGAGWKHSRSMLRPQFAREQVSHVKLLEPHMQVFFKHIRKHHGQTFDIQELFFRLTVDSATEFLFGESVESLRDESIGMLNDALDFDGKAGFADAFNYSQNYLASRALMQQMYWILNGKKFKECNAKVHKFADYYVEKALELTPDQLEKQDGYVFLYELVKQTRDRQVLRDQLLNILVAGRDTTAGLLSFVFFELARTPRVANKLREEIEDKFGLGQDARVEEISFESLKSCEYLKAVLNECLRLYPSVPQNFRVATRNTTLPRGGGKDGLSPVLVRKGQTVMYSVYAAHRNKQIYGEDALEFRPERWFEPETKKLGWAFLPFNGGPRICLGQQFALTEASYVTVRLLQEFSHLTMDPNTEYSPKKMSHLTMSLFDGANIQMY

SEQ ID NO: 62726 - protein, 312 aa, Pseudomonas fluorescens PfO-1
MYLVCGEALFDFFSEDDAGGQASKVNFKAIAGGSPFNVAVGLRRLGVDSALFGGLSTDYLGRRLQQVLQDEGVHPDYLVDFAAPTTLAMVAVGANGSPHYSFRGEGCADRQLSLAHLPALGPEVRGLHFGSFSLVVQPIADTLLALVQRESGKRLISLDPNVRLNPEPNIDLWRERIATLVPLADLIKVSDEDLSLLYPEQDPARVIEGWLQHRCQVVFLTRGGEGATVFSRVHGSWSVPASSVKIADTVGAGDTFQAALITWLTEHELDSVEGVQHLSREQIDGMLRFAVQAAALTCSKTGPDLPYRHQLT

SEQ ID NO: 62727 - protein, 106 aa, Brassica napus
MNIFSKKPNPREVLRESKREMTQATRGIEKEISSLQSEEKKLVLEIKRTAKTGNEGATKILARQLIRLRQQIANLQGSRAQMRGIATHTQAMHAHTSVAAGIQGAT

SEQ ID NO: 62728 - protein, 539 aa, Zea mays
  misc_feature (49)..(49): Xaa can be any naturally occurring amino acid
  misc_feature (209)..(209): Xaa can be any naturally occurring amino acid
LHTKERTGGELGASHGRTPARSHRWSVLGGAAAVLLLWLASQVLEWAWXAPRRVNRALRAQGLRGTRYRLLCGDLIEEQRLRAAALARPVPVDRPHDFLPRVAPFLHRVLQEHGKLSFTWFGPTPRVLITDPELAREVLSNKCGDFVKSLLSPLSTLLVAGLVVLDGEKWVKHRRILNPAFHAEKLKGMLPAFLACCNELVDRWEKQIXASAEPTELDVWPEFQNLSGDVISRAAFGVSYEEGRRIFLLQAEQAERLVQSFKTNYIPGFSLLPTENNRRMNEIDREVKTVLRGIIEKRQKAAKNGEATKDDLLGLLLESNMNYSDSDGKSSKGITVEEVIGECKVFYFAGMETTAVLLTWTVAVLSMHPEWQDRAREEVLQVFGENKPDFNGVARLKVVTMVLYEVLRLYPPVAAINRRTRQPTKLGGVTYPAGVMLMTPVMFIHRDPALWGSDADEFNPGRFADGVSKACRDPGAFAPFSWGPRVCIGQNFALLEAKLAVSMILQRFAFEVSPAYVHAPYTVLTLHPQHGAPVRLRRL

SEQ ID NO: 62729 - protein, 295 aa, Listeria monocytogenes str. 1/2a F6854
MEKKVGTDRVKRGMAQMQKGGVIMDVVNAEQAKIAEEAGAVAVMALERVPSDIRAAGGVARMADPRIVEEVMNAVSIPVMAKARIGHITEARVLEAMGVDYIDESEVLTPADDEFHLLKSDFTVPFVCGCRDIGEALRRIGEGAAMLRTKGEPGTGNIVEAVRHMRQVNGQIRQIAGMTDDELMVAAKNFGAPYELIKEIKTLGKLPVVNFAAGGVATPADAALMMELGADGVFVGSGIFKSDNPAKFASAIVQATTYYTDYELIGKLSKELGSPMKGIEMSRLNPEDRMQDRSF

SEQ ID NO: 62730 - protein, 896 aa, Alteromonadales bacterium TW-7
METLNTCSNTPLLKQTTCAYCGVGCGVDISLLNNTPTKLEGTREHPANFGRLCVKGTHLLDTTGSDNRLTSPLIDNEPASWDAATKFVANRFNAIIKEHGPESVAFYVSGQLLTEDYYVANKLMKGYIGSGNIDTNSRLCMSSAVAGYKRAFGEDVVPCTYDDLEQTELLILIGSNAAWTHPVLYQRMERAKKLNPNMKVVVIDPRKTDTAELADTFLNIKPGSDAALYNGLLTYLSEHNYLDTQFINEHTNGFETALVEAKKWSVKAVSDFCDIDAQLVSDFYALFAKSPTAISFYSMGINQSSSGVDKCNAIINAHLASGKLLKPGCGPFSITGQPNAMGGREVGGLANQLAAHLDIENEAHQQLVQRFWQSPTIAKKAGCNAIDMFDEIAKGKIKAIWVMATNPMVSLPNNAAIQHALEQCELVVVSDCIAKSDTLKFANVAFPSTGWGEKNGTVTNSERRISRQRPLVEPFSGAKNDWQIMCLVAQKMGFEGFDFTDPSGIFEEWAQLTDFENNGDRLLNLSALVGLSQQQYDNLKPVMWPVLKNEPYKNGQVFVNNQFSTADKKARFIPITPKLPVQQTSSDYPFVMNSGRIRDQWHTMSRTGKSTALSTHITRPYIEINPIDASKLNIKANDLITANAKTGQVTAHAKITDAVRKGECFMPIHWNKQFASSATVSGLYQSVVDPISGQPECKHGAVDLVKAQFAQYMQIFSKTELKITSDFWLKVNASNCVNYQLALNEQQNDLLYYCQTLTGLQGQWSAIGSAKAMHIQCIENEQLVFVAVVSLAQKDISLEWINHLFAEPLITFSQLQSLLYAMPDEEFTQGAQVCSCFKVREQPIINAIKCGENTVEKLGSKLKCGTNCGSCKTQLSQLIKQHTTQHANSIDVAVEM

SEQ ID NO: 62731 - protein, 425 aa, Zea mays
MASCGSFYFVPLLLLMLLLASPATAALVTSSQPGGNATAARPRPGMEQLKRKRIRALLTKLNKPALKTIQSSDGDIIDCVPSHLQPAFDHPKLRGEKILDPPERPKNRNFTFGGSGRSRVGEVVVQAWHATGEACPEGTVPIRRTTEKDLLRASSLRRYGRKPARRGVRRDSTSSGHEHAVGYVNSEQYYGAKASVNVWSPRIGDPSEFSLSQIWVLSGSFGNDLNTIEAGWQVSPELYGDSNPRFFTYWTTDAYQETGCYNHNCRGFVQTTNKIAIGAAITPESVYNGRQFDITLMLWKDPKHGHWWLELGPGLVVGYWPSHLFSHLARHANMVQFGGEVVNTRPSGSHTATQMGSGHFPREGFDRAAYFRNLQVVDWDNNLIPAANLKLLADHPGCYDIQGGTNSYWGSYFYYGGPGRNAKCP

SEQ ID NO: 62732 - protein, 252 aa, Saccharophagus degradans 2-40
MPKTILITGASSGFGEACAKIFAKQGNTLILVARRKQLLDELADNLGKQCDVYTAQVDVSQPASIATFFEQLPSKLGPIDTLINNAGLALGLESADKADINDWETMINTNCLGLVHFTRQVLPSMVANNLGHIVNIGSTAGKWPYPGGNVYGATKAFVQQFSRNLRADLLGKNIRVTNIDPGMAETEFSNIRFKGNNEKAEQVYHNAKPLTAQDIAETVQWVCNRPAHVNINSLEIMPVCQAWGGWEIDRNC

SEQ ID NO: 62733 - protein, 119 aa, Triticum aestivum
MASLSVAKVPQLAGGPKGAAAKKRSGVTYVEGMNAYRGLKGLNKVTILGGGKSADYKFPRIVVSLNPPGKRAGGFFGAQCKPPGEIFQIPVVMKALTLVGVPVGFVLLRAEAAFEESEE

SEQ ID NO: 62734 - protein, 374 aa, Oryza sativa (indica cultivar-group)
MAPTSSVHREGGSAAMDMAELIPTLPLETGSPPFPLRQYGGYWLPEWVLPGLEAVHTRFEPRPSDVFLASFPKSGTTWLKALAFATINRTTYPPSGDAHPLRHRGPHDCVKFFESTFAISGEGGGGDVDVFAALPSPRAVARPGTCSPPSRRRARLLATHIPYSLLPERITSAAADDGDSGCRIVYVCRDPKDAFVSMWLFTMSNMVKGVTTTSDEHHPAAAAPSIEQVFDLFCDGRSIAGPQWHHVREYWEASRRRPEKVLFLRYEEMLREPARNVERLAEFLRCPFTAGEVAAGVVDAIVDLCSIDRLRNVQANKTGVTDLAVKKESFFRRGVAGDWSNHMSPEMASRLDRVVEDALRGSGFTFAAAAGDSE

SEQ ID NO: 62735 - protein, 420 aa, Ustilago maydis 521
MTVAQTVAQADEAIKAGNNQEGERILKSILTNQSTSTDDAQLKEQEAALLRLGGLYRDTQNAEALAETVRSSRTFMSSIAKAKTAKLVRTLIDYFEGIPGSQQTQIQATKENAEWAKSERRIFLKQNLETKLIGLYFDSKNYREALPLIDTLLRELKKLDDKMILTEVHLLESKVNHAISNLPKAKAALTSARTAANSIYCPPTLQAQLDMQAGVLHAEDKDYTTAYSYFFETLEGFALQEDARAPLALKYMLLCKIMLNLSDDVNSIISGKHATKYAGRDVDAMKAVAKAHEDRSLEGFEQALRTYKEELSNDPIVKNHLSALYDTLLEQNLLRVIEPYSRVEIAHIAKEVRQPVREVEVKLSQMILDKVFHGILDQGAGCLVVYDQPVEDKTYQVTLDTLKHVGNVIDSLYKKANKLS

SEQ ID NO: 62736 - protein, 556 aa, Oryza sativa (japonica cultivar-group)
MGSSDFSWTLPDHPKLPKGKPVAVVVLDGWGEADADQYNCIHVAETPTMDSLKKGAPEKWKLVKAHGTAVGLPSDDDMGNSEVGHNALGAGRIFAQGAKLVDTALASGKIFEGEGFKYIKESFDQGTLHLIGLLSDGGVHSRLDQLQLLLNGASANGAKKIRVHILTDGRDVLDGTSVGFVETLENDLSQLRAKGIDACIASGGGRMYVTMDRYENDWDVVKRGWDAQVLGEAPHKFQNAVEAVKTLRSETKANDQYLPPFVIVDDSDKAVGPIVDGDAVVTFNFRADRMVMIAKALEYEDFDKFDRVRVPKIRYAGMLQYDGELKLPSHYLVSPPEIERTSGEYLVKNGIRTFACRQFGHVTFFWNGNRSGYFDETKEEYVEIPSDSGITFNVKPKMKALEIAEKARDAILSGKFDQVRVNLPNGDMVGHTGDIEATVVACKAADEAVKMILDAIEQVGGIYLVTADHGNAEDMVKRNKSGQPQLDKKGEIQILTSHTLQPVPVAIGGPGLHSGVRFRNDVQTPGLANVAATVMNLHGFEAPADYEPTLIEVVDK

SEQ ID NO: 62737 - protein, 229 aa, Listeria monocytogenes str. 4b F2365
MKLVLIRHGQSEWNKLNLFTGWHDVDLSQEGVVEAMTAGKRIKEAGLEFDVAFTSVLTRAIKTLNYVLEESDQMWVPVHKSWRLNERHYGALQGLNKQETAEKYGADQVQKWRRSYDTLPPLLEENDERQAKNDRRYQLLDTHAIPAGENLKVTLERVIPYWMDTIAPEIKEGRRVVIAAHGNSLRALVKFLEGIGDDEIMDLEIPTGVPLVYELNDDLKPVNKYYLDK

SEQ ID NO: 62738 - protein, 164 aa, Brassica napus
  misc_feature (133)..(133): Xaa can be any naturally occurring amino acid
  misc_feature (141)..(141): Xaa can be any naturally occurring amino acid
  misc_feature (149)..(149): Xaa can be any naturally occurring amino acid
MLATLMKLLSACLWPSSSSGKSSDSSSAGRQDGLLWYKDSGHHLLGEFSMAVVQANNLLEDQSQLESGPLSTLDSGPYGTFVGVYDGHGGPETSRFVNDHLFQHLKRFAAEEACMSMDVIRKAYEATEEGFLXVVTKQWPXKPQIAAVXSCCLVGVICGGMLYI

SEQ ID NO: 62739 - protein, 169 aa, Borrelia hermsii DAH
MSTLIQKTLCIIKPDGVRRGLIGNVISRFEKAGLKIVAAKMTLVNRAMAEIHYLYDDIAVRHGEFVWRSLIDFIISSPVFVFVIEGVEAVEVVRKFCGSTEPKVAALGTIRGDFAYHSFNYANEKKFAVYNVIHASASVDDALREIPIWFKEDEILTYKRNDELEHYYG

SEQ ID NO: 62740 - protein, 180 aa, Borrelia hermsii DAH
MEISMKDKTEYYDKFIMRVPNFPKEGILFYDITNVLLQAEAYKSLMEDAHAFYASRKIDCIAAIESRGYLIGSPLALKMGLPLLLIRKAGKLPRQVLREEYELEYGFSSIEIHKDDVKQHSNILLVDDILATGGTLKAAAMLLKKAGGVVSDIFCFIELVKMNGRDILREYSLNSLVRYF

SEQ ID NO: 62741 - protein, 254 aa, Triticum aestivum
  misc_feature (177)..(177): Xaa can be any naturally occurring amino acid
QQAAASEQLNVFTNDDVSFTGYPVVGYQHRIQAFGTCFNSPEDGLLTSCAWDPRIRGFFNYNSGFSIPLSNAPAFIADMQRLRDLNPDSFCSSVDPNIGVLLRYVKASSAYLGKPEDSIGVDIIFYRSHTEGMPRAHADVVDEIEQMALHKYGGIPHWGKSRNFAFDGAIAKVPKSXEFLRVKDRYDPEGLFSNEWTDKVLGINGSPNIIKKRCAIEGLCVCSNNSHCAPEQGYFCRPGKVYKEARVCSFFKDY

SEQ ID NO: 62742 - protein, 517 aa, Borrelia hermsii DAH
MKEFIVSNNAVIVLDFGSQYSQLIARKIREVGVYTRVIAYSISAEEIKDMHPLGIILSGGPASVYLDEAPTVDIEIFNLGVPILGICYGMQLIIKLFGGVISKCDKQEFGNTELFIDDNQSNLFLGLPNKLEIMMSHGDNIVKVPSSFKQIAYTKTCIASVFNEEQKIYGLQFHPEVTCSESGNQILKNFIFKICQAQVNWNLNNSIDDLVEKIKLQVGDKKVILGLSGGTDSLVCALLVNKAIESNLICIFIDTGLLRKNEAREILELNRQYNLNIKHVDSSSIFLNNLKNIDDPEEKRKIIGKTFIEVFEKIALEDKDVEFLAQGTIYSDVIESESRNDVFSSHIKSHHNVGGLPGKIKLKLLEPLRELFKDEVIQLGIQLGIAEDVLYRHPFPGPGLAIRIIGKITQEKINILQKADSILIEELLASNLYYKIRQAFVVLLPVKSVGVMGDSRTYEYTAVIRCVNTLDFMTANWVELPYDFLKKVSSRIINEARGINRVCYDISSKPPATIEWE

SEQ ID NO: 62743 - protein, 446 aa, Pseudomonas putida GB-1
MIESVDNFLARLQQRDPGQPEFHQAVEEVLRTLWPFLEANPHYLQSGILERMVEPERAVLFRVSWVDDQGKVQVNRGYRIQMSSAIGPYKGGLRFHPSVNLSVLKFLAFEQVFKNSLTSLPMGGGKGGSDFDPKGKSDAEVMRFCQAFMSELYRHIGADCDVPAGDIGVGAREIGFMFGQYKRLANQFTSVLTGKGMTYGGSLIRPEATGYGCVYFAEEMLKRQDKRIDGRRVAVSGSGNVAQYAARKVMDLGGKVISLSDSEGTLYAEAGLTDAQWDALMELKNVKRGRISELAGQFGLEFRKGQTPWSLPCDIALPCATQNELGAEDARTLLRNGCICVAEGANMPTTLEAVDIFLDAGILYAPGKASNAGGVAVSGLEMSQNAMRLLWTAGEVDSKLHNIMQSIHHACVHYGEEADGRINYVKGANIAGFVKVADAMLAQGVV

SEQ ID NO: 62744 - protein, 176 aa, Glycine max
MPSGSRDPLVVGGVIGDVLDPFEYSIPMRVTYNNRDVSNGCEFKPSQVVNQPRVNIGGDDLRNFYTLIAVDPDAPSPSDPNLREYLHWLVTDIPATTGASFGHEVVTYESPRPMMGIHRLVFVLFRQLGRETVYAPGWRQNFNTKEFAELYNLGLPVAAVYFNIQRESGSGGRRLY

SEQ ID NO: 62745 - protein, 246 aa, Zea mays
  misc_feature (209)..(209): Xaa can be any naturally occurring amino acid
  misc_feature (221)..(221): Xaa can be any naturally occurring amino acid
  misc_feature (224)..(224): Xaa can be any naturally occurring amino acid
  misc_feature (240)..(240): Xaa can be any naturally occurring amino acid
MGECEDGKEYRCWEELLPDALGLIFRNLPLQEVLTVLPRVCKSWGRVVAGPYCWQEIDIEEWSQQQGKPEQIARMVELLVGRSAGSCRRISVSGLPCDPRFSFIGDNARALRTLEIPRSEISDSMVESVAPRLPNVTFLDISSCTKMGARGLKAFGKHCKSLAGLRRVMHPIDLADRACQHDEAHAIACSMPRLRHLEMGYMLVATEAXVADNLGPWPELXFLXLLGCWAVNDKFCRATXPGLRVL

SEQ ID NO: 62746 - protein, 308 aa, Pseudomonas fluorescens PfO-1
MTSKLEQLKQFTTVVADTGDFEAIARVKPVDATTNPSLLLKAAAIPAYAELLNASVRDCKGDVGLASDRFGVAVGQEILKVIPGRISTEVDARLSFDQDAVLKRAHRLIELYDKAGVGRDRVLIKIASTWEGIRAAEILEKEGIQTNLTLLFSFAQAAACADAGVFLISPFVGRIYDWYKKANGNDYTGADDPGVQSVTRIYNYYKANDYKTVVMGASFRNLSQIEQLAGCDRLTISPDLIEKLAADTGKLERKLAPGHAGEARLSLNEAQFRWLSNEDAMATEKLAEGIRQFARDQEKLEALLQAKL

SEQ ID NO: 62747 - protein, 470 aa, Caulobacter crescentus CB15
MSSPQAVFERRDPVTGAVATTSIAMTADQARVAVDAAQAALPTWSALGPNARRALLSKAAAALEARADDFVAAMMGEIGATEGWARFNLMLAASMVREAAALTTQVSGEVIPSDKPGCLAMAVREPVGVILGIAPWNAPIILGVRAVATPLACGNTVVLKASESCPRTHELIAEAFAAAGLPEGALSIVTNAPADAAEVVGALIDHPAVRRINFTGSTAVGKIIAKRAAEHLKPVLLELGGKAPLIVLEDADLDEAVKAAAFGAFMNQGQICMSTERIIVVDAIADAFVAKFAAKASSLAVGDPREGKTPLGAVVDLKTVTHVQGLVADALADGAVQVSGGPANGVLMPATVVDKVTPAMRLFREESFGPVVAVIRARDEEHAIALANDTEYGLSASVFTRDIARGLKVARRIQSGICHVNGPTVHDEAQMPFGGVKASGYGRFGGKAGVDAFTELRWITVETQPGHFPI

SEQ ID NO: 62748 - protein, 475 aa, Lachancea kluyveri
MTSILSSTYRSPVARNLLKSSKTRGGLFLAARNYSNGEKTLKERFAEIFPSKAEEIKKLKKEHGKTVIGEVLLEQAYGGMRGIKGLVWEGSVLDPEEGIRFRGRTIPEIQKELPKAADGSEPLPEAIFWLLLTGEIPTETQVKALSADLASRSELPEHVVDLLDRLPKDLHPMAQFSIAVTALESESKLPKAYAQGVAKKDYWNYTFEDSLDLLGKLPVIASKIYRNVFKDGKLASVDPNADYGKNLANLLGFQNKDFVDLMRLYLTIHSDHEGGNVSAHTTHLVGSALSSPYLSLAAGLNGLAGPFDGRANQEVLEWLFKLREEVKGDYSKETIEKYLWDTLNSGRVVPGYGHAVLRKTDPRYTAQREFALKHFPDYELFKLVSTIYEVAPGVLTKQGKTKNPWPNVDSHSGVLLQYYGLTEASFYTVLFGVARAFGVLPQLIIDRAVGQPIERPKSFSTEKYIELVNSIKAKN

SEQ ID NO: 62749 - protein, 371 aa, Candida glabrata CBS 138
MDASRLKITKVSTPSERKPNDQLVFGKTFTDHMLTIEWTSENGWDAPEIKPYGKLCLDPSSIVFHYAFELFEGMKAYRTKDGKIAMFRPEKNMERMNKSAARICLPTFDGEELIKLIGKLIELDKHLIPEGEGYSLYIRPTLIGTSEGLGVKEPDRALLFVICSPVGPYYKTGFKAVRLDATDYATRAWPGGVGDKKLGANYAPCVLPQTQAAAKGFQQNLWLFGPEHYVTEVGTMNAFFAFNCKETGKKELVTAPLDGTILEGVTRDSILTLARKYLDPNEWEINERYFTIHEVQEKAHKGELLEAFGSGTAAIVSPIKEIGWKDTIINVPLIPGEQSGPLTKQIASWMMDIQYGKVELDNWLRIVADIN

SEQ ID NO: 62750 - protein, 506 aa, Nectria haematococca mpVI
MLVDTGLGLISELRARLGWAALLQIVPVTVVAYNLLWFIYTSFFSSLRKIPGPFLARISRVWEIKKAATGNIHEIVMDLHRCHGPIVRIGPNRYDFDTMEALKIIYRIGNALPKADYYIPFGLPSSPNLFDVQNPARHSAMKKQVASLYTMTALLSYEAGVDGQTIILKEQLQRFCDQKQVIDLPQFLQYYAFDVIGVITVGKSMGMMETNSDTNGACGALDAMWHYSSMMAFIPHMHAWWLRLSSLLPIDVPIKGLTEYVEQRIIQYRLKAAEFGDDDALKGENNFLAKLILMERQGTVTSTETQQAVGLNIGAGSDTTANALSSILYFLYTNPRTLRRLREELDTHVKEDPIRFQQSQSMPYLQAVIKEALRLHPGVGTQLTRVVPKGGLVIEGQFFPEGAEVGVNGWALYHNKAIFGNDASVFRPERWLETKGNLNIGGSFAFGAGSRSCIGKNISILEMSKAIPQIVRNFDIEINHGDMTWKNECWWFVKPEYKAMIKPRAA

SEQ ID NO: 62751 - protein, 532 aa, Oceanicola granulosus HTCC2516
MWDKLNAHHESVAARRFETLFDGGRAEDFSVRVGDMLFDYSKTNIDAEGRALLIELLERADVAGRREAMFSGAPINETEGRAVLHTALRNINGEPVTVDGQDVMPGVRETLERMEAFAADVREGRFTGQGGRITDVVNIGIGGSDLGPAMATLALAPYHDGPRCHFVSNVDPADIAGVLRGCDPATTLVIVASKTFTTIETMTNARTAKAWMSETVSEPAAQFAALSTAADKTADFGIAPERVFGFEDWVGGRYSMWGPIGLSLMIAIGPRAFRQFLAGGAEMDRHFRAADWSENMPALLALVGIWHNQVCGHATRAVLPYDNRLSRLPAYLQQLEMESNGKRVSMDGAELSVQSGPIVWGEPGTNGQHAFYQLIHQGTRVVPCEFLVAARGAEDDLHHQHQLLVANCLAQSEALMKGRTLDEARAKVADKFSGDELERQASHRVFPGNRPSTTLAYPELDPATLGRIIALYEHRVFVEGAVLGINSYDQWGVELGKELATGLQPVVEGRESTDGKDGSTAGLVNFLRQSGM

SEQ ID NO: 62752 - protein, 110 aa, Vibrio cholerae O1 biovar eltor str. N16961
METIDKIKQQIAENPILLYMKGSPKLPSCGFSSQAAQALMACGEKFAYVDILQNPDIRAELPVYAQWPTFPQLWIEGELIGGCDIMLEMFQKGELQTLVKEAAARSASQE

SEQ ID NO: 62753 - protein, 378 aa, Arabidopsis thaliana
MDWLRTKRIRAKKRKRNVKENGEVVLKELIECCDGKCNPIKNFSYDQIIKATNNFCQSNRASRIDVYYRCYKGMLDDRPVLIKKGKYTLDMKEICRDIAISSMVSGHKNFLKLLGCCLEFTPPVLVFEYAEVITLGPLLTSHPGYLRRIKIAREVANALTYLHTAFSRVFIHSNLDPFTIFLDGNGVAKLGNFCNCITIPEGETFVHDDTLQKYHELRHNTLKGTHGLGVCNLPVIDPDYKSTGKVTTKTDMHSFGGFMLALVQIREVDDELSLSSDMLRALADLFIKPYDDVRYVHFPLHHHVSKILRKFGYAEVVDSDMSEVAAWPIKAFLRLALRCIGCKLGDPLSSMIQVTKELRLIEKSAYYPSNNRSQMSSI

SEQ ID NO: 62754 - protein, 297 aa, Escherichia coli
MATNLRGVMAALLTPFDQQQALDKASLRRLVQFNIQQGIDGLYVGGSTGEAFVQSLSEREQVLEIVAEEGKGKIKLIAHVGCVTTAESQQLAASAKRYGFDAVSAVTPFYYPFSFEEHCDHYRAIIDSADGLPMVVYNIPALSGVKLTLDQINTLVTLPGVGALKQTSGDLYQMEQIRREHPDLVLYNGYDEIFASGLLAGADGGIGSTYNIMGWRYQGIVKALKEGDIQTAQKLQTECNKVIDLLIKTGVFRGLKTVLHYMDVVSVPLCRKPFGPVDEKYLPELKALAQQLMQERG

SEQ ID NO: 62755 - protein, 344 aa, Streptomyces avermitilis MA-4680
MRATLIYGAGDVRVEDVPDPKIQQPTDAVVRVLRSCICGSDLWPYKSRPATEQGERIGHEFLGVVEDVGSDVSGLKNGDLVVAPFVWSDNTCDFCAEGLHTSCRHGGWWAADGVDGGQGEAVRVPQAQGTLVKLPVAEDSALLPSLLTLSDVFCTGHHSAVTAGVDPRTTVTVVGDGAVGLSAVLAARRLGAERIILMGRHKDRTDLGRDFGATDVVPERGEEGIERVRELTGGDGTHTVLECVGTLPALQMSLGVVRAGGTVSRVGAPQYDDVPLGFQEFMNNITLTGGVAPARAYIDELLPDVLEGKVEPGRVFDRTVGLDDVPAGYRAMDDREALKVLIRP

SEQ ID NO: 62756 - protein, 389 aa, Oryza sativa (japonica cultivar-group)
MALLSPRVPRLPLASASAAGAGLRCCVSGGRAGSAAWCHASAAGSVASSSSELEAIRWGTAKLQGARDEMEDEVVLRPGSLLDGFSFAAVFDGHAGFSAVEFLRDELYKECAAALDGGAVLSTKNLDAITDSIQRAFATVDANLSTWLEQMDKEDESGATATAMFLRNDVLVVSHIGDSCLQVVSRGGRPQAVTNFHRPYGNKKASLEEVKRIRAAGGWIVDGRICGEISVSRAFGDIRFKTRKNEMLVKGVKEGRWTEKFISRINFKGDLIVSSPDVSLVELGPDVEFVLLATDGLWDYIKSSEAVALVRDQLRQHGDVQVACEALGQIALDRRSQDNISIVIADLGRTNWKELPAQRPNLFLELTQAVATVGAVSLGIYISSLLALQ

SEQ ID NO: 62757 - protein, 589 aa, Zea mays
  misc_feature (26)..(26): Xaa can be any naturally occurring amino acid
  misc_feature (74)..(74): Xaa can be any naturally occurring amino acid
  misc_feature (84)..(84): Xaa can be any naturally occurring amino acid
MGSYAYKYCMCFTRKFRSPDAQPPPXDVRAAHLSFASDAHALRRFVAGVQGESPADVDRILAMLSGGHSHGIAXRLVTRSPAAXSTPTLEDFFAFLFSPDLNPPIAHQVHQDMSAPFSHYFVFTGHNSYLTGNQLNSDSSDVPIVKALQRGVRVIELDMWPNPSKDNVDILHGGTLTAPVEMIKCLKSIKEYAFCASNYPLVITLEDHLTSDLQAKVATMLTETFGDLLFVPNPDPMKEFPSPASLMKRIIISTKPPQEYKEFLKAENNRSGSGNIAELPDQGSLRRIDSNADESDGKDELDEQDEEDSDEDDPKFQQDTACEYRKLITIQAGKPKGHLRDALKVDPDKVRRLSLSETQLAKATISHGAEVIRFTQKNILRVYPKGTRVNSSNYDPMNAWTHGAQMVAFNMQGHDKALRLMQGFFRANGGCGYVKKPDFLLRTGPNGEVFDPKASLPVKKTLKVKVYMGDGWRMDFSKTHFDAFSPPDFYTRVGIAGVKADSVMKKTRVIEDQWVPMWDEEFTFLLTVPELALLRVEVQEYDMSEKHDFGGQTVLPVWELKQGIRAVPLHDRKGVRYKSVRLLMRFDFV

SEQ ID NO: 62758 - protein, 617 aa, Mucor circinelloides
  misc_feature (443)..(443): Xaa can be any naturally occurring amino acid
  misc_feature (522)..(522): Xaa can be any naturally occurring amino acid
MLSLKRIATTTKSNIFHRALLAQRSYSYINANEYSDPRHDKNVHVMHSRGVNLLHDPLLSKGTAFSIAERERLSIRGLVPPRCQEMDKQLLRIKRNLDACETPLAKFVFLAALHDRNETLYYKIIMEHLEELAGIIYTPTVGLASQMSHSIYRRSRGMYFSSQDRGQMSAMVYNWPHDKVDVIVVTDGSRVLGLGDLGANGMEIPIGKLSLYVAAGGIRPRAVLPVVLDVGTNNQDLLNDPLYLGMSHPRLEGEEYYSFIDEWVTAITSRWPDTLIQFEDFKYPHAYNLLAKYRNRITCFNDDIQSTSSITLAGILASLKSRGMSQEDLSNERIICVGAGSAGVGVCEGIIDCMVAQGRVKSREEAYSKIYMLDQYGLLGNPGVHLPSDEEHGHPYQPRTTKLDDRQYCYVKHDLRDQMGLEELVRKVKPTVLLGLTGIQGVXSEEAVREMAKHHERPVIFPLSNPDTHAECTAEEAFKWTDGRAIFASGSPFKDVELPNGKIGRTNQCNNSYSFPVSGLGXGITVSRASRVTPNMFLETARTIADMATPSQLKEGILFPGVSQLREVALNVGTRVCEVAFEEGYATAKLEEGEILSEVVRSSAYQPEYVPLVYRDH

SEQ ID NO: 62759 - protein, 843 aa, Trichodesmium erythraeum IMS101
MRGVLMAGGSGTRLRPLTCDLPKPMVPILNRPIAEHIINLLKKHQIREIIATLHYLPDVMREYFQDGSKFGVQMTYSVEEEQPLGTAGCVKNIAELLDGTFLVISGDTITDFDLSAAIEFHQKHKSKATLVLTRVNNPIEFGVVITDEEQRIKRFLEKPSTSEVFSDTVNTGTYILEPEILDYLPSNQECDFSKELFPLLLDKNEPIYGYIAEGYWCDVGHLDSYRKAQYDALQHTVKLELPYKERSPNLWIGENTYIDPTAKIETPTLIGDNCRIGPRVHIELGSVIGDNVTIGADANVKRPIVWNGTLVGEDTNLRGCVICRGSRIHRRAQILEGAVVGSLSTVGEEAQISPHVRVWPSKTVESGAILNINLIWGTTAQRNLFGQRGVQGLANIDITPDFAVKLGAAYGSTLKNGSTVSVSRDQRNISRMVSRSLIAGLMSVGINVINLQSTAIPIARTILPTMNLVGGLHVRLSPDRSDQILIEIFDYQGINISKVKEKNIEGAYFKEDFRRVQISEIGNMIDRHEVLNAYSKGFENLLNSEAIRYSKSKVVIDYCYGVSGAVLPQLLTKFGCDAVVLNASLKETSLGIEERENLLDQLGRVVEALQANVGVQVTANGEQLILVDEVGSAIRGETLTALMVNLMLTAHPRGTVVVPINASAAVEQIAHRHDSHVIRTKANPTALMKACQINHNVVLGGSGDMGFIFPKLHPGFDAMFCIAKVIEMLTIQERSLGQITADIPPITHRCYTIRCPWKVKGALMRYLVETNPPEKLELTDGVKIINHQDNYWVLVLPDAGKPLVHIYADSNDRDWVDKTLRDYRNMIHDFVNLFMTRNQLDNL

SEQ ID NO: 62760 - protein, 330 aa, Pinus taeda
VAFNNITRLAFGKRFVNEEGKMDPQGVEFKEIVATGLKLGASLTMAEHIPYLRWMFPLEEGAFAKHGARRDNVTKAIMEEHTLARQTSGAKQHFVDALLTLQEKYDLSEDTIIGLLWDMITAGMDTTAITVEWAMAELVRNPRIQQKAQEEIDRVVGRDRVMNETDFPHLPYLQCITKEALRLHPPTPLMLPHKATQNVKIGGYDIPKGSNVHVNVWAIARDPAVWKDPVTFRPERFLEEDVDIKGHDYRLLPFGAGRRICPGAQLGINLVQSMLGHLLHHFVWAPPEGMQAEDIDLTENPGLVTFMAKPVQAIAIPRLPDHLYKRQPLN

SEQ ID NO: 62761 - protein, 370 aa, Oceanicola granulosus HTCC2516
MDVMEAAAAAEAAGRSIVHMEVGQPGTGAPAAALERLGREMSAGPLGYSVARGIPELRARIARHYGEAHDVDLDPNRVIVTAGASGAFLLAFSALFDTGARVGLGEPCYPSYRQILKALDMVPVGIPTGLETRMQPVAAHVAEYDLAGLLVASPANPTGTMLGRDDLASLSDACRAGGAALISDEIYHGLTYGTRAVSALEVTDEVYVINSFSKYFSMTGWRVGWMVVPENHVRVVERLAQNMFICPTHASQRLALAAFDCREALDANVAVYAENRRLMLERLPRAGFDRIAPPDGAFYIYADVSAHTDDSIAFAREILEEAGVAVTPGVDFDPQRGRQWLRFSYAQSTAAITEGLDRLERFLAVRSAAE

SEQ ID NO: 62762 - protein, 587 aa, Coccidioides immitis RS
MDVDQGRLQLFFLPSLVFSPVTSSHICFIPSYSLILRIIRDLLLAISGVVRAMPMAATFPSQLLRSSRCCANQCTGISRQIQSRSFHCASKSCYERKSYIQSPRKRSNSHARSFHSSAPAQATVKDPYNVLGVNKNASASDIKRAYYGLAKKYHPDTNKDPSAKDKFAEAQSAYEMLSDPEKKKAYDQFGARAFDQNGGFNPHAAGGGPFGGASAGGFHGFGGFGGEVNFEDLFAHAFGGAGRRRTARGSPFQSTVLVGEDIEVQTNVSFMDAAKGTKKDIFITPLVKCNSCQGEGLKPGRKRSQCSACGGSGTTVHIMGGFQMASTCGACDGTGSSIPRGAECSSCHGNGVVRERRTVQVDIPGGVEDGMRLRIAGEGDVPPGEPGTRKQRGDLFVFIRVAPDQRFSRSGADVLYTASIPLTTALLGGEVTVPTLDGEVKVKVATGTGTGDQITLSGMGMRKLGGRRGGNGDLKVQFKVAMPKYLTANQRTILEVLADEMGDKTAKRVMNVKDDRSASSPDSKSEKSADPHKGEGFLKAAWHKLMNQHHKPTDSSTEGKSDASQKKGSNQDNSDNHDESKKASGSG

SEQ ID NO: 62763 - protein, 196 aa, Glycine max
MMNEFRYSCKSAHQTLQWINEIIHFLTPYSSLINAHVVNFFKDRLWENVDAEWIECLRRESVQNLLLIPSGAVQDQWPTSLKEFILKIRSMVFCQEQADINMALPGLQTISLNTVLAQGMNVKKKHEVEILSAVTNTVANSIRADAILDVGAGQGYLAQVLAFQYQHPVIAIDACSHHGRGTDARAERIKNTIHHR

SEQ ID NO: 62764 - protein, 1402 aa, Candida glabrata CBS 138
MTAGTAGLDTGRPLYYVGAQKDNTPRDESLVSYVFKGETDYIKLLASTDPLSRVIDNNKGGVVLLDQVTLLESLPHLYSIGKKDSTSNITEGSVITIIVDLNLEDYSIIPAVSDLHLPIHIGLESINLEQNGIHFINFNRINGTQTANNIFTSGAASPKNLIINLSQYYNELVKSVPEDVAIFNITEYKKNLLPEILANVPSSITRINLLQGSSTASENQEYEDGFEPFLLDFFADFEVLVQNNIQQLLLTKIGNKVDDFNSVSAKIISNLESAKPVKNLFVGEVVDISKDVTEDYSNSIKNILKLEDAYIKVLKQLLGNNLSIINEYSNSTINTLSPEFGYGRYLQEKEIQNKLVELARKSLDPQLFHSQESDEFVKKLSKWVSFKSSSLDQNLLEEANKIGSDIFEYLKTDAHSQTAIKLLEVAENDEKYFQFKSSWLIGSDAWSYDLGNSGVHQVLTSSDNINMLIIDSEPYEQRKASTQRKKDVGLYAMNFHNVYVASVAVYSSYTQLLTAFIEANKFNGPSIVLAYLPYKSEKDTPLDVLKETKSGVESGYWPLYRYDPSKEEADEQSAFQLDSSVIRKQLEAFLERENKLTLLTKRNPALARTLAQSASDVVTQKQNKRAEAALESLLNGLSGPPLHIYFASDGGNASNLAKRLHGRASARGLKSTVLSMDDLILDELPGEENVVFITSTGGQGEFPQDGKSFWDALKGSTDLDLSNLNVSVFGLGDSQYWPRKEDKKYYNKPAQDLYRRLEFLGAKILAPLGLGDDQGDDGYQTGYSEWEPKLWEALGVANVEVEDEPKPITNEDIKLNSDFLRGTIASDLKDESTGTVQYSNEQLMKFHGIYTQDDRDIREVRKSEGLEPYYYFMARARLPGGKCTPHQWLGLDKLSEDSGNGTLKLTTRATFQIHGVLKKNLKHTLRGMNAVLIDTLAAAGDVNRNVMVTALPAQAKIHKQISTMAAEISEHFLPKTTAYHEIWLDGPEEQDYEDDWNERFNNRKEGPRKKKTLVSGNALVDIEPIYGPTYMPRKFKFNLTVPPYNDVDVFSSDIGLIAIVDKEKNSIEGYNIYVGGGMGTTHGNKKTYPRVASSFGYVKNEDVLPALEALLIIQRDYGNREDRKQARVKYTVDRLGVQGYKEKAEEIWGKKFEPERSYEITSNIDYFGWVKDENGLNHFTAYIENGRVIDTPDLPQKTGLRVLAQYMEKNNTGHFRLTGNQHLVVSDITDEHLDAVKEILAKYTLDNADFSGLRLSSSACVGLPTCGLAFAESERYLPDVITQLEDTLEEYGLRHDSIIMRMTGCPNGCSRPWLAELALVGKAPHTYNLYLGGGYYGQRVNKLYRANLNDEEIVDVIKPLFKRYAAERNEGEYFGDFVIRAGIVKPTLEGRLFHEDISEDAF

SEQ ID NO: 62765 - protein, 450 aa, Shigella flexneri 2a str. 301
MTKHYDYIAIGGGSGGIASINRAAMYGQKCALIEAKELGGTCVNVGCVPKKVMWHAAQIREAIHMYGPDYGFDTTINKFNWETLIASRTAYIDRIHTSYENVLGKNNVDVIKGFARFVDAKTLEVNGETITADHILIATGGRPSHPDIPGVEYGIDSDGFFALPALPERVAVVGAGYIAVELAGVINGLGAKTHLFVRKHAPLRSFDPMISETLVEVMNAEGPQLHTNAIPKAVVKNADGSLTLELEDGRSETVDCLIWAIGREPANDNINLEAAGVKTNEKGYIVVDKYQNTNIEGIYAVGDNTGAVELTPVAVAAGRRLSERLFNNKPDEHLDYSNIPTVVFSHPPIGTVGLTEPQAREQYGDDQVKVYKSSFTAMYTAVTTHRQPCRMKLVCVGPEEKIVGIHGIGFGMDEMLQGFAVALKMGATKKDFDNTVAIHPTAAEEFVTMR

SEQ ID NO: 62766 - protein, 489 aa, Thermobifida fusca YX
MTTIEREARIVEQVPKQVCIGGHWRDAQSGATFKVEDPATGSVLCEVADAGVADGMAALEMAAATQPTWAEYPPRERGEILRRAYELLMHRQEDLAVLMTLEMGKPVAESKGEIAYAAEFFRWFSEEAVRIDGSYSVAPNGQSRLLVMRQPVGPSLLITPWNFPMAMGTRKIGPAIAAGCTMILKPAQQTPLSALALADILHEAGLPEGVLSVLPTTDAAGLTGPLLRDGRLRKLSFTGSTPVGRALIKQSADQVLRTSMELGGNAPFLVFDDADLDAAVAGALQAKMRNIGEACTAANRFYVQSGVAEEFSRRLAERMAGLRMGRGTEPDVDVGPLIDDKARTKVQSLVDDAANRGARVLLGGKRGDGAGYFYHPTVLTDVPKDSEVCRTEIFGPVAPVIPFDTEEEALAEANRTEFGLVSYVYTENLRRALRMAEKLESGMVGLNQGIVSNPAAPFGGVKHSGLGREGGRVGIDEYLETKYVGIAGV

SEQ ID NO: 62767 - protein, 163 aa, Alkalilimnicola ehrlichei MLHE-1
MTALRDYVKSFLLVELLQGLRLTGKHFLSRSVTLEYPEEKTPKSPRFRGMHALRRYPNGEERCIACKLCEAVCPALAITIEAGPREDDGTRRTTLYEIDMFKCIYCGFCEESCPVDSIVETREHEYHMEHREERVFDKARLLANGDKYEAQIAADRAADAPYR

SEQ ID NO: 62768 - protein, 348 aa, Oryza sativa (indica cultivar-group)
MVDMLMLLVGEAMAPLLTRLYYNSGGNSLWMVTLAQSAGAPLLVIPFLLTPRAAAVGEPRPAPAASKMVAICVALGLVVGCDNLMYSYAMLYLPVSTFSLLAATQLAFNAVTSRLINAQRFTPLVVNSVVVLTFSAALLGVDDPSSSSSVGGGAGGDAVQRGKHAAGVVLTLSASAVYALILSLFEATFDKVIGAATPRWVLKMQISTNAVAATVSATALFASGEWRTIGGEMAAFKGGKAAYAATVVGVAVGWQAATLGAVRLIARVSSLFANVTGTLALPMVPVLAVALFGDKMTGTKVLAMLMAVWGFLSYVYQHYLDGRRAAAREGRVHAAAGCGICTDQMNYS

SEQ ID NO: 62769 - protein, 417 aa, Alkalilimnicola ehrlichei MLHE-1
MREFKSYTVNFGPQHPAAHGVLRMVLEMEGETVRRADPHIGLLHRATEKLAESKPYNQSIGYMDRLDYVSMLCNEHAYVMAIEKLLGIEAPIRAQYIRVMFDEITRILNHLMWLGAHGLDVGAMTAFLYCFREREDLMDCYEAVSGARMHAAYYRPGGVYRDLPESMPKYEPSKFRSKKELELMNAARQGTMLDFIEDFTERFPGCVDEYETLLTENRIWRQRLVDVGVVSPERALQLGFSGPMLRGSGIEWDLRKKQPYDVYDRVEFDIPVGTNGDCYDRYLVRIEEMRQSNRIIKQCVDWLRHNPGPVMLEDHKVAPPSREEMKDDMESLIHHFKLFTEGYTTPPGEVYAAVEAPKGEFGCYMISDGANKPYRVKLRAPGFAHLSAMDEMARGHMLADVVAIIGTQDIVFGEIDR

SEQ ID NO: 62770 - protein, 262 aa, Zea mays
  misc_feature (72)..(72): Xaa can be any naturally occurring amino acid
  misc_feature (85)..(85): Xaa can be any naturally occurring amino acid
MMLANKLGGLLKNATSSNMSVYQAIRCMSSSKLFVGGLSYGTDDHSLRDEFAKYGQVIEAKIILDRESGRSXRGFGFITYTSSEXASAAITAMDGKTLDGRNIRVNHANERTGGFRSSGGYGGGGYGGGGGGYGGGGYGGGYGGGSGGYGGGGSGDYGGGSGGYGGNYGDRAGGGYGGGGDYGVAGGAEGSFAAGGSDSFGSSNFADSGFGENPAGSFGAMGGSSGADGFSAGTPGDGNKNDEIMDDLFKDDEPDSYANKRS

SEQ ID NO: 62771 - protein, 146 aa, Triticum aestivum
MAEPPPPPSQSPAQTPPPTQQQTPAANARDGMMACVAALEAALLPCLPARELQAVDRSLQSSHQIDVERHARDFMEAAKKLQSYFIGMQREDQPTTEELLRKEITTMEEELKTKSELIAKHKSLIEGWQKELKDQLGKHNTELERV

SEQ ID NO: 62772 - protein, 434 aa, Listeria monocytogenes str. 4b F2365
MILTIKFLIIALLIAISAFFVATEFAIVKMRPSRLDQLIAEKDKRAVLARHIYNHLNAYLSACQLGITISSLGLGWLGESTVEAALHPLFSLMELPQSAITILSFTIAFLFITFLHVVVGELVPKTLAIDKTEAVALAVARPLHIFYKVMFPFIWILNGSAVFIARLFGLEPASEHEIAHTEDELKIIVGESYKSGEINQSEFRYVNKIFDFDERMAKEVMIPRTEIVTVDTGSTIGELSDIMQNERYTRYPVIDGDKDHVIGVLNLKEILSAYVEHGSNPSFSIDPYVKPIIRVIETIPIKELLFRMQRERSHIAILLDEYGGTSGLVTVEDIVEEIVGDIRDEFDADEIPEIRKIKDGHFIVDAKLLIDEVNNILGTEIEEEEVDTIGGWFLTQNYEVEVGDEIDYDGFIFRVKQGEPHHIEYIEIIKKTND

SEQ ID NO: 62773 - protein, 256 aa, Oryza sativa (japonica cultivar-group)
MSREENVYMAKLAEQAERYEEMVEYMEKVAKTVDVEELTVEERNLLSVAYKNVIGARRASWRIVSSIEQKEEGRGNEEHVTLIKEYRGKIEAELSKICDGILKLLDSHLVPSSTAAESKVFYLKMKGDYHRYLAEFKTGAERKEAAESTMVAYKAAQDIALADLAPTHPIRLGLALNFSVFYYEILNSPDKACNLAKQAFDEAISELDTLGEESYKDSTLIMQLLRDNLTLWTSDLTEDGGDEVKEASKGDACEGQ

SEQ ID NO: 62774 - protein, 419 aa, Photorhabdus luminescens subsp. laumondii TTO1
MNIENRITQKSLSMKIAETFVIKDDCLEIGGIPLTRLETQIGQTPFFAYSRKHIDQQVCLLRKYLPEKISIHYAIKANPFVPLIHHLSQKIEGFDVASANEMALALNTGVSPEDISFAGPGKTDTELKRAIAAQVLLNVESLNELRRIQILSEKLGLCARVSLRINPDYNLNSSGMKMGGGPRQFGMDVVYVPEALMFIRDYPDSLVFEGFQIYPGSQNLCAEHLIEAQNKALNLVIELSHSAPSPVRRFNLGGGFGVPYFQGNTELNITEVGNAMHKLVERAEKFLPEVEIILELGRYLVASSGIYVTKIVERKISHDMTFLVTDGGMNHHLSASGNLGQLIRRNYPAIIGNKIKGEKRETVNIVGPLCTPLDILVHQGDMSVATPGDLVVIFQSGAYGLSASPNNFLSQTNAVEVLV

SEQ ID NO: 62775 - protein, 451 aa, Mycoplasma mycoides subsp. mycoides SC str. PG1
MSRIERIFAREILDSRGTPTVEVEVWTEFGGYGCAKAPSGASTGVNEALELRDGDKARYNGKGVLKAVKNVNEIIAPKLIGVDALDQLTVDRIMLDLDGTEFKTKLGANGILAVSLAVAKSAASELDIPLYKYLGGVQAKKLPVPMLNVINGGEHADSAIDFQEFMIMPVGAKSFSEALRWSSETFQALKSLLKSKKDITAVGDEGGFAPNFEWAYEKHDLKSFKAKTPAEIALDLLVEAIKKAGYKPGKDGIMIAMDCASSELYLEDKKYHFKKIEKVTNQEWSLTTDEMISYLEKLVDNYPIISIEDGLAETDWEGFTKLTQKIGDKVQIVGDDLFTTNPKFIKQGINKKAANSTLIKLNQIGTLSETVEAITMTQKAGWTAVVSHRSGETEDTTIADLAVAFNTGQIKTGSMSRSDRIAKYNRLLQIESELDKNAVYDGLEAFYNLKK

SEQ ID NO: 62776 - protein, 548 aa, Pseudomonas fluorescens PfO-1
MTLSPFAGKPAPAELLVDIPRLVTAYYTGQPDASVSTQRVAFGTSGHRGSSFDLSFNEWHVLAISQAICLYREAQGITGPLFVGIDTHALSTPAGASALEVLAANGVTVMIAEGDEYTPTPAVSHAILCYNRGRTTGLADGIVITPSHNPPQSGGYKYNPTNGGPADTHITKWIEAKANELLANKLAGVKRISYEQALKAETTHRHDYVNTYVADLINVIDFDAIRGAKLRLGVDPLGGAGVRYWSAIAEHYRLDLDVVNKEVDSTFRFMTVDWDGQIRMDPSSSHAMQGLIGLKERFDVAFACDPDHDRHGIVTPSGGLLAPNNYLAVSIDYLFQNRPQWRADAAVGKTVVSSGLIDRVAKRLGRRLYEVPVGFKWFADGLFDGSLGFGGEESAGASFLRKDGGVWSTDKDGLIPALLAAEMTARTGRDPSQAYRALTDELGEPFSVRVDAKANPEQKALLSKLSPEQVTSTELAGEKIQSILSKAPGNDQAIGGLKVMTENGWFAARPSGTEDIYKIYAESFIGDDHLKQLVAEAQMLVDGAISTQ

SEQ ID NO: 62777 - protein, 363 aa, Mycoplasma mycoides subsp. mycoides SC str. PG1
MAICKIGSKYTFTIRGILFCYIIKFMLMCFLERGLYLMIKKIGILTSGGDAPGMNNAIAGVVKTAASKGIEVYGINDGYKGLVNGWFEKLNVEKTLDILSRGGTYLGSARLPEFKELEVRQKAVANLKKAGIEALVVIGGDGSYMGAQKLTEMGINCIGLPGTIDNDISSTDYTIGFHTALNTIVEAVDRIRDTMQSHNRADVVEIMGNGCGDLVTYTAVATGAEIFSPAEDLLTIEQMGQKAKQFRLLGKKSLIILVSEKSYGISAKEIAEKIQKISGYETKATVLGHIQRGGRPTAMDRYIAFTAGMFAVEKLAEGKGGLFIGLENNKLVARDIDSTLNMKKEDKKPFIKYLREINGYFSK

SEQ ID NO: 62778 - protein, 431 aa, Pseudomonas putida GB-1
MTHRIVIVGGGAGGLELATRLGKSLGKRKQADITLVDANLTHIWKPLLHEVAAGSLNSSEDELNYVAQAKWNHFNFQLGRMSGLDREGKQIQLAATLDEEGRELLPARTLGYDTLVIAVGSNTNDFGTLGAAQHCLFLDTRKQAERFHQQLLNHYLRAHAGDVASEKISVAIVGAGATGVELAAELHHAAHELAAYGLDRIQPKDMHITLIEAGPRVLPALPERISVPVHKTLEKLGVKVMTNAAVSEVTEDGLKTKDGEVIQASLKVWAAGIRAPGFLKDIDGLETNRINQLVVRPTLQTTRDDNIFAFGDCAACPQPGSDRNVPPRAQAAHQQASMLAQSLKARLENKALPTYEYKDYGSLVSLSRFSAVGNLMGNLMGSVKLEGWLARMFYVSLYRMHQMALYGFFRTALMMLGSKIGRGTEPRLKLH

SEQ ID NO: 62779 - protein, 478 aa, Lactococcus lactis subsp. lactis Il1403
MEHKKLKAFPNDFLWGSASAAYQVEGAPFEDGKKASVWDNFVRIPGKTFKGTNGDVAVDHYHRYKEDVALMKELGLKSYRFSIAWTRILPDGRGEVNQAGLKFYEDLIDELIANEIEPIVTIYHWDLPQALEDLYGGWESREIIADFVNYAEVLFNAFKGKVKYWVSLNEQNIFTSQGWSLATHPPGKRDMKLFYQVNHIANLTNAAVINKFHELEMDGQIGPSFAYTPQYAKDSDPLNVLAAENAEELYSHFWMDVYLYGEYPIAAMAYLRENGLAPEFEAGDAELLKSAKPDFLGINYYQTATNAWNPVDGGVGVGSFNTSGKKGTTKESGIPGLHKKIQNPFIDRTNWDWEIDPEGLRIALRRITSRYRIPVMITENGLGEYDKVEDGKIHDDYRIKYLESHVKAIKEAMTDGAKVIGYHTWSYTDLLSWLNGYQKRYGFVYVDQDETMEGSLKRIPKDSYYWYQHLIETNAEEV

SEQ ID NO: 62780 - protein, 256 aa, Mycobacterium sp. JLS
MSDRFSMEGRVAVITGGGTGIGRASALVLAEHGADVVLAGRREEPLKATAADVEALGRRAIAVPTDVTKADQCQALVDATLGEFGRLDVLLNNAGGGETKSLMKWTDEEWHEVLELNLSSAWYLSRAAAKPMIAQGKGAIVNISSGASLLAMPQAPVYAAAKAGLNNLTGSMAAAWTRKGVRVNCIACGAIRTPGLEADAKRQGFDIDMIGQTNGSGRIAEADEIGYGVLFFASDASSYCSGQTLYMHGGPGPAGV

SEQ ID NO: 62781 - protein, 250 aa, Alkalilimnicola ehrlichei MLHE-1
MRKPMVAGNWKMNGSLALVNDMGRALADVDCSAVDVLVCPPFPYIGPLRRAVPDESGVALGGQDVSRYDSGAYTGEVAGAMLAEMGCRHVIVGHSERRAMHAETDEVVVDKVQAALRAGLTPIVCVGETLEARDAGETEQVVGRQLDAVLELGGFVVEKLVLAYEPVWAIGTGRTASPEQAQAVHAFIRQRAADALGDELAQRLPILYGGSVKPGNARELFGCADVDGGLIGGASLDPDGFLEIISAARP

SEQ ID NO: 62782 - protein, 393 aa, Arabidopsis thaliana
MAETQGKVITCKAAVVWGPKVPLVIQEICVDPPQKMEVRVKILYSSICHTDLGCWNGTNEAERAFPRILGHEAVGIVESVGEGVKDVKEGDYVIPTFNGECGECKVCKREESNLCERYHVDPMKRVMVNDGGTRFSTTINKDGGSSQSQPIYHFLNTSFTEYTVLDSACVVKIDPNSPLKQMSLLSCGVSTGVGAAWNIANVKEGKSTAVFGLGSVGLAVAEGARARGASRIIGVDANASKFEKGKLMGVTDFINPKDLTKPVHQMIREITGGGVDYSFECTGNVDVLREAFLSTHVGWGSTVLVGIYPTPRTLPLHPMELFDGRRITGSVFGGFKPKSQLPNFAQQCMKGVVKLEPFITNELPFEKINDAFQLLRDGKSLRCILQISKLLKR

SEQ ID NO: 62783 - protein, 698 aa, Oryza sativa (japonica cultivar-group)
MDAPPLRLRLAVAFLSLLLTVSASAAAASGGGGGFNVSFDSAALAFSDLTLLGDSFLRNGSVGLTRDTAVPSSSAGSVLCSRAVAFGGGGGSAASFAARFSFVIAEQNAGSTGGDGIAFFISPDHATLGATGGYLGLFNSSSSAAKTNASIVAVEFDTMLNDEFGDPSDNHVGLDLGLPVSVNAVDLAAFGVVLNSGNLTTAWIDYHGADHLLQVSLSYSAAKPAKPVLSVAVDLSPYLRDAMYVGFSASTEGSTQQHTIKEWTFQTFGFPSATNSSSFSNTTGNASAQTVPGEAAAGGAASRKKRFGLALGILGPVALAVSFVFFAWVSIRKLIELTSRKNAGFLPELVKGPRKFSYKELSAATRGFHASRVIGKGAFGTVYKAAMPGTATASAVSYAVKRSTQAHQSRNEFVAELSVIACLRHKNLVQLEGWCDDKGELLLVYEYMPNGSLDKALYGEPCTLSWPERYTVASGIASVLSYLHQECEQRVIHRDIKTSNILLDGNLSPRLGDFGLARLMDHNKSPVSTLTAGTMGYLAPEYLQSGKATEQTDVFSYGVVVLEVCCGRRPIDKDDGGGKNVNLVDWVWRLHGEDRLIDAADPRLAGGFYRDEMLRLLLVGLSCANPNCDERPAMRRVVQILNREAEPVPVPRKKPLLVFSSSASIKLQEIAFACGDDVRGGLPAAATSPRSEGGDIER

SEQ ID NO: 62784 - protein, 338 aa, Sinorhizobium meliloti 1021
MGVVIPLEDNKNKQASVKPLVDLTLSDMERVNQLILSKAGSDVQMIPEVANHLISSGGKRLRPMLTLAAASMFGYEGDGHIKLATSVEFMHTATLLHDDVVDESDLRRGKSTARTIWGNQASVLVGDFLLGQAFRMMVDVGSIDALDVLSTAASVIAEGEVLQLSVAKNMETTEDDYLQVIRAKTAALFAAASEVGPIVAGGSKADRNALKSYGTNLGLAFQLVDDVLDYGGTSSDLGKNVGDDFREGKITLPVILSYRRGTPQDRAFWREAIEGGASDAANLEKALGLIRRYGGLTDTIARAKHYGTIARDALAPLPASPWKSALVEVIDFCIDRVS

SEQ ID NO: 62785 - protein, 289 aa, Listeria monocytogenes str. 4b F2365
MENRISGTTRLLGLIGTPVDHSKSPIMYNYSFQKAGLDYAYLAFDTPIEKVADTIKAIKTFNLRGANVTMPCKSEVLKHMDDLSPAARMIGAVNTIVNEDGKLTGHITDGLGFIANLRDASVDVTGKKMTIIGAGGAATAIQVQCALDGAKEITIFNIKDAFYDKAKQTAASIKQEVPNCIVHIYDLNDTEKLNAEIATSDILVNATLVGMHPNEHETPISDTSVFRKELIVADIIYNPKKTQLLLDAEAAGCKTVGGLGMLLWQGAEAYKLFTGKDMPVSEVKNLYFN

SEQ ID NO: 62786 - protein, 138 aa, Zea mays
  misc_feature (57)..(57): Xaa can be any naturally occurring amino acid
  misc_feature (117)..(117): Xaa can be any naturally occurring amino acid
FVFIFRAMDGLRVTMRLRDAPLHEFLPEWNIQVMVSESRAETGANQEDALARIEKLXEVNAKLGYLESMLGISHPELSEMQDRAILEAAIAMTNQRDQVFAEIMRPMAGTPQELGHXVTIIRQVAQKVVAKVGKTIRY

SEQ ID NO: 62787 - protein, 454 aa, Mycoplasma mycoides subsp. mycoides SC str. PG1
MKVIVLGTNHAGTTAVRTLKRLDPTCEVTTYDKNDAISFLGCGIALWVKGEVKDPNMLFYATPEILRSEGVNVFMNHEVLSVDDKAKTVTVKDLKTGEVKTDNYDKLIVATGTWPLIPPIPGIDLEGVQICKNYHHAKKILEHNLDKSYKKIAVVGAGYIGVELVEAFNEYGKDVTLIDVANRIMPVYYDQEFTDLMQEKMTKAGVKLSLGAKVIEFKGENGKVTQVVTDKGNIDVDYVIFSVGVRPQSAILEGICDLDDRKAIVTNDFMQTTNPDIYAIGDCAQVYNKAMNKNVPIQLATTAVRTGVIAAFNVIKGNGLKSPGFTGANGISVFGLHMASVGISVEAAKRMGYDVDFINFKDLDRPEFMSTANEVLFKVVWDKKTRKIIGAQVASEKNHTEVMYMLALGIQKDLTIDELPLVDIFFLPHFNKPFNFISLAGLEVLGLNYFKKEK

SEQ ID NO: 62788 - protein, 634 aa, Xanthomonas oryzae pv. oryzae KACC10331
MNQPTEPLDMDVCAREPIHIPGLIQPYGVLLVIEPADGRIVQASSTAAELLGVPMDALLGMAYTQVLEMPDAQPGAVDDQPQHVLHADVRFPQRSAPTDHPWVAAWHLYPEQWLIEIEPRDARLMDVTLREALPLLRSIERDAGIEEASVRAAKGLRSMIGFDRVMVYRFDEEWNGDVIAEARQPELEAYLGLHYPASDIPAQARALYLRNRVRQIADVRYQPSPIQPTLHPRLGTPVDLSDVSLRSVSPVHLEYLANMGVSATLVSSIVVNDALWGLISCHHYSPHFTSHAMRDATDAVTRALAGRIGALQAVGRARLESVLLTIREKLITDFNDAEHLTVDMLADMAPDLMDVVDADGVAIFHGNEISRHGSVPDADALRRIRDHIESEHHDALRADAVGALHVDAIGEVFPELADLAPLAAGFIFVPLMPQSRSALLWTRREQVQQVKWAGNPQLAKLQDIPNSRLSPRKSFDLWQQTVRGRARRWSPLHLESARSLRVLIELMERKRFQQDFSLLEASLSRLRDGVAIIERGANAAAHRLMFVNPAFADLSQTEVADLIGCDILALLADDAERGKVELLEEALRLGRAAYVTLPLRTQGGEPAYRQFHLEPLPSSSGVTAHWLLQLRDPE

SEQ ID NO: 62789 - protein, 329 aa, Mycoplasma mycoides subsp. mycoides SC str. PG1
MAIINNIKAVTDALDCAMQRDPNVIVFGEDVGTEGGVFRATQGLAVKFGNDRCFNAPISEAMFAGVGLGMAMNGMKPVVEMQFEGLGLASLQNILTNISRMRNRTRGKYTAPMVIRTPMGGGIRALEHHSEALEAVYAHIPGVQIVCPSTPYDTKGLILAAIDSPDPVIVVEPTKLYRAFKQEVPDEHYIVPIGEAYKIQEGNDLTVVIYGAQTVDCQKAIALLKETHPNATIDLIDLRSIKPWDKKMVVESVKKTGRLLVVHEAVKSFSVSAEIITTVNEECFEYIKAPLSRCTGYDVITPFDRGEGYFQVNPKKVLVKMQELLDFKF

SEQ ID NO: 62790 - protein, 428 aa, Mycoplasma mycoides subsp. mycoides SC str. PG1
MFKVKFADIGEGLTEGIVAEVLVKVGDVVKEGQSLYFVETDKVNSEIPAPVAGKIAVINIKAGQEIKVGDVVMEIDEGTGASVASEPKAEAKSEAKVEVVEENASVVGATPVSNDLIVRKQASTVAKSSTIKATPLARKVAADLNVDLSLVTPTGPNQRILVADIKNYHSSSAQPVSQPAPAPVVTPTIKVVEPSAPLSWDEVPMNGVRKATVKAMTKSHTEIAAFTGMKNTDITETHKMRTELKDHAAASGIKLTYLAFIIKAVAKSLRDMPNINVRGDFANNKIQFMHNINIGIAVDTPNGLMVPVIKGVDHLSVFEIAIKINELANKAKDGKLTRAEMTEATFTVSNFGSVELDYATPIINSPESAILGVGAMSQTPLYINGELQKRFIMPLSMTCDHRIIDGADAGRFLIKVQDYLSKPVLLFM

SEQ ID NO: 62791 - protein, 595 aa, Mycoplasma mycoides subsp. mycoides SC str. PG1
MFKVKFADIGEGLTEGTVAEVLVKVGDVVKEGQPLYFVETDKVNSEIPSPVAGKIAIINISTGQEIKVGDVVIEIDDGTSVSTSEPKVEVVEENASVVGATPVSNDVLPSRAPKPKPEAPKVDVQIEDTFDVCVVGAGIGGYVTAIKSAQLGLKTLIIEKEYYGGVCLNVGCIPTKTLLKTSHVYHDIMHKAKELGIVLQNTEKVVIDWAQVLQRKNGVVKKLTGGVKYLLDKNKVTQIKGEAVALDKNTISVNNKNYRVNNLIIASGSTPNHLPLPGFDQGRKDGIIIDSTGILSVPKIPETLVVIGGGVIGIEFSCLFASLGTKVTVLQGLPTVLEMLDKDIIDAMTKELKNRYNIEVITNASVKEFKNGSVVYEIDDKDQMIKGEYVLESVGRKTSITGFENIGLELTPRKAIVVNEYQETNLDGVYAIGDVVGKVMLAHTAVKGAIVAANRIAKKANKDHAEDIVMDYYRIPSCIYTHPEVSMIGKTEQQLKQENIEYKTFKFPFSAIGKALADNDTSGFVKIIIEPKYKTILGAHIIGNRATEMISEIAAVIECEGTITEIANTIHPHPTMSEAIGEAAEALETGKAIHF

SEQ ID NO: 62792 - protein, 365 aa, Lactococcus lactis subsp. lactis Il1403
MTENIITETRPSIYGLTRDQLIEWAIENGEKKFRATQVWDWLYRKRVQSFEEMSNLSAAFIDKLNEHFILNPLEQVVVQESADGTVKYLFMLPDQMMIETVLMRQSYGLSVCVTTQVGCNMGCTFCASGILKKERDVTAGEIVSQIMLVQKYFDERGLDERVSHVVVMGIGEPFDNYEHLMNFLRVINDDNGLAIGARHITVSTCGFMPAKIKEFAHENLQINLAISLHAPNNELRTSLMRITRNAPLEKLFEAIDYYTETTNRRVTYEYIMLSGENDSPEIAQQLADLIKPRNKLSYVNLIPYNPVAEHIKYERSTKDNTAKFYDVLKKNGINCVVRQEHGTDIDAACGQLRSKQIKKNKAKLA

SEQ ID NO: 62793 - protein, 335 aa, Schizosaccharomyces pombe
MQQTYKPNTSALKDGAPKATVDQKQLLPCKYRVGRVLGGGTYATVREAVHIETNKMYAAKIMNKKMMEKKQDFVKNEIAILKRVSYEHPNILHLVDFFETVNNLYLITELATGGALFDRICAKGSFYEADAAALMRTTTSAVKYLHDNGIVHRDLKPENLLYRSKDPNSDLLIADFGLSHFYEDSQYYMLMTACGTPEYMAPEVFRRTGYGKPVDMWAIGVITYFLLSGYTPFARPSQVEVIEAILANEYTFNDPCWSGISETAKDFIKKCLENDPSKRLTAADALKHPFLSENGPATSNLLPNVRENFNARKTFRTAYNAVRAFNTWKKLENKH

SEQ ID NO: 62794 - protein, 326 aa, Lactococcus lactis subsp. lactis Il1403
MLTFWQDYPEIQNKLKDVQALMIERLKINNQEIEAALEKFASRGGKMVRPALFLLFAGIVPNGSKDEEKIIKIAASLEMLHSATLIHDDIIDDSPLRRGLPSIESQFGKDVAVYAGDFVYTVYFELLIETMNGTSFVAKNAQSMKKILQGELTQMQSAFDKNNTARRYMKAISGKTAELLSLSCLEGVYFAGGDKKLQHSARKIGRAIGLAFQVYDDILNFTVGLDEADKPILTDFRQGIYTLPLLLAREVNDEAIAPYLEAPENLSRQECLDLAELVTESGGIAGALLVAGRLTELALNEIRKLPESTNRQILEEATQILLERNY

SEQ ID NO: 62795 - protein, 227 aa, Desulfovibrio vulgaris subsp. vulgaris str. Hildenborough
MLIREWMTRNVITVTPDTSMMKASKLMKENGFRRLPVLDGNGKLIGIVSDRDIKEASPSKATTLDMHELYYLLSEIKVKDIMTRDPICVQPDETVERVALLMIEKHIGGMPVVDEEGQLVGIITDSDIFKVLIAITGVRSGGVQFAFELENKPGTLKPIIDTLRELNASIDAILTSDQTGSDDTRRVFIRIVPMDRAEENRVIEAIKEKFPLLYWARARVHEMERPA

SEQ ID NO: 62796 - protein, 1078 aa, Alkalilimnicola ehrlichei MLHE-1
MRLRGMPKRTDIKSILIIGAGPIVIGQACEFDYSGAQACKALREEGYRVILVNSNPATIMTDPETADAVYIEPIEWQTVARILEKERPDAVLPTMGGQTALNCALDLSREGVLERLGIEMIGANKEAIDMAEDRESFREAMARIGLETAHAEIAHSMEEALDAQKRIGFPTIVRPSFTLGGSGGGIAYNREEFIEICERGLDLSPTNELLIEESVLGWKEYETEVVRDKADNCIIICFIENLDPMGVHTGDSITVAPAQTLTDKEYQIMRDASLAVLREIGVETGGSNVQFAINPADGRMVVIEMNPRVSRSSALASKATGFPIAKVAAKLAVGYTLDELRNEITGGATPASFEPTIDYVVTKIPRFTFEKFPKAPPRLTTQMKSVGEVMAIGRTFQESLQKALRGLENDLTGLDERVDLSVEGGNDLIRQELRQPSPERLLYLADGFRAGFTLEELFELTWIDPWFLAQIQELVAVEQGLRTGGLKSLDRDRLFNLKQKGFSDARLARLLGVREADVRARRLQLEVRPVFKRVDSCAAEFASATAYMYSTYEEECEAEPTDRRKIMVLGGGPNRIGQGIEFDYCCVHAALAMREDGYETIMVNCNPETVSTDYDTSDRLYFEPLTLEDVLAIVEIERPEGIIVQYGGQTPLKLARDLEAAGAPIIGTTPDSIDLAEDRERFQGLINKLGLKQPPNRTARSADQALRLAAEIGYPLVVRPSYVLGGRAMDIVYGEDELLQYMHEAVRVSNDSPVLLDRFLDDAVEVDVDAICDGEDVLIGGIMEHIEQAGVHSGDSACSLPPYTLAPDVQDRLREQTRALALELGVVGLMNIQFAIKGSDVYLLEVNPRASRTVPYVSKAIGTPLAKVAARCMAGQTLAAQGITREVIPAYYSVKEAVFPFIKFPGVDPILGPEMKSTGEVMGIGRSFGEAYAKSQVAASVKLPRSGRCFISVRDVDKPGAIEVARELIRRGFSLVATRGTAAALSEAGVECDVINKVLEGRPHIVDAIKNDEIDLIVNTTEGRQAIADSYSIRREALQHKVCYTTTINGARATLLALDYLDAADVNRLQDLHREATA

SEQ ID NO: 62797 - protein, 329 aa, Zea mays
MESPISRTNLNCISLADPNVQKSVALLKQACLDSGFFYVVDHGISQEFMDEVFAQSKKFFDLPHSEKMKLLRDEKNRGYTPMLDEILDPENQVNGDYKEGYYIGVEVPADDPEANRPFYGPNQWPSKEVLPKWREVMEQYHREALIVAKSVARIIALALDLDVDFFDRPEMLGESIATLRLLHYEGKVSDPAKGVYGAGAHSDYGLITLLATDDVVGLQICKDKNAQPQLWEYVAPLKGGFIVNLGDMLERWSNGVFRSTLHRVVLDGRERYSIAYFVEPSHDCVVECLPTCKSESNPPKFPPITCSAYLSQRYKDTHADLKSYDDSKA

SEQ ID NO: 62798 - protein, 152 aa, Glycine max
MAKFGEGDARWIVQERADGANVHNWHWAERDCLDWSRALLSKLLAGLPVLSGEGGLTLRTTTLDKLDGEAYVNIRKGKVIPGYELSLTLAWEADATTESGVVKVTGTAEVPYLADENADEDPELRITVRGDDGPLARRAKDAFIAHGKPLVI

SEQ ID NO: 62799 - protein, 474 aa, Burkholderia vietnamiensis G4
MQPAEIGTPLRRTLGARHINLMALGATIGVGLFLGSATAIRLAGPSILLGYAFVGVFVFFVMRALGEMAVAHPVAGSFNRYAYEYIGPRAGFVTGWTYWFMWILCIMAEVTAVAIYMKFWFPGMPAWVWSLAALATMGLLNFVAVRAFGELEFWFAAIKIVTIVFMILSGIGIIGFGFGNGGVATGIGNLWRHGGFLPNGMWGLASAIPMVVFAYLGVEIIGLTAGETKNPEKSLARAVNSVFWRIAIFYIGALFIIMSLYPWNAIGTQGSPFVLTFERLGIRGAAGIINFVVLSAALSSCNSGIFGTARIVFNLAQQGQAPRIFAHTSKSGIPACAVVLTLVAALLGVLLNYVAPKGLFEWLTAIGTFAGLFSWAIILVAHYRFRRQRVAQDNRMLMPWWPYSSYCTLAFLAVLVAFMLKFDETRVAVIVGPLWLAFLWIVYGLSAKNGASRQGVPSPSASFAVEGVTRDIRD

SEQ ID NO: 62800 - protein, 343 aa, Populus tremula x Populus alba
MARSNIAGKSPSMVSIMLLFGLLLASLDATGAQIGVCYGMNGNLPPAQEVIELYSQRGIRRMRLYDPNQDALRALQGTNIELMLGVPNADLQRIASSQTNANAWVQRNVRSFGNVRFRYIAVGNEVRPFDSYAQFLVPAMKNIRNALYSAGLGNIKVSTAIDNGVIEDDSSPPSKGSFRGDHRPFLDPIIRFLLNNQAPLLVNLYPYLSYTGNSEDIRLDYALFTAPSSLVSDPPLNYQNLFDAILDTVYAALEKSGGGSLDIVVSESGWPTAGGTGTSVDNARIYNNNLVQHVKRGTPKKPGKPIETYIFSMFDETYKNPELEKHWGIFLPNKQPKYNINLR

SEQ ID NO: 62801 - protein, 652 aa, Saccharophagus degradans 2-40
MCGIAGLVSPSLPIDSLKATATAMAQAIEHRGPDAMGVWVEQEQKLAFSHRRLSIQDLSESGAQPMHSHSKRYTIAFNGEIYNFLEIKKPLIDAGFEFRGHSDTEVLLCAIEHWGLEQTIAKAKGMFAIALWDSQTKVLTLIRDRIGEKPLYYGVINGSFVFGSELKAIFAHTPAKALTLNKVAIASFLRHGYISAPNSVFVEVKKLSPGCRIDINLAKQSDWSIANLTPQPYWTVAQSANQPYLYTEQNQSEAISALDEKINKVINEQSIADVPLGAFLSGGIDSTVVSAVLQANTSTAIDTFTIGFEEKSFNEAEFAKEIAKHLGTKHHEHYVNQQDILELVNILPRVYDEPFADASQLPTILVNRFARSELTVCLSGDGGDELFAGYNRYVFTEAVLKKAAALPAVFKSILKALITSVAPGKWDKLYQALNSIAKRKGGAEFGNKLYKMVSLADAKSKAAAYEYLMSYWQQPEQVLKAFNGELAMQSPLSLEDDFINAAMAWDQQWYLPGDNLTKTDRASMAASLELRAPLLDIELIDFAWTVSPELKVRDGKSKWLLREVLYKYVPKELIERPKMGFSVPISQWIRTDLSAWVDELLDKEFIEKQGIFNYAPIQHALLEHRSGSYDHGKKLWTLLMFQAWFKTNIIDG

SEQ ID NO: 62802 - protein, 403 aa, Listeria monocytogenes str. 1/2a F6854
MSKPKIVILGAGYGGLKTLRKLQQRNLEAEIVLVNKNDYHHETTWLHEAAAGTIEPEKLMYPLDKVVNDTKTTFVQDTVVKINKDEKTVTLDANGDISYDYLLIALGSEAETFGISGLKEYAFTITSVESVKKIRAHIEAQFAKWKTDPRDELLTIIVGGAGFTGIEFLGELTNRIPELVKQYDVPREKVRIYCMEAAPKVLPQFDAKLVDYGVGVLEDRGVEFHVGKPVKEATADGVKYAESENEVREIKAATIIWAAGVRGNSVIEASGFEAGRGRVKVNNNLTVPGNEEILIVGDCSLIINPANDRPFPPTAQIAMQQADVAAVNLAKLVKGETDLQDFVYHEKGTVCSLGDNDAIGVVFGKNLKGYPASVMKKVIDDRALLLIGGSGVLASKGKFKFYK

SEQ ID NO: 62803 - protein, 85 aa, Glycine max
FYAYWRENAIDLGDYNFTLSYDTNITRQACLSAISWIVCDVLNCMLDFYILWHLVKVEVMPNLILVVDEELGIVVRLQDQARLAY

SEQ ID NO: 62804 - protein, 750 aa, Oryza sativa
MASSSNPSNLPCSSDGVCMLCKVLTTEVEQLRCSTCATPWHTPCLSSIPPLTDVAHWVCPDCSGDVTASYPPSDVVRPESSLLAAIRVIEADPVLSIQEKARRRQELLGHAGDAGAAITEAVGENVEDSESNNPLSMLNKNINCSFCMLLPERPVTTPCGHNFCLKCFRRWIENGKRACVICRAPITQKVAQDLRINLALVQAIRMAKAANNASTTGETTVYHYKENEDKPDRAFTTERAKRAGMANASSGQIFVTIAPDYFGPILEDHDPRRNRGVRVGDHWKDRMEGRQWGAHFPHIAGIAGQSTHGAQSVALSGGYLDDEDHGEWFLYTGSGGRDLSGNKRTSKEQSFDQKFEKLNAALRVSCLNGYPVRVVRSFKEKRSPYAPESGVRYDGIYRIEKCWRKTGVQGTFKVCSDEHGDHPRPLPDIEELKNAIDITERKGNPAWDFDATDGWKWMITPPISRKAVVTGDPRGKKMQGAARHTNNLSMRERLLKEFRCSICRNVMEEPVTTPCAHNFCKKCLLGSYDNLSLTEERSRGGRTLRARKIVKKCPSCPSDIADFVQNPQVNRDIMNVIESLQKEAEKEDHARVSGEGSSAALVDSDDENDTAWENQDDGNLDEGGCNNPEDMITESVDLNSVTNVDNTENKVEVQQPHKRTAGAGKGKGGKRARTSSAPGDADARNVVTSTETLDGIAAENVADLVQIEDCTFTGVERADPNALEVDGKNMIPDFSEAEKVNPKQDQEVLP

SEQ ID NO: 62805 - protein, 187 aa, Magnaporthe grisea
MKVFTNKDTFNYSWEEVSTANWRKYCPWNDKSTHVIAVDTISRSVDSQTGILRTERLITCRQNAPDWVCKVLGASNGESLMYEVSYVDAANKKVTMVSQNMTWSNLINVQETVVYSPLNDKQTQFVQDAKITALCGGWQKIRNSIEDAIVTRFRENAAKGREGFESVLAMSKRGFAEERARQVVMAQ

SEQ ID NO: 62806 - protein, 296 aa, Oenococcus oeni PSU-1
MIKNTLENPLKKHFNQDYPDQFQEEPGLESKLTPKPDAGEETYQGSNQLKGRKALVTGGDSGIGRAAAIAYAREGADVAINYLPSEQSDAEEVKKYIEESGRKAVLIPGDLKSEDFNQKMVKKAVEELGGLDILALVAGKQQAETDITHLSTKQLEDTFATNVFSIFWTVKAALQYLKAGSAIITTTSIQAYKPSSFLLDYASTKGAIHTLTQALSGQLAEKGIRANTVAPGPIWTPLQVTGAQPQENIPSFGQNTPLKRAGQPVELSSVYVFLASNQASYVTGQTYGVTGGGFTN

SEQ ID NO: 62807 - protein, 376 aa, Shigella flexneri 2a str. 301
MAKQDYYEILGVSKTAEEREIRKAYKRLAMKYHPDRNQGDKEAEAKFKEIKEAYEVLTDSQKRAAYDQYGHAAFEQGGMGGGGFGGGADFSDIFGDVFGDIFGGGRGRQRAARGADLRYNMELTLEEAVRGVTKEIRIPTLEECDVCHGSGAKPGTQPQTCPTCHGSGQVQMRQGFFAVQQTCPHCQGRGTLIKDPCNKCHGHGRVERSKTLSVKIPAGVDTGDRIRLAGEGEAGEHGAPAGDLYVQVQVKQHPIFEREGNNLYCEVPINFAMAALGGEIEVPTLDGRVKLKVPGETQTGKLFRMRGKGVKSVRGGAQGDLLCRVVVETQIGLDEKDKQLLHELHESYGGPTGEHNSPRSKSFFDGVKKFFDDLTR

SEQ ID NO: 62808 - protein, 431 aa, Vibrio cholerae O1 biovar eltor str. N16961
MVMADKKATLHIEGKAPIELPIMDGSLGPQVIDVRTLGSNGYFTFDPGFLATASCESQITYIDGAKGILLHRGYPIDQLANNADYLEVCYILLYGEAPNRKQYEEFKKIVTRHTMVHEQIASFFHGFRRDAHPMAVMCGVVGALAAFYHDSLDINNDTHREIAAYRLLSKMPTLAAMCYKYSVGQPFIYPRNDLSYAENFLHMMFATPCEEYEVNPIVARAMDKIFTLHADHEQNASTSTVRLAGSSGANPFACIAAGIASLWGPAHGGANEACLRMLEEIGSVDKIPEYVRRAKDKDDPFRLMGFGHRVYKNYDPRATVMREACHEVLKELSIQDPLLDVAMELERIALSDEYFIEKKLYPNVDFYSGIILKAIGIPVSMFTVIFAMSRTIGWIAHWNEMHSDPDNRIGRPRQLYTGQKLRDFTPLHERS

SEQ ID NO: 62809 - protein, 180 aa, Phaseolus vulgaris
MASSMISSPAVTTVNRAGAGAGMVAPFTGLKSLGGFPSRKMNNDITSVANNGGRVQCIQVWPTVGKKKFETLSYLPPLTKQQLAKEVDYLLRKGWVPCLEFELEHGFVYREHNKSPGYYDGRYWTMWKLPMFGCTDSSQVLKELYEAQTAHPDGFIRIIGFDNVRQVQCISFIAYKPPGY

SEQ ID NO: 62810 - protein, 381 aa, Caulobacter crescentus CB15
MRAEIEPFHAIAISRLAHQLKMEGRSIIHMEFGQPSTGAPSKALAKAHDILDAEAMGYWESPLLREKIAQRYQTLYGVTVEPERIILTCGASPALVLALSSLFKPGDRIALARPGYVAYRNTLKALHLEPVEIACGPEDRFQLTAKHLADLEPAPVGVIVASPANPTGTIIEPAELEAIAKVCAARGIRIISDEIYHGLSYAGRTPSMLEFAPDALIVNSFSKYFSMAGWRLGWLLTPPGEDLDRARAYVGNLFLTAPSLAQHAGLAAMDCIDELEGHIDVYRANRQLMLDALPALGLKEIAPPDGAFYIWANIAHLTDDSLGFCEDLLRDTGVATAPGVDFDPVEGKRFIRFSFAVSTPEVEEALRRITPWFEARTASAA

SEQ ID NO: 62811 - protein, 328 aa, Arabidopsis thaliana
MNLLAVLQVLQFDQEESFTTSMTKQVGKKFAWVIKNFSSLQCKKFYSVPFQIGDCKWRLSIYPKGNNCDYLSLFLEVADFKSLPSGWRRYVKLRLYIVKQEMWGWGFLYMLPLTKLHDEKEGFLVNGELMIVAEVDALGFIDPLNESEESEDPTQPLKKIKLNDDGAVSSDLLEEASPRKESMEVNGFQVLPSQVESVRLIFERHPDIASEFRAKNQYLRKACMDFLLSLVETLCQSLQEFSNEDLVEADIALTYLKDAGFKVDWLEKKLDQVRDKKEKERSCLAKLQETEETLLKLKQKCTELDALMDTEKAELSAIRTPLSFEDVV

SEQ ID NO: 62812 - protein, 340 aa, Oryza sativa (japonica cultivar-group)
MFDFLMLPSVSIGFASYVFRLYPTEGFVNFLQQNCLPQPQEGENFHLVGQTTNTMSTPPPTPQAAANNTVQIDIHEDAINDASAKKRSLRYWTHDEEERLASAWLNASKDPIHGNEKKGDTFWKEVTDEFNRKGNGKRTREINQLKVHWSRLKSSIGEFNDYWTKVTQMNTSGYDDDMLEKEAQQMYANTFGKPFALVHWWKILRKEPKWCAMIEKDKNKAEVVDIPDEQKRPIGREAAQAERNGKRKKDSMSEGIVILGDNIEKIIKVTQDRKLEREKVTEAQIHISNVNLKAAEQQKEAKMFEVYNSLLTQDTSNMSEEQKARRDKALQKLEEKLFAD

SEQ ID NO: 62813 - protein, 201 aa, Aspergillus nidulans FGSC A4
MASEMQNSNPTIINTADLPTRLRPSASPKSSTYGSEFFASALPSLTVDALSDYSPSTSESENDDDLMEEPIDEQEIYDLVSTISDPEHPISLGALAVVSLPDISIKPALPDVPDSPLRTVTVLITPTITHCSLATVIGLGVRVRLEQSLPPRFRVNVQIKEGTHSTADEVNKQLADKERVAAALENGTLMGVIAKMLETCL

SEQ ID NO: 62814 - protein, 351 aa, Brassica napus var. napus
MMKETNAAGEASSSLRRHRKRQRLPSVENGRETASVDGDEVIPEARSGTLLDLDLLDCPVCFQALTQHVFQCDNGHIACSSCCRELRNKCPACALPIGNNRCRIMERVVESVTVPCPNAKHGCTEKFSYGKELAHEKECRFALCYCPAPDCNYAGVYKDLYTHYDANHKDTSTRFVCDTLHRTYLGTVSTTSVLQEYRDGPLVVVQGFVVAHGLSVTVNCIAPSAPGVGKFSFNLTYTLGRHTVTFGSTEMNRIQKVSLETPQSDFMSIPSYLVSPIIVKNLRICIRRLEEEAGEDEEEEEAGEEEEAGEEEEEAGEEEEEEEAVEVDVVNNVRRSTRQKKGNSKYQNKVK

SEQ ID NO: 62815 - protein, 515 aa, Bacillus subtilis subsp. subtilis str. 168
MTTPYKHEPFTNFQDQNYVEAFKKALATVSEYLGKDYPLVINGERVETEAKIVSINPADKEEVVGRVSKASQEHAEQAIQAAAKAFEEWRYTSPEERAAVLFRAAAKVRRRKHEFSALLVKEAGKPWNEADADTAEAIDFMEYYARQMIELAKGKPVNSREGEKNQYVYTPTGVTVVIPPWNFLFAIMAGTTVAPIVTGNTVVLKPASATPVIAAKFVEVLEESGLPKGVVNFVPGSGSEVGDYLVDHPKTSLITFTGSREVGTRIFERAAKVQPGQQHLKRVIAEMGGKDTVVVDEDADIELAAQSIFTSAFGFAGQKCSAGSRAVVHEKVYDQVLERVIEITESKVTAKPDSADVYMGPVIDQGSYDKIMSYIEIGKQEGRLVSGGTGDDSKGYFIKPTIFADLDPKARLMQEEIFGPVVAFCKVSDFDEALEVANNTEYGLTGAVITNNRKHIERAKQEFHVGNLYFNRNCTGAIVGYHPFGGFKMSGTDSKAGGPDYLALHMQAKTISEMF

SEQ ID NO: 62816 - protein, 189 aa, Methanosarcina barkeri str. Fusaro
MKELKILVVNNYGQFCHLIHRAVRDLDMDTKIIPNTTPIEDILAEEPDGLILSGGPEMDRAGLCFDYVREIDLPILGICLGHQAIALAYGGHVHSGKKGGYAEVEVEVLEEDDILRGLGPKATVWASHADEVAILPEGFIHLARSDICEIEAMRHPTKPIYGVQWHPEVSHTEKGEELLTNFLEICEKY

SEQ ID NO: 62817 - protein, 180 aa, Glycine max
MANQAVYSVWAIPPEDVGARCANLMTTLRSEFGGPHFHPHITVVGAIKLTPEDAVTKLRSACQALRPFHVTVDRVAAGSFFYQCVYLLLRPDPHLLETSAHCCTHFGYTNSTPYMPHLSLLYGDLSDEEKRKAQERANAIDDTLGGLTFQITRLALYKTDTEDKTLKSWEKIAECTLTPN

SEQ ID NO: 62818 - protein, 275 aa, Triticum aestivum
  misc_feature (215)..(215): Xaa can be any naturally occurring amino acid
  misc_feature (247)..(247): Xaa can be any naturally occurring amino acid
HDRTSLYKKAGWYRSGNPGISSTHASDPHSLPSPSFPFPFLPFPSLPFPRKRDLLLTPATAKHTATTQTNRQTRCSPTPASASPPTRRRGQATHTPRSSPPPPPPSPPHLHPPTLLRRRHLSLSLSLSCTTNNNNIKPPLFLLHPTTPPPPPPCTTTLGDMGQPSLISEYDLGAEGDLFKAPEPIIEEPVLALDPVAAAISMMSGGDNSMDDSIXRLDMGLSWVLYECEKVLMEKSVIEETISWLVXLRVPMLNVGGRAGGPRAFIVRGVLLAGR

SEQ ID NO: 62819 - protein, 277 aa, Magnaporthe grisea
MAHSHSHDGSAPHSHSHDGSTFNAQEHGHSHEILTGPGSYLGREMPIVEGRDFSERAFTIGIGGPVGSGKTTLMLALCLALRDTHSLAAVTNDIFTREDAEVLTRNKALPPSRIRAIETGGCPHAAVREDISANLACLEDLHRTFNGVDLLLIESGGDNLAANYSRELADFIIYVIDVSGGDKIPRKGGPGITQSDLLVVNKTDLAEIVGADLGVMERDARKMREGGPTVFAQVKKSVGVEHIVNLILSAWKASGAEEIAKANGGPRPTEGLEELNA

SEQ ID NO: 62820 - protein, 196 aa, Mycoplasma mycoides subsp. mycoides SC str. PG1
MIKQASFITSSANKSNWIDDDVSEICLIGRSNVGKSSFINSLTNNNKLAKISNTPGKTRLLNFFEINKGEYRLVDAPGYGYAKVDDNLKIQFAKMMEEYFINRRNLKGVFLLLDLRHKPSNDDIMMYQFLKHYNIPVVIIGTKLDKLKKSEYVKNEKMIKETISFYQEDDFVKISNLNKTNIIKCYELIDKLLGSK

SEQ ID NO: 62821 - protein, 805 aa, Bacillus subtilis subsp. subtilis str. 168
MGKKQLVLVGNGMAGVRAIEEILSVAKDEFQITIFGAEPHPNYNRILLSKVLQGDTDIKDITLNDWDWYEENNIQLYTNETVIKVDTENKTVITDADRIQPYDELILATGSVPFILPIPGADKKGVTAFRDIKDTDTMLAASKQYKKAAVIGGGLLGLEAARGLLNLGMDVSVIHLAPFLMERQLDATAGRLLQNELEKQGMTFLLEKQTEEIVGDDRVEGLRFKDGTSIEADLVVMAVGIRPNTTLGAESGIPVNRGIIVNDYMQTEIPHIYAVGECAEHRGIAYGLVAPLYEQAKVLAKHMCGIETKPYEGSVLSTQLKVSGVEVFSAGDFNESEEKKAIKVFDEQDGIYKKIVLRGNQIVGAVLFGDSSEGNRLFSMIQKEADISETSKISILQPLSQEAGTSITAAMSDDEIICGCNGVSKGAIIQAIQEKGCSSTDEIKACTGASRSCGGCKPLVEEILQHTLGSDFDASAQKEAICGCTTLSRDEVVEEIKAKGLSHTREVMNVLGWKTPEGCSKCRPALNYYLGMINPTKYEDDRTSRFVNERMHANIQKDGTYSVVPRMYGGVTNSTDLRKIADVVDKYEIPLVKMTGGQRIDLIGVKKEDLPKVWEDLDMPSGYAYGKTLRTVKTCVGEQFCRFGTQDSMALGIALEKKFEGLNTPHKVKMAVSACPRNCAESGIKDLGVVGIDGGWELYVGGNGGTHLRAGDLLMKVKTNEEVLEYAGAYLQYYRETANYLERTSAWLERVGLSHVQSVLNDPEKRQELNGRMNETLSVHKDPWKDFLEDKQTSKELFENVVTTS

SEQ ID NO: 62822 - protein, 103 aa, Magnaporthe grisea
MTGRGKGGKGLGKAGPKRHRKILRDNIQGITKPAIRRLARRGGVKRISAMIYEETRGVLKSFLEGVIRDAVTYTEHAKRKTVTSLDVVYALKRQGRTLYGFGG

SEQ ID NO: 62823 - protein, 231 aa, Saussurea involucrata
MVVGLGSGVASSLTIQYLGQKLRVGLLRDVVGIPTSVGSASEAEKAGIPLHQYQDGSQIDLAFNDADIVEEGSLNAVIGHQRLQGEESIMEEKRISDVTENLILMLTEKQYKSVIEGAIPVLVKSVSWMDTAEEIDDLFVGDAEVRRRASIGHAGPTGGDFPLVTREGYNVLDVIFTSPISSLAEVAKLLDNIDGVACHGIITKTPCTAVMTTESGLYIIDNTVTSTTRSL

SEQ ID NO: 62824 - protein, 375 aa, Sinorhizobium meliloti
MDARAAVAIQAGKPLEVMTVQLEGPRAGEVLVEVKATGICHTDDFTLSGADPEGLFPAILGHEGAGIVVDVGPGVTSVKKGDHVIPLYTPECRSCPSCLSRKTNLCTAIRATQGQGLMPDGSSRFSINGDKIHHYMGCSTFSNFTVLPEIALAKVNPDAPFDKICYIGCGVTTGIGAVINTAKVEIGATAIVFGLGGIGLNVIQGLRLAGADMIIGVDLNNDKKPWGEKFGMTHFVNPKEVGDDIGPYLVNLTKRGADHIGGADYTFDCTGNTNVMRQALEASHRGWGKSVIIGVAGAGQKIATRPFQLVTGRTWMGTALGGARGRTDVPKIVDWYMEGKIAIDPMITHTMPLDDINKGFELMHSGESIRSVVLF

SEQ ID NO: 62825 - protein, 255 aa, Methanosarcina mazei Go1
MGDVTTAFILTTCAGLSTGTGSLIAFLVPNLKFTWLSMLLGFAAGAMIYISFVDLLAESVGAVGFFQANAAFFLGMLGMGILDRVIEHIHTDTLPDRNTLSRSEENDLQKAGLLTAAGIAMHNFPEGIAVLAASLGSPYLGFSVALAIAIHNIPEGIAVSVPIYYASGDRKKAFAYSFFAGLTEPLGAVFAYFFLFRFLSPEMLFLMLAAVGGVMVFICFDELLPISIKYGNEHLTFLGVFSGMSVIALSLYLIH

SEQ ID NO: 62826 - protein, 330 aa, Pinus taeda
VAFNNITRLAFGKRFVNEEGKMDPQGVEFKEIVATGLKLGASLTMAEHIPYLRWMFPLEEGAFAKHGARRDNVTKAIMEEHTLARQTSGAKQHFVDALLTLQEKYDLSEDTIIGLLWDMITAGMDTTAITVEWAMAELVRNPRIQQKAQEEIDRVVGRDRVMNETDFPHLPYLQCITKEALRLHPPTPLMLPHKATQNVKIGGYDIPKGSNVHVNVWAIARDPAVWKDPLTFRPERFLEEDVDIKGHDYRLLPFGAGRRICPGAQLGINLVQSMLGHLLHHFVWAPPEGMQAEDIDLTENPGLVTFMAKPVQAIAIPRLPDHLYKRQPLN

SEQ ID NO: 62827 - protein, 409 aa, Zea mays
MSALGTLSGGAAGVSGLLRLRRRAAPAPAIAAPSHLPAGTVKCAAAVPDAAPIVWGRQLRPALLLPAALLPSLQPARRHTLQPPAAAAESAGEAKSVGFLEKYPALVTGFFFFMWYFLNVIFNILNKKIYNYFPYPYFVSLIHLVVGVVYCLISWSVGLPKRAPINGTLLKLLFPVALCHGIGHITSNVSFAAVAVSFAHTIKALEPFFSAAATQFILGQQVPFSLWLSLAPVVIGVSMASLTELSFNWTGFINAMISNISFTYRSIYSKKAMTDMDSTNVYAYISIIALIVCIPPALIFEGPKLMQHGFSDAIAKVGLTKFVSDLFLVGLFYHLYNQIATNTLERVAPLTHAVGNVLKRVFVIGFSIIVFGNKISTQTGIGTSIAIAGVAMYSYIKAKIEEEKRKKSA

SEQ ID NO: 62828 - protein, 234 aa, Bartonella henselae str. Houston-1
MNVQQLKKMAALKALEFVEDDMRLGIGSGSTVNEFIPLLGERVANGLRVTCVATSQYSEQLCHKFGVPISTLEKIPELDLDIDGADEIGPEMTLIKGGGGALLHEKIVASASRAMFVIADETKMVKTLGAFALPIEVNPFGIHATRIAIEKAADNLGLSGEITLRMNGDDPFKTDGGHFIFDAFWGRILQPKLLSEALLAIPGVVEHGLFLGLASRAIVAMADSQIKVLEPFDF

SEQ ID NO: 62829 - protein, 242 aa, Methanosarcina barkeri str. Fusaro
MIHIGQLDLEKKAAVVAVILEKSLEISRKAAKMGADLLEIRLDLLGIRDLETAAETIRKVKSETGLPVILTNRSITEGGKWEGKEADRIELLTNLISLKDGPDAVDIELSAGREARDQVIKAAKAHGKTVIVSSHDFSRTPAFQEMKTILEEAFLAGADIAKLAVMPQSRRDVLNLLRVALDAREAGNAVCTIAMGRLGKHTRVIAPFYGSVLTYAAVNSEVSAAPGQFQVDEVKKILELLE

SEQ ID NO: 62830 - protein, 280 aa, Methanosarcina barkeri str. Fusaro
MKQVFGVFGDPIAHSLSPAMHNAAFSALGMDCIYHAFRVKPEKLEKAILGAEAMGFGGLNLTVPLKETALKLDCIKPDPLAEKIGAVNTIVFGETGEIKGYNTDGLGAKQALQNSAVEMEGSKIVVTGAGGAARSIAFQLAADGAEITIVNRTEGRAIELAKDISAASLSGNVTGKGLSGLKNLLQDANILINTTTLGMHPNVDTAIATAEDLHPDLTVFDIVYNPLETRLLREAKASGAKTVSGVLMLVYQGAEAFKLWTGIEPPVELMKKTVLEALQV

SEQ ID NO: 62831 - protein, 214 aa, Brassica napus
MTSFSAFSEMMGSENESPALSGEYCPTLAASCPKKPAGRKKFRETRHPIYRGVRQRHSGKWVCEVREPNKKSRIWLGTFLTAEIAARAHDVAAIALRGKSACLNFADSAWRLRIPETTCPKDIQKAAAEAAVAFQAEINDTTADHGIDVEETIVEAIFTEENNDGFYMDEEESMFGMPALLASMAEGMLLPPPSVQFGHTYDFDGDADVSLWSY

SEQ ID NO: 62832 - protein, 495 aa, Escherichia coli
MNFHHLAYWQDKALSLAIENRLFINGEYTAAAENETFETVDPVTQAPLAKIARGKSVDIDRAMSAARGVFERGDWSLSSPAKRKAVLNKLADLMEAHAEELALLETLDTGKPIRHSLRDDIPGAARAIRWYAEAIDKVYGEVATTSSHELAMIVREPVGVIAAIVPWNFPLLLTCWKLGPALAAGNSVILKPSEKSPLSAIRLAGLAKEAGLPDGVLNVVTGFGHEAGQALSRHNDIDAIAFTGSTRTGKQLLKDAGDSNMKRVWLEAGGKSANIVFADCPDLQQAASATAAGIFYNQGQVCIAGTRLLLEERIADEFLALLKQQAQNWQPGHPLDPATTMGTLIDCAHADSVHSFIREGESKGQLLLDGRNAGLAAAIGPTIFVDVDPNASLSREEIFGPVLVVTRFTSEEQALQLANDSQYGLGAAVWTRDLSRAHRMSRRLKAGSVFVNNYNDGDMTVPFGGYKQSGNGRDKSLHALEKFTELKTIWISLEA

SEQ ID NO: 62833 - protein, 291 aa, Magnaporthe grisea
MATNVCRSRALASALRPVKPATVRPRTEAAVRLFSVSAARDVVVPKDAPNVRQAPRAPIGKIEVPIVNPADKYASKAENLHRYGQWLMSCLPKYVQQFSLWKDELTIYICPSGVIPVFNFLKYNTSAEFTTVSDITAVDFPTRDQRFEIVYNLLSVRHNARIRVKTYADEASPVPSICSIYDGANWYEREVYDMFGVFFVGHPDLRRIMTDYGFEGHPLRKDFPLTGYTEVRYDEEKKRIVTEPLELTQAFRNFEGGSSAWEQVGPGNDRTPESFKLPTPKPEEPKEEPKK

SEQ ID NO: 62834 - protein, 429 aa, Alkalilimnicola ehrlichei MLHE-1
MQRSHELFERARQHIVGGVNSPVRAFTGVGGEPPFIARAEGPYLYDEDGNRYVDYVCSWGPMVAGHAHPKVVRAVQAAAADGLSFGAPTEVEIRMAEKLKAMLPSLERVRMVNSGTEATMSALRLARGHTGREKIIKFRGCYHGHVDALLVQAGSGALTLGIPGSPGVPAAVVEQTITLPYNDAEAVRECFQRMGDEIAAVIVEPVAGNMNCVPPVPGFLEALRECCDDHGSVLIFDEVMTGFRVGVQCAQGRYGITPDLTCLGKVIGGGMPVGAFGGKAQIMADLAPEGPVYQAGTLSGNPVAMAAGLATLALVDDPATHRALEEATATLVDGLRERAEAAGVSVSLNQAGSMFGLFFTDQNPVTTFEQVQACDLEAFKVFFHAMLEEGVYMAPSAFEAGFLSTAHDTPAIEYTLAAAERAFARVARR

SEQ ID NO: 62835 - protein, 356 aa, Leptosphaeria maculans
MDIVLEVCDTFLFDPLYATLLPAQASSFTANATANATLSSIRQEPTAYALPHASWQYEPATKYFSIEPSKYAYMSSWPRDDWRRQALTLYLITWLFGVCVYYLFAGLSYLLVFDKATFNHPRYLKHQIKLEMKQANIAFPIMAIFTVPWFLAEVRGYSKLYDTTEKGPGRWYDYLQIPFFIAFTDLCIYWIHRGLHHPMVYKHIHKPHHKWIMPTPFASHAFHPIDGYAQGLPYYIFPFLFPLSKIASVAFFVFVNIWTVLIHDGEYAHNSPIINGAACHTMHHLYFNYNYGQFTTLWDRLGGSYRKPNDELFKRELKMCQDEWNKQAKAVDMMVEQVEGENDRSYQGEPESKKVQ

SEQ ID NO: 62836 - protein, 478 aa, Nicotiana tabacum
MAAVNGVGISWPSKLTQSQRPKLVFSPSPRRCTPSSSTIKMTASVDEKKKTFTLQKSEEAFSKAKELMPGGVNSPVRAFKSVGGQPIIIDSVKGSRMRDIDGNDYIDYVGSWGPAIIGHADDEVLAALAETMKKGTSFGAPCLLENTLAEMVISAVPSIEMVRFVNSGTEACMGVLRLARAFTGRPKIIKFEGCYHGHADPFLVKAGSGVATLGLPDSPGVPKAATTDTLTAPYNDISAVESLFKEHKGEVAAIILEPVVGNAGFIQPNPDFLAAIRKITKENDALLIFDEVMTGFRLAYGGAQEYFGITPDLTTLGKIIGGGLPVGAYGGRRDIMEMVAPAGPMYQAGTLSGNPLAMTAGIHTLKRLQGPGTYDYLDKITGELTQGILDAGKKTGHAMCGGYIRGMFGFFFVEGPVNNFSDAKKSDTEKFGRFYRGMLEEGVYFAPSQFEAGFTSLAHTSEDIQRTVAAAEKVLKQI

SEQ ID NO: 62837 - protein, 392 aa, Oryza sativa (japonica cultivar-group)
MALRRFAVAGRVLLHRVESLPPPRPPLAFLSSESRGHLVRRFSTPSSTPPHFMVQYLVSKCGLSPAAAAKAAPRFAHLDSASRPDAALAFLRSQGLTRAQVREVVSWKPELLLSDVDATLDPKFRAVRALGLGRADVARLFALYPPALTYGIHTNLLPRVLFWIDFLGSAKLLMKWLAKTWLLRYSVDALLRNLSTLRSLGVQQSRITTTVRMQPTLITQTPARFQKLVGRVEACGVPPSSGMYMWAFFALHNVSEGSFRAKKAAVVGAAGCTEEEFDAMFRRAPCLVFVPAALLRRKVEFLMAEAGCDATHIVTNPVLLTLSLGKRMAPRCRVVEALRSRGVGIGKKANLGSVMRYPEDKFVERFIVTVAFTLFDLRLLFGLCGPCGIRPF

SEQ ID NO: 62838 - protein, 463 aa, Bartonella henselae str. Houston-1
MGSFDFDLFVIGSGSGGVRAARLAGALGKRVAIAEEYRIGGTCVIRGCVPKKLYFYASQYAQEFSKSIGFGWKYADPIFNWEKLVAAKNKEISRLEGLYREGLQNSNVHIYESRAVFVDEHTLELSVTGERISAEKILIATGAKIVSNSAIKGSDLCLTSNEIFDLEKLPKSIVIVGGGYIGVEFANIFHGLGVKTTLLHRGDLILRNFDYDLRQLLNDAMVAKGISIIYEATVSQVQSTENCYNVVLTNGQTICADRVMLATGRVPNTTGLGLERAGVKVNEFGAVVVDEKMTTNVSHIWAVGDVTGHIQLTPVAIHDAMCFVKNAFENTSTTPDYDLITTAVFSQPEIGTVGLSEEDALHRYKRVEIYRTVFRPMRNVLSGSPEKMFMKLVVDGESRIVVGAHVLGENAGEIAQLIGISLKGKLTKDIFDKTMAVHPTMSEELVTMYKPSYVYENGEKLDN

SEQ ID NO: 62839 - protein, 201 aa, Gibberella zeae PH-1
MASKGKEAATSKDATPTNPRGIPYAPFVDKVEDYVTTRDDVEPTLRSFQEMISKYQFMEMNLQKRMGGLKEKIPDIQKTLDSVKFLKLRKDDDEAIETTFELNDTLYSKAKIPATEEVYIWLGANVMLSYPIDEAETLLSSKLSTAKTSLSNCEEDLDFLREQITTMEVAVARVYNWEVVQKRKDKAVEEEENKKVKSQGD

SEQ ID NO: 62840 - protein, 464 aa, Bartonella henselae str. Houston-1
MVTNELKRGMSKRQVIFLALGSAIGTGLFYGSAQAIKLAGPSVLIAYCIAGLAVFMVMRALGEMIIHNPLPGSFARYAANYISPLAGFLTGWTYVFEMILVGLADITAFATYMAFWYPDVAPWIWALSITLIITGINLAAVEVYGELEFWLSSIKIIAIIAIIILGIAIIFCGLGTSTISSAVSVDNLWKNGGIFPNGWFGFFACFSVVIFAFGGIEIIGMAVMEVQNPHQTISKAINSTPIRILLFYIMTLTILMALYPWNAIGLMESPFVSIFESLGISSAANILNVVVVTAAISAMNSGMYGAGRMIYGLSQESYALKKFQYLSKNGIPIFVILLIFIIFLLGVILNYFYHDRLFFLIAAMATFATVFVWVMILLSQIFMRLKMSKEMQCSLKFPIPFWPIGSIFSILFMVFIFILLWFFDDTRPILIVGASWISWLIICFYALKLFNFWKKKQYQSMNKD

SEQ ID NO: 62841 - protein, 294 aa, Helianthus tuberosus
MEQYEKVEKIGEGTYGVVYKARDKVTNETIALKKIRLEQEDEGVPSTAIREISLLKEMQHGNIVRLQDVVHSDKRLYLVFEYLDLDLKKHMDSCPEFSKDPRLVKTFLYQILRGIAYCHSHRVLHRDLKPQNLLIDRRTNALKLADFGLARAFGIPVRTFTHEVVTLWYRAPEILLGSRHYSTPVDVWSVGCIFAEMVNQRPLFPGDSEIDELFKIFRIMGTPNEETWPGVTSLPDFKSAFPKWSSKDLATVVPNLEKAGLDLLCKMLWLDPSKRITARTALEHEYFKDIGFVP

SEQ ID NO: 62842 - protein, 304 aa, Helianthus tuberosus
MEDKYEKLEKVGEGTYGKVYKAKDKNTGELVALKKTRLEMDEEGIPPTALREISLLQMLSTSIYIVRLLCVQHIQHKGKPILYLVFEYLDTDLKKFIDSHRKGPNPSPLPPSQIQSFLYQLLKGVAHCHGHGVLHRDLKPQNLLVDKEKGILKIADLGLGRAFTVPLKSYTHEIVTLWYRAPEVLLGSAHYSTGVDMWSVGCIFAEMSRRQALFPGDSEFQQLLHIFRLLGTPTEEVWPGVSSLKDWHVYPRWEAQNLARSVPSLGPEGVDLLSKMLKYDPADRISAKLAMDHPYFDSLDRSQF

SEQ ID NO: 62843 - protein, 1120 aa, Silicibacter sp. TM1040
MPKRTDIKSIMIIGAGPIVIGQACEFDYSGAQACKALREEGYRVILVNSNPATIMTDPGLADATYIEPITPEVVAKIIEKERPDALLPTMGGQTGLNTSLALEEMGVLEKFNVEMIGAKREAIEMAEDRKLFREAMDRLGLENPRATIVTAPKKDNGNADLEAGVALALEALEDIGLPAIIRPAFTLGGTGGGVAYNREDYIHYCRSGMDASPVNQILVDESLLGWKEYEMEVVRDKADNAIIVCSIENVDPMGVHTGDSITVAPALTLTDKEYQMMRTASIAVLREIGVETGGSNVQWAVNPADGRMVVIEMNPRVSRSSALASKATGFPIAKIAAKLAVGYTLDELDNDITKVTPASFEPTIDYVVTKIPKFAFEKFPGSEPYLTTAMKSVGEAMAIGRTIHESMQKALASMESGLTGFDEVEIPGVQAGLWESVGADDKAAVIKAISQQTPDRLRTIAQAMRHGLSDDEIQGVTKFDPWFLARIREIIDAEREIRKNGLPMREDKLRALKMLGFSDARLGLLTGRDEDNVRRARHNLGVKAVFKRIDTCAAEFEAQTPYMYSTYESPMMGEVECEARPSDRKKVVILGGGPNRIGQGIEFDYCCCHACFALTDAGYETIMVNCNPETVSTDYDTSDRLYFEPLTMEHVMEILRVEQENGTLHGVIVQFGGQTPLKLANALEAEGIPILGTTPDAIDLAEDRERFQALVNELGLKQPKNGIASTGEQALKIAEEIGFPLVIRPSYVLGGRAMEIVRDMDQLKRYINEAVVVSGDSPVLLDSYLSGAVELDVDAICDGKDVHVAGIMQHIEEAGVHSGDSACSLPPYSLDKEVIERIKEQSFALAKALNVVGLMNVQFAIKDNEIYLIEVNPRASRTVPFVAKATDSAIASIAARVMAGEPLSNFPQRAPYEPDAGYDVNTPMADPMTLADPDMPWFSVKEAVLPFARFPGVDTILGPEMRSTGEVMGWDRSFARAFLKAQMGAGMVLPSKGRAFISIKDEDKTEVMLDTARILIAQGFDLVATRGTQGWLAGHGVECAVVNKVYEGRPHVVDMLKDGEIQLVLNTTEGNQAVEDSKPMRSVALYDKIPYFTTAAGAHAAARAIQAQAEGEVEVKSLQG

SEQ ID NO: 62844 - protein, 445 aa, Debaryomyces hansenii CBS767
MVKQILLLGSGFVAKPTVDILSKTPDFKVTVACRTLSKAKELAGDVADAISLDVTDEKSLDAEVAKVDLVISLIPYTFHVNVVKSAIKNKKHVVTTSYINPQLRELEQQIKDAGITVMNEIGLDPGIDHLYAVKTIEEVHQKNGKIKSFLSYCGGLPSPENSDNPLGYKFSWSSRGVLLALRNFAKYWKDGKVVDVKSEDLMATAKPYFIYPGFAFVCYPNRDSTTYKELYSIPEAETVIRGTLRFQGFPEFVKVLVDLGFLKEDESPIFSKPTAWKDALAAQIGAKSSEEKDLVSKISEVGTFKSEEDKERILSGFKWLGLFSDKQTTPRGNPLDTLCATLEEKMQYEKGERDLVVLQHKFGIEWANGETEIRTSTLVDYGNPDGYSSMAKLVGVPCAVATQQILDGTLNIKGLLAPMSSDINDPIMKTLKDDYGIYLVEKTVG

SEQ ID NO: 62845 - protein, 119 aa, Zea mays
  misc_feature (44)..(44): Xaa can be any naturally occurring amino acid
RQSEILHAEQNDYKTADIYLVGAFEAWGSLDDPKAIFILKYILXCKIMANQTDYVTGIISPIAVLKYLGPNNHAMNADSYTYSNRSLKYFETALRDYKSHLYDDHIVHRHISSLYDTLL

SEQ ID NO: 62846 - protein, 365 aa, Arabidopsis thaliana
MLVKPSIISGLVRLTSHSPSSSSSVLRRQEFLVRTLCGSPIIRAMSSTSEADAESVLRTVTPSLDLKRHKGQAGKIAVIGGCREYTGAPYFAAISALKIGADLSHVFCTKDAAPVIKSYSPELIVHPVLEESYSISQLSEEDKREVQDKVLGEVGKWMERFDCLVIGPGLGRDPFLLECVSIIMLLAKKSNVPFVIDGDGLFLVTNSIDLVHSYPLAVLTPNVNEYKRLVQKVLNCEVDEQNAEDQLRSLAKQIGGVTILRKGKSDLISNGETVKSVSIYGSPRRCGGQGDILSGGVAVFLSWAQQLKSDPESPSENPAILGCIAASGLLRKAASLAFTKHKRSTLTSDIIECLGESLEDICPAS

SEQ ID NO: 62847 - protein, 202 aa, Zea mays
VGEVVVSPPYVFLPVVKSQLRQEFQVAAQNCWVKKGGAFTGEISAEMLVNLGVPWVILGHSERRALLGESNEGLKVIACVGETLEEREAGSTMDVVAAQTKAIAEKIKDWSNVVLAYEPVWAIGTGKVATPAQAQEVHASLRDWVKINVSPEVSESTRIIYGGSVTAANCKELAAQPDVDGFLVGGASLKPEFIDIINAAAV

SEQ ID NO: 62848 - protein, 195 aa, Xanthomonas oryzae pv. oryzae KACC10331
MMDTATHATPASASPLAIVVMGVSGSGKTTIAQALAAHYGFRFLDADDYHSVAARAQMAAGQPLTDAMRLPWVELLSATLRDCVQAGESVVLAFSGLRSAHRQLLRNSGVPMRFVFLHAGPHVIAARLSARAGHFMPPMLLDSQIQTLELPLDEADVVSVEVDASVAAVVQDAIAQLATIDPAALQHASRASERV

SEQ ID NO: 62849 - protein, 386 aa, Candida dubliniensis
MDIVLEICDYYLFDKVYADVFPKDGPVHEYLKPAIQSFSEINFPKLQNWDSFDTNSTLISSNNFNISNVNPATIPGYLLSKIASYQDKSEIYGLAPKFFPATEFIDTSFLSRSNIFREVLSLFIITTLFGWLLYFIVAYLSYVFVFDKKIFNHPRYLKNQMSLEIKRATSAIPVMVLLTIPFFLLELHGYSFLYEEINESTGGYKAILWQIPKFILFTDCGIYFLHRWLHWPSVYKALHKPHHKWIVCTPFASHAFHPVDGFFQSLPYHLYPLLFPLHKVLYLLLFTFVNFWTVMIHDGSYWSNDPVVNGTACHTVHHLYFNYNYGQFTTLWDRLGNSYRRPDDSLFVKDQKKEEEKKIWKEQTRQMEEIRGEVEGKVDDREYIDQ

SEQ ID NO: 62850 - protein, 323 aa, Zea mays
MAAGRELVVSFGEMLIDFVPTVAGVSLAEAPAFLKAPGGAPANVAIAVSRLGGGAAFVGKLGDDEFGRMLAAILRDNGVDDGGVVFDSGARTALAFVTLRADGEREFMFYRNPSADMLLTADELNVELIKRAAVFHYGSISLIAEPCRTAHLRAMEIAKEAGALLSYDPNLREALWPSREEARTQILSIWDQADIVKVSEVELEFLTGIDSVEDDVVMKLWRPTMKLLLVTLGDQGCKYYARDFHGAVPSFKVQQVDTTGAGDAFVGALLQRIVKDPSSLQDEKKLVESIKFANACGAITTTKKGAIPSLPTEAEVLQLIEKA

SEQ ID NO: 62851 - protein, 849 aa, Arabidopsis thaliana
MSKLRKKYLEHLLCVLIFFTYVIGYGEAQSKSFLVDCGSNATTEVDGRTWVGDLSPNKSVTLQGFDAITASTSKGSSVYAEIYKTARVFDAVLNYTFEGITQGNYFVRLHFSPFAIENHNVNESSFSVFADGLRLMLDINIAGEIAHKNLILESTGHNATASSLVKEFLLPTGPGKLVLSFIPEKGSFGFVNAIEIVSVDDKLFKESVTKVGGSEVELGLGGRGIETMYRLNVGGPKLGPSKDLKLYRTWETDLSYMVIENAGVEVKNSSNITYALADDSPVAPLLVYETARMMSNTEVLEKRFNISWKFEVDPNFDYLVRLHFCELLVDKQNQRIFRIYINNQTAAGNFDIFAHAGGKNKGIYQDYLDPVSSKNDVLWIQLGPDSSVGASGDALLSGLEIFKLSKNGNLAHLIRFDSTGHSVSDSKMRIIWISVGAGIAIIIFFVFLGILVVCLCKKRRSKSDESKNNPPGWRPLFLHVNNSTANAKATGGSLRLNTLAASTMGRKFTLAEIRAATKNFDDGLAIGVGGFGKVYRGELEDGTLIAIKRATPHSQQGLAEFETEIVMLSRLRHRHLVSLIGFCDEHNEMILVYEYMANGTLRSHLFGSNLPPLSWKQRLEACIGSARGLHYLHTGSERGIIHRDVKTTNILLDENFVAKMSDFGLSKAGPSMDHTHVSTAVKGSFGYLDPEYFRRQQLTEKSDVYSFGVVLFEAVCARAVINPTLPKDQINLAEWALSWQKQRNLESIIDSNLRGNYSPESLEKYGEIAEKCLADEGKNRPMMGEVLWSLEYVLQIHEAWLRKQNGENSFSSSQAVEEAPESFTLPACSNQDSSETEQSQTGSALHNSA

SEQ ID NO: 62852 - protein, 352 aa, Coprinopsis cinerea okayama7#130
MGGVDTVFSIELDPSQALRHPLGEVPPIVKEQSLERLTVEIGLAQRHTVAGPHITYLNPRIHDDVDAMIAEAQRRYKLLRLGGLSGDEVLLTIPSSEAGIQAARTLQKANINVNLYPVCTLMHAAACVEAGAAAITVNVGQVLGWFERGKGARAYPDAFAHPGVKSIQSILTYFRINDIKTRLIGQNFRKMAEIALLADFDAVAVSEYQLDRLQWNIARIAPPEEVPKEVLEKARQAKYPAGLLTDDGNFLKKLDHDSQNLIRSTLDPELERSSKAMDKIEDAVFREVKNHWARLNELNPNTRPHGVRSDEEGDRRVSGVAKHKSAAAQNAWILDWRDKVDAELQLHDLEAF

SEQ ID NO: 62853 - protein, 726 aa, Triticum aestivum
MGNPGAFHHSITLQSFTVFSLVAVFVADHHVQGGDDGCSLFSCGHLRDISYPFRRRGDPRECGVEAYELGCTSSKATIHINTGTYYVTAINYTGSYFWVMDPNFNTSSSCPLPLWNHLPYFGSGDHSTTDSASPVFHYLATQSYNRACFANCSRAVTNKSAYKPVACLSAKNSHVYVWVSDFLCMVDDLEPYCGYLAEIPSDSGQLQNASYADITQFISKGFTVQFPVGTRYSYRPSASVKLRKNINLCRNNSISYFKEQASCASIVNWTHAFLWSEVHFLECVTQNSYDHYYTTKLVLIVATIVSAIVIPKFFFVLCRFLLAPVAVWIFVAYKYWKTRIIIDAVEKFLRIQQMIGPTRYAYTDIVAVTSHFRDKLGQGGYGSVYKGVLLPGDVHVAVKMLEGNTNCNGEDFISEVSTIGRIHHVNVVRLVGFCSEEMRRAIVYEYMPHGSLDKYIFSPEKSFSWDKLNQIALGIARGINYLHQGCDMQILHFDIKPHNILLDSNFVPKVADFGLAKLYPRGDSFVPLSAMRGTVGYIAPEMISRSFGVISSKSDVYSFGMLLLEMAGGRRNADPNMGSSSQAYYPSWVYDQLTQEEAGEEISPVAADMHELEKKLCVVGLWCIQMRSHDRPMMSEVIEILEAGVDGLQMPSRPFFCDEGHIHVEDSYHFTSELMSMPAHSSFSSLLLGNRHVTEMYLYICLQEPDPSYLSWIQSRTKLIFNSSNN

SEQ ID NO: 62854 - protein, 246 aa, Triticum aestivum
  misc_feature (137)..(137): Xaa can be any naturally occurring amino acid
VEHLSMYLDVADSANLPYGWSRSAQFSLSVVNQIDQKYTTRKDTQHQFSARESDWGFTSFMPLSELYDPSRGYLVNDTIVVEAEVAVRKMVDYWTYDSKKETGYVGLKNQGATCYMNSLLQTLYHIPYFRKAVYHMXPTTENDMPSGSIPLALQSLFYKLQYSDNSVATKELTKSFGWDTYDSFMQHDVQELNRVLCEKLEDKMKGTVVEGTIEQLFEGHHINYIECINVDYKSNRKESFYDLQLD

SEQ ID NO: 62855 - protein, 523 aa, Nicotiana tabacum
MAGGGGIGPGNGKEYPGNLTLYVTVTCIVAAMGGLIFGYDIGISGGVTSMDSFLSRFFPSVFRKQKADDSTNQYCKFDSQTLTMFTSSLYLAALLSSLVASTVTRKLGRRLSMLCGGVLFCAGALINGFAQNVAMLIVGRILLGFGIGFANQSVPLYLSEMAPYKYRGALNLGFQLSITIGILVANVLNYFFAKIHWGWRLSLGGAMVPALIITIGSLFLPETPNSMIERGNHDEAKARLKRIRGIDDVDEEFNDLVVASEASRKIENPWRNLLQRKYRPHLTMAIMIPFFQQLTGINVIMFYAPVLFKTIGFGADASLMSAVITGGVNVLATVVSIYYVDKLGRRFLFLEGGIQMLICQIAVSICIAIKFGVNGTPGDLPKWYAIVVVIFICVYVAGFAWSWGPLGWLVPSEIFPLEIRSAAQSINVSVNMIFTFIVAQVFLTMLCHLKFGLFLFFAFFVVIMTVFIYFFLPETKNIPIEEMVIVWKEHWFWSKFMTEVDYPGTRNGTSVEMSKGSAGYKIV

SEQ ID NO: 62856 - protein, 264 aa, Triticum aestivum
LGSPVLTLTPELPLNPSRPRRRRPPQPSTPSPLRTPYASAAMDAATDGEQRRLLSIPKEGERVIAPTRRPDGTLRKEIRIRAGYVPQDEVAIYQSKGALMKKSGPDVTPGYDPALDAKPKTKAAKRNERRKEKRHQGGSTNDKGKSLDIEEADAGEPDKVHSSKTKQKNTVDSITEQISGIAISESPATATPSTNAANNLQTESSVTEIDKKIRALKKKIRLAETQVQGDPEKLKPEQLEKTKKIEGWREELKLLESTRGHAAS

SEQ ID NO: 62857 - protein, 582 aa, Zea mays
MGKSPAKWIKSVLFGKRSSSRSGSTKAKDLSKGTTNKAAAAAAAAAGKEPAFSESSPVISEPVLVSAHNNETAREAAKGENSSVQEVPVTDVSQDLEKQGTVGSDTSNDAERLREEQAAVKAQAAFRGYLARRAFRALKGIIRLQALIRGHLVRRQAVSTLRATWLIVKFQALVRGRNVRLSNVSIQATTELSQQNFGGSKPGSWKEKLSSNAFARKLLSSPIVVEALHVQYDEMDPNSAFNWLERWTVSHVWKPISQPKRVGTDAKPHTRKASYAMETESAKLKRNARKSPAVPFEPSQTNTTIENEKTRRNPRKLSSTPAESVPDGQLTELEKVKRSLRKVTSSTVETSKVPSPTTEIPDRQEVQCERPLRSAKQAPIHVENQEPQNVNLSENAKMDILVPDIQPDVEVASDLVTITNEEKVDETPSVVAPATEIMPLQDINSEENALVNDVEERSKEEHPSTDNLKGSKRRSSFSVKPEYPENGSKNSPALPSYMAATQSAKAKLRGNSSPRLSSDSAEKNGFTRRHSLPSPNNGKIISHSPRTQRPTHAGGKDGAKGDKAMLSSRDASERPLKAEWRR

SEQ ID NO: 62858 - protein, 340 aa, Trichodesmium erythraeum IMS101
MRIGINGFGRIGRLALRAAWEWPELEFVHINEIKGGTAAAAHLLKFDSVHGKWSLDVEAAGEQVIIDGKPLSFSEYSEPGEVPWEKLGVDIVLECSGKFRTKSTLEPYFQNGVKKVIVAAPVKEEALNVVMGVNDNLYDPEKHHLLTAASCTTNCLAPVVKVIHEGLGIKHGVITTIHDNTNTQIIVDAPHKDLRRARATSLSLIPTTTGSATAIGLIYPELNGKLNGLAVRVPLLNASLTDCVFEVVRPTTVVEINSLLKTASETPPLKGILGYEERPLVSIDYKDDPRSSIIDALSTMVVDETQVKILAWYDNEWGYANRMVELARKVVVSWKSGLSF

SEQ ID NO: 62859 - protein, 1275 aa, Colwellia psychrerythraea 34H
MLFTGSLITDCPIRQKIREFYRIDENVAVDHILPAAEVNVSARSRAWERARKMVLKIRQDQEGNGAIDSLLNEYSLSSEEGVVLMCLAEALLRVPDKHTQDELIRDKISQGQWSSHLGASDSLFVNASSWGLLLTGSMVNYADKRKKEQFGLLKKTVGRLGEPVIRKSMNYAMKVMGKQFVMGETIKAATERAATKEQQGYVYSYDMLGEGARTMADANMYLKAYQDAINAIGEVAVASGKNDPRKVPGISIKLSAIHPRYEFSHKERVMTEIVPKLKALCLQAKQYNIGLTVDAEESERLDISLDIIEAVFSDSELGDWQGFGIALQAYQKRAIHVVDWLRDLTLRTERKMMVRLVKGAYWDTEIKNAQKDGLNHFPVFTRKSSTDVSYHACANKLLEYRDTIYPQFATHNAYTAATIVELAGDDKAGFEFQCLHGMGDSLYDQIVKEESIQCRIYAPVGHHEDLLAYLVRRLLENGANSSFVNAIVDEDQPVESLLEDPVEKTQRLKAKYNNQIIMPIDLYRGEGEKGRDNSKGLDLTDINEIIPLKAALDNWFVDHLLNKNEVPDGANAVMNPANRSEIIGFHQHASHGDMLLMIDKAETAFSTWSKTPAVDRAALLCRIGDILERHIDELIAMCIKEAGKVAQDGIDEVREAVDFCRYYAARAIELSSDERLEARGVVLCISPWNFPLAIFLGQVAAAIATGNTVLAKPAEQTGLIALRAIELMKSVGLPENVVQAVIARGSAVGNTIIPDSRIQTVMFTGSTETGTRISQTLSDRGGDQVPLIAETGGQNCMIVDSTALPEQVVDDVISSGFQSAGQRCSALRVLFLQEDIADNVITMLQGALAELHIGNPAKLSTDIGPVIDQKALDALNAHAEYMKSHGKLLYQCEFSEDVVDEDGHFFFAPRLYEIDDISVLKQEVFGPCVHIVRFKGNEIESVVDKINGTGFGLTMGIHTRIEHRAINLAKLSRAGNIYINRNMIGAIVGVQPFGGRGLSGTGPKAGGPNYLTRLVKEKATPDERDFNFSANKTITLSGDAAENHQANHLMDKANWAEKEWRSTELNTRISCVRQLLAKIAHVEIVDDLAEDLNHTLVLARSQLIDIEKRLKKPQQLPGPTGESNIIYLENRGNIICYADENVSFHFWVQSIVTSLATGNTVIAVVSDLFYQEALEFRDKFVATGAGKDVFQVAKQCHLEAMLAHPALSGVVVDSGCEIKHYISEKLALRHGAILPVITSEYFDTMIQRLVTEKTISIDTTASGGNTSLMTLVEED

SEQ ID NO: 62860 - protein, 348 aa, Triticum aestivum
GSRPDPRVQAPVAASGGDDGPPRYLRPEAAAEAVTGDADGEAQIPIIDHRRLLLELDHGGEESARLHRACQDWGFFQLVNHSVPDDVGESGKANIQQFFQLPAETKKRFAQEQGQLEGYGQLFVVSDDQKLDWADMLFLYAQPPERRKTRFWPDQPATFRSTLDRYSGALKDVSDSLLATMAKNLGLKRETIAEKCTRGMQSFRMNYYPPCAQAEKVIGLSPHSDANLLTLVLQVNHVQGLQIKRNGSWLPVKPVPGAFIVNIGDMLEVFTNGRYRSIEHRAVVDPKEERLSVAAFHFPDMDAMIGPLEELTAHEDDAYKTLDLESFMKIFFATKLEGKSFLDRMKLN

SEQ ID NO: 62861 - protein, 343 aa, Corynebacterium glutamicum ATCC 13032
MRIATLTSGGDCPGLNAVIRGIVRTASNEFGSTVVGYQDGWEGLLGDRRVQLYDDEDIDRILLRGGTILGTGRLHPDKFKAGIDQIKANLEDAGIDALIPIGGEGTLKGAKWLSDNGIPVVGVPKTIDNDVNGTDFTFGFDTAVAVATDAVDRLHTTAESHNRVMIVEVMGRHVGWIALHAGMAGGAHYTVIPEVPFDIAEICKAMERRFQMGEKYGIIVVAEGALPREGTMELREGHIDQFGHKTFTGIGQQIADEIHVRLGHDVRTTVLGHIQRGGTPTAFDRVLATRYGVRAARACHEGSFDKVVALKGESIEMITFEEAVGTLKEVPFERWVTAQAMFG

SEQ ID NO: 62862 - protein, 668 aa, Pasteurella multocida subsp. multocida str. Pm70
MATRRELANAIRFLSMDAVQKAKSGHPGAPMGMADIAEVLWRDFLKHNPSNPHWADRDRFILSNGHGSMLIYSLLHLSGYDLSIEDLKQFRQLHSKTPGHPEYGYAPGVETTTGPLGQGITNAVGFAIAEKTLAHQFNRPGHEIVDHHTYVFLGDGCLMEGISHEACSLAGTLGLGKLIAFYDDNNISIDGHVDGWFTDDTQKRFEAYGWHVIPAVDGHNPEQILEAVKQAQAETTKPTLIICKTIIGYGSPNKANSHDCHGAPLGDDEIAAAREFLKWEHAPFEIPAEIYAQWDAKEKGQVAEKAWEEKLAAYAKAYPELAAEFTRRVNAELPANWAAESQAFIEHLQANPANIASRKASQNAIEAYAKLLPEFLGGSADLASSNLTLWSGSKPIRAVENADGNYINYGVREFGMSAIMNGIALHGGFIPYGATFLMFMEYAHNAVRMAALMKQRSLFVYTHDSIGLGEDGPTHQPVEQTSALRLIPNLETWRPCDQVESAVAWKAAVERKEGPSALIFTRQNLAQMDRTAEQLANVARGGYVLRHCCENQNCPDLILIATGSEVELAMKAADVLDAEGVKVRVVSMPSTNVFDKQDAAYRESVLPSHITKRVAIEAGIADFWYKYVGFEGRVVGMNSFGESAPADQLFKLFGFTVENVVAKAKEIL

SEQ ID NO: 62863 - protein, 316 aa, Pasteurella multocida subsp. multocida str. Pm70
MTQLDSLRSMTVVVADTGDIEAIKQYQPQDATTNPSLILSASALPQYAPLIDDAIAYAKTKSDCPRQQLVDAEDKLAVNIGLEILKIIPGRISTEVDARLSYDTQATIEKARKLIKLYNEAGIENHRILIKIASTWQGIRAAEVLEKEGINCNLTLLFSEAQARACAEAGVYLISPFVGRILDWHKANTGRQDYPAAEDPGVISVTQIYNYYKQHNYKTVVMGASFRNVDEIIELAGCDRLTISPTLLSHLQAREGELVRKLAFSGELKDRPQPLTESEFYWQHNSDPMAVAKLAEGICKFAEDQEKLEKMLLERL

SEQ ID NO: 62864 - protein, 178 aa, Triticum aestivum
AYLGDTIEQVCTKKQAGTGPEFPGYRRPTRPVKPSTSVDEALERLVEHRITGFPVTDDHWNLVGVVSDYDLLALDLISGNGQAEADIFPEVDSTWKTFHQIQKLLSKTNGKVVSDVMTSAPLVVRETTNLEDAARLLLVTKYRRLPVVDSSGKLVGIITRGNVVRAALEFKKNVEGSL

SEQ ID NO: 62865 - protein, 72 aa, Glycine max
SGRGKGFLGLGKGPAQRHRKVLFDNIQCITKPAILRLARRGGVNTITGLIYYETRGVLKIFLENVIHDAVTY

SEQ ID NO: 62866 - protein, 730 aa, Magnaporthe grisea 70-15
MASSEQSSTALSSQRKPLDLPQLKSEEDHDVVLKTIRMLVADLCQQFGGGHPGGAIGMAAIGVALWKYVMRYSPEEPEYFNRDRFVLSNVGASVKLTLGLSTGHTCLFQYVFLHLSGYKAMTFDQLKSYHSKRTDALCPGHPEIEHEGVEVTTGPLGQGVANAVGLAMATKNLASTYNRPGFPVVDNHTWCMIGDACLQEGVALEAISLAGHLALDNLTIIYDNNQITCDGSVDLTNTEDVNAKMRACGWHTVDVEDGCFDIGGIVRALAEARQAAHGKPTFINVRTVIGLGSAVAGKAEAHGAAFGAADVANMKRSVGFDLEQHFVIGDKVRDFFADIPKRGHNLVADWKGLVSKYAEAHPEVASEFDRRTKGELPENWRELIPKSFSDKPTATRASSGLVLNPIAKDVKSFMVGTADLTPSVHMTWDGMEDFQNPNIRPTCGINGSYTGRYIHYGVREHAMCAISNGLAAFNPGTFVPVTSSFFMFYLYAAPAVRMGALQKLQVIHAATHDSIGMGEDGPTHQPIELATLFRAMPNLLYMRPADSEETAGAWEVAIAERTRPSIVSTSRHKLPQLVGKSSRKGVAKGAYVVSEPADGKADVTILGVGAELCLALDVAEALAGKNIKVRVVSFPCWRLFDEQPVAYRRETLRRHEGIPAVVVEPYAPNGWERYADAGVCLRRFGHSLPGPEAYKYFEYETPKVTEKIEGYLKGLETGEWLRGEFADLQI

SEQ ID NO: 62867 - protein, 644 aa, Cryptococcus gattii
MAFSPSLTPSRPAPVPPRRAAGTAHHMIGVTDTAAAPQSNFSSTSYSPSFSYTNSSIQSTKIADTRRSRTIRSGAASIKEEGLRAFMWSKRWLVLGSAELRIYKNESSSSPVYTVSLEDIQDVQRVDLKPYCVEIETSDKLLYFAFRSDNEVYGWMDDINSRTPRLGVSQPTNFVHQVHVGCDPKSGGFTGLPPQWSKLLTSSAITEEEAARNPEAVLDVLQFYTQQQASDVLEGYQKFPLPSVSNQYLTTGAAATRFEGVGLGGQQQQQQQRLRSAPFAATGSLVTTVVSGPRSFDTETKTLAQKEKEIVLNPQRQPLDSVTRPSVGKNDKEKVMRSPGPTVEKRISTMNEVQIMEKLRSVVSAKDPSQLYSKIRKVGQGASGMVFVAKTLSNGKKVAIKQMDLSQQPRKELIVNEIIVMRESQHPNVVNFLDAFLVRGSELWVVMEYMEGGALTDVIENNKLEENQIAAICLETCRGLQHLHSRSIIHRDIKSDNLLMNTQGEVKITDFGFCAKLTDQKSKRATMVGTPYWMAPEVVKQKEYGAKVDIWSLGIMAIEMIENEPPYLDEEPLKALYLITTNGTPTLKSPEKLSQDLKHFLSVCLCVDVAFRATSTELLKHEFLQLACSVQDLAPLLRFKQDTL

SEQ ID NO: 62868 - protein, 186 aa, Solanum chmielewskii
FFSLIPKAKTAKIVNKGIVDAVAKIPGTSDLQITLCKDIVQWARSEKRTFLRQRVEAKLAALLMENKEYSEALTLLSGLIKEVRRLDDKLLLVEIDLLESQLHFSLRNLPKAKAALTAARTAANAIYVPPAQQGAIDLQSGILHAEEKDYKTAYSYFYEAFEAFNALENPQALYSLKYMLLCKIMV

SEQ ID NO: 62869 - protein, 213 aa, Solanum pimpinellifolium
IFNLSDLLSQEKRAEDLQKLLVQLRPFFSLIPKAKTAKIVNKGIVDAVAKIPGTSDLQITLCKDIVQWARSEKRTFLRQRVEAKLAALLMENKEYSEALTLLSGLIKEVRRLDDKLLLVEIDLLESQLHFSLRNLPKAKAALTAARTAANAIYVPPAQQGAIDLQSGILHAEEKDYKTAYSYFYEAFEAFNALENPQALYSLKYMLLCKIMVS

SEQ ID NO: 62870 - protein, 203 aa, Pichia angusta
MNNEYDYLFKLLLIGDSGVGKSCLLLRFAEDTYTQDYISTIGVDFKIRTIELDGKTIKLQIWDTAGQERFRTITSSYYRGAHGIIIVYDVTDQESFNNVNQWLQEIDRYATSGVMKLLVGNKCDLTDKKVVDYAVAKEFADSRGIKFLETSASQSTNVEQAFIVMSKQIKSQMANSQPASNTAGKPSVNLSGTSVINQQGGCC

SEQ ID NO: 62871 - protein, 213 aa, Solanum lycopersicum
AIFNLSDLLSQEKRAEDLQKLLVQLRPFFSLIPKAKTAKIVNKGIVDAVAKIPGTSDLQITLCKDIVQWARSEKRTFLRQRVEAKLAALLMENKEYSEALTLLSGLIKEVRRLDDKLLLVEIDLLESQLHFSLRNLPKAKAALTAARTAANAIYVPPAQQGAIDLQSGILHAEEKDYKTAYSYFYEAFEAFNALENPQALYSLKYMLLCKIMV

SEQ ID NO: 62872 - protein, 583 aa, Nicotiana tabacum
SIKFLAPSLPNPARFSKNAVKLHATPPSVAAPPAGAPEVAAERLEPRVEEKDGYWILKEQFRKGINPQEKVKIEKQPMKLFMENGIEELAKIPIEEIDQSKLTKDDIDVRLKWLGLFHRRKNQYGRFMMRLKLPNGVTTSAQTRYLASVIRKYGKEGCADITTRQNWQIRGVVLPDVPEILKGLAEVGLTSLQSGMDNVRNPVGNPLAGIDPEEIVDTGPYTNLLSQFITGNSRGNPAVSNLPRKWNPCVVGSHDLYEHPHINDLAYMPATKDGRFGFNLLVGGFFSAKRCDEAIPLDAWVPADDVVPVCKAILEAFRDLGFRGNRQKCRMMWLIDELGVEGFRAEVEKRMPQQELERASPEDLVQKQWERRDYLGVHPQKQEGYSFIGLHIPVGRVQADDMDELARLADEYGSGEIRLTVEQNIIIPNIENSKIEALLKEPVLSTFSPDPPILMKGLVACTGNQFCGQAIIETKARSLMITEEVQRQVSLTRPVRMHWTGCPNTCAQVQVADIGFMGCLTRDKNGKTVEGADVFLGGRIGSDSHLGEVYKKAVPCDDLVPLVVDLLVNNFGAVPREREETED

SEQ ID NO: 62873 - protein, 153 aa, Brassica napus
MAAYHQPYDPYYVYNPLPQPLQHFADEPGAINTLFVSGLPDDVKAREIHNLFRRRPGFESCQLKYTGRGDQVVAFATFSSHGFAMAAMNELNGVKFDPQTGSTLHIEVARSNSRRKDRPGSGPYVVIDNRNKETSDDQSDEGESDPYEAQEPG

SEQ ID NO: 62874 - protein, 343 aa, Thuja occidentalis
MVSQKENKKRYALALLIVVSILINHADGETIGVCYGMLVDSMPSKSDVVNLLKSRNIGKARLYEANRDALEALKGSGIEVIVGVGNTELQKIAGDQAAANGWVNDNIVPFASSVTIKYIAVGNEVYANKELINYLLPAMNNIQTAMRNANLQNIKVSTPHAASVLSNSFPPFSGKVLALIWAAILKFLSDNGSLFMGPSLSILQATLATRNSISLDYALFRSTNPIVNDGGRMYNNLFDAMVDSFIFAMEKLGYPKIPIVITESGWPSAGTDVATVDNAGTYNNNLIKHVFSSDGTPKRPGNTIETYIFALFNENMKSGSEEERHFGLFETNKNPVYPVNFSP

SEQ ID NO: 62875 - protein, 241 aa, Alkalilimnicola ehrlichei MLHE-1
MANVPLDTDLMEHLRGARRPVVLTGAGMSAESGVPTFREAQSGLWARFDPVELATPEAFERHPQRVLDWYAWRREQVAKARPHAGHQALARWEAACAALVIVTQNVDGLHQRAGSRNVVELHGRIDRDRCHHCGERAETPARVCAQCGGPLRPDVVWFGEMLPEPALRRALGAVSEADLVLSVGTSTLVQPAASLPAEALAAGVPVVEINPEPTPLKGRTLYRLRGKAAEWLPRLVAIACD

SEQ ID NO: 62876 - protein, 166 aa, Oryza sativa (japonica cultivar-group)
MGFVTAAADAVVALLSLTMAVAAPLFDAQVVLPRGLYPAPLVGIHRWFAAEFGHYLVADPPPFFRGLVWLDLAFLWPVCVANLYGILARRPWSAATSIMAGVYVLTYMSAIFGEMLGSGRTTPKLIQLYVPFALAAVTAVLRGFCSCSAQATAVASHAPTARKKRL

SEQ ID NO: 62877 - protein, 500 aa, Brassica napus
MGRKMLADGELDKAVAAEEATEAHYDFDLFVIGAGSGGVRAARFSANNGAKVGICELPFHPISSEEIGGVGGTCVIRGCVPKKILVYGATYGGELEDARNYGWEINENVDFTWKKLLQKKTDEILRLNNIYKRLLANAAVKLYEGEGRIVGPNEVEVRQIDGTKISYTAKHILIATGSRAQKPNIPGHELAITSDEALSLEEFPKRAVVLGGGYIAVEFASIWRGMGGTVDLFFRKELPLRGFDDEMRALVARNLEGRGVNLHPQTSLTQLTKTDEGIKVISSHGEEFMADVVLFATGRNPNTKRLNLEAVGVELDQAGAVKVDEYSRTNIPSIWAVGDATNRINLTPVALMEATCFANTVFGGKPTKADYSNVACAVFCIPPLAVVGLSEEEAVEKATGDILVFTSGFNPMKNTISGRQEKSLMKLIVDEQTDKVIGASMCGPDAAEIMQGIAIALKCGATKAQFDSTVGIHPSSAEEFVTMRTVTRRIAYKAKPKTSL

SEQ ID NO: 62878 - protein, 115 aa, Debaryomyces hansenii CBS767
MSDDHMEIDSHLENEQQIESKAKSSKQKFEVKKWTAVAFWSWDIIVETCAICRNHLMEPCIECQPNTLNNSNEECIAAWGMCNHAFHMHCIARWLKSRNVCPLDNREWSYQKFGN

SEQ ID NO: 62879 - protein, 411 aa, Zea mays
CRQWLRSIKKHAFVASPYPVIITLEDHLPSQLQEKVAKMVVEVFGNILYYPPDDTHELKELPSPEQLKGRVLLSTKPPKEYLETKLSDSTKEGDADLHLGKGTGDDAVWGKEVPDFRTEIQSAEKDDENDDVDDEEEQKLQPHIAPQYKHLITIRAGKPKDSLADALKSDPEKVRRLSLSEQQLAKAAKDHATEIVRFTQRNILRIYPKGTRVTSSNYNPFVGWVHGAQMVAFNMQGYGRALWLMHGFYKANGGCGYVKKPDFLMQTEPQVFDPREPQPVKKTLKVKVYMGDGWRMDFKQTHFDQYSPPDFYTRVGIAGVPADSVMKKTNAIEDNWTPVWEKEFSFPLTVPELALLRVEVHEYDMSEKDDFGGQTVLPVSELRPGIRAVALFDRKGMKYNHVKLLMRFEFA

SEQ ID NO: 62880 - protein, 211 aa, Solanum chilense
NLHLSDLLSQEKRAEDLQKLLVQLRPFFSLIPKAKTAKIVNKGIVDAVAKIPGTSDLQITLCKDIVQWARSEKRTFLRQRVEAKLAALLMENKEYSEALTLLSGLIKEVRRLDDKLLLVEIDLLESQLHFSLRNLPKAKAALTAARTAANAIYVPPAQQGAIDLQSGILHAEEKDYKTAYSYFYEAFEAFNALENPQALYSLKYMLLCKIM

SEQ ID NO: 62881 - protein, 322 aa, Alkalilimnicola ehrlichei MLHE-1
MDIDAIRNLAADDMAAVNRLIQERLSSEVVLIDQMGHYIVNSGGKRLRPLLVLLAARAAGYRGEHHIKLAAVVEFIHTATLLHDDVVDESTLRRGQDTANSIWGNEAAVLVGDFLYTRAFEMMVEVGLLPIMQVMARTTNTIAEGEVMQLLNCHDPDVSEARYRDVIYRKTASLFEAACCLGGTIAGLPQAQTDHLAAYGLHLGTAYQLVDDALDYAGKAEEIGKNIGDDLAEGKPTMPLIYAMARGSAEERQVIREAISEGGISRIAAVQQAIENTGAIPYTQRLARDEAEEAVNRLAHLPDSEWKQALEALARFSVARTF

SEQ ID NO: 62882 - protein, 371 aa, Magnaporthe grisea 70-15
MAHLPNPSLQVTADHQLKQVEASILSPGPGEVLLHVKCTGVCGSDVHFWKTGAIGTLVVEGDCILGHEAAGIVLSTGQDVTTLKPGDRVAIEPGVPCNKCFLCSEGRYNLCQEVQFAGVWPYHGTLQRYKVHPARWLHKLPDSLSYAEGALLEPLSVVLHGIRVAGLSLGRGAVICGAGPIGLIALAAARASGAHPIVITDVEPRRLEFAREFVPSCQTYRVDPTQSPEENARGIRALFGLKGGAVPDPDEYSAPPVVLECTGVESSVCTAAFTARRGGIVVVIGVGKSTMNNLPFMHLSLAEIDLRFINRYRDTWPAGIACLESGILPDLKKLVTHVFPLEKAIEGLTLASDPRNGSIKVQIVDEVDISP

SEQ ID NO: 62883 - protein, 210 aa, Solanum peruvianum
LSDLLSQEKRAEDLQKLLVQLRPFFSLIPKAKTAKIVNKGIVDAVAKIPGTSDLQITLCKDIVQWARSEKRTFLRQRVEAKLAALLMENKEYSEALTLLSGLIKEVRRLDDKLLLVEIDLLESQLHFSLRNLPKAKAALTAARTAANAIYVPPAQQGAIDLQSGILHAEEKDYKTAYSYFYEAFEAFNALENPQALYSLKYMLLCKIMVS

SEQ ID NO: 62884 - protein, 310 aa, Oryza sativa (japonica cultivar-group)
MAPSRPLMRGIRPPRVFPTRGGRTSPLALALAALLLASALLLALIAFGVFSLPVSAPNAATTDSAAAGGDAEPADPRPPRTRARRDLSEGLGERGAQWTEVISWEPRAFVYHNFLSKEECDYLIGLAKPHMVKSTVVDSTTGKSKDSRVRTSSGMFLQRGRDKVIRAIEKRIADYTFIPMEHGEGLQVLHYEVGQKYEPHFDYFLDEYNTKNGGQRMATLLMYLSDVEEGGETIFPDANVNSSSLPWYNELSECARKGLAVKPKMGDALLFWSMKPDATLDPLSLHGGCPVIKGNKWSSTKWMHVREYKA

SEQ ID NO: 62885 - protein, 214 aa, Solanum cheesmaniae
AIFNLSDLLSQEKRAEDLQKLLVQLRPFFSLIPKAKTAKIVNKGIVDAVAKIPGTSDLQITLCKDIVQWARSEKRTFLRQRVEAKLAALLMENKEYSEALTLLSGLIKEVRRLDDKLLLVEIDLLESQLHFSLRNLPKAKAALTAARTAANAIYVPPAQQGAIDLQSGILHAEEKDYKTAYSYFYEAFEAFNALENPQALYSLKYMLLCKIMVS

SEQ ID NO: 62886 - protein, 492 aa, Wolinella succinogenes DSM 1740
MAQKTLLIITDGIGHKPSSPHNAFTQAKKPTYDSLFASAPHALLSTHGLSVGLPEGQMGNSEVGHMCIGAGRILYQDLVKISLALKDGSLEKNPTLLGFSSRAKRIHLAGLASDGGVHSHMEHLLGLAQIFSRLGHEVLLHLITDGRDVSPTSSKEFIAQALALESDLIKIATISGRYYAMDRDKRWDRIKRAFGVIARGDSPTSLTPQEYIQAQYQAGITDEFIEPAALGGYQGFEPSDGFVFANFRSDRAREIVSALGGASFEGFDRGAYQPPKTLAMTSYDDSFPFPILFPKEKVEPTLAQVISEAGLSQLHVAETEKYAHVTFFFNGGIETPWENESRVLIPSPSVATYDLKPEMSAPEVAEATLSGMRQGYDFIVVNFANGDMVGHTGNTEAAISAVESVDRELGRLLEEAKKSGYAVILTSDHGNCEEMRDERGSMLTNHTVGEVWCFILAQGVTEIREGGLNQVAPTVLKIMGLPTPKEMDSPLF

SEQ ID NO: 62887 - protein, 309 aa, Glycine max
MAQQEVVEGFKFEQRHGKERVRVARVWKTRQGQHFVVEWRVGITLFSDCVNSYLRDDNSDIVATDTMKNTVYAKAKECSDILSAEDFAILLAKHFVSFYKKVTGAIVNIVEKPWERVIVDGQPHEHGFKLGSEKHTTEAIVQKSGSLQLTSGIEGLSVLKTTQSGFVNFIRDKYTALPDTRERILATEVTALWRYSYESQYSLPQKPFYFTEKYQEVKKVLADTFFGPPNGGVYSPSVQNTLYLMAKATLNRFPDIAYVSLKMPNLHFLPVNISNQDGPIVKFEDDVYLPTDEPHGSIQASLSRLWSKL

SEQ ID NO: 62888 - protein, 227 aa, Coffea canephora
MAEYDQSNIKVEEGSAVEATDRGLFNLGKKEEVKKCDQGQAISAEFDEKVRVSEPDKEEGKKHGGLLEKLHRSGSSSSSSSEEEVEEGGEKKKKKKEKKGLKDKIKEKISGDKKDEEKVEKCEEDTSIPVEKYAEPAHADAAHEPEEKKGFLDKIKEKLPGGGQKKTEEVAAAAPPPPPAECTATEGEAKDKKGFLDKIKEKLPGYHPKTEEEKEKEKEKEKEAGCH

SEQ ID NO: 62889 - protein, 198 aa, Solanum lycopersicoides
DLQKLLVQLRPFFSLIPKAKTAKIVNKGIVDAVAKIPGTSDLQITLCKDIVQWARSEKRTFLRQRVEAKLAALLMENKEYSEALTLLSGLIKEVRRLDDKLLLVEIDLLESQLHFSLRNLPKAKAALTAARTAANAIYVPPAQQGAIDLQSGILHAEEKDYKTAYSYFYEAFEAFNALENPQALYSLKYMLLCKIMVS

SEQ ID NO: 62890 - protein, 501 aa, Sinapis alba
DEEITCQENNPFTCGNTDGLNSSSFEADFIFGVASSAYQIEGTIGRGLNIWDGFTHRYPDKSGPDHGNGDTTCDSFSYWQKDIDVLDELNATGYRFSIAWSRIIPRGKRSRGVNQKGIDYYHGLIDGLIKKGITPFVTLFHWDLPQTLQDEYEGFLDPQIIDDFKDYADLCFEEFGDSVKYWLTINQLYSVPTRGYGSALDAPGRCSPTVDPSCYAGNSSTEPYIVAHHQLLAHAKVVDLYRKNYTHQGGKIGPTMITRWFLPYNDTDRHSIAATERMKQFFLGWFMGPLTNGTYPQIMIDTVGARLPTFSPEETNLVKGSYDFLGLNYYFTQYAQPSPNPVNATNHTAMMDAGAKLTYINASGHYIGPLFESDGGDGSSNIYYYPKGIYSVMDYFKNKYYNPLIYVTENGISTPGSENRKESMLDYTRIDYLCSHLCFLNKVIKEKDVNVKGYLAWALGDNYEFNNGFTVRFGLSYINWNNVTDRDLKKSGQWYQKFISP

SEQ ID NO: 62891 - protein, 349 aa, Staphylococcus aureus
MNFNNKTKYGKIQEFLRSNNEPDYRIKQITNAIFKQRISRFEDMKVLPKLLREDLINNFGETVLNIKLLAEQNSEQVTKVLFEVSKNERVETVNMKYKAGWESFCISSQCGCNFGCKFCATGDIGLKKNLTVDEITDQVLYFHLLGHQIDSISFMGMGEALANRQVFDALDSFTDPNLFALSPRRLSISTIGIIPSIKKITQEYPQVNLTFSLHSPYSEERSKLMPINDRYPIDEVMNILDEHIRLTSRKVYIDYIMLPGVNDSLEHANEVVSLLKSRYKSGKLYHVNLIRYNPTISAPEMYGEANEGQVEAFYKVLKSAGIHVTIRSQFGIDIDAACGQLYGNYQNSQ

SEQ ID NO: 62892 - protein, 403 aa, Vibrio vulnificus YJ016
MTVEMKVERGLFDEVMVPCYNPMEMIPVKGQGSRIWDQNGNEYIDFAGGIAVSCLGHCHPVMVNALTEQAGKLWHLSNVMTNEPALRLAKKLTEVSFAERVFFANSGAEANEAALKLARRYAADVYGPEKSEIIAFKQGFHGRTFFTVTVGGQAAYSDGFGPKPGDVTHLPYNDIEALQAHISDRTCAVMMEPLQGEGGIIPPTAEFIQAVRELCDKHNALLVFDEVQTGNGRTGEFYAYQGLGVTPDILSTAKSLGGGFPIGAMLTTAKLAEHLKVGTHGSTYGGNPLACAVAEAVVTEVSKPETLQGVKEREQWFREGLAKLNEKYQIFAEIRGKGLLLGAALNEQWQGRARDVLVAAGKEGLLVLVAGANVVRFTPSLVITKQEIEEGFAKLDKAIASLV

SEQ ID NO: 62893 - protein, 326 aa, Magnetococcus sp. MC-1
MESDHNRDMLARARQTLELEAEAILAMRERLNGDFVQAVQQILACTGRVVVTGMGKSGIIGHKIAATLSSTGTPALYLHPGEGIHGDLGMLTAQDCVIALSNSGETAEVLALLPVIKRLGTPLIAILGRMASTLARQSDVALDASVAREACPLNLAPTSSTTAALALGDALAVALLEARGFSEDQFALFHPGGALGRKLLLKVEDLMHHGAALPQVARHTLVKDALWEMTAKRLGLTAVLEEDGRLAGIITDGDLRRQLEDHPGDLLNLRAEQIMTVNPKAIQPDALAAQAVHDMETRAITALLVVDAQQLVGVIHLHDLLRAGVV

SEQ ID NO: 62894 - protein, 383 aa, Citrus sinensis x Poncirus trifoliata
MAIDCIKNIPTMLHQPKEEYKDEQKPLVFDASVLKHQTQIPKQFIWPDDEKPCVNAPELQVPLIDLGGFLSDDPVAAKEASRLVGEACRKHGFFLVVNHGVDSSLIADAHRYMDHFFELPLNEKQRARRKLGEHCGYASSFTGRFSSKLPWKETLSFRYSAEKSLSNNIVEDYLLNTMGDEFKQFGRVYQDYCESMSRLSLGIMELLAISLGVGRAHFKEFFEENDSIMRLNYYPPCQKPELTLGTGPHCDPTSLTILHQDQVGGLQVFVDNEWRSISPNFEAFVVNIGDTFMALSNGRYKSCLHRAVVNSQTTRKSLAFFLCPKNDKVVSPPSELVDTYSSPRIYPDFTWPMLLEFTQKHYRADMKTLEAFTNWLQQKKQLK

SEQ ID NO: 62895 - protein, 334 aa, Glycine max
MNRGVLQSSPVQQMMTGNPNWWNININSMAPQAPPFLSTPNNFPIPCAPTSLPFPSWHENQDLPESWSQLLMSGVVDEQGKAGMGQFIQTKKLESWEDQMLGQAPNASLVDVKQENLVNSYAYGHGSEELQSSKPSWSPKSCVTTSFSSNMLDFSNNKTDARHPPPDLSSECNSTAAGGALKKARVQPSATTQTTFKVRKEKLGERITALHQLVSPFGKTDTASVLLEAIGYIRFLQSQIEALSLPYLSGGSGNTRQQHSVQGEKRCIFPEDPGQLLDENCLKRKAAGEPDTQEEPKKGLRSRGLCLVPVSCTLQVGSDNGADYWAPALGGGFR

SEQ ID NO: 62896 - protein, 390 aa, Arabidopsis thaliana
MSSMLSPPVKKRKIVAPQSQSASASFQSLPDDLILSIVARVPRLYHRTVSLVCKSFRSLLVSPELYKARSVSGHTESCLYLSIACYPDYRMFTLCRKPDQTLTTSEEEEKKKSNGYYLAPVPDPDSHPVYFSSLVTVGSDIYNIAGSHASSNVSILDCRSNTWREAPRLGVELTSVSASVLDRKIFVVGMYADDEESESKNDFFEVLDTETHTWDPQPFNCSETKDKFLNCRTAFIDGKFLVKPWIHRGVVAYNSKESRWEPVQTKMAMSMFNDSYCQIHNVIYLAFDGRIRWYDDALNCWGDVQGLLELGNIPHGPSCVRLADYRGNIAVFWFRYLPDNDDYKWKMIWCAEIALERRTSWEIWGKVLWFDPVLTVPADYEFVKALAATV

SEQ ID NO: 62897 - protein, 244 aa, Zea mays
MALPTANPGFRLGCQESPAMGLRSAPRLALRRPGAVSGHRTLTGDITSLRLITAVKTPYLPDGRFDLEAYDSLINMQIEGGSEGVIVGGTTGEGHLMSWDEHIMLIGHTVNCFGTRIKVIGNTGSNSTREAVHATEQGFAVGMHAALHINPYYGKVSTEGLISHFEAVLPMGPTIIYNVPSRSGQDIPPQVIETLSGYPNMAGVKECVGHERVKCYTDKGITVWSGNDDECHDSRWKYGATGVI

SEQ ID NO: 62898 - protein, 1461 aa, Gibberella zeae PH-1
MTQHREHQPSSSSTTLQDTHNTDNTSDHDYDAEIHQLARRITSQSATSGHAPLFPLGENTSLDPESSHFNPKKWAKAFLKTRTAAADGNTPRTAGIAFKNLDAFGFGQATDFQNTLVNIFLNATSIVRKIGGYKGQRIDILRNLDGLVEAGEMLCVLGPPGSGCSTLLRSISGETHGFHLGDDTVLNYQGIRPEQMKKAYRGEAIYTAEVDHHFPHLTVGDTLYFAARCRCPPIDKLPHGVTAREYAEHLRDVIMAMFGISHTKNTRVGNDFVRGVSGGERKRVTIAEAALGYSPLQCWDNSTRGLDSANAVEFCRVLRTQADVLGISSCVAIYQAPQSAYDLFDKVVVLYEGRQIFFGRTGDAQAYFENLGFVCPEQQTTADFLTSMTNPGERIVRPGANPPRTSDEFALAWKNSQDRSRLIDEIDYYVEQHPFDGPDLQRFSESRRLDQARVQREKSPFNLSFWQQYTINLWRSVKMLLGDPSITLTMLITNIFQALIVSSIFYNLPHNTTSFFRRTTLLFFIVLMNAFSSVLEIMTLYEKRKVVEKQSRYAFYHPSAESLAAIVTDLPYKVINAILMNTTLYFMCNLRREPGPYFAFLLFSFTLTMCMSMMFRFIGSATKSISQALAPACVILLGLVLYSGYAIPTEYMQGWLAWIRWINPVFYGLESVFLVEFHGQEYSCSSFVPSGAGYENLNSGEQVCNIAGSIPGQSFVRGEDYLRTSFGFVNSHRWRNFGILIVWALFYMALHLLTTEYVASERSKGEVLVFLRESMHKVSGKRATDEESGSSLPVGKQEAAGNSSEKVEVERQTSVFHWNDVCYDIKVKGEERRILDHVDGWVKPGTLTALMGVSGAGKTTLLDVLASRVTMGVVSGEMLVNGHQRDSSFQRKTGYVTQQDLHQASSTVREALRFSAILRQPAKYSKQERIDYVDTVISLLGMDAYADAIIGVPGEGLNVEQRKRLTIGVELVARPQLLLFLDEPTSGLDSQTSWSICDLMETLTKSGQAILCTIHQPSAMLFQRFDRLLLLAKGGKTVYFGEVGHNSQVLMDYFTRNGGPSLPPKANPAEHMLHVIGAAPGAQTDVDWPAIWRKSPEYESVQRELQSLKSESSSGQTQTSAGDASEYKEFASSYTTQLWEVTKRLFQGYWRNPQYMYSKVLLSVGAALFIGLSVMDSSNTIRGLQNQMFGVFLFLTIFSQVAEQMMPVFVEQRTLFEARERPSKTYSWQSFMFANITVEVAWNSFIGVFSFIVWYYPIGLYRNAEWTNQVDSRGITIFLHVWMFFLLASTFTHMIIAGLPDSDTAAGILNLIFIMMFAFCGVLAGPNVLPRFWIFMYRVNPFTYVVEGFLGTTLANAPVTCAANEILDFKPTNGSTCSEFLSAYITEHGGYLHGGSGSSTTECHYCPMANTNSFLKLININFDNRWRDFGLLWAYVLFNCAAAVAIYWLVRVPKKSKSKKA

SEQ ID NO: 62899 - protein, 497 aa, Arabidopsis thaliana
MEMMILISLCLTTFLTILLFFKSLLKRPNSNLPPSPWRLPVIGNLHQLSLHPHRALSSLSARHGPLMLLRFGRVPVLIVSSADVAHDVMKTHDLKFANRPITKSAHKISNGGRDLVFAPYGEYWRNVKSLCTIHLLSNKMVQSSEKRREEEITLLMETLEEASLSSSSVNLSKLITNMVSDIMGKVVLGKKYSGEEGTIDVKTITKSFLDAVGLSPVGEYIPSLAWIGKITGSDGKLEKITKQFGDFIEKVLQEHEDTTADKETPDFVDMLLTIQRDETAQCQLDKSDLKVIIFEMFLGSTTTTSAVIEWAMTRLMRNPECLKKLQDEIRSVSKMNSYVSGKEVENMNYLKAVIKEVLRLHPPLPLLVPRLLSEDVKLKGYDITAGTQVIINAWAIQRDTATWGSDAQEFRPERHFDSTWDFVGRNFKYIPFGAGRRLCPGIGLGSVMASVTLANLVKRFDWRVEDGPSGYDKPDLVEGAGIDVCRKFPLVVFPSSA

SEQ ID NO: 62900 - protein, 451 aa, Thermoanaerobacter tengcongensis MB4
MNYDVIVVGGGPGGYTAAIRLSELGKKVALIEEDSLGGTCLNRGCIPTKVYAHAAELVTRIKEAKDFGITAEYTLDIAKLRQKKERVVKRLVGGVGYLMNLHHIDVINGKGTFIDKNTVEVNGAKYTAENFIIATGSKVFLPPIEGIDLEGVMTSDKALELEKIPEKIVIIGAGIIGLEFANIYASLGSKVIMIEMLPQLLPMLDRDVVGVMEKALKKQKIELHLNSKVEKIERGLRVIYTENGNQESVECDAVLVAVGRVPNVNGVDALNLEMNGRGIKVDSHMRTSIENIYAIGDVTGGIQLAHVASYQGIVAAHNIAGEEKEADLTAVPNCLYTNPEVAWVGLNESQAREKYGEVKIGTFPYTALGRAMTMGESDGFVKIIAEGKYGRVVGMEIIGAGATEIIHEGVLAIKEEFTLEELADSIHAHPTLSESIKEAAEDALGMPINKG

SEQ ID NO: 62901 - protein, 191 aa, Populus alba
RLVPDTVYLTVNYIDRYPSGNVMNRQRLQLLGVACMMIAAKYEEICAPQVEEFCYITDNTYFRDEVLEMESTVLNYLKFEMTAPTAKCFLRRFVRAAQGIIEAPSMQLECLANYIAELPLLEYSMLCYAPSLVAASAIFLAKYILLPSKRPWNSTLQHYTLYEPVDLSDCVKDPHRLCCGDHNSTLPAIRE

SEQ ID NO: 62902 - protein, 478 aa, Solanum lycopersicum
MSSYSELSNLPIREIPGDYGFPIISAIKDRYDYFYNQGEDAWFHNKAEKYKSTVVKINMAPGPFTSNDYKLVAFLDANSFVCMFDNSLIDKTDTLGGTFKPGKEYYGGYRPVAFIDTKDPNHAALKGYILSSFAKRHNLFIPLFRNTLSDHLFNNLEKQVTEQGKADFNALLPTMTFDFIFRLLCDQKNPSDTVLGAQGPEHLRKWLFPQLIPSLSAKKLPNIIEDMLFHNFLIPFGFIKSDYNKLVDAFSKSAVSMLDEAEKLGIKREEAVQNILFLVGINMFAGLNAFFPHLFRFVGEAGASLHTQLAKEIRSVIKEEGGAITLSAINKMSLVKSVVYETLRLRPPVPLQYGKAKKEFMVQSHDASYKINKGQFVVGYQPMASRDPKIFANPDEFVPDRFMNDGEKMLKHVLWSNGRETESPAPDNKQCPGKDLVHLLGRLILVEFFIRYDTFTLEITPLFRAPNVAFNTLTKASK

SEQ ID NO: 62903 - protein, 211 aa, Populus alba
AQAAAALENKKQVCVNVEKVPAAGVDGVDAVGRKVAVKKPAQKKVTVKPKPEEVVVISPDSEEVVKQEKPVKKKKEGEGSKKNKPTLTSVLTARSKAACGIANKLKEQIIDIDAADVNNDLAGVEYVEDIYKFYKLVENESRPNNYMDMQPEINEKMRAILVDWLVDVHQKFQLSPETFYLTINIIDRFLSVKTVPRRELQLVGIGATLMA

SEQ ID NO: 62904 - protein, 728 aa, Gibberella zeae PH-1
MPAYNSVFNSDPNVPRIIGNFPLLPLRTKTRGPAYTLPAPSPPLPANESPDPDSDSYDILDEVLALFRANTFFRNFEIQGPADRLLVYGIWFVSDCLTKIRPHASLRDAQKDVMNLALDLNFAIPGDPGWPLNQMYEAPKDRQEAEQLKQYMSQVRQELAARLLARVYDEDETKPSKWWLSFTKRKFMGKSLTCAYIYVFCMPLYFEYRLNKMDKETVQPNSWVAVRLPNETYKVFQVVPNTTISLGKYGSFPTNLIINRPFHFTYEVQDRVEGETFSRLRVVPAKELNADDLADANKEATEPAEGDDVIAAADGEELTLVDESGKVLIRSNREIIDDSARQTLKPEEIEELKRKGASAGKELIAKLLLSHTAIDQKTAYSLAKYKLLKTKKYIRRFTVLPLDVPMLAQWLLEDRDASKILEMRQEMMALVGCWADVHFSGAAPEDTTTPQSGRWLVVDDTGGLLVASLAERMDILYPKPEPEAAEDIAATDKTEQNQPQTSEAANPTEQKPERRRHPKRSDFNVPYVNKNTLTMIHGQTQPNLALLRYFNYDAANANPSPPYHPLDTNLMDISWLQLLAPEEDDAYNNKPPEATPEEIASWKTNRRGNYHRKRRRWARIRHVVDTTRAGGFSGLAVASSMDPISIVRSTVPLLSGGAPIAIYSPSIEPLTELADCFSVARRAAWVSSPPAEVESKTAEELERWEGSEEFPINPTLLLGVTIQSITHD

SEQ ID NO: 62905 - protein, 315 aa, Capsella rubella
MGTILKLPIIDLSSPEKLSTSSLIRQACLDHGFFYLTNHGVSEELMEGVLMESKKLFSLPLDEKMVMARRGFRGYSPLYEEKPHSSTLAKGDSKEMFTFGSSEGVLAQIYPNEWPREELLPLWRPTMECYYKTVMDVGKKLLGLVALALNLEENFFEQVGGFNAQAAVVRLLRYPGELNSSGEVTCGASAHSDYGMITLLATDGVPGLQVCRDKDKEPKVWEDVAGVKGAFVVNIGDLMERWTNGLFRSTMHRVVSVGKERYSVAVFVDPDPNCVVECLESCCSETSPPRFPPVRTKDYFHERFSQTLASYSGSG

SEQ ID NO: 62906 - protein, 219 aa, Pasteurella multocida subsp. multocida str. Pm70
MDQLEMKKMAAAAALQYVKPDSIIGVGSGSTVNCFIEALGSMRDQIKGAVAASKASEALLAKQGIEVFSANEVSSLDIYVDGADEINPQKMMIKGGGAALTREKIVAALAKKFICIVDTSKQVDVLGSTFALPVEVIPMARSQVARKLVALGGSPEYREGVVTDNGNVILDVYHFAIMNPVEMEKELNNVPGVVTNGIFALRAADIIIVGTPEGAKVIE

SEQ ID NO: 62907 - protein, 315 aa, Capsella rubella
MGTVLKLPIIDLSSPEKISTSRLIRQACLDHGFFYLTNHGVSEELMEGVLMESKKLFSLPLDEKMVMARRGFRGYSPLYDEKLDPSATSKGDSKEIFTFGSSEGVLAQIYPNEWPLEELLPLWRPTMECYYKSVMDVGKKLLGLVALALDLEEKFFEQVEGFNVQAAVVRLLRYPGELNSSGEVTCGASAHSDYGMLTLLATDGVPGLQVCRDKDKEPRVWEDVAGIKGAFLVNIGDLMERWTNGLFRSTMHRVVSVGKERYSVAVFFDPDPNSVVECLESCCSETSPPRFPPIRTRDYFHERFSQTFASYSGSG

SEQ ID NO: 62908 - protein, 331 aa, Magnetococcus sp. MC-1
MAQQTNEALARLRSLVEQDLQRTNEVILEQLNSPVELITQVGDHLLNSGGKRLRPILTLVTAKLFGYQKADVHALLAAVVEFIHTATLLHDDVVDKSNTRRGQATANSVWGNKAPILVGDFLFSRSFQIMVEHGDLRVLRIVSDCCAIISEGEVMQLVASNDLATDEERYLDVIRHKTASLFASASQLGAVVADQSDEIAQRMYDYGMMLGTAYQVVDDLLDYSAETEKLGKNVGDDFQEGKITLPVIHAFRSGDAEEQAFWRRCLEDEEQDESSFDHARALIAKHGSLDYTMSQARALIVKAKAALAPLPESAERQALMDLADLSVDREY

SEQ ID NO: 62909 - protein, 335 aa, Medicago truncatula
MEPVDSEKAVGKNSSVSLMISNPKVFDCCICFLLLSIPIFQCKTGHIVCFTCCSKLGNKCDKCSKCISLKRCRAFENLLQYIKMSCPNEKYGCRETIDYSQKTKHEEKCIYVPCYCPISGCDFVASSEVLSNHFSNKHEDSQIKFSYGQSFIVSLKSDDDAIILQEKYDGKLFILINSTITTLLGNAVNICCFGPNASESEYSYGIKARSQRCKLKLHSFVTNVQQVTLGTLSPEFLMIPNGSSKPLKLEICITCTNPVMQIFVRDLNGKIITLKVKSLDTIFSVKEQIHDKKTYPVQDQRLTFCCRQLHDSMTVADNNIQKDSTLHLTLRLLGD

SEQ ID NO: 62910 - protein, 343 aa, Medicago truncatula
MEPVDAAKDVGKNSSISVMISNPKVFDCSICFQLLSFPIFQCDNGHIVCSTCCSKFGNKCDKCSKCISLKRCRAFENLLQYIKMPCLNEKYGCKETIDYIQKRKHEEECIYVPCYCPLSGCDFVASSEVLSDHFSHKHEDSQINFYYGFSFLVSLKSDDEVIVLQEKRSGKVFILNNSTMLYSKKNYSTMLLGNAVNICCFGPTASVSEYSYDISARSQKCKLKLHSFAKNLHQVTLATLSSEFLVIPIGSSEPLELVICITPTTPTMRIFVNLLTGETITLEVNSLDTICSVKEKILDETEYSMQSQRLIFAGKQLDDSRTVADYNIQNESTIDVAFRILGD

SEQ ID NO: 62911 - protein, 482 aa, Lactobacillus sakei subsp. sakei 23K
MEYQQLAPFPQDFLWGSASAAYQIEGAYQEAGKGQSVWDQFVRIPGKTFKATNGDVAVDHYHRYQEDVALMARAGLKAYRFSISWPRVLPTGRGTVNEEGLAFYDRLIDELIANQIEPIVTIYHWDLPQALQDEYGGWESRQIIPDFTAYAALLFERFGDRVRHWVTLNEQNIFITHGYLTAEHPPAVMDAKRTYQANHMANLANASVIKLFHEKGYQGGNGPSFAYSPTYALDADPVNQIAADDAEQLNANLWLDIYAWGRYPKLILNYWAREGLLPDITAADQALLQDPLARPDFMGLNYYQTTTVTANPLVGGVGLTKQNTSGKKGTSQASGVPGLFKTSDNPYMQQTDWDWNIDPEGLRMALRRIESRYNLPVLITENGLGAYDRLEGAGEVHDEYRIVFLKAHIQAIQEAITDGVTVIGYTTWSFTDLLSWTNGYQKRYGFVYVDRDETDEKELNRYPKDSFYWYQRVIRSNGQQLN

SEQ ID NO: 62912 - protein, 410 aa, Triticum aestivum
MELGLASSRGPAGPSLAVAGRRPRSSLSPPLPRPLSLQIQTRGYSMPTLHYKDHTTVGCQASVATKYMETDDTVDLDWENLGFGLVDTDFMYMAKCGPDGNFSKGEILPFGPIALSPSAGVLNYGQGLFEGLKAYRKTDGSVLLFRPEENAIRMKNGSDRMCMPAPSVEQFVDAVKQTVLANKRWVPPTGKGSLYIRPLLIGSGAILGLAPAPEYTFLIYVSPVGNYFKEGLAPINLIIEDNFHRAAPGGTGGVKTIGNYASVLKAQTTAKDKGYSDVLYLDAVHNKYLEEVSSCNIFVVKGNAISTPAIEGTILPGITRKSIIEVAESKGYKVEERHVSVDELLDADEVFCTGTAVVVSPVGSITYKGKRVEYDGNQGVGVVSQQLYTSLTSLQMGHTEDRMGWTVQLN

SEQ ID NO: 62913 - protein, 379 aa, Zea mays
MATAGKVIKCRGCRDVGGRQTAVHRGGGGSAAAGHGGAYQDPLHRALPHRRLLLGGQGANPGVPEDLRTRSGRIVESVGEGVTDVAPGDHVLPVFTGECKECAHCKSEESNMCDLLRINVDRGVMIGDGKSRFTISGQPIFHFVGTSTFSEYTVIHVGCLAKINPEAPLDKVCILSCGISTGLGATLNVAKPAKGSTVAIFGLGAVGLAAMEGARLAGASRIIGVDINPAKYEQAKKFGCTEFVNPKDHDKPVQEVLIELTNGGVDRSVECTGNVNAMISAFECVHDGWGVAVLVGVPHKDDQFKTHPMNFLSEKTLKGTFFGNYKPRTDLPNVVEMYMKKELELEKFITHSVPFSEINTAFDLMLKGESLRCIMRMED

SEQ ID NO: 62914 - protein, 119 aa, Brassica napus
MGDIWTWLISFFFLIALVGIIVYQLVCLADLEFDYINPYDSASRINSVVLPEFIIQGVLCVFYLLTGHWFMSLLCLPYLYYNFQLYSKRQHLVDVTEIFNLLNWEKKKRLFKLAYIILN

SEQ ID NO: 62915 - protein, 471 aa, Lentinula edodes
MSDVVKKGSDDSSATVTSQVTDSPTIPDVDNYVAYTIKNTKALPPVTWSNLLNELNWLSVYILTIPPLVGFVGAFYVKLQWETAVWAVAYYFLTGLGITAGYHRLWAHRAFNASLPLQYVLAILGAGSLQGSIKWWSRGHRAHHRYTDTELDPYNAHKGFWFSHVGWMLVKPRRKPGVADVSDLRHNPVVKWQHKHYLSLILFMGFILPSIVAYVGWGDAKGGFIYAGVIRLVFVHHSTFCVNSLAHWLGETPFDDKHTPRDHMITAFVTIGEGYHNFHHQFPMDYRNAIKWYQYDPTKWTIWVLAKLGLASHLKVFPDNEVRKGQLTMELKKLRRTQDKLSWPSDSNDLPVISWESFTSQSEKRPLILISGFIHDVSDFIEEHPGGAHFVRNYIGKDATTAFFGGVYDHSNAAHNLLAMKRVGVLHGGSPHGLDDKRAIPPSQRLKIARYTELLSPGSSSAYSDGEDGLL

SEQ ID NO: 62916 - protein, 521 aa, Oryza sativa (japonica cultivar-group)
MALPFPVPRGAHWAVTSTAHVLVGFTGEMARVEQPRAPAPYNAAFLRKKLTLATKMHTTKSSDSHLDIAGTVVTHSHGAAVAAGKQKAAATAAAGRPGARNRQALGDIGNVLNAHVVDGKIQLPEGINRPITRSFGAQLLKKAQENAVAANKIVVQNPARKEPAPKPAKKVVPRPENAAKASTGAGVNENKKPSESEGAGSSSGGSALKYSRKKVVNTLTSVLTARSKHACGITEKPKEVVEDIDKLDGDNQLAVVEYIEDIYNFYRTAQICSETDSVVLAQLERRPTDYMSSQVEVNPKMRAILADWIIDVHYKFELMPETLYLTMYVIDRYLSLQPVLRRELQLVGVAAMLIASKYEEMWAPEVQDLIHVCDNAYSRQHILAMEKNILNRLQWNITVPTPYVFLLRFIKAAGGDKELENMVFFFSEMALKEYGMASLCPSLVAASAVYAAQCTLKRSPLWTSTLKHHTGFTESQLRECAKVLVNAHAAAPESKLKTAYRKYASEQLGRVSLRPPAVCLA

SEQ ID NO: 62917 - protein, 794 aa, Thermoanaerobacter tengcongensis MB4
MLVSLSWLKEFVDIDEDAKTIAEGLTMSGSKVEGIKSYGEEISNVVVGQIVSLEKHPNADKLWVGIVDIGSEKLQIVTGAENIKVGAYIPVALHGATLPGGVKIKRSKLRGVESEGMMCSAEELGLDESLLPEYQRNGIFILPPLPLGMDINEALQLKDDVLEFEITPNRPDCLSVVGIARETAATFRKSFRMPEIRVTEVEEPNPARVTIEAPDLCYRYVARVVKNVKIGPSPIWMQVRLLKAGIRPINNVVDVTNYVMLELGQPLHAFDLDKVKNKHIIVRRARDGEKLVTLDGKERILDSSMLVIADEEKAIGLAGVMGGENTEITDSTVNILIESANFKGSNIRHTSKKLGLRSEASARFEKGLDPEITVLACERAAQLMEKYCGGEVLKGIVDEYPKPMERTVLTVRPDRINKFLGTNLATSEMIEILRSLEFEVVEKGEELEIKVPHFRKDVTMEADIAEEIARLYGYNNIEDSLMKNAQTTLGSLTKEQQLEEKAREVLLACGLNEIVTMSFMGERDLDRINVPKDSVLRKAVKIINPLGEEQSLMRTTLLPFMLNVAYTNYSRKVGEFRAFEISRVFLPKELPLKELPEEVKTISLGMYGKEVDFYTIKGVIEELLEVMGIVDVEYVRAEEPSYHPGRSAKILFKEEVLGVFGEVHPDVLENYDLPVRVYAGELNLDKIIKFANVDKKYTPLPKYPAVERDIAVVVDKDLFVAEVEKVIKETGRGFVEKTALFDVYKGPNIPEGKKSVAFSIWYRSYEKTLTDEEVNEVHARIVKALEEKLGAKLR

SEQ ID NO: 62918 - protein, 461 aa, Rhodopseudomonas palustris CGA009
MLKTIDTPQVRDATPKLKLYSREEADAFVAKVKAAGYDYVRFEFPDMAGLSRGKTIPIGHVSSYMRSGLNLYGGTVALDSYSIPVRDSGYNEEMNYTDCVMVVDTDTLTPVPWLEKTGRVICDTMWYDGTPQMATPRLLLKKMLNVAASMGYTVKSGHEYEFYVVDHATRAPLFGGQPIFVTSRTHQTPAIDDLIRVLEAQGIDIITWNVEHGPGQIEINYSALDDIAAADRAFVFKGTVKEYLAKHGLLATFMTKPYKGLSGSCSHFHISLLDSKTGENAFLDKEAENGLSRLMRSFIQGILDHTRACMALWSPTPNCYRRIRPRTYAPSNISWGIQDRSASIRVKASYDQATHLEVRVPSALSNPYLVSASVIASGLLGVMQNRELSPAAAGPKEDDARFEKLPTAIEDALEAFEADVALREMLGDEFAKVYLAMKWQEAARLRDEIPAAETNEYFELY

SEQ ID NO: 62919 - protein, 659 aa, Schizosaccharomyces pombe
MEYYTSKEVAEWLKSIGLEKYIEQFSQNNIEGRHLNHLTLPLLKDLGIENTAKGKQFLKQRDYLREFPRPCILRFIACNGQTRAVQSRGDYQKTLAIALKKFSLEDASKFIVCVSQSSRIKLITEEEFKQICFNSSSPERDRLIIVPKEKPCPSFEDLRRSWEIELAQPAALSSQSSLSPKLSSVLPTSTQKRSVRSNNAKPFESYQRPPSELINSRISDFFPDHQPKLLEKTISNSLRRNLSIRTSQGHNLGNFGQEILPRSSRRARPSELVCPLSSLRISVAEDVNRLPRIDRGFDPPLTVSSTQRISRPPSLQKSITMVGVEPLYQSNGNEKSSKYNVFSESAHGNHQVLSFSPGSSPSFIEQPSPISPTSTTSEDTNTLEEDTDDQSIKWIRGALIGSGSFGQVYLGMNASSGELMAVKQVILDSVSESKDRHAKLLDALAGEIALLQELSHEHIVQYLGSNLNSDHLNIFLEYVPGGSVAGLLTMYGSFEETLVKNFIKQTLKGLEYLHSRGIVHRDIKGANILVDNKGKIKISDFGISKKLELNSTSTKTGGARPSFQGSSFWMAPEVVKQTMHTEKTDIWSLGCLVIEMLTSKHPYPNCDQMQAIFRIGENILPEFPSNISSSAIDFLEKTFAIDCNLRPTASELLSHPFVS

SEQ ID NO: 62920 - protein, 116 aa, Arachis hypogaea
MATLDSDVPMVPAGEPSSSAGPSSKKPKRFEIKKWNAVALWAWDIVVDNCAICRNHIMDLCIECQANQASATSEECTVAWGVCNHAFHFHCISRWLKTRQVCPLDNSEWEFQKYGH

SEQ ID NO: 62921 - protein, 448 aa, Listeria innocua Clip11262
MKKEKTERTKQSWRKAQNAPSLSEVNNSVAIPKNAKFFRKLFAFMGPGALIAVGYVDPGNWATSIAGGSEFGYTLLSVILISNILAVLLQSLASKLGIVTGRDLAQASSDHFSKPFGFVLWILAELAIIATDIAEVIGSAIALNLLFGIPLIWGVCITALDIFLVLFLQHKGFRYIEVIVITLMVTILVCFGAEMVMSHPDMQAIAKGFIPQSEIVTNPAMLYIALGILGATVMPHNLYLHSSIVQTRQYARTKEGKREAIRFSFIDSTFSLTIALLINASILILAAAAFYTTGQHNVAGIEDAYKLLNPTLGSSIASTVFAVALLASGQNSTLTGTLAGQIVMEGFLNIRLKPVVRRLLTRVLAIVPAVIITALYGANGINELLIFSQVILSMQLSFAVIPLVMFTSDKQKMGEFVNSPWLKIVSWSVAIFIAFLNIYLLFYTLTSL

SEQ ID NO: 62922 - protein, 228 aa, Oryza sativa (japonica cultivar-group)
MGEVVHRVQKKTGRKVELLSPMPPPVEEKKEEEKKEEPEPPKPEEKEPTVIAVVLKVHMHCEACAQVIRKKILKMKGVQSAEPDMKASQVTVKGVFEESKLTDYVHKRIGKNAAVVKSEPAPPPENAGDANAKDDKKAAEGGEEKDESKEEKKEGDDEKEKEKEKDDSNAAEVEEKDKEKDPSALAAANLYMHYPRFSNPGGYGVPGYAYPYAPQLFSDENPNACVVM

SEQ ID NO: 62923 - protein, 341 aa, Staphylococcus aureus
MSTNIAINGMGRIGRMVLRIALQNKNLNVVAINASYPPETIAHLINYDTTHGKYNLKVEPIENGLQVGDHKIKLVADRNPESLPWKELDIDIAIDATGKFNHGDKAIAHIKAGAKKVLLTGPSKGGHVQMVVKGVNDNQLDIEAFDIFSNASCTTNCIGPVAKVLNNQFGIVNGLMTTVHAITNDQKNIDNPHKDLRRARSCNESIIPTSTGAAKALKEVLPELEGKLHGMALRVPTKNVSLVDLVVDLEKEVTAEEVNQAFENAGLEGIIEVEHQPLVSVDFNTNPNSAIIDAKSAMVMSGNKVKVIAWYDNEWGYSNRVVDVAEQIGALLTSKETVSAS

SEQ ID NO: 62924 - protein, 156 aa, Triticum turgidum subsp. durum
TFMIYAAPVGTYFKEGMAAINLLVEEEIHRAMPGGTGGVKTISNYAPVLKAQMDARSKGFADVLYLDSVHKRYVEEASSCNLFVVKGGAVATPATEGTILPGVTRRSIIELARDSGYQVEERLVSIDDLVSADEVFCTGTAVGVTPVSTITYQGTR

SEQ ID NO: 62925 - protein, 200 aa, Wolinella succinogenes DSM 1740
MITVVESSFLTSASALSQTPPPKNSEVVFIGRSNVGKSTLINLIVDSKGLAKSSSTPGKTQLINYFETIWKRGEERIPLWLVDLPGFGYAKVSKEMRKDWGEKLIHFLQERRSIKLFVQLIDARHPDLAIDAEAWAMIGAIKRGDQKVIRVFTKMDKLNRNDQKKLQQRYPDACFTAMLGKEGIASVRERVLKDVLGEEA

SEQ ID NO: 62926 - protein, 709 aa, Arabidopsis thaliana
MASTSSGGGGGGDKKKKKGFSVNPKDYKLMEEVGYGASAVVHRAIYLPTNEVVAIKSLDLDRCNSNLDDIRREAQTMTLIDHPNVIKSFCSFAVDHHLWVVMPFMAQGSCLHLMKAAYPDGFEEAAICSMLKETLKALDYLHRQGHIHRDVKAGNILLDDTGEIKLGDFGVSACLFDNGDRQRARNTFVGTPCWMAPEVLQPGSGYNSKADIWSFGITALELAHGHAPFSKYPPMKVLLMTIQNAPPGLDYDRDKKFSKKMSSCAQSFKELVALCLVKDQTKRPTAEKLLKHSFFKNVKPPEICVKKLFVDLPPLWTRVKALQAKDAAQLALKGMASADQDAISQSEYQRGVSAWNFNIEDLKEQASLLDDDDILTESREEEESFGEQLHNKVNDRGQVSGSQLLSENMNGKEKASDTEVVEPICEEKSTLNSTTSSVEQPASSSEQDVPQAKGKPVRLQTHSGPLSSGVVLINSDSEKVHGYERSESERQLKSSVRRAPSFSGPLNLPNRASANSLSAPIKSSGDDKSKANVVQIKGRFSVTSENLDLARASPLRKSASVGNWILDSKMPTGQAIKESSSHLSFIIPQLQNLFQQNSMQQDLIMNLVNTLQQAAETTDGSQNGKLPPLPRGSDSNGTVVELTAAERERLLLTKITELRARLFLFFNQSHLSYRRSMWMKELTEELEVEKSKQTQLQQKLKSVTGREQL

SEQ ID NO: 62927 - protein, 190 aa, Wolinella succinogenes DSM 1740
MREITRTTKETNIKASLELYGSGVAKIETGIGFFDHMLESLAKHALWDLEISCEGDLQVDAHHSVEDCGIVLGLLLRESLYPAQGIERFGNASVVMDESCVECDLDVSNRPFLVFDMTIEGAVGEFDAELAEEFFRALAFNAGLSLHIVQKRGKNRHHLIEAAFKALAVAMRRACTQNPRIGTPSTKGLL

SEQ ID NO: 62928 - protein, 513 aa, Aspergillus nidulans FGSC A4
MASQPPVKRPPPAPSNPVLLAAQKQWLFTDEELTRSPSQLSGMTVENENLHRSKGVNFITQVGIMLKLPQPTLATAAVYLHRFFMRYAIADKPERPGIHPYPIAATSLFLATKVEENVRRMKELVIAVCRVAQKKPDLVVDEQSKEFWKWRDTILHHEDILLEALCFDLQLEQPYRILYDFICFFRVNDNKHIRNSSWAFLNDSMYTVLCLQFPARVIAAAAFYAAASHCDIGFEDDEFGRSWWEQIDVDIAQVRRACTRMAELYESNSQHRHSQYYPPVPLAWKEGAEKTRIPRPGGSLDAPPDPSSRKRSREPEDSSKSSQQPSQDTASLKKEEASQNGARSPKRPRVGSDADQPRSAAGSLPQGGTHPHPPTTSPQSPQASSSFSHDRPPNGHHAHQSQRYQHPLPSAPRTTFPPRRNSETKNVDTIQQRIDQIVQQNSVPPKRATADKYRERDRDDEDAYQKRRPSYSSSTRNEHPPPPPPEHRQQPPPPPPPEPEPDDEGGGSEEGEL

SEQ ID NO: 62929 - protein, 321 aa, Pseudomonas syringae pv. tomato str. DC3000
MDQLPIIDISPLYGTDTQAWQAVATQIDSACREWGFFYIKGHPITAERIEQVQSAAKDFFARDAAEKLRIDITQSTHHRGYGAIATEQLDPGLPSDLKETFDMGLHLDTNHPDVLAGKPLRGPNRHPAIPGWKDLMEQHYLDMQALAQTLLRAMTLALGIERDFFDQRFQDPVSVLRMIHYPPRHTATSSEQQGAGAHTDYGCITLLYQDTAGGLQVRDVRGEWIDAPPIDGTFVVNLGDMMARWSNDRYLSTPHRVVSPLGVDRYSMPFFAEPHPDTRIECLPGCQSETHPARYPVTTCAEFLLSRFADTYAYRREQEAS

SEQ ID NO: 62930 - protein, 338 aa, Xylella fastidiosa Ann-1
MSVALSIDLSKKKTILCFGEALIDMLAQPPVKKGMPRAFLQCAGGAPANVAVAVARLGGAVQFVGMLGSDMFGDFLFDSFAEAGVVTDGIVRTNTAKTALAFVALDAHGERSFSFYRPPAADLLFRAEHFQDASFSDALIFHACSNSMTDADIAEVTFEGMRRAQAAGAIVSFDLNFRPMLWPNGENPASRLWKGLSLADVVKLSSEELDYLANTLAADANAVIQQLWQGRAQLLLVTDAAGPVHWYTRTAGGQVPTFRVQVQDSNAAGDAFVGGMLYTFAQQFDDAAALIDFCHDPESIASTLRFAAAVGALAVTRQGAFTAMPMLSEVLSLIQEQS

SEQ ID NO: 62931 - protein, 775 aa, Arabidopsis thaliana
MDEDGNLQISNSNYNGEEEGEDPENNTLNQPLLKRHRTLSSTPLALVGAKVSHIESLDYEINENDLFKHDWRSRSKAQVFQYIFLKWTLACLVGLFTGLIATLINLAVENIAGYKLLAVGYYIAQDRFWTGLMVFTGANLGLTLVATVLVVYFAPTAAGPGIPEIKAYLNGIDTPNMFGFTTMMVKIVGSIGAVAAGLDLGKEGPLVHIGSCIASLLGQGGPDNHRIKWRWLRYFNNDRDRRDLITCGSASGVCAAFRSPVGGVLFALEEVATWWRSALLWRTFFSTAVVVVVLRAFIEICNSGKCGLFGSGGLIMFDVSHVEVRYHAAHIIPVTLIGVFGGILGSLYNHLLHKVLRLYNLINQKGKIHKVLLSLGVSLFTSVCLFGLPFLAECKPCDPSIDEICPTNGRSGNFKQFNCPNGYYNDLSTLLLTTNDDAVRNIFSSNTPNEFGMVSLWIFFGLYCILGLITFGIATPSGLFLPIILMGSAYGRMLGTAMGSYTNIDQGLYAVLGAASLMAGSMRMTVSLCVIFLELTNNLLLLPITMFVLLIAKTVGDSFNLSIYEIILHLKGLPFLEANPEPWMRNLTVGELNDAKPPVVTLNGVEKVANIVDVLRNTTHNAFPVLDGADQNTGTELHGLILRAHLVKVLKKRWFLNEKRRTEEWEVREKFTPVELAEREDNFDDVAITSSEMQLYVDLHPLTNTTPYTVVQSMSVAKALVLFRSVGLRHLLVVPKIQASGMSPVIGILTRQDLRAYNILQAFPHLDKHKSGKAR

SEQ ID NO: 62932 - protein, 245 aa, Oryza sativa (japonica cultivar-group)
MEEEGFYTNLMNEGNDSLDWDSLSTMPVEDDMSNQLDENGMSSEPVTQQFPTIERTTVARPNQKRSKNFSEQEDKILVSAWLHVSLDPVLGTNQTRAAYWTRIYEHLYKTSKSTPDRSQNSLMHRWKTIQENVNKFCGYLSQIEGRRQSGVSIHDKIAQAIAVFKELEDKPFQFLHCWTLLRSQSKWHDKMKQITSQKPCATKKQKASTDGLGKAIPTNDDTTNHVDEDNEPTETEEPKIKYLAA

SEQ ID NO: 62933 - protein, 549 aa, Secale cereale
MAAAATRRAASSLASRCLLSRPAASPAAVPSALRRADGARGLLPGLLQRFGTAAAAEEPISPSVQVSETQLLINGKFVDAASGKTFPTLDPRTGEVIARVSEGDAEDVDRAVIAARKAFDHGPWPKMTAYERSRILLRFADLIEKHNDDIAALETWDNGKPYEQAAQIEVPMLARLMRYYAGWTDKIHGLIVPADGPHHVQVLHEPIGVVGQIIPWNFPLLMYGWKVGPALACGNTIVLKTAEQTPLSALYVSKLLHEAGLPEGVLNIVSGFGPTAGAALASHMDVDKIAFTGSTDTGKVILELSARSNLKPVTLELGGKSPFIVMDDADIDQAVELAHFALFFNQGQCCCAGSRTFVHERVYDEFVEKSKARALKRVVGDPFRKGVEQGPQIDDEQFKKILRYIKSGVDSGATLVTGGDKLGDKGYYIQPTIFSDVQDGMKIAQEEIFGPVQSIFKFNDLNEVIKRANASQYGLAAGVFTNNLDTANTLTRALRAGTIWVNCFDIFDAAIPFGGYKMSGIGREKGIDSLKNYLQVKAVVTALKNPAWL

SEQ ID NO: 62934 - protein, 198 aa, Thermoanaerobacter tengcongensis MB4
MLRLLKKALQVGEATVEYPFKPVEVAQGFRGKPAYDFSRCIGCGACATACPSNAITMDCDLDRGIKSWNINYGRCIFCGRCEEVCPTGAIVLSTEFELAVIKKEDMYCRAEFQLCRCIFCGEYFETFREIEYVREILEQTGLTKKSLESWVQLLKVCPKCRRHKVARIAALDNWHVDLNGRREEKWNQKLSYKNLKQS

SEQ ID NO: 62935 - protein, 551 aa, Sorghum bicolor
MAARRAASSVLSRFLLTRPSPSPSPASAASPAGKSALLGAGGPLHRFSTAPAAAAATAEEPIQPAVEVKHTQLLINGNFVDAASGKTFPTLDPRTGEVIARVAEGDSEDIDRAVAAARRAFDEGPWPRMTAYERCRVLLRFADLIERHAEEIAALETWDNGKTLAQAAGAEVPMVARCIRYYAGWADKIHGLVVPGDGAHHVQVLHEPVGVAGQIIPWNFPLLMFAWKVGPALACGNTVVLKTAEQTPLSALYVANLLHEAGLPEGVLNVVSGFGPTAGAALCSHMGVDKLAFTGSTGTGQIVLELAARSNLKPVTLELGGKSPFVVMDDADVDQAVELAHQAVFFNQGQCCCAGSRTFVHERVYDEFVEKSKARALKRVVGDPFRNGVEQGPQIDGDQFNKILRYVQSGVDSGATLVTGGDRVGSRGFYIQPTVFADAKDDMKIAREEIFGPVQTILKFSGMEEVIRRANATHYGLAAGVFTRSLDAANTLSRALRAGTVWVNCYDVFDATIPFGGYKMSGVGREKGVYALRNYLQTKAVVTPIKDPAWL

SEQ ID NO: 62936 - protein, 351 aa, Clostridium beijerinckii
MKGFAMLGINKLGWIEKERPVAGSYDAIVRPLAVSPCTSDIHTVFEGALGDRKNMILGHEAVGEVVEVGSEVKDFKPGDRVIVPCTTPDWRSLEVQAGFQQHSNGMLAGWKFSNFKDGVFGEYFHVNDADMNLAILPKDMPLENAVMITDMMTTGFHGAELADIQMGSSVVVIGIGAVGLMGIAGAKLRGAGRIIGVGSRPICVEAAKFYGATDILNYKNGHIVDQVMKLTNGKGVDRVIMAGGGSETLSQAVSMVKPGGIISNINYHGSGDALLIPRVEWGCGMAHKTIKGGLCPGGRLRAEMLRDMVVYNRVDLSKLVTHVYHGFDHIEEALLLMKDKPKDLIKAVVIL

SEQ ID NO: 62937 - protein, 544 aa, Vibrio vulnificus YJ016
MLKKCSKITLVLFQGKQGMSPKCRKLLKFDEVITMSAKKPLALVILDGYGYREDTASNAIANAKTPVMDALIANQPNTLISASGMDVGLPDGQMGNSEVGHTNIGAGRVVYQDLTRITKSILDGEFQQTAALVEAIDTAVKAEKAVHIMGLMSPGGVHSHEDHILAAVEMAAERGAEKIYLHCFLDGRDTPPRSAEGSLQRFQDLFAKLGKGRVASLVGRYYAMDRDNNWDRVQVAYDLLTQAKADFTYDSAVAGLAAAYERGENDEFVKATEIKAEGQESAAMQDGDAVIFMNYRADRARQITRTFVADFAGFERAAFPAVNFVMLTQYAADIPLAIAFPPASLENTYGEWLSKQGQTQLRISETEKYAHVTFFFNGGVETEFAGEERQLVASPKVATYDLQPEMSSTELTEKMVAAIKSGKYDTIICNYPNADMVGHTGVYEAAEKAIEALDASVGQVVEAIKEVGGQLLITADHGNAEMMVDPETGGIHTAHTSLPVPLIYVGDKAVEFKEGGKLSDLAPTMLSLAGLEIPAEMTGQVLVK

SEQ ID NO: 62938 - protein, 250 aa, Triticum monococcum
MNKRLLDSRHCLANANCGLALPLVLFNVCCYEGLWVHYFHVAGAVALQLRLAPLQDDVIVASFPKSGTTWLNALTFATMARRTNPAAGAGHPLLRLNPHQCIPFLDKLFQSCTEAKLEALPSPRLMNTHMPIDMIMPGGGGCKVVYICREPKDMVISQWHFLRRLQPDLPLADLLESVCSGAMPYGPVWDHILGYWRASTARPDGVLFLRYEELLRNPAEKVRELARFVGLPFSDAEEEAGVVHDIVKLE

SEQ ID NO: 62939 - protein, 122 aa, Oryza sativa
EQQPQQNSLFHPKVIAVYKGVGKILKRWTSGKLPKAFKIVPSLKNWEEILYVTNPDEWSPSAFYQATRIFSANLNNFMSQRFYNTILLPKIRDDMSQNKKLNFHLYRALKRATFRPSAFYKG

SEQ ID NO: 62940 - protein, 168 aa, Oryza sativa
WIMTKAMKSMDDKEALYRRLAPEQLVAVEGLHDLCRWIKDHKLKRAAVTNAPRSNAELMLSLLGLTEFFPVLVIGSECDRAKPFPDPYLKALELIGASPDHTFIFEDSASGIRAGVAANVPVVGLTTRNPEKVLQDAGASLLIKDFQDPKLLSILEEIEPTVAAVEQV

SEQ ID NO: 62941 - protein, 527 aa, Pasteurella multocida subsp. multocida str. Pm70
MQIKDISHLYNIIKTFLLYGIDEALPQHRYTRAIRCWRKTLFWLRNQHKDKTFGLRLRLALQELGPVWIKLGQMLSTRRDLFPPDIADELALLQDQVDPFDGKIARAQIEKALGAPLETWFDEFNETALASASIAQVHTAKFKQNAPHLENRLAGKEVVLKVLRPNIQQMINADLSLMYKVASWIPRIKAEGRRLRPVEVVREYEKNLRDELDLRREMANAIQLRANFENSPMLYIPEMYKQFCHQTVIVMERIYGIPVSNIEELHANGTNMKLLAERGVQVFFTQVFRDSFFHADMHPGNIFVNRAHPDDPQYIGIDCGIVGRLNDHDKRYLAESFVAFFNRDYRRVAEMHVASGWTPKDTNIDDFEQAFREVCEPIFAKPLSEISFGHVLLNLFNVAREYNMEVQPQLVLLQKTLLYIEGLGRQLYPQLDLWDTAKPFLQKWLDEQMGIKAFTKSVKQKLPYWREHLVDLPENVMDALAQQKIIADELIHLNRTLAKKRNIPHFTSFILGLCTGLAIWLLIYLLS

SEQ ID NO: 62942 - protein, 1870 aa, Gibberella zeae PH-1
MKGSDSLRRANRPAANFDLPPVALAQAQQQTQVQAQAQAQSFQSQSQPQESITNTVTSTSPEITNASLHGQAQAKAQALTTARFRSSSRPSLQDLALVDGTSTSNNHDLPPAYALSSSSSSTGPSSFSYPPAHVHPRPSTANAAATTHTHTRPRPLGPSSSDIATAEQAQFLRIHPVSSTSSLRPRSSTTSASAVASASASTSPSHTPNSLLRQHTSPPSAVDNNSAHFVPRGGLPPAPSIMYQANQRHVSGTDPSRPYQVPPPPPPPMGGPNNGHMPNMMNLPPPPPLPRYNTAPGSNGLSLPPPPGPPPASALGQQPPWHGAFGRMYDSRSGFNIPPPPPSSQHQPYNPKLHAQIAAGQTVSIPPPPPPNEAMSATYIPQGDTYGEGVGIPAFGLEDPTLTVNSQTLRPVTTPQSGTDTNATTPMDEATRERLYAANNAQPRGTSNSSNPTPPGSIPPEIAAQWPLDTVLLWLAQNQFSKDWQETFRALNLHGAQFLELGSGHGGRGNFGMMHQQVYPRLAQECTNSRTGWDQPREREEGKRMRRLIRSIVTGRPADVSKVSTSHGRKESLNGGHGNNLPSAGTDPMDSPNTPLTAPGPGFSSRRFSQTRSTTLPNSISASNINSESNHRNILKHVDTDGARRHSPNVSESSEATFRAPAVHSASPTGSPGIPPALYTSTTTPTIAQSPSAIKAGHRSRSSMDSVASVAAIYGSGVPSDAASLLNRNMNLGDIVHGRSHDARSRHSPSDGGDRSAGGETPSSAKDSNRLLSFLSRKKKQTKDDGAYPSPEDMNGSPTSPHGSFRPVGLGVRGSNGSDTNIDLSGSTLGDDRNGSTLNMRWNKISPVRTYVLATMDYWNYRMCDITEAETATEIRQVICMHLGLGDYENSHIYLTEAGKFEHVDPLDDPSLITVRRAKGDPLGTLKFFVTPPGVAPISSLSVKAEVPIILSPSYLSPGTPVEDAQQMSRQRSSSSPPTSRSNTLTNEKNEDKIAREAKQYRAEIERKQQEYLAKRKQAAMKGSPSETLGPGIVGRNVDFDQPRESPYEDKRPEPLFPQRRPPAPPSDPSATLIKANSLSRKTGASMRASSSSLEGYPSKRYPENEMAEKTKKANKQAPPAPGIGAALAGMGRNLSAIGQSAKNGRASSPSRSSTHSIPGGKDTFSTVEPSQGRGSPSTTSSSKLTTGNVTWNKKNLGFIVPDYSPSDSSFLLSPSPTVDAKFNATVPRAMSPAEMSPNSSRSRTSFPPNQQSPTHRRASHGPEPEFEDTDVHFSKPAPAPPADDDSDDSDDGLFAIPIANQNKGKAAAANADANGHSKRPSLHVNTERSRKGLSVAFKSPKSFGSGMDSNEDSGRQNPTTPHSETWEPEEKDKESKLGRRKSFIEKDVWANRPPTDALINNLDDFFPNLDLDQPVLDEPGESGMPPSPIAESSETNIDQQAQNVAPPQPSYPQHVPPAIPPTRQPSLYNENDTLGSDESTLKALDQHRPTSVAQRSIRRSGGLGRMKSIREVARGAHEANKRTTSTNQGQAATTNIMRRKSTKMFNANIVQIRPDRRGSVVMPQIPQDTVPKRQTTFRWFKGQLIGKGTYGRVYLGMNATTGEFLAVKEVEVNPKAAGGDKNKMKELVAALDQEIDTMQHLDHINIVQYLGCERKETSISIFLEYISGGSIGSCLRKHGKFEESVVSSLTRQTLSGLAYLHREGILHRDLKADNILLDLDGTCKISDFGISKKTDNIYGNDKTNSMQGSVFWMAPEVIRSQGEGYSAKVDIWSLGCVVLEMFAGKRPWAKEEAVGAIYKIANGERPPIPEDIQDTLGPLAVAFMMDCFQVNPFDRPTADVLLSQHPFCEVDPHYQFYDTALYHRIKSFK

SEQ ID NO: 62943 - protein, 293 aa, Listeria innocua Clip11262
MDLGKVITAMVTPIHPEKNKVCKKRIHHLVNHLIDNGSDGLVIAGTTGESPTLSHDEKMKLFRQVVETNAGRAKLIAGTGSNNTAETIAFTKEVAELGGIDAVLVVAPYYNKPNQDGLYAHFVAVAEASDLPVVIYNIPGRSVVNIEPETIIRLAKLPNIIGVKESSGNLDNISKIIAETSDDFLVYSGDDSLTLPILAVGGNGVISVASHVVGNEMQEMMQAYESGDVKKAASIHRSLLPLMNGLFSVPNPAPTKYLLNQQGISVGPVRLPLVDLNAEQGTKLQAILEGLSK

SEQ ID NO: 62944 - protein, 150 aa, Brassica napus
MSSPEEKKKRKRMSTTKKKKPPLVTPNPSLPDDLLLSCFARVSRLYYPTLSLVSKTFQSLLASPELYKTRSSIGRTESCLYVCLKSHPDPIPRWYTLCRKPDKTLTTNEDTMKLKKKSSGYVLAKIPTSHSGPVHWSGLATVGSDIYNIG

SEQ ID NO: 62945 - protein, 380 aa, Zygosaccharomyces rouxii
MATHEEFIRTQVFGTVFEITNRYTDLNPVGMGAFGLVCSATDTLAGQPVAIKKIMKPFSTAVLAKRTYRELKLLKHLRHENLICLQDIFLSPLEDIYFVTELQGTDLHRLLQTRPLEKQFVQYFLYQILRGLKYVHSAGVIHRDLKPSNILINENCDLKICDFGLARIQDPQMTGYVSTRYYRAPEIMLTWQKYDVEVDIWSAGCIFSEMIEGKPLFPGKDHVHQFSIITDLLGSPPRDVINTICSENTLKFVTSLPHRDPVPFQERFKTVEPDAVDLLERMLVFDPKKRITAADALVHPYLAPYHDPTDEPTAEAQFDWDFNDADLPVDTWRVMMYSEILDFHKIGGGDGQIDTNAAFDDQVAAATAAPMAQHTNQTNQ

SEQ ID NO: 62946 - protein, 224 aa, Pichia jadinii
MAERTVKPQRRALVNRTTNETKIQISLSLDGGYVTVPESIFKDKKYDDATQVTSSQVISINTGVGFLDHMIHALAKHGGWSLIVECIGDLHIDDHHTTEDVGIALGDAVKEALAYRGVKRFGSGFAPLDEALSRAVVDLSNRPFAVVELGLKREKIGDLSCEMIPHFLESFAQAAHITMHVDCLRGFNDHHRAESAFKALAVAIKESISSNGTNDVPSTKGVLF

SEQ ID NO: 62947 - protein, 450 aa, Streptococcus pyogenes MGAS315
MVIPYDYIVIGGGSAGIASANRAAMHGAKVLLAEGKEIGGTCVNLGCVPKKVMWYGAQVADILGTYAKDYGFDFKEKAFDFKQLKANRQAYIDRIHVSYERGFEQNGVNRIYDYAVFKDAHTVEIAGQLYTAPHILIATGGHPVFPDIEGAQYGISSDGFFALDEVPKRTAVVGAGYIAVELAGVLHALGSKTDLFIRHDRPLRSFDKAIVDVLVEEMAVGGPCLHPHSEVAKVVKNTDESLTLYLKDGQEVEVDQLIWAIGRKPNLEGFGLDKTGVTLNDKGYIETDAYENTSVKGIYAVGDVNGKLALTPVAVAAGRRLSERLFNGKTDEKLDYQNVATVIFSHPVIGSVGLSEEAAVKQYGQEAVKTYQSRFTSMFTAITNHRQPCLMKLVTVGDTEKIVGLHGIGYGVDEMIQGFAVAIKMGATKADFDNTVAIHPTGSEEFVTMR

SEQ ID NO: 62948 - protein, 347 aa, Clostridium thermocellum ATCC 27405
MKGKMKVCVLTGKEKLEWVERDIPQPGRGELQIKLKHVGVCGSDLHFYKEGRLANWELDGPLALGHEPGGIVSAIGEGVEGFEIGDKVALEPGVPCGECEDCRKGHYNLCKHIKFMAIPHEKDGVFAEYCVHSASMCYKLPENVDTMEGGLMEPLSVALHATELSNAKIGETAIVLGSGCIGLCTVMALKARGVSEIYVTDVVDKRLEKALEVGATRVFNSQREDIVEFAKTLPGGGADQVYECAGSRVTTLQTCKLIKRAGKVTLVGVSPEPVLELDIATLNAMEGTVYSVYRYRNMYPIAIAAVSSGVIPLKKIVSHVFDFKDCIEAIEYSTNHKDEVIKSVIKF

SEQ ID NO: 62949 - protein, 547 aa, Sorghum bicolor
MARRAASSLVSRCLLARASAPAAPPAVPSALRRPDGMRGLLPGVLQRFSTAAAVEEPITPSVQVNYTKLLINGNFVDAASGKTFPTLDPRTGEVIAHVAEGDAEDINRAVAAARKAFDEGPWPKMTAYERSRILLRFADLIEKHNDELAALETWDNGKPYEQAAHIEVPMVARLMRYYAGWADKIHGLVVPADGPHHVQILHEPIGVAGQIIPWNFPLLMFAWKVGPALACGNTLVLKTAEQTPLSALYISKLLHEAGLPEGVVNVVSGFGPTAGAALASHMDVDKLAFTGSTDTGKVVLELAARSNLKTVTLELGGKSPFIIMDDADIDHAVELAHFALFFNQGQCCCAGSRTFVHERVYDEFVEKAKARALKRVVGDPFRKGVEQGPQIDDEQFNKILRYIRSGVDSGANLVTGGDRLGEKGYYIQPTIFSDVQDGMKIAQEEIFGPVQSILKFKDLNEVIKRANASPYGLAAGVFTNSLDTANTLTRALRAGTVWINCFDIFDAAIPFGGYKMSGIGREKGIDSLKNYLQVKAVVTPIKNAAWL

SEQ ID NO: 62950 - protein, 322 aa, Bacillus methanolicus
MNKIAVLTSGGDAPGMNAAIRAVVRRGIFKGLDVYGVKNGYKGLMNGNFVSMNLGSVGDIIHRGGTILQTTRCKEFKTAEGQQQALAQLKKEGIDGLIVIGGDGTFEGARKLTAQEFPTIGIPATIDNDIAGTEYTIGFDTAVNTAVEAIDKIRDTAASHDRIYVVEVMGRNAGDIALWAGMCAGAESIIIPEADHDVEDVIDRIKQGYQRGKTHSIIVVAEGAFNGVGAIEIGRAIKEKTGFDTKVTILGHIQRGGSPSAYDRMMSSQMGAKAVDLLVEGKKGLMVGLKNGQLIHTPFEEAAKDKHTVDLSIYHLARSLSL

SEQ ID NO: 62951 - protein, 667 aa, Bacillus methanolicus
MLQQKIDIDQLSIQTIRTLSIDAIEKVGSGHPGMPMGAAPMAYTLWTKFMNYNPSNPNWFNRDRFVLSAGHGSMLLYSLLHLTGYDLSLEDLKNFRQWGSKTPGHPEFGHTPGVDATTGPLGQGIAMAVGMAMAERHLASKYNRYKFNIIDHYTYSICGDGDLMEGVSAEAASLAGHLKLGRLIVLYDSNDISLDGDLHMSFSESVQDRFKAYGWQVLRVEDGNDIDSIAKAIAEAKNNEDQPTLIEVKTIIGYGSPNKGGKSDAHGSPLGKEEIKLVKEHYNWKYDEDFYIPEEVKEYFRELKEAAEKKEQAWNELFAQYKEAYPALAKELEQAINGELPEGWDADVPVYRVGEDKLATRSSSGAVLNALAKNVPQLLGGSADLASSNKTLLKGEANFSATDYSGRNIWFGVREFGMGAAVNGMALHGGVKVFGATFFVFSDYLRPAIRLSALMKLPVIYVFTHDSVAVGEDGPTHEPIEQLASLRAMPGISTIRPADGNETAAAWKLALESKDEPTALILSRQDLPTLVDSEKAYEGVKKGAYVISEAKGEVAGLLLASGSEVALAVEAQAALEKEGIYVSVVSMPSWDRFEKQSDAYKESVLPKNVKARLGIEMGASLGWSKYVGDNGNVLAIDQFGSSAPGDKIIEEYGFTVENVVSHFKKLL

SEQ ID NO: 62952 - protein, 461 aa, Zea mays
  misc_feature (315)..(315): Xaa can be any naturally occurring amino acid
  misc_feature (349)..(349): Xaa can be any naturally occurring amino acid
  misc_feature (377)..(377): Xaa can be any naturally occurring amino acid
MPPSADAMPAPGDAACAGDVRLISSKELREHASAADLWISISGDVYDVTPWLPHHPGGDLPLITLAGQDATDAFAAYHPPSARPLLRRFFVGRLSDYTVSPASADYRRLLAQLSSAGLFERVGPTPRVQLALMAVLFYAALYLVLACASASAHMLAGGLIGFVWIQSGWMGHDSGHHRITGHPLLDRVVQVLSGNCLTGLSIAWWKCNHNTHHIACNSLDHDPDLQHMPLFAVSPKLFGNIWSYFYQRTLAFDAASKFVISYQHLDLIQGCRIAGQERHRRRGRRSEEFGLGGIEYPWMVNGTRIWLRGRQLLVXTFVPTRLSVFFFTHLFSGIQHVQLVRDDFASDVXDGPPKGNDWFEKQTAGTLDILCFFSLDXWCHGLQFQIEHHLFPRLPRCHLRKVAPAVRDLCKKHGLTYSAATFWGANVLTWKTLRAAALQARTATSGGAPKNLVWEAVNTHG

SEQ ID NO: 62953 - protein, 97 aa, Oryza sativa
METDINAPPPPAPAPAGAGEGSSSAAGPSSRKPNKRFEIKKWNAVALWAWDIVVDNCAICRNHIMDLCIECQANQASATSEECTVAWGQSRYDPVTG

SEQ ID NO: 62954 - protein, 135 aa, Brassica napus
  misc_feature (75)..(75): Xaa can be any naturally occurring amino acid
  misc_feature (88)..(88): Xaa can be any naturally occurring amino acid
  misc_feature (132)..(132): Xaa can be any naturally occurring amino acid
QILIWIPTKYTQTNSKFVDLLHSQQNIFGLSEDSFRLSSPRVPLSRTKPSEETAAERRERRKWTPIDDVVLISSXLNTSKDPVVGNEXKSRAFWKMIAAYFAASPKVAGYEHREAAHCKQRWHKINYLVNKXCGA

SEQ ID NO: 62955 - protein, 333 aa, Zea mays
  misc_feature (38)..(38): Xaa can be any naturally occurring amino acid
  misc_feature (47)..(47): Xaa can be any naturally occurring amino acid
  misc_feature (65)..(65): Xaa can be any naturally occurring amino acid
  misc_feature (77)..(77): Xaa can be any naturally occurring amino acid
  misc_feature (92)..(92): Xaa can be any naturally occurring amino acid
  misc_feature (119)..(119): Xaa can be any naturally occurring amino acid
  misc_feature (126)..(126): Xaa can be any naturally occurring amino acid
  misc_feature (206)..(206): Xaa can be any naturally occurring amino acid
MAPELMTAKMTAKAAAAAAAAAAAKPATRAYVTFLAGXGDYWKGVVXGLAKGLRKVRSAYPLVVXAVLPDVPESHRXRILPSRRACVVREIXEPVYPPENQTQFAMAYYVINYSKLRIXWEFVEYXRMVYLDADIQVFENIDGLFELEKGYFYAVMDCFCEKTWSHTPQYRIGYCQQCPDQGWRGQRRPAELGPPAVRSTSTPPTXFAEQDFLNMFFRDQYRPIPNVYNLVLAMLWRHPENVQLEKVKVVHYCAAGSKPWRFTGKEANMDREDINALVNKWWDIYNDETLDLKGLPSLSPDDDDEVEAVAKKPLRAALAEAGTVKYVTAPSAA

SEQ ID NO: 62956 - protein, 524 aa, Colwellia psychrerythraea 34H
MKLSLSLSQKPPVTSVYTANQVLKNEANVARSQGIAMYELMHSAGAAVFTQLSLSWPNAKHLLILCGKGNNGGDGFVVAKLAHQAKIKVSVLLTCDVSQLKGDALSAYQAMIFAGVSLIVEDRVNKHAESLAIINDFSGEVIVDALFGIGFTGQLTPRLQEFVTSINHQKAKVISIDVPSGLCATTGEVQGESIEGQAIIADITLTFIVYKQGLLTGQAANFVGELFLAPLAMNNAFTKQVQTNNHYAQYKLPLNQPKRLPSSHKGDSGLLLTIGGSDTMPGAIRLASESALRCGAGLVAVSCHKNNQMFIMNGRPELMLAPETSALLEASTQLYKAKAYLVGPGLGQSDQAKQLFELISKTSQTQNKTTVIDADALILLSETKQQCNHWVLTPHPKEAAALLQCDVASIEADRFSAVRAIAKQYGGICLLKGAGTLISDGERVVINNSGNSGMASGGMGDVLSGIISALVMQSDNNFYSTCLAAYIHGAAADIIANKNGQRGLLASDLFIPLQQLLNGKVPNH

SEQ ID NO: 62957 - protein, 1582 aa, Aspergillus fumigatus
MTGPTKISILGQESIVADFGLWRNYVAKDLISGCPSTTYVLITDTNIGSIYTPGFQKSFEEAAASVSPSPRLLIYNAPPGEVSKSRQTKADIEDWMLSQSPPCGRDTVVIALGGGVIGDLTGFVAATYMRGVRFVQVPTTLLAMVDSSIGGKTAIDTPLGKNLIGAIWQPSRIYIDLEFLETLPVREFINGMAEVIKTAAISSEEEFTALEDNAETILSAVRREVKPGQRRFEGIEEILKARILASARHKAFVVSADEREGGLRNLLNWGHSIGHAIEAILTPQILHGECVAIGMVKEAELARHLGILKGVAVARIVKCIAAYGLPTSLKDSRIRKLTAGKHCSVDQILFNMALDKKNDGPKKKIVLLSAIGRTYEPRASVVPNEDIGVVLAPSIEVHPGVSTTSEVVCAPPGSKSISNRALVLAALGSGTVRIKNLLHSDDTEVMLNALERLGAATFSWEEEGEVLVVNGKGGALQAHPSPLYLGNAGTASRFLTTVATLATASSVDSSVLTGNNRMKQRPIGDLVDALTANGAQIEYVENKGSLPLKIAASGGFTGGQINLAAKVSSQYVSSLLMCAPYAKEPVTLKLVGGKPISQPYIDMTTAMMRSFGIDVKKSTTEEHTYHIPQGRYINPAEYVVESDASSATYPLAIAAVTGTTCTIPNIGSKSLQGDARFAVDVLRPMGCTVEQTDTSTTVTGPADGVLRPLPNVDMEPMTDAFLGASVLAAIARGKDSNHTTRIYGIANQRVKECNRIKAMHDELAKFGVVCREHDDGLEIDGIDRSTLRQPAGGVFCYDDHRVAFSFSVLSLIAPKPTLILEKECVGKTWPGWWDTLRQKFAVKLEGKELKEAESPVLTRAEKASASVFIIGMRGAGKTTSGHWVASTLKRPFIDLDDELERIEGMTIPDIIKQRGWQGFRDAELNLLQRTMKERPTGHVFACGGGVVEIPEARKLLIDWHKTKGNVLLIMRDIKQVMAFLNIDKTRPAYVEDMLGVWLRRKPWFQECSNIQYYSQHASAGLPRASEDFARFIKFVTGLDDSLGTIKKKQHSFFVSLTLPDVRGADQILEQACVGSDAVELRVDLLEDPDSSNGIPTVDFVADQISYLRSRITLPVIFTIRTKGQGGRFPDDAHAEAMQLYRLAVRSGCEFVDLEIAFPDEMLRAVTEMKGYSKIIASHHDPNGELSWANMSWMKYYNRALEYGDVIKLVGVARNLDDNTALRKFKNWAEEAHDVPLIAINMGGNGQLSRILNGFMTPVSHPALPFRAAPGQLSATDIRKGLSLMGEIKKKRFALFGSPISESRSPALHNTLFAEMGLPHEYTRLETANVEDVKDFIRAPDFGGASVTIPLKLDIMPLLDEITAEAEIIGAVNTVVPVSDGEGKPQRLVGHNTDWQGMVQCLRNAGAYGADGSASALVVGGGGTSRAAIYALHQMGFSPIYIVGRNPAKLESMVSTFPTSYNIQIVEGNEKLEHVPHVAIGTIPADRPIDPGMREILCHMFERAQEADADASRTIEGSPRVLLEMAYKPRVTALMQLAVDAGWTTIPGWTLLMEYSSNIGRVFALSTNVHGYVVTSCYPVELC

SEQ ID NO: 62958 - protein, 404 aa, Streptococcus pyogenes MGAS315
MLVGLSFQHLFAMFGATVLVPILVGIDPSVALLSSGLGTLAHLSVTKFKIPAYMGSSFAYIAAMQLLMKTNGIGAVAQGAMTGGLVYLIVALIVKVIGNDWIDKILPPIVVGPIVMVIGLSLASTAVNDVMLKNGNYNLTYLVIGLVTLLSVIFFNIYGKGIVAIVPLLLGLLVGYVVALLVGVLTGQEIVDFTNVAQAKWFSIPSVEIPFLTYGVKFYPSAILTMAPIAFVTMTEHFGHIMVLNSLTKRDYFKDPGLEKTLTGDGFAQIIAGFLGAPPVTSYGENIGVMALNKIFSVYVIAGAAVIAALLSFIGKVSALIQSIPTPVIGGISVALFGVIASSGLKILIESKVDMDNKKNLLIASVILVSGIGGLMLQVNGLQISGVAFSTLLGIILYQVLPEK

SEQ ID NO: 62959 - protein, 207 aa, Pinus sylvestris
MEVHSTVNHASAKRFWNILRIALFMIRKGLISKRKMLMDMHLMMERGKVYGRSLRNLVFHHSRGNNHGGFGLQDYEFSCSNSPAIFHMTKRKHHYFPTHILHFPCIHPHQVEDKEEPSTPVFPQLDYSNEYFSKDCLDQNDLPVLQKLSPLLSPLCRRISNSGEDQAYDHQVDRRADEFIAKFYEQLRLQNRMSLLQYQEMLERGTA

SEQ ID NO: 62960 - protein, 333 aa, Ralstonia solanacearum GMI1000
MLYFAAMIANFNPDRALALAQQTFDIEAQAVLGLKSQVSADFARAVEMVLRCTGRVVVSGIGKSGHIARKVAATLASTGTPAFFVHPAEASHGDLGMVTRDDVFIGFSNSGEVSELTAILPLVKRLGARLIAVTGNPQSSLAQHADVILNSRVEVEACPLNLAPTASTTAQMALGDALAVALLDARGFGADDFARSHPGGSLGRKLLTHVRDIMRQGDAVPRVTEDTPLSQALMEITRKGMAMTAVVDATGRAVGVFTDGDLRRLLETPRDWRTVPMHEVMHRNPHAVGPDQLAVEAVEVMETHRINQLLVVDAAGQLMGALHIHDLTRAKVI

SEQ ID NO: 62961 - protein, 1048 aa, Streptococcus pyogenes MGAS315
MVIGSGPIIIGQAAEFDYAGTQACLALKEEGYKVILVNSNPATIMTDKEIADKVYIEPLTLEFVNRIIRKERPDAILPTLGGQTGLNMAMALSKAGILDDLEIELLGTKLSAIDQAEDRDLFKQLMQELDQPIPESTIVKTVDEAVTFARDIGYPVIVRPAFTLGGTGGGICSSEEELCEITENGLKLSPVTQCLIERSIAGFKEIEYEVMRDSADNALVVCNMENFDPVGIHTGDSIVFAPTQTLSDIENQMLRDASLKIIRALKIEGGCNVQLALDPYSFKYYVIEVNPRVSRSSALASKATGYPIAKLAAKIAVGLTLDEMINPITGTTYAMFEPALDYVVAKIPRFPFDKFEHGERQLGTQMKATGEVMAIGRNLEESLLKACRSLEIGVCHNEMTSLSNISDEELVTKVIKAQDDRLFYLSEAIRRGYSIEELESLTKIDLFFLDKLLHIVEIEQELQMHVDHLESLKKAKRYGFSDQKIAEIWQKDESDIRAMRHSHSLYPVYKMVDTCAAEFDAKTPYFYSTYELENESVQSNKESILVLGSGPIRIGQGVEFDYATVHSVKAIQKAGYEAIIMNSNPETVSTDFSVSDKLYFEPLTFEDVMNVIDLEQPKGVIVQFGGQTAINLAQALSEAGVTILGTQVEDLDRAEDRDLFEKALKELGIPQPQGQTATNEEEALEAAKKIGFPVLVRPSYVLGGRAMEIVENKEDLIEYIRTAVKASPEHPILVDSYIFGKECEVDAISDGKSVLIPGIMEHIERAGVHSGDSMAVYPPQQLSKQIQETIAEYTKRLAIGLNCIGMMNVQFVIKNEQVYVIEVNPRASRTVPFLSKVTGIPMAQIATKLILGQTLKDLGYEDGLYPQSQLVHIKAPVFSFTKLAQVDSLLGPEMKSTGEVMGSDTSLEKALYKAFEANNSHLSEFGQIVFTIADDSKAEALSLARRFKAIGYQIMATQGTAAYFAEQGLSACLVGKIGDAANDIPTLVRHGHVQAIVNTVGIKRTADKDGQMIRSSAIEQGVPLFTALDTAKAMLTVLESRCFNIEAI

SEQ ID NO: 62962 - protein, 236 aa, Hyphomonas neptunium ATCC 15444
MPDMASDTEKQNAAAAAMDFVEEGMTIGLGTGSTAKFFVEMLADEIADGLIVRCIETSNQTRELARSLGVPLIPFEQVDRIHLTVDGADEVGPGGVLIKGGGAALLREKIIANASDHMVVIADSSKEVPHLGAFPLPVEVTPFGYTITAKKVHDALVASGVERPRIELRKAAGSTDLLVTDGGNHILDCHCGRIPDPAKTGAYLSGVPGVVEHGLFIGIARTVIIGEENGAHIIEY

SEQ ID NO: 62963 - protein, 231 aa, Ralstonia solanacearum GMI1000
MAAAVHRACRIVVRRHPGRVVAGYRIAFSLSVSAMTDASISPSSPVPASTELGDVTRYLRERIRTVPDWPQLGVMFRDITPLLQDPKSLRVLVDVFVHRYMGQGLNLVAGIDARGFILGSIVAYELNLGFVPIRKKGKLPFTTVAEEYMLEYGSATVEIHADACKPGDRVLLIDDLIATGGTMMAGKRLLERLGATVVEGAAIVDLPELGGSRLLMDGGLPLFTVCRFDGH

SEQ ID NO: 62964 - protein, 766 aa, Streptococcus agalactiae NEM316
MDNTVIVHYHSRKKNYFNLSLWQWRDGSEGQDAHFSRFDSFGAVAILKYPLPYFLSHYYVIVKDKNWHHKTIDYRIDCTKGGARKEVWIVDGDDNLYYSRQAAVSSHHYSRRQPHAYDMAINSRAFDKKWGFDGWLGFEYSETKTAFRLWAPTAERVELILYHSTDETASVSKVLSMKRGTAVNYKNHKENTHGVWFTELEGNYNYQAYTYRVYYRRRTFKITRDPYSIATTANGKRSIVIAPEALTPEGFKISHGKEAKWRLENPNQAVIYEMHVRDFSISETSGVKTDYQGKFKGLHQKDTVNQHGDKTTFDYVQDLGVNYIQLQPIFDHHQTFDDDGHYAYNWGYDPENYNVPEASFSSNPHEPATRILELKSAIQAYHDAGIGVIMDVVYNHTFSSTDSAFQLTVPDYYYRMNHNGTFQNGSGCGNETASEKEMCRKYILDSVLYWVKEYNIDGFRFDLMGLHDVETMNIIRNELNKIDPRILVYGEGWDMGAGLTPQNKAKKDNAYQMPGIGFFNDDVRDAVKGAEIYGEFKKGLVSGNSTEDIVAKGILGSDELVSYIDPSQVLNYIEAHDNYNLNDLLWELHPNDNEKQHIYRVEVASAMNLLMQGMAFMQLGQEFLRTKCYPTGDKGQLTQADKERAMNSYNAPDQVNQVNWDNVTFHKSTINFIRKIITLKTNSPYFSYSSFEEIRKHVFVESAQYHSGFISFTVEEHKKIKIIFNIKGKRLQNPFIGDIIISNHEEGKAIDSLDDELSVMIFDITK

SEQ ID NO: 62965 - protein, 376 aa, Desulfitobacterium hafniense DCB-2
MKAIVYEGIRDVKVKNVGDPGIQKPDDIIVKVTSTAICGSDLHLIHGMVPGMPEGFVLGHETMGIVEEVGGDVYNIKKGDRVIVPFPIACGHCWYCEHDLWSQCDNANPEAEVGAYFGYSNTFGGYDGGQAEYLRVPYANVGPKVVPEELTDEQVLFLTDILPTSYWGVEIGGVKKDDTVVVLGCGPVGLLTIKWAIFQGAKRVIAVDHISYRLDHAYRYYGVEVINFEDHDNTGEYIKEITHGGADVVIDCVGMDGKASTLEKIETLLKLQGGSKSAIEIATQAVRKGGTVALVGVYGSKYNLFPLGDFFSRNITLKMGQCPAHSYVEPIMELIKTGRFDATDIITHRLSLDKGEHAYEVFDEKKDNCIKVVLKP

SEQ ID NO: 62966 - protein, 379 aa, Streptococcus agalactiae NEM316
MKNEMLALILAGGQGTRLGKLTQSIAKPAVQFGGRYRIIDFALSNCANSGINNVGVITQYQPLELNTHIGNGSSWGLDGIDSGVTVLQPYSATEGNRWFQGTSHAIYQNIDYIDRINPEYVLILSGDHIYKMDYDDMLQTHKDNLASLTVAVLDVPLKEASRFGIMNTDSNDRIVEFEEKPEHPKSTKASMGIYIFDWKRLRTVLIDGEKNGIDMSDFGKNVIPAYLESGERVYTYNFDGYWKDVGTIESLWEANMEYIGEDNKLHSRDRSWKIYSKNLIAPPNFMTEDANVKDSLVVDGCFVAGNVEHSILSTNVQVKPNAIIKDSFVMSGATIGEGAKINRAIIGEDAVIGDGVVIDGSKEVEVIGYKEVVGVPNED

SEQ ID NO: 62967 - protein, 377 aa, Streptococcus agalactiae NEM316
MKIDKYTAILGNTVSYPDMHSLTDNRPLASLPFDGKYRLIDFQLSSLANAGVRSIYGIFRGNNVRSVFDHIRSGREWGLGTLLSHYSLGFYDTDDDIRTVNGDYYDQILTYLRRSGSDQTIYMSCDMLCNIDLSQVIHLHNANGTQATVVYKKMPRSAIAEANQVLTIDESDHVVSLGKAVDNDDNQKMSAEIYVINTPWLIEKMEEEAQNNEPRKLRFLLRDLIVESNALAFEYTGYLSNISSIKSYYDANMDMLTPNKFYSLFFSNQKVYTKVKNEEATYFDKQSNVSNSQLASGSIIKGYLDHSIVSRNCLLENGTRVVNSIIFPKVKIGEGATIENTIIDKCVKVAPGVTLKGSLDKPLVIPKFSEINEDIIQ

SEQ ID NO: 62968 - protein, 167 aa, Coccidioides immitis RS
MASDANASPVPEVASIASPINLVLLSLFVVVVYMQFRPKAPVTLPKDQAPVVFRTFKPTTLIEFNGQDNKPVYLAVRGKVFDVSPGRNFYGPGGPYENFAGRDATRGLACQSFDEEMLTKDLKGPLDDLHGLDEEQLDNLRGWEERFLEKYLVVGKLVAEGDPEAPK

SEQ ID NO: 62969 - protein, 695 aa, Oryza sativa (japonica cultivar-group)
MARHRVRCLLAAALLLVAPMAAAQPWQFCGQSGNFSANSAYQSNLRQLSATLPKNASAALFAAGSLGTVPDIVYALALCRGDANASACESCVDNAFQGGQQLCPYNKDVFIVYDLCYLRFTNRNLLASATDNGSPMMLMNAQNASATAEVFDAAAATLLNATSGYAAANSSRRFATGEEAFDAADPTIYGLSQCTPDMSPDDCRSCLGGIIALIPQYFGRKRGARVIGTRCNYRYEVYPFFAGGSMLRLPAPAAPAAPPPAPGPANMTPPAHTGERKKNKSGTALAIALPLVVVLLAMVAICFSVQRRRKRSRSKQQHSYSMQMGEDIESVDSLFIDLSTLRAATGNFSETNRLGEGGFGSVYKGVLPNGEEIAVKRLSMSSGQGIEELKNELVLVAKLQHKNLVRLVGVCLQEHEKLLVYEYMPNRSIDTILFGTILYSEFNKLLVKLWFTDKRRELDWGKRFRIINGIARGLQYLQEDSQLRIIHRDLKASNVLLDSDYTPKISDFGLARLFGGDQTREITRHVVGTYGYMAPEYAMRGHYSVKSDVFSFGILMIEIVTGRRSSGSLSFDQSNDLLSLVWEHWTMGTILEMMDPSLTSHAPRDQMLKCIHIGLLCVQDNPADRPMMSTVNVMLSSSTVSLQSPSKPSFFIPKSDTDSNIYSESHPLTSQSTASTGRSGGMSVNDVSITELEPR

SEQ ID NO: 62970 - protein, 673 aa, Oryza sativa (japonica cultivar-group)
MATFARHRVLLCRLAAALLLAPVAAAQPWQFCGQGGNYSANGTYQSNLAGLSATLPKNASASRTLFAKDSLGAVPDIVYALALCRGDVANATACESCVATAFQDAQQLCPYDKDAFIVYDLCYLAFSNRNILAAAADDDGSPRFLMNTQNASAPAEVFDAAVATLLNATSSYAAENSSRRFATGEEAFDAAAATPTIYGLSQCTPDMSPDDCRSCLGRIIALIPRYLSRRKGGRAIGMRCNFRYEVGPFFAGGSMLRLPAPANSTPTAPTGGRKKNKSGTALAIALPLVVILLATVVICLSVQRWRKRSRSKQQSSYSIQMAEDIESTDSLFIDLSTLRAATGNFSESNRIGEGGFGSVYKGVLPSGEEIAVKRLSMSSGQGIEELKNELVLVAKLQQKNLVRLVGVCLQEHEKLLVYEYMPNRSIDTILFDLEKRKELDWGKRFRIINGIARALQYLHEDSQLRIIHRDLKASNVLLDSDYNPKISDFGLARLFEGDQTREVTSRVVGTYGYMAPEYAMRGHYSVKSDVFSFGILMIEIVTGRRSSGSYSFDQSYDLLSRVWEHWTMGTILEMMDPSLTSHAPRDQMLKCIHIGLLCVQDNPADRPMMSTVNIMLSSNTVSLQSPSKPSFFIPKSGTDSNIYSESYPQTSQPTHRSGMMSVNDVSVTELEPR

SEQ ID NO: 62971 - protein, 186 aa, Triticum aestivum
  misc_feature (146)..(146): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVXRIIGFDNMRQVQCVSFIAFKPPGCEESGKGLNSSLTTGHI
